US009051573B2

(12) United States Patent
Holland et al.

(10) Patent No.: US 9,051,573 B2
(45) Date of Patent: Jun. 9, 2015

(54) NEWLY DISCOVERED BACTERIUM IN THE FAMILY ACETOBACTERACEAE

(75) Inventors: Steven M. Holland, Bethesda, MD (US); David E. Greenberg, Bethesda, MD (US); Adrian Zelazny, Silver Spring, MD (US); Patrick Murray, Gibson Island, MD (US)

(73) Assignee: The United States of America, as represented by the Secretary, Department of Health and Human Services, Washington, DC (US)

( * ) Notice: Subject to any disclaimer, the term of this patent is extended or adjusted under 35 U.S.C. 154(b) by 1417 days.

(21) Appl. No.: 12/225,615

(22) PCT Filed: Mar. 28, 2007

(86) PCT No.: PCT/US2007/007795
§ 371 (c)(1),
(2), (4) Date: Sep. 16, 2009

(87) PCT Pub. No.: WO2007/126975
PCT Pub. Date: Nov. 8, 2007

(65) Prior Publication Data
US 2010/0055506 A1    Mar. 4, 2010

Related U.S. Application Data

(60) Provisional application No. 60/788,521, filed on Mar. 31, 2006.

(51) Int. Cl.
| | |
|---|---|
| *H01M 4/90* | (2006.01) |
| *H01M 8/16* | (2006.01) |
| *C12R 1/02* | (2006.01) |
| *C12N 15/52* | (2006.01) |
| *C12P 7/54* | (2006.01) |
| *C12R 1/01* | (2006.01) |

(52) U.S. Cl.
CPC . *C12N 15/52* (2013.01); *C12P 7/54* (2013.01); *C12R 1/01* (2013.01); *C12R 1/02* (2013.01); *H01M 4/90* (2013.01); *H01M 8/16* (2013.01); *Y02E 60/527* (2013.01)

(58) Field of Classification Search
None
See application file for complete search history.

(56) References Cited

U.S. PATENT DOCUMENTS

| | | | |
|---|---|---|---|
| 4,085,254 A | 4/1978 | Atkins | 429/2 |
| 4,578,323 A | 3/1986 | Hertl et al. | 429/15 |
| 4,581,336 A | 4/1986 | Malloy et al. | 435/176 |
| 4,683,195 A | 7/1987 | Mullis et al. | 435/6 |
| 4,683,202 A | 7/1987 | Mullis | 435/91 |
| 4,965,188 A | 10/1990 | Mullis et al. | 436/6 |
| 5,976,719 A | 11/1999 | Kim et al. | 429/2 |
| 6,190,903 B1 | 2/2001 | Weinstein et al. | 435/252.5 |
| 7,491,453 B2 | 2/2009 | Logan et al. | 429/2 |
| 2004/0048111 A1* | 3/2004 | Halme et al. | 429/2 |

OTHER PUBLICATIONS

Uhlig et al. International Journal of Systematic Bacteriology, Apr. 1986, p. 317-322.*
Chan et al. Biochem. J. (1991) 280, 139-146.*
Grundig et al. Arch Micrbiol (1987) 149:149-155.*
Stackebrandt, E. Food Technol. Biotechnol. 41 (1) 17-22 (2003).*
Anthony et al., "The Structure and Mechanism of Methanol Dehydrogenase,"*Biochim. Biophys. Acta.*, vol. 1647, pp. 18-23 (2001).
Asai et al., "The Flagellation and Taxonomy of Genera *Gluconobacter* and *Acetobacter* with Reference to the Existence of Intermediate Strains," *J. Gen. Appl. Microbiol.*, vol. 10, pp. 95-126 (1964).
Bartowsky et al., "Spoilage of Bottled Red Wine by Acetic Acid Bacteria," *Lett. Appl. Microbiol.*, vol. 36, pp. 307-314 (2003).
Bartual et al., "Development of a Multilocus Sequence Typing Scheme for Characterization of Clinical Isolates of *Acinetobacter baumannii*," *J. Clin. Microbiol.*, vol. 43, pp. 4382-4390 (2005).
Boesch et al., "*Acetobacter intermedius*, sp. nov.," *Syst. Appl. Microbiol.*, vol. 21, pp. 220-229 (1998).
Chongcharoen et al., "Adaptation and Acclimatization to Formaldehyde in Methylotrophs Capable of High-Concentration Formaldehyde Detoxification," *Microbiology*, vol. 151, pp. 2615-2622 (2005).
Cleenwerck et al., "Re-examination of the genus *Acetobacter*, with Descriptions of *Acetobacter cerevisiae* sp. nov. and *Acetobacter malorum* sp. nov.," *Int. J. Syst. Evol. Microbiol.*, vol. 52, pp. 1551-1558 (2002).
DelVecchio et al., "The Genome Sequence of the Facultative Intracellular Pathogen *Brucella melitensis*," *Proc. Natl. Acad. Sci. U.S.A.*, vol. 99, pp. 443-448 (2002).
Dorman et al., "*Nocardia* Infection in Chronic Granulomatous Disease," *Clin. Infect. Dis.*, vol. 35, pp. 390-394 (2002).
"Editorial: Cause and Effect," *Nat. Rev. Microbiol.*, vol. 4, pp. 414 (2006).
Eisen JA, "The RecA Protein as a Model Molecule for Molecular Systematic Studies of Bacteria: Comparison of Trees of RecAs and 16S rRNAs from the Same Species," *J. Mol. Evol.*, vol. 41, pp. 1105-1123 (1995).
Franke et al., "Description of *Gluconacetobacter sacchari* sp. nov., A New Species of Acetic Acid Bacterium Isolated from the Leaf Sheath of Sugar Cane and from the Pink Sugar-Cane Mealy Bug," *Int'l J. Syst. Bacteriol.*, vol. 49, pp. 1681-1693 (1999).
Fredricks et al., "The Acetobacteraceae: Extending the Spectrum of Human Pathogens," *PLoS Pathogens*, vol. 2, pp. 0249-0250 (2006).
Garcia-Martinez et al., "Use of the 16S-23S Ribosomal Genes Spacer Region in Studies of Prokaryotic Diversity," *J. Microbiol. Meth.*, vol. 36, pp. 55-64 (1999).

(Continued)

*Primary Examiner* — Oluwatosin Ogunbiyi
(74) *Attorney, Agent, or Firm* — Sheridan Ross P.C.

(57) ABSTRACT

Provided is an isolated novel Gram-negative bacterium, wherein the bacterium is an aerobic, facultative methylotroph that produces colonies that are yellow pigmented, wherein the bacterium can use methanol as a sole carbon source and can oxidize glucose and ethanol into acid. Also provided are novel purified polypeptides and isolated nucleic acids from the bacterium. Further provided are methods of using the bacterium and the purified polypeptides to degrade organic material and for use in biofuel cells.

76 Claims, 2 Drawing Sheets

(56) References Cited

OTHER PUBLICATIONS

Gevers et al., "Re-Evaluating Prokaryotic Species," *Nat. Rev. Microbiol.*, vol. 3, pp. 733-739 (2005).

Gonzalez et al., "Application of Molecular Methods for the Differentiation of Acetic Acid Bacteria in a Red Wine Fermentation," *J. Appl. Microbiol.*, vol. 96, pp. 853-860 (2004).

Greenberg et al., "A Novel Bacterium Associated with Lymphadenitis in a Patient with Chronic Granulomatous Disease," *PLoS Pathogens*, vol. 2, pp. 0260-0267 (2006).

Greenberg et al., "*Granulibacter bethesdensis* gen. nov., sp. nov., a Distinctive Pathogenic Acetic Acid Bacterium in the Family Acetobacteraceae," *Int. J. Syst. Evol. Microbiol.*, vol. 56, pp. 2609-2616 (2006).

Greenberg et al., "*Acetobacteraceae bacterium* CGDNIH1 16S Ribosomal RNA Gene, Partial Sequence," *A Novel Bacterium Associated with Lymphadenitis in a Patient with Chronic Granulomatous Disease*, XP-002451606 (2005).

Greenberg et al., "*Granulibacter bethesdensis* CGDNIH1, Complete Genome," *Genome Sequence Analysis of a Novel Human Pathogenic Acetic Acid Bacterium*, XP-002451609 (2006).

Guide et al., "Reinfection, Rather than Persistent Infection, in Patients with Chronic Granulomatous Disease," *J. Infect. Dis.*, vol. 187, pp. 845-853 (2003).

Gupta et al., "*Gluconobacter oxydans*: Its Biotechnological Applications," *J. Mol. Microbiol. Biotechnol.*, vol. 3, pp. 445-456 (2001).

Ivanova et al., "Genome Sequence of *Bacillus cereus* and Comparative Analysis with *Bacillus anthracis*," *Nature*, vol. 423, pp. 87-91 (2003).

Jackson et al., "The p47$^{phox}$ Mouse Knock-Out Model of Chronic Granulomatous Disease," *J. Exp. Med.*, vol. 182, pp. 751-758 (1995).

Jojima et al., "*Saccharibacter floricola* gen. nov., sp. nov., A Novel Osmophilic Acetic Acid Bacterium Isolated from Pollen," *Int. J. Syst. Evol. Microbiol.*, vol. 54, pp. 2263-2267 (2004).

Kapatral et al., "Genome Sequence and Analysis of the Oral Bacterium *Fusobacterium nucleatum* Strain ATCC 25586," *J. Bacteriol*, vol. 184, pp. 2005-2018 (2002).

Kaszycki et al., "Formaldehyde and Methanol Biodegradation with the Methylotrophic Yeast *Hansenula polymorpha* in a Model Wastewater System," *Microbiol. Res.*, vol. 154, pp. 289-296 (2000).

Katz et al., "Biochemical Fuel Cells," in *Handbook of Fuel Cells—Fundamentals, Technology and Applications*, Vielstich et al. (Eds.), Chap. 21, pp. 1-2, 9, 11-12 (2003).

Lekstrom-Himes et al., "Treatment with Intralesional Granulocyte Instillations and Interferon-γ for a Patient with Chronic Granulomatous Disease and Multiple Hepatic Abscesses," *Clin. Infect. Dis.*, vol. 19, pp. 770-773 (1994).

Liiv et al., "Multiple Functions of the Transcribed Spacers in Ribosomal RNA Operons," *Biol. Chem.*, vol. 379, pp. 783-793 (1998).

Lisdiyanti et al., "Identification of *Acetobacter* Strains Isolated from Indonesian Sources, and Proposals of *Acetobacter syzygii* sp. nov., *Acetobacter cibinongensis* sp. nov., and *Acetobacter orientalis* sp. nov.," *J. Gen. Appl. Microbiol.*, vol. 47, pp. 119-131 (2001).

Lisdiyanti et al., "Systematic Study of the Genus *Acetobacter* with Descriptions of *Acetobacter indonesiensis* sp. nov., *Acetobacter tropicalis* Sp. Nov., *Acetobacter orleanensis* (Hennberg 1906) comb. nov., *Acetobacter Lovaniensis* (Frateur 150) comb. nov., and *Acetobacter estunensis* (Carr 1958) comb. nov," *J. Gen. Appl. Microbiol.*, vol. 46, pp. 147-165 (2000).

Lisdiyanti et al., "*Kozakia baliensis* gen. nov., sp. nov., A Novel Acetic Acid Bacterium in the α-Proteobacteria," *Int. J. Syst. Evol. Microbiol.*, vol. 52, pp. 813-818 (2002).

Ludwig et al., "Bacterial Phylogeny Based on Comparative Sequence Analysis," *Electrophoresis*, vol. 19, pp. 554-568 (1998).

Macauley et al., "The Genus *Gluconobacter* and its Applications in Biotechnology," *Crit. Rev. Biotechnol.*, vol. 21, pp. 1-25 (2001).

McDonald et al., "The Methanol Dehydrogenase Structural Gene *mxaF* and its Use as a Functional Gene Probe for Methanotrophs and Methylotrophs," *Appl. Environ. Microbiol.*, vol. 63, pp. 3218-3224 (1997).

Nanda et al., "Characterization of Acetic Acid Bacteria in Traditional Acetic Acid Fermentation of Rice Vinegar (Komesu) and Unpolished Rice Vinegar (Kurosu) Produced in Japan," *Appl. Environ. Microbiol.*, vol. 67, pp. 986-990 (2001).

Nunn et al., "Methanol Dehydrogenase Subunit 1 Precursor (EC 1.1.99.8)," XP-002451608 (1990).

Page R, "TreeView: An Application to Display Phylogenetic Trees on Personal Computers," *Compt. Appl. Biosci.*, vol. 12, pp. 357-358 (1996).

Poblet et al., "Identification of Acetic Acid Bacteria by Restriction Fragment Length Polymorphism Analysis of a PCR-Amplified Fragment of the Gene Coding for 16S rRNA," *Lett. Appl. Microbiol.*, vol. 31, pp. 63-67 (2000).

Pollock et al., "Mouse Model of X-Linked Chronic Granulomatous Disease, an Inherited Defect in Phagocyte Superoxide Production," *Nat. Genet.*, vol. 9, pp. 202-209 (1995).

Ruiz et al., "Identification of Acetic Acid Bacteria by RFLP of PCR-Amplified 16S rDNA and 16S-23S rDNA Intergenic Spacer," *Int. J. Syst. Evol. Microbiol.*, vol. 50, pp. 1981-1987 (2000).

Seearunruangchai et al., "Identification of Acetic Acid Bacteria Isolated from Fruits Collected in Thailand," *J. Gen. Appl. Microbiol.*, vol. 50, pp. 47-53 (2004).

Segal et al., "Genetic, Biochemical, and Clinical Features of Chronic Granulomatous Disease," *Medicine*, vol. 79, pp. 170-200 (2000).

Sereti et al., "Disseminated Nocardiosis in a Patient with X-Linked Chronic Granulomatous Disease and Human Immunodeficiency Virus Infection," *Clin. Infect. Dis.*, vol. 33, pp. 235-239 (2001).

Shimwell et al., "Differentiation of *Acetomonas* and *Pseudomonas*," *J. Gen. Microbiol.*, vol. 23, pp. 283-286 (1960).

Shukla et al., "Biological Fuel Cells and Their Applications," *Curr. Sci.*, vol. 87, pp. 455-468 (2004).

Sievers et al., "Phylogenetic Identification of Two Major Nitrogen-Fixing Bacteria Associated with Sugarcane," *Syst. Appl. Microbiol.*, vol. 21, pp. 505-508 (1998).

Sievers et al., "Phylogenetic Position of *Gluconobacter* Species as a Coherent Cluster Separated from All *Acetobacter* Species on the Basis of 16S Ribosomal RNA Sequences," *FEMS Microbiol. Lett.*, vol. 126, pp. 123-126 (1995).

Snyder et al., "*Asaia bogorensis* Peritonitis Identified by 16S Ribosomal RNA Sequence Analysis in a Patient Receiving Peritoneal Dialysis," *Am. J. Kid. Dis.*, vol. 44, pp. e15-e17 (2004).

Sokollek et al., "Description of *Acetobacter oboediens* sp. nov. and *Acetobacter pomorum* sp. nov., Two New Species Isolated from Industrial Vinegar Fermentations," *Int. J. Syst. Bacteriol.*, vol. 48, pp. 935-940 (1998).

Speert et al., "Infection With *Pseudomonas cepacia* in Chronic Granulomatous Disease: Role of Nonoxidative Killing by Neutrophils in Host Defense," *J. Infect Dis.*, vol. 170, pp. 1524-1531 (1994).

Stackebrandt E, "The Richness of Prokaryotic Diversity: There Must Be a Species Somewhere," *Food Technol. Biotechnol.*, vol. 41, pp. 17-22 (2003).

Tanasupawat et al., "*Gluconobacter thailandicus* sp. nov., An Acetic Acid Bacterium in the α-Proteobacteria," *J. Gen. Appl. Microbiol.*, vol. 50, pp. 159-167 (2004).

Thompson et al., "Phylogeny and Molecular Identification of Vibrios on the Basis of Multilocus Sequence Analysis," *Appl. Environ. Microbiol.*, vol. 71, pp. 5107-5115 (2005).

Winkelstein et al., "Chronic Granulomatous Disease: Report on a National Registry of 368 Patients," *Medicine*, vol. 79, pp. 155-169 (2000).

Yamada et al., "Identification of Acetic Acid Bacteria Isolated from Indonesian Sources, Especially of Isolates Classified in the Genus *Gluconobacter*," *J. Gen. Appl. Microbiol.*, vol. 45, pp. 23-28 (1999).

Yamada et al., "*Asaia bogorensis* gen. nov., sp. nov., An Unusual Acetic Acid Bacterium in the α-Proteobacteria," *Int. J. Syst. Evol. Microbiol.*, vol. 50, pp. 823-829 (2000).

Yamashita et al., "Emendation of the Genus *Acidimonas* Urakami, Tamaoka, Suzuki and Komagata 1989," *Int. J. Syst. Evol. Microbiol.*, vol. 54, pp. 865-870 (2004).

(56) References Cited

OTHER PUBLICATIONS

Yukphan et al., "Identification of Strains Assigned to the Genus *Gluconobacter* Asai 1935 Based on the Sequence and the Restriction Analyses of the 16S-23S rDNA Internal Transcribed Spacer Regions," *J. Gen. Appl. Microbiol.*, vol. 50, pp. 9-15 (2004).

Yukphan et al., "Re-identification of *Gluconobacter* Strains based on Restriction Analysis of 16S-23S rDNA Internal Transcribed Spacer Regions," *J. Gen. Appl. Microbiol.*, vol. 50, pp. 189-195 (2004).

Zeigler DR, "Gene Sequences Useful for Predicting Relatedness of Whole Genomes in Bacteria," *Int. J. Syst. Evol. Microbiol.*, vol. 53, pp. 1893-1900 (2003).

* cited by examiner

NEWLY DISCOVERED BACTERIUM IN THE FAMILY ACETOBACTERACEAE

CROSS REFERENCE TO RELATED APPLICATIONS

This application claims priority to U.S. provisional application No. 60/788,521, filed on Mar. 31, 2006. The aforementioned application is herein incorporated by this reference in its entirety.

This invention was made with government support awarded by the National Institutes of Health. The United States government has certain rights in the invention.

SEQUENCE LISTING STATEMENT

This application is filed with four (4) identical CD-ROM disks: Copy 1, Copy 2, Copy 3 and Copy 4 in computer readable form, all of which contain the sequence listing of the claimed amino acid and nucleic acid sequences which are hereby incorporated by this reference in their entirety.

BACKGROUND OF THE INVENTION

1. Field of the Invention

This invention relates generally to the discovery of a novel bacterium found in lymph nodes of a subject diagnosed with chronic granulomatous disease. Specifically, the invention relates to a new genus and species of bacteria, designated *Granulibacter bethesdensis*, and uses thereof.

2. Background Art

Human industrial activities inevitably generate industrial wastes. These industrial wastes comprise organic materials, for example methanol, formaldehyde, and ethanol. The high costs of degrading these wastes are borne by industry. These costs hinder market expansion for these and other related businesses.

It would be useful to manufacture and market a biomass degrading and treatment method capable of converting organic waste materials into non-toxic end-products. Such a method would include a system for treating organic waste and a new degrading agent, for example a novel bacterium. Using such a system, a person can 1) reduce waste treatment costs, 2) prevent pollution of the environment, and 3) improve soil, e.g. farmlands.

Further, it would be useful to mass produce and purify the plurality of polypeptide enzymes that the bacterium uses to degrade organic material and use the enzymes to degrade organic material in situations where the presence of the bacterium may not be necessary. Moreover, the purified polypeptide enzymes can be used in small biofuel cells to produce electrical energy from the degradation of organic materials.

Accordingly, applicants isolated a novel bacterium from a subject diagnosed with chronic granulomatous disease and discovered that the bacterium is capable of degrading methanol, formaldehyde, ethanol, and their respective intermediate breakdown products into non-toxic end-products. Examples of non-toxic end-products include, but are not limited to carbon dioxide, hydrogen ions, and acetic acid. Such a bacterium can be useful for many different purposes in biodegradation of organic waste and in the production of electrical energy.

Chronic granulomatous disease (CGD) is a rare inherited disease of the phagocyte NADPH oxidase system that leads to defective production of toxic oxygen metabolites and impaired killing of certain microbes [1]. Clinically, patients develop recurrent life-threatening infections with catalase-producing organisms as well as tissue granuloma formation [2]. The bacteria and fungi that commonly cause infection in CGD include *Staphylococcus aureus, Serratia marcescens, Burkholderia cepacia, Nocardia* and *Aspergillus* species [3-7]. Rare infections with organisms only encountered in CGD, such as *Paecilomyces* sp. and *Trichosporon inkin*, suggest that CGD patients have a unique susceptibility pattern [1]. However, when a specific microbiologic diagnosis cannot be made, patients are frequently treated with broad-spectrum antimicrobials that cover the most likely pathogens.

In the course of evaluation of fever and lymphadenitis in a CGD patient, a novel Gram-negative bacterium was identified that belongs to the family Acetobacteraceae, bacteria that are found widely in the environment. These bacteria have a variety of industrial uses, for example the production of vinegar. What is needed in the art is a bacterium that can use methanol as its sole carbon source and that can degrade organic material, e.g., methanol, formaldehyde, and ethanol, into non-toxic end-products. Such a bacterium can also be used in a biofuel cell to convert organic material into carbon dioxide and electrical energy.

SUMMARY OF THE INVENTION

In accordance with the purposes of this invention, as embodied and broadly described herein, this invention, in one aspect, relates to an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid.

In another aspect, the invention relates to a method of degrading an organic material, comprising contacting the organic material with an effective, degrading amount of an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid, whereby contacting the organic material with the bacterium degrades the organic material.

In another aspect, the invention relates to a method for growing an isolated Gram-negative bacterium, designated *Granulibacter bethesdensis* and deposited under ATCC Accession No. BAA-1260 in accordance with the terms of the Budapest Treaty with the American Type Culture Collection (ATCC), Manassas, VA, on Nov. 18,2005 and DSM Accession No. 17861, wherein the bacterium is an aerobic, facultative methylotroph that produces colonies that are yellow pigmented, wherein the bacterium can use methanol as a sole carbon source and can oxidize glucose and ethanol into acid, comprising culturing the bacterium at a temperature and on a medium effective to promote growth of the bacterium.

In another aspect, the invention relates to a biofuel cell, comprising a cathode, an anode, a conductive medium, an ion exchange membrane interposed between the cathode and the anode, and a bacterial catalyst around the anode, wherein the bacterial catalyst comprises an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid.

In another aspect, the invention relates to a plurality of purified polypeptides that can degrade organic material and can convert chemical energy in organic material into electrical energy.

In another aspect, the invention relates to a plurality of isolated antibodies that specifically bind to the disclosed purified polypeptides.

In yet another aspect, the invention relates to isolated nucleic acids that encode the purified polypeptides that can degrade organic material and can convert chemical energy in organic material into electrical energy.

Additional advantages of the invention will be set forth in part in the description which follows, and in part will be obvious from the description, or may be learned by practice of the invention. The advantages of the invention will be realized and attained by means of the elements and combinations particularly pointed out in the appended claims. It is to be understood that both the foregoing general description and the following detailed description are exemplary and explanatory only and are not restrictive of the invention, as claimed.

BRIEF DESCRIPTION OF THE DRAWINGS

The accompanying drawing, which is incorporated in and constitutes a part of this specification, illustrates one embodiment of the invention and together with the description, serves to explain the principles of the invention.

DESCRIPTION OF THE PREFERRED EMBODIMENTS

Figure 1:
FIG. 1 shows a phylogram of the 16S rRNA gene sequences of members of the Acetobacteraceae. The 16S rRNA gene sequence of *Stella humosa* was used as an outgroup. The tree was constructed with Clustal W and the neighbour-joining method with 1000 bootstrap replicates. Numbers at nodes are percentage of bootstrap replicates that supported this pattern (only values of 50% or higher shown). The scale bar for the branch lengths represents the number of substitutions per site. Abbreviations: T, type strain.

The present invention may be understood more readily by reference to the following detailed description of preferred embodiments of the invention and the Examples included therein and to the Figures and their previous and following description.

Before the present compounds, compositions, articles, devices, and/or methods are disclosed and described, it is to be understood that this invention is not limited to specific synthetic methods, specific purified proteins, or to particular nucleic acids, as such may, of course, vary. It is also to be understood that the terminology used herein is for the purpose of describing particular embodiments only and is not intended to be limiting.

As used in the specification and the appended claims, the singular forms "a," "an" and "the" include plural referents unless the context clearly dictates otherwise. Thus, for example, reference to "a purified polypeptide" includes mixtures of two or more purified polypeptides.

Ranges may be expressed herein as from "about" one particular value, and/or to "about" another particular value. When such a range is expressed, another embodiment includes from the one particular value and/or to the other particular value. Similarly, when values are expressed as approximations, by use of the antecedent "about," it will be understood that the particular value forms another embodiment. It will be further understood that the endpoints of each of the ranges are significant both in relation to the other endpoint, and independently of the other endpoint.

In this specification and in the claims which follow, reference will be made to a number of terms which shall be defined to have the following meanings.

"Optional" or "optionally" means that the subsequently described event or circumstance may or may not occur, and that the description includes instances where said event or circumstance occurs and instances where it does not. For example, the phrase "the medium can optionally contain glucose" means that the medium may or may not contain glucose as an ingredient and that the description includes both media containing glucose and media not containing glucose.

Provided herein is an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid. An example of the bacterium is designated *Granulibacter bethesdensis*, having the ATCC patent deposit designation BAA-1260. As used herein, "facultative" means not required or compulsory. As used herein, a "methylotroph" is a bacterium that can use methanol as a source of energy. Thus, for example, a facultative methylotroph is a bacterium that can grow either in the presence or in the absence of methanol. Therefore, the Gram-negative bacterium of the present invention can grow in the presence of methanol, but the bacterium does not require methanol to grow. These Gram-negative rods were isolated from three cervical lymph nodes from a subject diagnosed with chronic granulomatous disease (CGD) and were cultured on BCYE plates (Remel) after four days' incubation at 35° C. As used herein, by "subject" is meant an individual. Preferably, the subject is a mammal such as a primate, and, more preferably, a human. The term "subject" includes domesticated animals, such as cats, dogs, etc., livestock (e.g., cattle, horses, pigs, sheep, goats, etc.), and laboratory animals (e.g., mouse, rabbit, rat, gerbil, guinea pig, etc.).

The organism is a non-motile coccobacillus that is catalase-positive and oxidase-negative. Tests for the presence of lysine and ornithine decarboxylases and arginine dihydrolase were negative. The bacterium is urease-positive and weakly ferments glucose; it does not produce acid from lactose, mannitol, sucrose, maltose or xylose. These results were confirmed at the Centers for Disease Control and Prevention (CDC).

The API 20 NE (BioMerieux) and RapID NH (Remel) commercial kits generated codes 0200000 and 1501, respectively, neither of which yielded an identification. In view of the failure of conventional tests to identify the organism and its fastidious growth characteristics, the 16S rRNA gene was sequenced, and a search for related sequences was made in GenBank. The best 50 matches by BLAST search were all members of the family Acetobacteraceae, with the closest match being *Gluconacetobacter sacchari* (95.7% similarity; accession no. AF127412) and *Gluconacetobacter liquefaciens* (95.5% similarity; accession no. X75617). The 16S rDNA sequence similarity between the subject's isolate and other commonly encountered pathogenic Gram-negative rods was very low (~80%). A phylogenetic tree of *Granulibacter bethesdensis* based on its 16S RNA sequence is shown in FIG. 1.

The family Acetobacteraceae comprises several genera including the genus *Gluconacetobacter* and *Acetobacter*. The closest 16S rRNA gene sequence match was to *Gluconacetobacter sacchari* at 95.7%. However, strains that have a 16S rDNA sequence similarity below 97% are not considered the same species [9]. A polyphasic taxonomic approach shows that this organism belongs to a new genus and species in this family. Members of the genera *Gluconacetobacter, Acetobacter, Gluconobacter* and *Acidomonas* [10] have been called the acetic acid bacteria because they derive energy from the aerobic oxidation of ethanol to acetic acid. They have been cultured from fruits, fermented foods, plants, soil and water [11-14], are utilized industrially in the production of vinegar, and are encountered during the fermentation of wine. Characteristics that differentiate the new genus *Granulibacter* from other genera of acetic acid bacteria are shown below in Table 1.

Bacteria decompose or biodegrade organic molecules as part of their need to derive chemical energy to make ATP or produce metabolic intermediates. Being a methylotrophic organism, *G. bethesdensis* contains the biochemical pathways needed to degrade methanol into carbon dioxide.

For methanol to be biodegraded, it must first be converted into formaldehyde. Formaldehyde is a potent poison that must be broken down quickly in methylotrophic organisms such as *G. bethesdensis*, or else the bacterium will die. Just as this organism can degrade formaldehyde to detoxify its own internal environment, it can be used to degrade formaldehyde in the external environment. Moreover, the bacterium's purified polypeptide enzymes, for example methanol dehydrogenase and formaldehyde-activating enzyme, can be produced in large quantities by methods known to persons skilled in the art and can be used in the removal of industrial pollutants, for example, methanol and formaldehyde.

Further, *Granulibacter bethesdensis* belongs to a family of bacteria collectively referred to as the acetic acid bacteria. Thus, the bacterium can convert alcohols, for example ethanol, into acetic acid (vinegar) which has many industrial uses.

In one aspect, the bacterium comprises a genome identified as SEQ ID NO:1 which is deposited under GenBank Accession No. CP000394. In another aspect, the bacterium comprises a 16SRNA nucleic acid that is greater than about 98% similar to the nucleic acid identified as SEQ ID NO:2. In another aspect, the bacterium comprises a 16SRNA nucleic acid that is greater than about 99% similar to the nucleic acid identified as SEQ ID NO:2. In yet another aspect, the bacterium comprises a 16SRNA nucleic acid identified as SEQ ID NO:2.

Further, the bacterium is a facultative methylotroph that can degrade organic material into carbon dioxide and water. For example, the bacterium can degrade methanol into carbon dioxide and hydrogen ions. In another aspect, the bacterium can degrade ethanol into acetic acid. In order to use methanol, for example, as a carbon source for energy, the bacterium comprises a plurality of novel polypeptides that are enzymes that in vivo metabolize methanol. Each disclosed purified polypeptide, designated by its respective sequence identification number, is listed in Table 3, adjacent to the polypeptide known in the art that is most similar to it.

Figure 2:
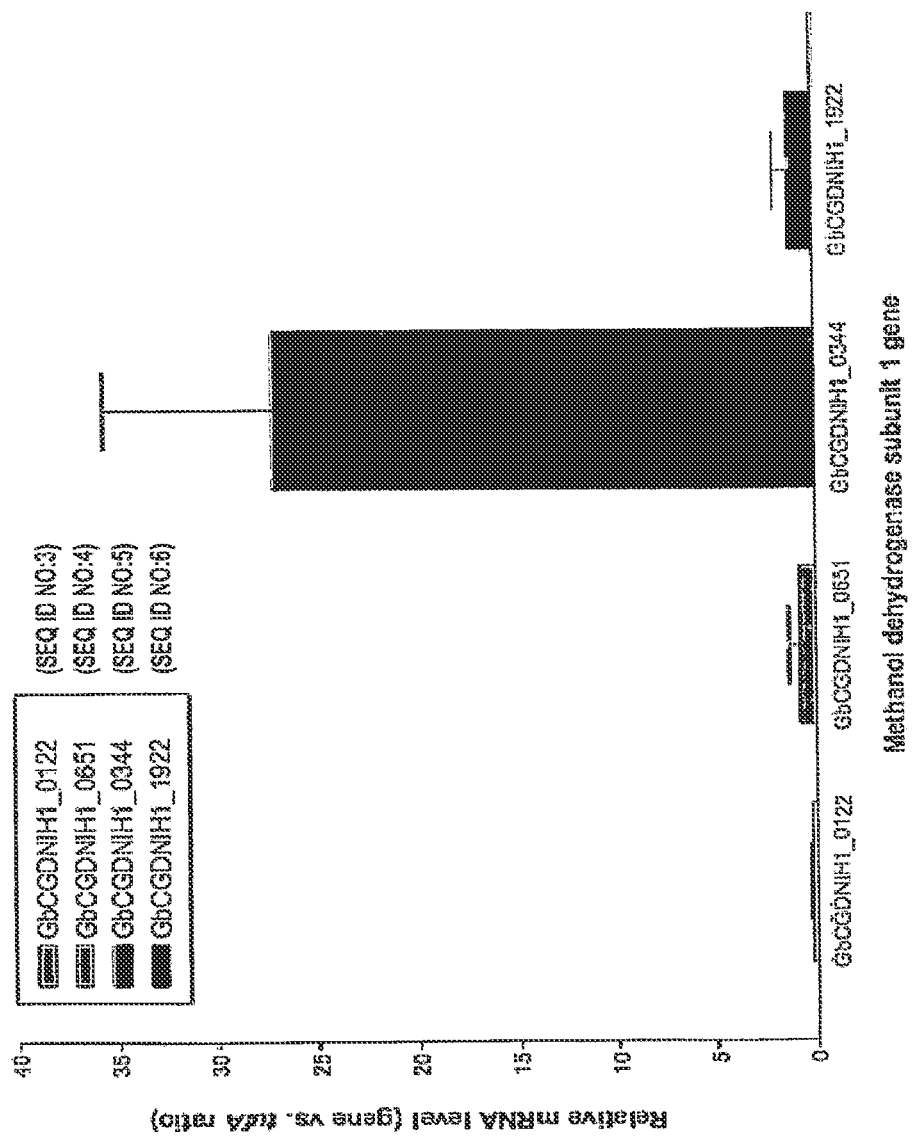
FIG. 2 shows quantitative RNA analysis of methanol dehydrogenase and selected virulence gene expression. Cumulative data from 5 different Taqman experiments analyzing gene expression in vitro at 26° C. late log phase, 26° C. stationary phase, 37° C. mid log phase, 37° C. late log phase and 37° C. stationary phase growth of the methanol dehydrogenase genes shown. GbCGDNIH1_0122 is SEQ ID NO:3; GbCGDNIH1_0651 is SEQ ID NO:4; GbCGDNIH1_0344 is SEQ ID NO:5; and GbCGDNIH1_1922 is SEQ ID NO:6.

In one aspect, the bacterium produces methanol dehydrogenase, wherein the methanol dehydrogenase oxidizes methanol into formaldehyde. The methanol dehydrogenase comprises two subunits, a first subunit and a second subunit. The first subunit comprises one polypeptide that can be any one of four polypeptides. RT-PCR of GbCGDNIH1_0122 (SEQ ID NO:3), GbCGDNIH1_0651 (SEQ ID NO:4), GbCGDNIH1_0344 (SEQ ID NO:5), and GbCGDNIH1_1922 (SEQ ID NO:6) from in vitro cultivated organisms from early, mid, late log and stationary phase growth at 25° C. and 37° C., respectively, showed that GbCGDNIH1_0344 (SEQ ID NO:5) is highly expressed relative to the three other ORFs (FIG. 2). Thus, the first subunit can be one polypeptide selected from the group consisting of a first polypeptide having an amino acid sequence identified as SEQ ID NO:3, a second polypeptide having an amino acid sequence identified as SEQ ID NO:4, a third polypeptide having an amino acid sequence identified as SEQ ID NO:5, and a fourth polypeptide having an amino acid sequence identified as SEQ ID NO:6.

Therefore, in one aspect, the first subunit methanol dehydrogenase polypeptide has an amino acid sequence greater than about 61% similar to an amino acid sequence identified as SEQ ID NO:3. Thus, the first subunit polypeptide can be greater than about 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:3. Therefore, in one aspect, the first subunit polypeptide has an amino acid sequence identified as SEQ ID NO:3.

Alternatively, the first subunit polypeptide has an amino acid sequence greater than about 70% similar to an amino acid sequence identified as SEQ ID NO:4. Thus, the first subunit polypeptide can be greater than about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:4. Therefore, in one aspect, the first subunit polypeptide has an amino acid sequence identified as SEQ ID NO:4.

Alternatively, the first subunit polypeptide has an amino acid sequence greater than about 77% similar to an amino acid sequence identified as SEQ ID NO:5. Thus, the first subunit polypeptide can be greater than about 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:5. Therefore) in one aspect, the first subunit polypeptide has an amino acid sequence identified as SEQ ID NO:5.

Alternatively, the first subunit polypeptide has an amino acid sequence greater than about 72% similar to an amino acid sequence identified as SEQ ID NO:6. Thus, the first subunit polypeptide can be greater than about 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:6. Therefore, in one aspect, the first subunit polypeptide has an amino acid sequence identified as SEQ ID NO:6.

The second subunit polypeptide has an amino acid sequence greater than about 64% similar to an amino acid sequence identified as SEQ ID NO:7. Thus, the second subunit polypeptide can be greater than about 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:7. Therefore, in one aspect, the second subunit polypeptide has an amino acid sequence identified as SEQ ID NO:7.

In another aspect, the disclosed bacterium produces a methanol dehydrogenase first subunit polypeptide having an amino acid sequence identified as SEQ ID NO:3, which is encoded by a nucleic acid having a nucleic acid sequence identified as SEQ ID NO:8.

In another aspect, the disclosed bacterium produces a methanol dehydrogenase first subunit polypeptide having an amino acid sequence identified as SEQ ID NO:4, which is encoded by a nucleic acid having a nucleic acid sequence identified as SEQ ID NO:9.

In another aspect, the disclosed bacterium produces a methanol dehydrogenase first subunit polypeptide having an amino acid sequence identified as SEQ ID NO:5, which is encoded by a nucleic acid having a nucleic acid sequence identified as SEQ ID NO:10.

In another aspect, the disclosed bacterium produces a methanol dehydrogenase first subunit polypeptide having an amino acid sequence identified as SEQ ID NO:6, which is encoded by a nucleic acid having a nucleic acid sequence identified as SEQ ID NO:11.

In another aspect, the disclosed bacterium produces a methanol dehydrogenase second subunit polypeptide having an amino acid sequence identified as SEQ ID NO:7, which is encoded by a nucleic acid having a nucleic acid sequence identified as SEQ ID NO:12.

In another aspect, the bacterium disclosed herein produces formaldehyde-activating enzyme that has an amino acid sequence greater than about 82% similar to an amino acid sequence identified as SEQ ID NO:13, wherein the formaldehyde-activating enzyme converts formaldehyde into methylene tetrahydromethanopterin. Thus, the formaldehyde-activating enzyme can be greater than about 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:13. Therefore, in one aspect, the formaldehyde-activating enzyme has an amino acid sequence identified as SEQ ID NO:13, which is encoded by a nucleic acid having a nucleic acid sequence identified as SEQ ID NO:14.

In another aspect, the bacterium produces methylenetetrahydromethanopterin dehydrogenase (NAD+/NADP) that has an amino acid sequence greater than about 54% similar to an amino acid sequence identified as SEQ ID NO:15, wherein the methylenetetrahydromethanopterin dehydrogenase (NAD+/NADP) converts methylene tetrahydromethanopterin into methenyl tetrahydromethanopterin. Thus, the methylenetetrahydromethanopterin dehydrogenase (NAD+/NADP) can be greater than about 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:15. Therefore, in one aspect, the methylenetetrahydromethanopterin dehydrogenase (NAD+/NADP) has an amino acid sequence identified as SEQ ID NO:15, which is encoded by a nucleic acid having a nucleic acid sequence identified as SEQ ID NO:16.

In another aspect, the bacterium produces N5N10-methenyltetrahydromethanopterin cyclohydrolase that has an amino acid sequence greater than about 62% similar to an amino acid sequence identified as SEQ ID NO:17, wherein the N5N10-methenyltetrahydromethanopterin cyclohydrolase converts methenyl tetrahydromethanopterin into 5-formyl tetrahydromethanopterin. Thus, the N5N10-methenyltetrahydromethanopterin cyclohydrolase can be greater than about 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:17. Therefore, in one aspect, the N5N10-methenyltetrahydromethanopterin cyclohydrolase has an amino acid sequence identified as SEQ ID NO:17, which is encoded by a nucleic acid having a nucleic acid sequence identified as SEQ ID NO:18.

In another aspect, the bacterium produces formylmethanofuran-tetrahydromethanopterin formyltransferase that has an amino acid sequence greater than about 62% similar to an amino acid sequence identified as SEQ ID NO:19, wherein the formylmethanofuran-tetrahydromethanopterin formyltransferase converts 5-formyl tetrahydromethanopterin into formyl methanofuran. Thus, the formylmethanofuran-tetrahydromethanopterin formyltransferase can be greater than about 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:19. Therefore, in one aspect, the formylmethanofuran-tetrahydromethanopterin formyltransferase has an amino acid sequence identified as SEQ ID NO:19, which is encoded by a nucleic acid having a nucleic acid sequence identified as SEQ ID NO:20.

In another aspect, the bacterium produces tungsten-containing formylmethanofuran dehydrogenase that converts formyl methanofuran into formate. Tungsten-containing formylmethanofuran dehydrogenase comprises a subunit (c) polypeptide, a subunit (a) polypeptide, and a subunit (b) polypeptide.

In one aspect, the subunit (c) polypeptide has an amino acid sequence greater than about 46% similar to an amino acid sequence identified as SEQ ID NO:21. Thus, the subunit (c) polypeptide can be greater than about 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:21. Therefore, in one aspect, the subunit (c) polypeptide has an amino acid sequence identified as SEQ ID NO:21, which is encoded by a nucleic acid having a nucleic acid sequence identified as SEQ ID NO:24.

In another aspect, the subunit (a) polypeptide has an amino acid sequence greater than about 52% similar to an amino acid sequence identified as SEQ ID NO:22. Thus, the subunit (a) polypeptide can be greater than about 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:22. Therefore, in one aspect, the subunit (a) polypeptide has an amino acid sequence identified as SEQ ID NO:22, which is encoded by a nucleic acid having a nucleic acid sequence identified as SEQ ID NO:25.

In yet another aspect, the subunit (b) polypeptide has an amino acid sequence greater than about 32% similar to an amino acid sequence identified as SEQ ID NO:23. Thus, the subunit (b) polypeptide can be greater than about 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:23. Therefore, in one aspect, the subunit (b) polypeptide has an amino acid sequence identified as SEQ ID NO:23, which is encoded by a nucleic acid having a nucleic acid sequence identified as SEQ ID NO:26.

In another aspect, the bacterium produces methylenetetrahydrofolate dehydrogenase (NADP+) that has an amino acid sequence greater than about 62% similar to an amino acid sequence identified as SEQ ID NO:27, wherein the methylenetetrahydrofolate dehydrogenase (NADP+) converts N5N10-methylene tetrahydrofolate into N5N10-methenyl tetrahydrofolate. Thus, the methylenetetrahydrofolate dehydrogenase (NADP+) can be greater than about 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:27. Therefore, in one aspect, the methylenetetrahydrofolate dehydrogenase (NADP+) has an amino acid sequence identified as SEQ ID NO:27, which is encoded by a nucleic acid having a nucleic acid sequence identified as SEQ ID NO:28.

In yet another aspect, the bacterium produces methylenetetrahydrofolate cyclohydrolase that has an amino acid sequence greater than about 64% similar to an amino acid sequence identified as SEQ ID NO:29, wherein the methylenetetrahydrofolate cyclohydrolase converts N5N10-methenyl tetrahydrofolate into N10-formyl tetrahydrofolate. Thus, the methylenetetrahydrofolate cyclohydrolase can be greater than about 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:29. Therefore, in one aspect, the methylenetetrahydrofolate cyclohydrolase has an amino acid sequence identified as SEQ ID NO:29, which is encoded by a nucleic acid identified as SEQ ID NO:30.

In another aspect, the bacterium produces formate-tetrahydrofolate ligase that has an amino acid sequence greater than about 69% similar to an amino acid sequence identified as SEQ ID NO:31, wherein the formate-tetrahydrofolate ligase converts N10-formyl tetrahydrofolate into formate. Thus, the formate-tetrahydrofolate ligase can be greater than about 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:31. Therefore, in one aspect, the formate-tetrahydrofolate ligase has an amino acid sequence identified as SEQ ID NO:31, which is encoded by a nucleic acid identified as SEQ ID NO:32.

In another aspect, the bacterium produces formate dehydrogenase, wherein the formate dehydrogenase converts formate into carbon dioxide. The formate dehydrogenase comprises a first subunit polypeptide, a second subunit polypeptide, a third subunit polypeptide, a fourth subunit polypeptide, and a fifth subunit polypeptide. Thus, provided is a first subunit polypeptide having an amino acid sequence greater than about 62% similar to an amino acid sequence identified as SEQ ID NO:33. Thus, the first subunit polypeptide can be greater than about 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:33. Therefore, in one aspect, the first subunit polypeptide has an amino acid sequence identified as SEQ ID NO:33, which is encoded by a nucleic acid identified as SEQ ID NO:38.

Further provided is a second subunit polypeptide having an amino acid sequence greater than about 74% similar to an amino acid sequence identified as SEQ ID NO:34. Thus, the second subunit polypeptide can be greater than about 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:34. Therefore, in one aspect, the second subunit polypeptide has an amino acid sequence identified as SEQ ID NO:34, which is encoded by a nucleic acid identified as SEQ ID NO:39.

Further provided is a third subunit polypeptide having an amino acid sequence greater than about 77% similar to an amino acid sequence identified as SEQ ID NO:35. Thus, the third subunit polypeptide can be greater than about 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:35. Therefore, in one aspect, the third subunit polypeptide has an amino acid sequence identified as SEQ ID NO:35, which is encoded by a nucleic acid identified as SEQ ID NO:40.

Further provided is a fourth subunit polypeptide having an amino acid sequence greater than about 46% similar to an amino acid sequence identified as SEQ ID NO:36. Thus, the fourth subunit polypeptide can be greater than about 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:36. Therefore, in one aspect, the fourth subunit polypeptide has an amino acid sequence identified as SEQ ID NO:36, which is encoded by a nucleic acid identified as SEQ ID NO:41.

Also provided is a fifth subunit polypeptide having an amino acid sequence greater than about 62% similar to an amino acid sequence identified as SEQ ID NO:37. Thus, the fifth subunit polypeptide can be greater than about 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:37. Therefore, in one aspect, the fifth subunit polypeptide has an amino acid sequence identified as SEQ ID NO:37, which is encoded by a nucleic acid identified as SEQ ID NO:42.

In another aspect, the bacterium produces an aldehyde dehydrogenase, wherein the aldehyde dehydrogenase oxidizes acetaldeyde into acetic acid. The aldehyde dehydrogenase comprises a first subunit polypeptide, a second subunit polypeptide, and a third subunit polypeptide. Thus, provided is a first subunit polypeptide having an amino acid sequence greater than about 51% similar to an amino acid sequence identified as SEQ ID NO:43. Thus, the first subunit polypeptide can be greater than about 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:43. Therefore, in one aspect, the first subunit polypeptide has an amino acid sequence identified as SEQ ID NO:43, which is encoded by a nucleic acid identified as SEQ ID NO:46.

Also provided is a second subunit polypeptide having an amino acid sequence greater than about 54% similar to an amino acid sequence identified as SEQ ID NO:44. Thus, the second subunit polypeptide can be greater than about 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%; 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:44. Therefore, in one aspect, the second subunit polypeptide has an amino acid sequence identified as SEQ ID NO:44, which is encoded by a nucleic acid identified as SEQ ID NO:47.

Further provided is a third subunit polypeptide having an amino acid sequence greater than about 73% similar to an amino acid sequence identified as SEQ ID NO:45. Thus, the third subunit polypeptide can be greater than about 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:45. Therefore, in one aspect, the third subunit polypeptide has an amino acid sequence identified as SEQ ID NO:45.

In another aspect; the bacterium produces an alcohol dehydrogenase, wherein the alcohol dehydrogenase oxidizes methanol into formaldehyde or ethanol into acetaldehyde. In one aspect, the alcohol dehydrogenase has an amino acid sequence greater than about 59% similar to an amino acid sequence identified as SEQ ID NO:48. Thus, the alcohol dehydrogenase can be greater than about 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% similar to an amino acid sequence identified as SEQ ID NO:48. Therefore, in one aspect, the alcohol dehydrogenase has an amino acid sequence identified as SEQ ID NO:48, which is encoded by a nucleic acid identified as SEQ ID NO:49.

Further provided is a purified polypeptide selected from the group of purified polypeptides having amino acid sequences identified as SEQ ID NO:3, SEQ ID NO:4, SEQ ID NO:5, SEQ ID NO:6, SEQ ID NO:7, SEQ ID NO:13, SEQ ID NO:15, SEQ ID NO:17, SEQ ID NO:19, SEQ ID NO:21, SEQ ID NO:22, SEQ ID NO:23, SEQ ID NO:27, SEQ ID NO:29, SEQ ID NO:31, SEQ ID NO:33, SEQ ID NO:34, SEQ ID NO:35, SEQ ID NO:36, SEQ ID NO:37, SEQ ID NO:43, SEQ ID NO:44, SEQ ID NO:45, SEQ ID NO:48, wherein each polypeptide, alone or in combination with one or more disclosed polypeptides, can degrade an organic material, for example methanol, formaldehyde, ethanol, and intermediate breakdown products thereof. Examples of the end-products that result from the degradation of the organic materials include carbon dioxide, hydrogen ions and acetic acid. The energy produced from the biodegradation process can be heat energy, chemical energy, or electrical energy.

As used herein, a "purified polypeptide" or "isolated polypeptide" is a polypeptide that is substantially free from the materials with which the polypeptide is normally associated in nature or in culture. The polypeptides of the invention can be obtained, for example, by extraction from a natural source, for example, an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid; by expression of a recombinant nucleic acid encoding the polypeptide (for example, in a cell or in a cell-free translation system); or by chemically synthesizing the polypeptide. In addition, a polypeptide may be obtained by cleaving full-length polypeptides. When the polypeptide is a fragment of a larger naturally occurring polypeptide, the purified (isolated) polypeptide is shorter than and excludes the full-length, naturally-occurring polypeptide of which it is a fragment.

The disclosed novel polypeptides can be prepared by using any of a number of chemical polypeptide synthesis techniques well-known to those of ordinary skill in the art, including solution methods and solid phase methods. One method of producing the disclosed polypeptides is to link two or more peptides or polypeptides together by protein chemistry techniques. For example, peptides or polypeptides can be chemically synthesized using currently available laboratory equipment using either Fmoc (9-fluorenylmethyloxycarbonyl) or Boc (tert-butyloxycarbonoyl) chemistry. (Applied Biosystems, Inc., Foster City, Calif.). One skilled in the art can readily appreciate that a peptide or polypeptide corresponding to an antigen of the present invention, for example, can be synthesized by standard chemical reactions.

For example, enzymatic ligation of cloned or synthetic peptide segments allows relatively short peptide fragments to be joined to produce larger peptide fragments, polypeptides or whole protein domains (Abrahmsen L et al., Biochemistry, 30:4151 (1991)). Alternatively, native chemical ligation of synthetic peptides can be utilized to synthetically construct large peptides or polypeptides from shorter peptide fragments. This method consists of a two-step chemical reaction (Dawson et al. Synthesis of Proteins by Native Chemical Ligation. Science, 266:776-779 (1994)). The first step is the chemoselective reaction of an unprotected synthetic peptide-alpha-thioester with another unprotected peptide segment containing an amino-terminal Cys residue to give a thioester-linked intermediate as the initial covalent product. Without a change in the reaction conditions, this intermediate undergoes spontaneous, rapid intra-molecular reaction to form a native peptide bond at the ligation site. Application of this native chemical ligation method to the total synthesis of a protein molecule is illustrated by the preparation of human interleukin 8 (IL-8) (Baggiolini M et al. (1992) FEBS Lett. 307:97-101; Clark-Lewis I et al., J. Biol. Chem., 269:16075 (1994); Clark-Lewis I et al., Biochemistry, 30:3128 (1991); Rajarathnam K. et al., Biochemistry 33:6623-30 (1994)).

Alternatively, unprotected peptide segments are chemically linked where the bond formed between the peptide segments as a result of the chemical ligation is an unnatural (non-peptide) bond (Schnolzer, M et al. Science, 256:221 (1992)). This technique has been used to synthesize analogs of protein domains as well as large amounts of relatively pure proteins with full biological activity (deLisle Milton R C et al., Techniques in Protein Chemistry IV. Academic Press, New York, pp 257-267 (1992)).

The polypeptides of the invention can also be prepared by other means including, for example, recombinant techniques. Examples of appropriate cloning and sequencing techniques, and instructions sufficient to direct persons of skill through many cloning exercises are found in Sambrook et al. (2001) Molecular Cloning—A Laboratory Manual (3rd ed.) Vol. 1-3, Cold Spring Harbor Laboratory, Cold Spring Harbor Press, NY, (Sambrook).

It is understood that as discussed herein, the terms "similar" or "similarity" mean the same thing as "homology" and "identity." Thus, for example, if the use of the word homology is used to refer to two non-natural sequences, it is understood that this is not necessarily indicating an evolutionary relationship between these two sequences, but rather is looking at the similarity or relatedness between their nucleic acid or amino acid sequences. Many of the methods for determining similarity between two evolutionarily related molecules are routinely applied to any two or more nucleic acids or polypeptides for the purpose of measuring sequence similarity regardless of whether they are evolutionarily related.

In general, it is understood that one way to define any known variants and derivatives or those that might arise, of the disclosed nucleic acids and polypeptides herein, is through defining the variants and derivatives in terms of similarity, or homology, to specific known sequences. In general, variants of nucleic acids and polypeptides herein disclosed typically have at least, about 70, 71, 72, 73, 74, 75, 76, 77, 78, 79, 80, 81, 82, 83, 84, 85, 86, 87, 88, 89, 90, 91, 92, 93, 94, 95, 96, 97, 98, or 99 percent similarity, or homology, to the stated sequence or the native sequence. Those of skill in the art readily understand how to determine the similarity of two polypeptides or nucleic acids. For example, the similarity can be calculated after aligning the two sequences so that the similarity is at its highest level.

Another way of calculating similarity, or homology, can be performed by published algorithms. Optimal alignment of sequences for comparison may be conducted by the local homology algorithm of Smith and Waterman Adv. Appl. Math. 2: 482 (1981), by the homology alignment algorithm of Needleman and Wunsch, J. Mol. Biol. 48: 443 (1970), by the search for similarity method of Pearson and Lipman, Proc. Natl. Acad. Sci. U.S.A. 85: 2444(1988), by computerized implementations of these algorithms (GAP, BESTFIT, FASTA, and TFASTA in the Wisconsin Genetics Software Package, Genetics Computer Group, 575 Science Dr., Madison, WI; the BLAST algorithm of Tatusova and Madden FEMS Microbiol. Lett. 174: 247-250 (1999) available from the National Center for Biotechnology Information, or by inspection.

The same types of similarity, or homology, can be obtained for nucleic acids by, for example, the algorithms disclosed in Zuker, M. Science 244:48-52, 1989, Jaeger et al. Proc. Natl. Acad. Sci. USA 86:7706-7710, 1989, Jaeger et al. Methods Enzymol. 183:281-306, 1989 which are herein incorporated by reference for at least material related to nucleic acid alignment. It is understood that any of the methods typically can be used and that in certain instances the results of these various methods may differ, but the skilled artisan understands if similarity is found with at least one of these methods, the sequences would be said to have the stated similarity.

For example, as used herein, a sequence recited as having a particular percent similarity to another sequence refers to sequences that have the recited similarity as calculated by any one or more of the calculation methods described above. For example, a first sequence has 80 percent similarity, as defined herein, to a second sequence if the first sequence is calculated to have 80 percent similarity to the second sequence using the Zuker calculation method even if the first sequence does not have 80 percent similarity to the second sequence as calculated by any of the other calculation methods. As another example, a first sequence has 80 percent similarity, as defined herein, to a second sequence if the first sequence is calculated to have 80 percent similarity to the second sequence using both the Zuker calculation method and the Pearson and Lipman calculation method even if the first sequence does not have 80 percent similarity to the second sequence as calculated by the Smith and Waterman calculation method, the Needleman and Wunsch calculation method, the Jaeger calculation methods, or any of the other calculation methods. As yet another example, a first sequence has 80 percent similarity, as defined herein, to a second sequence if the first sequence is calculated to have 80 percent similarity to the second sequence using each of the calculation methods (although, in practice, the different calculation methods will often result in different calculated similarity percentages).

Each of the disclosed polypeptides can have one or more conservative amino acid substitutions. These conservative substitutions are such that a naturally occurring amino acid is replaced by one having similar properties. Such conservative substitutions do not alter the function of the polypeptide. For example, conservative substitutions can be made according to Table 4, shown below.

Thus, it is understood that, where desired, modifications and changes may be made in the nucleic acid encoding the polypeptides of this invention and/or in the amino acid sequence of the disclosed polypeptides and still obtain a polypeptide having like or otherwise desirable characteristics. Such changes may occur in natural isolates or may be synthetically introduced using site-specific mutagenesis, the procedures for which, such as mis-match polymerase chain reaction (PCR), are well known in the art. For example, certain amino acids may be substituted for other amino acids in a polypeptide without appreciable loss of functional activity. It is thus contemplated that various changes may be made in the amino acid sequence of the polypeptides of the present invention (or underlying nucleic acid sequence) without appreciable loss of biological utility or activity and possibly with an increase in such utility or activity.

The disclosed purified polypeptides can be used, for example, in vitro, as enzymes to catalyze chemical reactions for the purpose of degrading an organic material. Moreover, the disclosed polypeptides can be used on a large, industrial scale to degrade organic material. In one aspect, one or more purified polypeptides can be used to treat organic waste comprising, for example, methanol, formaldehyde, and/or ethanol, in order to clean up and detoxify a chemical spill that threatens the environment. The disclosed purified polypeptides can be used alone, or in any combination or sequence, to degrade organic material. Moreover, a person of skill would know which polypeptides to use and the effective amounts of each polypeptide to attain a selected end-product. For example, if a person of skill wanted to produce formaldehyde from methanol, only those polypeptides that comprise methanol dehydrogenase are selected. Further, if the goal is to degrade formaldehyde into a non-toxic end-product, for example in a toxic spill, a person of skill can choose the polypeptides that comprise formaldehyde-activating enzyme to initiate the process which will eventually result in the production of carbon dioxide. Thus, a person of skill can use the disclosed polypeptides in various combinations and sequences to degrade organic materials to prevent damage to land and water resources.

Further provided is a plurality of isolated nucleic acids that encode the disclosed purified polypeptides and variants or fragments thereof. Examples of nucleic acids that encode the disclosed polypeptides include the nucleic acids identified as SEQ ID NO:8, SEQ ID NO:9, SEQ ID NO:10, SEQ ID NO:11, SEQ ID NO:12, SEQ ID NO:14, SEQ ID NO:16, SEQ ID NO:18, SEQ ID NO:20, SEQ ID NO:24, SEQ ID NO:25, SEQ ID NO:26, SEQ ID NO:28, SEQ ID NO:30, SEQ ID NO:32, SEQ ID NO:38, SEQ ID NO:39, SEQ ID NO:40, SEQ ID NO:41, SEQ ID NO:42, SEQ ID NO:46, SEQ ID NO:47, and SEQ ID NO:50.

As used herein, the term "nucleic acid" refers to single or multiple stranded molecules which may be DNA or RNA, or any combination thereof, including modifications to those nucleic acids. The nucleic acid may represent a coding strand or its complement, or any combination thereof. Nucleic acids may be identical in sequence to the sequences which are naturally occurring for any of the moieties discussed herein or may include alternative codons which encode the same amino acid as that which is found in the naturally occurring sequence. These nucleic acids can also be modified from their typical structure. Such modifications include, but are not limited to, methylated nucleic acids, the substitution of a non-bridging oxygen on the phosphate residue with either a sulfur (yielding phosphorothioate deoxynucleotides), selenium (yielding phosphorselenoate deoxynucleotides), or methyl groups (yielding methylphosphonate deoxynucleotides), a reduction in the AT content of AT rich regions, or replacement of non-preferred codon usage of the expression system to preferred codon usage of the expression system. The nucleic acid can be directly cloned into an appropriate vector, or if desired, can be modified to facilitate the subsequent cloning steps. Such modification steps are routine, an example of which is the addition of oligonucleotide linkers which contain restriction sites to the termini of the nucleic acid. General methods are set forth in Sambrook et al. (2001) Molecular Cloning—A Laboratory Manual (3rd ed.) Vol. 1-3, Cold Spring Harbor Laboratory, Cold Spring Harbor Press, NY, (Sambrook).

The nucleic acids of this invention can be detected with a probe capable of hybridizing to the nucleic acid of a cell or a sample. This probe can be a nucleic acid comprising the nucleotide sequence of a coding strand or its complementary strand or the nucleotide sequence of a sense strand or antisense strand, or a fragment thereof. The nucleic acid can comprise the nucleic acid of the bacterial genome, for Example the nucleic acid identified as SEQ ID NO:1, or fragments thereof. Thus, the probe of this invention can be either DNA or RNA and can bind either DNA or RNA, or both, in the biological sample.

The nucleic acids of the present invention, for example SEQ ID NO:8, SEQ ID NO:9, SEQ ID NO:10, SEQ ID NO:11, SEQ ID NO:12 or any of the other disclosed nucleic acid, and fragments thereof, can be utilized as probes or primers to detect nucleic acids of the disclosed bacterium. A polynucleotide probe or primer comprising at least 15 contiguous nucleotides can be utilized to detect a nucleic acid of the disclosed bacterium. Therefore, the polynucleotide probes or primers of this invention can be at least 15, 20, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195 or at least 200 nucleotides in length.

As used herein, the term "nucleic acid probe" refers to a nucleic acid fragment that selectively hybridizes under stringent conditions with a nucleic acid comprising a nucleic acid set forth in a sequence listed herein. This hybridization must be specific. The degree of complementarity between the hybridizing nucleic acid and the sequence to which it hybridizes should be at least enough to exclude hybridization with a nucleic acid encoding an unrelated protein.

"Stringent conditions" refers to the washing conditions used in a hybridization protocol. In general, the washing conditions should be a combination of temperature and salt concentration chosen so that the denaturation temperature is approximately 5° C. to 20° C. below the calculated Tm of the nucleic acid hybrid under study. The temperature and salt conditions are readily determined empirically in preliminary experiments in which samples of reference DNA immobilized on filters are hybridized to the probe or polypeptide-coding nucleic acid of interest and then washed under conditions of different stringencies. The Tm of such an oligonucleotide can be estimated by allowing 20C for each A or T nucleotide, and 4° C. for each G or C. For example, an 18 nucleotide probe of 50% G+C would, therefore, have an approximate Tm of 54° C. Stringent conditions are known to one of skill in the art. See, for example, Sambrook et al. (2001). The following is an exemplary set of hybridization conditions and is not limiting:

Very High Stringency
Hybridization: 5×SSC at 65° C. for 16 hours
Wash twice: 2×SSC at room temperature (RT) for 15 minutes each
Wash twice: 0.5×SSC at 65° C. for 20 minutes each
High Stringency
Hybridization: 5×-6×SSC at 65° C.-70° C. for 16-20 hours
Wash twice: 2×SSC at RT for 5-20 minutes each
Wash twice: 1×SSC at 55° C.-70° C. for 30 minutes each
Low Stringency
Hybridization: 6×SSC at RT to 55° C. for 16-20 hours
Wash at least twice: 2×-3×SSC at RT to 55° C. for 20-30 minutes each As mentioned above, the disclosed nucleic acids and fragments thereof can be utilized as primers to amplify a disclosed bacterial nucleic acid by standard amplification 30 techniques. A variety of PCR techniques are familiar to those skilled in the art. For a review of PCR technology, see White (1997) and the publication entitled "PCR Methods and Applications" (1991, Cold Spring Harbor Laboratory Press), which is incorporated herein by reference in its entirety for amplification methods. In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195, 4,683,202 and 4,965,188. Each of these publications is incorporated herein by reference in its entirety for PCR methods. One of skill in the art would know how to design and synthesize primers that amplify the disclosed nucleic acids or fragments thereof.

A detectable label may be included in an amplification reaction. Suitable labels include fluorochromes, e.g. fluorescein isothiocyanate (FITC), rhodamine, Texas Red, phycoerythrin, allophycocyanin, 6-carboxyfluorescein (6-FAM), 2',7'-dimethoxy-4',5'-dichloro-6-carboxyfluorescein (JOE), 6-carboxy-X-rhodamine (ROX), 6-carboxy-2',4',7',4,7-hexachlorofluorescein (HEX), 5-carboxyfluorescein (5-FAM) or N,N,N',N'-tetramethyl-6-carboxyrhodamine (TAMRA), radioactive labels, e.g., 32 P, 35 S, 3 H; etc. The label may be a two stage system, where the amplified DNA is conjugated to biotin, haptens, etc., having a high affinity binding partner, e.g. avidin, specific antibodies, etc., where the binding partner is conjugated to a detectable label. The label may be conjugated to one or both of the primers. Alternatively, the pool of nucleotides used in the amplification is labeled, so as to incorporate the label into the amplification product.

The sample nucleic acid, for example amplified fragment, can be analyzed by one of a number of methods known in the art. The nucleic acid can be sequenced by dideoxy or other methods. Hybridization with the sequence can also be used to determine its presence, by Southern blots, dot blots, etc.

Once the nucleic acid sequence is obtained, the sequence encoding the specific amino acids can be modified or changed at any particular amino acid position by techniques well known in the art. For example, PCR primers can be designed which span the amino acid position or positions and which can substitute any amino acid for another amino acid. Alternatively, one skilled in the art can introduce specific mutations at any point in a particular nucleic acid sequence through techniques for point mutagenesis. General methods are set forth in Smith, M. "In vitro mutagenesis" Ann. Rev. Gen., 19:423-462 (1985) and Zoller, M. J. "New molecular biology methods for protein engineering" Curr. Opin. Struct. Biol., 1:605-610 (1991), which are incorporated herein in their entirety for the methods. These techniques can be used to alter the coding sequence without altering the amino acid sequence that is encoded.

In another aspect, provided is a vector, comprising a disclosed nucleic acid. The vector can direct the in vivo or in vitro synthesis of any of the polypeptides described herein. The vector is contemplated to have the necessary functional elements that direct and regulate transcription of the inserted nucleic acid. These functional elements include, but are not limited to, a promoter, regions upstream or downstream of the promoter, such as enhancers that may regulate the transcriptional activity of the promoter, an origin of replication, appropriate restriction sites to facilitate cloning of inserts adjacent to the promoter, antibiotic resistance genes or other markers which can serve to select for cells containing the vector or the vector containing the insert, RNA splice junctions, a transcription termination region, or any other region which may serve to facilitate the expression of the inserted gene or hybrid gene. (See generally, Sambrook et al.). The vector, for example, can be a plasmid. The vectors can contain genes conferring hygromycin resistance, gentamicin resistance, or other genes or phenotypes suitable for use as selectable markers, or methotrexate resistance for gene amplification. The vector can comprise the nucleic acid in pET15b, pSRα-Neo, pPICZα, or pPIC9K.

There are numerous other E. coli (Escherichia coli) expression vectors, known to one of ordinary skill in the art, which are useful for the expression of the nucleic acid insert. Other microbial hosts suitable for use include bacilli, such as Bacillus subtilis, and other enterobacteriaceae, such as Salmonella, Serratia, and various Pseudomonas species. In these prokaryotic hosts one can also make expression vectors, which will typically contain expression control sequences compatible with the host cell (e.g., an origin of replication). In addition, any number of a variety of well-known promoters will be present, such as the lactose promoter system, a tryptophan (Trp) promoter system, a beta-lactamase promoter system, or a promoter system from phage lambda. The promoters will typically control expression, optionally with an operator sequence, and have ribosome binding site sequences, for example, for initiating and completing transcription and translation. If necessary, an amino terminal methionine can be provided by insertion of a Met codon 5' and in-frame with the downstream nucleic acid insert. Also, the carboxy-terminal extension of the nucleic acid insert can be removed using standard oligonucleotide mutagenesis procedures. Also, nucleic acid modifications can be made to promote amino terminal homogeneity.

Additionally, yeast expression can be used. The invention provides a nucleic acid encoding a polypeptide of the present invention, wherein the nucleic acid can be expressed by a yeast cell. More specifically, the nucleic acid can be expressed by Pichia pastoris or S. cerevisiae. There are several advantages to yeast expression systems, which include, for example, Saccharomyces cerevisiae and Pichia pastoris. First, evidence exists that proteins produced in a yeast secretion systems exhibit correct disulfide pairing. Second, efficient large scale production can be carried out using yeast expression systems. The Saccharomyces cerevisiae pre-pro-alpha mating factor leader region (encoded by the MFα-1 gene) can be used to direct protein secretion from yeast (Brake, et al.). The leader region of pre-pro-alpha mating factor contains a signal peptide and a pro-segment which includes a recognition sequence for a yeast protease encoded by the KEX2 gene: this enzyme cleaves the precursor protein on the carboxyl side of a Lys-Arg dipeptide cleavage signal sequence. The nucleic acid coding sequence can be fused in-frame to the pre-pro-alpha mating factor leader region. This construct can be put under the control of a strong transcription promoter, such as the alcohol dehydrogenase I promoter, alcohol oxidase I promoter, a glycolytic promoter, or a promoter for the galactose utilization pathway. The nucleic acid coding sequence is followed by a translation termination codon which is followed by transcription termination signals. Alternatively, the nucleic acid coding sequences can be fused to a second protein coding sequence, such as Sj26 or beta-galactosidase, used to facilitate purification of the fusion protein by affinity chromatography. The insertion of protease cleavage sites to separate the components of the fusion protein is applicable to constructs used for expression in yeast. Efficient post translational glycosylation and expression of recombinant proteins can also be achieved in Baculovirus systems.

In another aspect, provided are vectors containing the disclosed nucleic acids in a host suitable for expressing the nucleic acids. The host cell can be a prokaryotic cell, including, for example, a bacterial cell. In one aspect, the bacterial cell can be an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid, and wherein the bacterium is designated Granulibacter bethesdensis and deposited under ATCC Accession No. BAA-1260. Moreover, the bacterial cell can be an E. coli cell.

Alternatively, the cell can be a eukaryotic cell, including, for example, a Chinese hamster ovary (CHO) cell, a mycloma cell, a Pichia cell, or an insect cell. The coding sequence for any of the polypeptides described herein can be introduced into a Chinese hamster ovary (CHO) cell line, for example, using a methotrexate resistance-encoding vector, or other cell lines using suitable selection markers. Presence of the vector DNA in transformed cells can be confirmed by Southern blot analysis. Production of RNA corresponding to the insert coding sequence can be confirmed by Northern blot analysis. A number of other suitable host cell lines have been developed and include myeloma cell lines, fibroblast cell lines, and a variety of tumor cell lines such as melanoma cell lines. Expression vectors for these cells can include expression control sequences, such as an origin of replication, a promoter, an enhancer, and necessary information processing sites, such as ribosome binding sites, RNA splice sites, polyadenylation sites, and transcriptional terminator sequences. Preferred expression control sequences are promoters derived from immunoglobulin genes, SV40, Adenovirus, Bovine Papilloma Virus, etc. The vectors containing the nucleic acid segments of interest can be transferred into the host cell by well-known methods, which vary depending on the type of cellular host. For example, calcium chloride transformation is commonly utilized for prokaryotic cells, whereas calcium phosphate, DEAE dextran, or lipofectin mediated transfection or electroporation may be used for other cellular hosts.

Further provided is a method of making any of the disclosed purified polypeptides, fragments and variants described herein comprising culturing a host cell comprising a vector that encodes a polypeptide and purifying the polypeptide produced by the host cell. As mentioned above, these polypeptides include, but are not limited to, the polypeptides listed in Table 3, fragments thereof, polypeptides comprising an amino acid sequence at least about 95% similar to the disclosed amino acid sequences or fragments thereof and the purified polypeptides listed in Table 3, fragments thereof, with one or more conservative amino acid substitutions.

In another aspect, provided is a plurality of isolated antibodies, or fragments thereof, wherein each antibody, or fragment thereof, specifically binds to one of the disclosed polypeptides listed in Table 3. Thus, provided is an isolated antibody, or fragment thereof, that specifically binds, for example, a purified polypeptide identified as SEQ ID NO:3, or a fragment thereof. Another example of an isolated antibody, or fragment thereof, is an antibody that specifically binds to a purified polypeptide identified as SEQ ID NO:4.

In one aspect, provided is an isolated antibody, or fragment thereof, that specifically binds an epitope contained within each polypeptide listed in Table 3. In other words, provided is a plurality of isolated antibodies, or fragments thereof, that specifically bind an epitope contained within each amino acid sequence of the polypeptides disclosed in Table 3.

An antibody of the present invention can be a polyclonal antibody or a monoclonal antibody. By "specifically binds" is meant an antibody binding reaction which is determinative of the presence of the antigen (in the present case, each polypeptide listed in Table 3, or antigenic fragments thereof) among a heterogeneous population of polypeptides and other biologics. Thus, under designated immunoassay conditions, the specified antibodies bind preferentially to a particular polypeptide and do not bind in a significant amount to other polypeptides in the sample. Preferably, specific binding includes binding at about or above 1.5 times assay background, and the absence of significant binding is less than 1.5 times assay background.

Preferably, the antibody binds a disclosed polypeptide ex vivo or in vivo. Optionally, the antibody of the invention is labeled with a detectable moiety. For example, the detectable moiety can be selected from the group consisting of a fluorescent moiety, an enzyme-linked moiety, a biotin moiety and a radiolabeled moiety. The antibody can be used in techniques or procedures such as diagnostics, screening, or imaging. Anti-idiotypic antibodies and affinity matured antibodies are also considered to be part of the invention. Thus, an antibody disclosed herein can be used to detect the presence of *Granulibacter bethesdensis* in a biological sample from a subject, for example a lymph node removed from the subject, in order to diagnose the cause of an infection.

As used herein, the term "antibody" encompasses, but is not limited to, whole immunoglobulin (i.e., an intact antibody) of any class. Native antibodies are usually heterotetrameric glycoproteins, composed of two identical light (L) chains and two identical heavy (H) chains. Typically, each light chain is linked to a heavy chain by one covalent disulfide bond, while the number of disulfide linkages varies between the heavy chains of different immunoglobulin isotypes. Each heavy and light chain also has regularly spaced intrachain disulfide bridges. Each heavy chain has at one end a variable domain (V(H)) followed by a number of constant domains. Each light chain has a variable domain at one end (V(L)) and a constant domain at its other end; the constant domain of the light chain is aligned with the first constant domain of the heavy chain, and the light chain variable domain is aligned with the variable domain of the heavy chain. Particular amino acid residues are believed to form an interface between the light and heavy chain variable domains. The light chains of antibodies from any vertebrate species can be assigned to one of two clearly distinct types, called kappa (k) and lambda (l), based on the amino acid sequences of their constant domains. Depending on the amino acid sequence of the constant domain of their heavy chains, immunoglobulins can be assigned to different classes. There are five major classes of human immunoglobulins: IgA, IgD, IgE, IgG and IgM, and several of these may be further divided into subclasses (isotypes), e.g., IgG-1, IgG-2, IgG-3, and IgG-4; IgA-1 and IgA-2. One skilled in the art would recognize the comparable classes for mouse or other species. The heavy chain constant domains that correspond to the different classes of immunoglobulins are called alpha, delta, epsilon, gamma, and mu, respectively.

As used herein, the terms "immunoglobulin heavy chain or fragments thereof" and "immunoglobulin light chain or fragments thereof" encompass chimeric peptides and hybrid peptides, with dual or multiple antigen or epitope specificities, and fragments, including hybrid fragments. Thus, fragments of the heavy chains and/or fragments of the light chains that retain the ability to bind their specific antigens are provided.

In another aspect, provided is a method of degrading an organic material, comprising contacting the organic material with an effective, degrading amount of an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid, whereby contacting the organic material with the bacterium degrades the organic material. As used herein "degrade" means "to break down" or "to decompose." As used herein, "biodegrade" means "to break down or decompose by biological processes." Thus, the process of decomposing an organic material by contacting the material with bacteria is an example of biodegradation. As used herein, an "effective amount" is within the knowledge of one skilled in the art. Various methods are known by which a person of skill can determine the amount of bacteria required to effectively degrade the organic material, e.g., organic waste, of interest. The organic material can comprise any composition containing carbon and includes, but is not limited to, methanol, formaldehyde, ethanol, hydrocarbons, benzene, and other aldehydes, including intermediate breakdown products of the materials disclosed herein. In one aspect, the bacterium comprises a genome identified as SEQ ID NO:1 and is deposited under GenBank Accession No. CP000394. In another aspect, the bacterium comprises a 16SRNA nucleic acid that is greater than about 98% similar to the nucleic acid identified as SEQ ID NO:2. In yet another aspect, the bacterium comprises a 16SRNA nucleic acid that is greater than about 99% similar to the nucleic acid identified as SEQ ID NO:2. In one aspect, the bacterium comprises a 16SRNA nucleic acid identified as SEQ ID NO:2.

The contacting step of the disclosed method occurs at a pH of from about 5.0 to about 7.5. In one aspect, the contacting step occurs at a pH of from about 5.5 to about 6.5. The method disclosed can be carried out at a temperature from about 15° C. to about 40° C. In another aspect, the disclosed method can be carried out at a temperature from about 25° C. to about 37° C.

Further provided is a method of growing an isolated Gram-negative bacterium, designated *Granulibacter bethesdensis* and deposited under ATCC Accession No. BAA-1260, wherein the bacterium is an aerobic, facultative methylotroph that produces colonies that are yellow pigmented, wherein the bacterium can use methanol as a sole carbon source and can oxidize glucose and ethanol into acid, comprising culturing the bacterium at a temperature and on a medium effective to promote growth of the bacterium. The bacterium can grow at a temperature from about 30° C. to about 37° C. In one aspect, the bacterium can grow at a temperature from about 35° C. to about 37° C. Further, the bacterium can grow on medium wherein the pH is from about 5.0 to about 7.5. In one aspect, the pH of the medium can be from about 5.5 to about 6.5. Media are currently known that are effective in promoting growth of the disclosed bacterium. Therefore, a person of skill would know which media would be effective in promoting the growth of the novel bacterium. Examples of media on which the bacterium can grow are shown below in Example 3.

With the need for alternative sources of energy becoming of paramount importance, biofuel cells potentially offer many solutions to our power problems. Biofuel cells can utilize readily available substrates, for example glucose, ethanol, methanol, and formaldedyde and convert them into electrical energy and benign by-products. As used herein, a "biofuel cell" is a small energy storage and conversion device that can provide a remote power source exactly where it is needed and only when needed. In one aspect, a biofuel cell can comprise whole bacteria that serve as small bioreactors to produce energy. Alternatively, a person of skill can isolate the polypeptide enzymes from the bacteria and/or produce them as taught herein for use in a biofuel cell and thus obviate the need for using the live bacterium.

The electrochemical oxidation of fuels can be biocatalyzed by enzymes that communicate electrically with electrodes. There are different classes of oxidative enzymes (e.g., dehydrogenases) that can be used to establish electrical communication. *G. bethesdensis* contains many of these enzymes that alone or in combination can be used for power generation.

For example, *Granulibacter bethesdensis* can use methanol as a sole carbon source in a biofuel cell. In such an enzymatic fuel cell, an anode chamber contains an enzyme (polypeptide) or combination of enzymes, a substrate, for example, methanol, and a mediator. An enzyme, or combination of enzymes, can oxidize the substrate and release electrons to the anode using the mediator.

In one aspect, a biofuel cell utilizes the nicotinamide redox co-factors NAD+ and NADP+. These cofoactors play important roles in biological electron transport. They are carriers of electrons and can activate the biocatalytic functions of dehydrogenases. For example, a methanol biofuel cell uses enzymes in the conversion of methanol into carbon dioxide using the NAD+-dependent alcohol dehydrogenase, an aldehyde dehydrogenase and formate dehydrogenase. All of these enzymes are in *Granulibacter bethesdensis*. When these enzymes are coupled with an enzyme diaphorase, NADH is oxidized to NAD+ using an electron acceptor which is present in the anode. The biocatalytic anode is then conjugated with an oxygen-containing cathode to complete the biofuel cell.

Other mediators of oxidation can be used such as pyrroloquinoline quinone (PQQ) in a biofuel cell. For example, one of the main enzymes used by *G. bethesdensis* to convert methanol into formaldehyde is methanol dehydrogenase, a PQQ-dependent enzyme that can be used in an enzymatic fuel cell. In one aspect, key enzymes involved in oxidative pathways can be immobilized onto membranes which contact an organic substrate, for example methanol, formaldehyde, or ethanol, to produce energy. Examples of materials known in the art for use in making such membranes include, but are not limited to, graphite and polymers, for example nafion.

Therefore, provided is a biofuel cell, comprising a cathode, an anode, a conductive medium, an ion exchange membrane interposed between the cathode and the anode, and a bacterial catalyst around the anode, wherein the bacterial catalyst comprises an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid. An example of the bacterium is *Granulibacter bethesdensis*, having the ATCC patent deposit designation BAA-1260. Exemplary uses for a biofuel cell include, but are not limited to, uses in cell phones, computers (e.g., laptops), remote sensors, or in-body implants such as pacemakers, medical sensing, or drug dispersal devices. A miniature biofuel cell comprising the disclosed bacterium can convert stored energy in organic materials to electrical energy and power.

In another aspect, provided is a method of converting chemical energy in an organic material into electrical energy comprising contacting the organic material with an effective amount of a bacterial catalyst comprising an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid. In one aspect, the method can be carried out by a bacterium designated *Granulibacter bethesdensis*, having the ATCC patent deposit designation BAA-1260.

EXPERIMENTAL

The following examples are put forth so as to provide those of ordinary skill in the art with a complete disclosure and description of how the compounds, compositions, articles, devices and/or methods claimed herein are made and evaluated, and are intended to be purely exemplary of the invention and are not intended to limit the scope of what the inventors regard as their invention. Efforts have been made to ensure accuracy with respect to numbers (e.g., amounts, temperature, etc.), but some errors and deviations should be accounted for. Unless indicated otherwise, parts are parts by weight, temperature is in ° C. or is at ambient temperature, and pressure is at or near atmospheric.

Example 1

Microbiology

The growth of the isolate was assessed on various media under different incubation conditions. The organism grew best at 35° C. on *Acetobacter* Medium [20] with the following modifications: glucose (50.0 g/L), CaCO3 (12.5 g/L), autolyzed yeast (5.0 g/L), agar.(15.0 g/L). Colonies growing on this modified *Acetobacter* Medium developed a yellow color after 5 days. Good growth after 4-5 days of incubation was also obtained on BCYE agar and on tryptic soy agar (TSA) with sheep blood (Remel). Growth was not improved in a CO2 atmosphere.

Commercial biochemical kits, supplementary phenotypic tests and sequencing were used to identify the isolate. Commercial kits used included the API 20 NE (BioMerieux, Durham, N.C.) and the RapID NH (Remel, Lenexa, Kans.). Additional phenotypic tests included oxidase, catalase, oxidative-fermentative (OF) medium with different sugars (OF medium King, Remel), lysine and ornithine decarboxylases, arginine dihydrolase, urease test (Rapid Urea Slant, Hardy Diagnostics), and motility. Susceptibility testing was performed on TSA with sheep blood by the E-test (Amersham Biosciences Biodisk, Piscataway, N.J.). Sequencing and phylogenetic analysis. The full 16S rRNA gene was sequenced using the MicroSeq Full Gene 16S rRNA Bacterial Isolation Sequencing Kit (Applied Biosystems, Foster City, Calif.), according to the manufacturer's protocol, and sequences were analyzed using the 3100 Genetic Analyzer (Applied Biosystems). The Lasergene program (version 5.51; DNASTAR, Inc. Madison, Wis.) was used for sequence assembly and alignment. The assembled 16S rDNA sequence from the patient isolate was compared with 16S rDNA sequences available in GenBank databases using the standard nucleotide-nucleotide Basic Local Alignment Search Tool (Blastn) program (National Center for Biotechnology Information, Bethesda, Md.). Multiple sequence alignments of the 16S rRNA gene sequences from the isolate and the closest GenBank matches were done by the CLUSTAL W method.

Phylogenetic analyses were performed with the PHYLIP version 3.5c package [21]. Distance matrices based on Kimura's two-parameter model were produced with DNADIST program, and a neighbor-joining tree constructed with the NEIGHBOR program. The resulting unrooted tree was depicted using the TreeView version 1.4 package [22].

The 16S rDNA sequence from this novel gram-negative rod was deposited in GenBank under accession number AY788950.

Immunology Studies

Preparation of Protein Extracts, SDS Gel Electrophoresis, and Western-Blot Analysis. Bacterial cells were pelleted by centrifugation and extracted with the Pierce (Rockford, Ill.) bacterial protein extraction reagent. Protein concentrations were determined using the Pierce protein assay. 2 µg of total protein per lane were electrophoresed on 10% SDS-PAGE, and the separated proteins transferred to PVDF membrane (Invitrogen Life Technologies, Carlsbad, Calif.). The membrane was blocked in TBS buffer containing 5% non-fat dried milk and 0.05% Tween-20 before incubation with human or mouse serum (1:100 to 1:100,000 dilution). After 3 washes, the membrane was incubated with horseradish peroxidase conjugated goat anti-human or goat anti-mouse IgG (1:10000 to 1:20000; Amersham Biosciences). The blots were developed using the enhanced chemiluminescence kit (ECL Plus; Amersham Biosciences) as described by the manufacturer.

Example 2

To characterize the novel organism, a polyphasic taxonomic approach was taken, using phenotypic data in the form of biochemical tests and a multilocus DNA sequence analysis for phylogenetic reconstruction. For the multilocus approach, (1) the 16S rRNA gene, (2) the Internal Transcribed Spacer (ITS) region and (3) the RecA protein were studied. The first two loci have been used extensively in the phylogenetic analysis of the Acetobacteraceae [47, 43, 40, 39], while the RecA protein has been described as a model molecule for systematic studies between related species in the alpha-proteobacteria, generally producing results congruent with those obtained from 16S data [30]. The results of the study indicate that the bacterium is most appropriately placed in a new genus within the acetic acid bacteria.

Phenotypic Analysis

Phenotypic identification was initially attempted with commercial biochemical kits and supplementary phenotypic tests routinely used in clinical microbiology. Kits included the API 20 NE (BioMerieux, Durham, N.C.) and the RapID NH (Remel, Lenexa, Kans.), neither of which yielded an identification. Supplementary phenotypic tests included oxidase, catalase, oxidative-fermentative (OF) medium with either glucose, lactose, mannitol, sucrose, maltose or xylose (OF medium King, Remel), lysine and ornithine decarboxylases (Remel), arginine dihydrolase (Remel), urease (Rapid Urea Slant, Hardy Diagnostics), and motility (Motility Test Medium, Hardy Diagnostics). Growth on methanol as a sole carbon source was performed on medium 569 [45]. Additional tests used for the acetic acid bacteria (Table 1) as well morphological and physiological characterization were carried out as previously described [44, 25]. Cellular fatty acid analysis was performed as described elsewhere [49].

DNA Isolation and Sequencing

DNA was isolated from using the NucliSens kit (bioMerieux, USA). The 16S gene was initially PCR-amplified and sequenced using the MicroSeq Full Gene 16S rRNA Bacterial Isolation Sequencing Kit (Applied Biosystems, Foster City, Calif.), according to the manufacturer's protocol. Sequences were analyzed using the 3100 Genetic Analyzer (Applied Biosystems). The Lasergene program (version 5.51; DNASTAR, Inc. Madison, Wis.) was used for sequence assembly and alignment. 16S rDNA sequences from the isolates were compared with 16S rDNA sequences available in GenBank/EMBL/DDBJ databases. Preliminary whole genome sequencing efforts for G. bethesdensis were performed by methods used for several other bacteria [29, 37, 35]. The 16S rRNA gene, the ITS region, and the RecA protein encoding gene were collected by Blast searching the preliminary genome assembly.

Phylogenetic Analysis

Nucleotide and deduced amino acid sequences for targeted genes were initially analyzed with MacVector version 6.0/7.0 software package (Oxford Molecular, Beaverton, Oregon). DNA sequences were first aligned with the ClustalW program in the Lasergene software package (DNASTAR, Madison, Wisc.). Alignments for the 16S rRNA gene, ITS region and the RecA sequences were performed following standard procedures provided by the manufacturer (DNASTAR, Madison, Wisc.). The alignments were transferred into the MacClade program (Maddison, D. R. and W. P. Maddison, 2003. MacClade 4: Analysis of phylogeny and character evolution. Version 4.06. Sinauer Associates, Sunderland, Mass.) for removal of insertions/deletions (indels), sequence errors, equalizing sequence lengths and manual correction of the alignments. MacClade output files were opened in PAUP (Swofford, D. L. 1998. PAUP*. Phylogenetic analysis using parsimony (*and other methods). Version 4. Sinauer Associates, Sunderland, Mass.) with an 'include all' line command. For the 16S rRNA gene, ITS region, and RecA protein, maximum likelihood neighbor-joining trees were created with a paraphyletic outgroup. The robustness of clade designations was tested with a full heuristic search and 1000 bootstrap replicates.

Nucleotide Sequence Accession Numbers

Nucleotide sequences for the 16S rRNA gene, ITS region and recA gene for G. bethesdensis have been deposited in the GenBank database under the following accession numbers: AY788950, DQ340304 and DQ340305, respectively. The nucleotide sequence for the Rhodospirillum rubrum ITS region was obtained from the R. rubrum genome project of the US Department of Energy Joint Genome Institute.

Results

Phenotypic Analysis

Isolates of this bacterium were obtained from lymph node cultures of a subject with CGD. The organism was a Gram-negative coccobacillus to rod, and obligately aerobic. On initial isolation from the subject, colonies were visible after 4-6 days of incubation on buffered charcoal yeast extract (3CYE) agar, Sabouraud dextrose agar, inhibitory mold agar and Middlebrook 7H11 agar incubated in either ambient air at 30° C. or 7% CO2 at 35° C. A second isolate grew after two weeks in a commercial broth used for the isolation of mycobacteria (BD Bactec MGIT 960, Becton, Dickinson and Company, Sparks, Maryland). A third isolate grew after five days on BCYE agar.

As part of the characterization of this novel bacterium, different media commercially available and made in the laboratory were evaluated. The organism grew optimally on a modified glucose-yeast extract-CaCO3 *Acetobacter* medium (Atlas, R. M., 1993) containing: glucose (50.0 g/L), CaCO3 (12.5 g/L), autolyzed yeast (5.0 g/L), and agar (15.0 g/L). Colonies on this medium were convex, entire and smooth and produced a yellow non-diffusible pigment. The organism grew in a temperature range of 25-37° C. within four days, with an optimal temperature of 35-37° C. There was no growth at 42° C. Optimal pH range for growth was 5.0-6.5.

The organism was non-motile, catalase-positive and oxidase-negative. Lysine and ornithine decarboxylases and arginine dihydrolase were all negative. Urease was positive for two isolates, and weak or negative for the third isolate; there was weak acid production from glucose but no acid production from lactose, mannitol, sucrose, maltose or xylose. The bacterium grew on glutamate and mannitol agars. It oxidized lactate and acetate to carbon dioxide and water, but the activity of the latter was weak. For testing ketogenic activity on glycerol (dihydroxyacetone production), glucose 1 g/l was added to the glycerol medium because the organism failed to grow on the medium described by Shimwell et al. 1960. The bacterium did not produce dihydroxyacetone from glycerol. The organism grew on methanol as a sole carbon source. It generated acetic acid poorly on ethanol-CaCO3 agar (with 2% CaCO3) [25]. Acetic acid production was more evident on modified ethanol-CaCO3 agar plates containing lower concentrations of CaCO3. The results of these and additional biochemical tests are summarized in Table 1.

The major fatty acids of the bacterium were a straight-chain unsaturated acid (18:1w7c) and C16:0, which accounted for 50 and 17% of the total cellular fatty acids, respectively. Other fatty acids identified were C19:0cyc11-12 (10%), and smaller amounts of 2-OH C14:0, sum of 3-OH C14:0 and/or i-C16:1I, 3-OH C16:0, C17:0, C17:1w6c, C18:0, 2-OH C18:1, 2-OH C16:0, C16:1w7c, and 3-OH C18:0.

Multi-Locus DNA Sequence Analysis 16S rRNA Gene

A multilocus approach was used for the phylogenetic characterization of the novel bacterium. During genome sequencing efforts, 3 homologous 16S-23S rRNA gene loci were discovered. The 16S rRNA gene is 1482 bases in length and identical at all three loci. Blast searches indicated that the 16S rRNA gene sequence was most similar to sequences of other organisms in the family Acetobacteraceae. Because 16S rRNA gene sequences are of varying lengths in the database, ClustalW alignments were used to identify a conserved, common, internal 1401 base pair region, among multiple representatives of the Acetobacteraceae. This region spanned positions 33 to 1434 of the 16S rRNA gene of the novel bacterium. Sixteen 16S gene sequences of representative taxa or type strains within the family Acetobacteraceae were collected from NCBI and the resulting phylogenetic tree is shown in FIG. 1. Multiple iterations of 16S analyses were performed with many different species and strains of the Acetobacteraceae with no strains homologous to the novel bacterium detected. Phylogenetic groupings of representatives of the *Acetobacter, Gluconobacter, Gluconacetobacter, Acidomonas, Asaia* and *Kozakia* genera, as seen in FIG. 1 are similar to what has previously been published [47, 52, 53]. The 16S rRNA gene sequence of the novel organism groups within the Acetobacteraceae family, while branch length and positioning indicates that it warrants separate genus-level status (FIG. 1). Percent identity values for our bacterium compared with representative members of the Acetobacteraceae from 95.6% with *Gluconacetobacter* liquefaciens to 86.2% with *Stella humosa* (Table 2).

ITS Region

Phylogenetic analysis has been performed on *Gluconobacter* using both the 16S rRNA gene sequence and the internal transcribed spacer (ITS) region for comparison [47] and on ITS alone [52, 53]. The ITS sequence of our bacterium is 776 bases in length and identical at all three ribosomal loci. Given the variant lengths of ITS sequences in the database, a conserved internal 752 base-pair region from the ITS sequence of the novel organism, spanning base positions 24 to 776, was chosen for further phylogenetic analysis. Similar regions from 14 representative taxa (including eight type strains), with a focus on the acetic acid bacteria, were collected from GeneBank for analysis. The resulting phylogenetic tree is shown in FIG. 1. The grouping and associations seen in FIG. 1 for the *Acetobacter, Gluconobacter* and *Gluconoacetobacter* species are compatible with previously published results for the ITS region of these species [47, 52, 53]. In addition, the ITS sequence of the novel organism demonstrates distances from these species that were apparent in the genus-level analysis. The results confirm that the ITS region in the Acetobacteraceae is well suited to comparative analysis with the 16S rRNA gene, as previously demonstrated [47, 52, 53]. Branch length (substitutions/site) and branching pattern indicate that the organism should be classified in a separate genus within the family Acetobacteraceae. Percent similarity values of the ITS region of the isolate ranged from 56.2% with *Acetobacter aceti* to 45.1% with *R. rubrum*.

RecA Protein

The RecA protein, in addition to the 16S rRNA gene and the ITS region, has been used in multilocus sequence analysis for taxonomic studies of novel bacterial isolates [30]. The recA gene sequences are the only protein encoding gene sequences that are publicly available in databases for organisms in the genera *Acetobacter, Gluconobacter* and *Gluconoacetobacter*. While a protein-encoding locus such as TecA is subject to different functional selective pressures than the 16S rRNA gene or ITS sequences [38], recA is considered a conserved gene and is suitable for multilocus phylogenetic analyses [38]. The recA gene of the novel isolate is 1053 bases in length and translates into 351 amino acids. Most Acetobacteraceae recA genes or proteins in the database are partial sequences; therefore, 152 amino acids encoded in 456 conserved nucleotides, spanning residues 407 to 863 in the recA gene of our organism, were studied. The results for 12 RecA sequences, including those for 6 type strains, with a focus again on the acetic bacteria were similar to what was seen for the ITS and 16S regions. Branching pattern and length again suggest separate genus-level status for the novel organism within the family Acetobacteraceae. DNA similarities for the recA gene of the novel organism ranged from 80.6% with *Acetobacter estunensis* to 71.4% for

*Rhodobacter sphaeroides*, while RecA protein similarities ranged from 90.8% with *Acetobacter orleanensis* to 75.0% with *R. sphaeroides*.

Example 3

Media on Which the Novel Bacterium Grows

Medium #1

| Medium 569 (Methanol minimal agar) | |
|---|---|
| KNO3 | 1.0 g |
| MgSO4•7H2O | 0.2 g |
| CaCl2•2H2O | 0.02 g |
| Na2HPO4 | 0.23 g |
| NaH2PO4 | 0.07 g |
| FeSO4•7H2O | 1.0 mg |
| CuSO4•5H2O | 5.0 mg |
| H3BO3 | 10.0 mg |
| MnSO4•5H2O | 10.0 mg |
| ZnSO4•7H2O | 70 mg |
| MoO3 | 10.0 mg |
| Agar | 15.0 g |
| Distilled water | 990 ml |
| Methanol | 10 ml |

Medium #2

The organism grew optimally on a modified glucose-yeast extract-CaCO3 *Acetobacter* medium (Atlas, R. M., 1993) containing: glucose (50.0 g/L), CaCO3 (12.5 g/L), autolyzed yeast (5.0 g/L), and agar (15.0 g/L).

References

1. Segal B H, Leto T L, Gallin J I, Malech H L, Holland S M (2000) Genetic, biochemical, and clinical features of chronic granulomatous disease. Medicine (Baltimore) 79: 170-200.
2. Winkelstein J A, Marino M C, Johnston R B, Jr., Boyle J, Curnutte J, et al. (2000) Chronic granulomatous disease. Report on a national registry of 368 patients. Medicine (Baltimore) 79: 155-169.
3. Dorman S E, Guide S V, Conville P S, DeCarlo E S, Malech H L, et al. (2002) *Nocardia* infection in chronic granulomatous disease. Clin Infect Dis 35: 390-394.
4. Guide S V, Stock F, Gill V J, Anderson V L, Malech H L, et al. (2003) Reinfection, rather than persistent infection, in patients with chronic granulomatous disease. J Infect Dis 187: 845-853.
5. Sereti I, Holland S M (2001) Disseminated nocardiosis in a patient with X-linked chronic granulomatous disease and human immunodeficiency virus infection. Clin Infect Dis 33: 235-239.
6. Speert D P, Bond M, Woodman R C, Curnutte J T (1994) Infection with *Pseudomonas cepacia* in chronic granulomatous disease: role of nonoxidative killing by neutrophils in host defense. J Infect Dis 170: 1524-1531.
7. Lekstrom-Himes J A, Holland S M, DeCarlo E S, Miller J, Leitman S F, et al. (1994) Treatment with intralesional granulocyte instillations and interferon-gamma for a patient with chronic granulomatous disease and multiple hepatic abscesses. Clin Infect Dis 19: 770-773.
8. Koch R (1882) Die Atiologie der Tuberkulose. Berliner Klinische Wochenschrift 19: 221-230.
9. Stackebrandt E (2003) The Richness of Prokaryotic Diversity: There Must Be a Species Somewhere. Food Technol Biotechnol 41: 17-22.
10. Poblet M, Rozes N, Guillamon J M, Mas A (2000) Identification of acetic acid bacteria by restriction fragment length polymorphism analysis of a PCR-amplified fragment of the gene coding for 16S rRNA. Lett Appl Microbiol 31: 63-67.
11. Lisdiyanti P, Kawasaki H, Seki T, Yamada Y, Uchimura T, et al. (2001) Identification of *Acetobacter* strains isolated from Indonesian sources, and proposals of *Acetobacter syzygii* sp. nov., *Acetobacter cibinongensis* sp. nov., and *Acetobacter orientalis* sp. nov. J Gen Appl Microbiol 47: 119-131.
12. Seearunruangchai A, Tanasupawat S, Keeratipibul S, Thawai C, Itoh T, et al. (2004) Identification of acetic acid bacteria isolated from fruits collected in Thailand. J Gen Appl Microbiol 50: 47-53.
13. Yamada Y, Hosono R, Lisdyanti P, Widyastuti Y, Saono S, et al. (1999) Identification of acetic acid bacteria isolated from Indonesian sources, especially of isolates classified in the genus *Gluconobacter*. J Gen Appl Microbiol 45: 23-28.
14. Sievers M, Schlegel H G, Caballero-Mellado J, Dobereiner J, Ludwig W (1998) Phylogenetic identification of two major nitrogen-fixing bacteria associated with sugarcane. Syst Appl Microbiol 21: 505-508.
15. Bartowsky E J, Xia D, Gibson R L, Fleet G H, Henschke P A (2003) Spoilage of bottled red wine by acetic acid bacteria. Lett Appl Microbiol 36: 307-314.
16. Gonzalez A, Hierro N, Poblet M, Rozes N, Mas A, et al. (2004) Application of molecular methods for the differentiation of acetic acid bacteria in a red wine fermentation. J Appl Microbiol 96: 853-860.
17. Sokollek S J, Hertel C, Hammes W P (1998) Description of *Acetobacter oboediens* sp. nov. and *Acetobacter pomorum* sp. nov., two new species isolated from industrial vinegar fermentations. Int J Syst Bacteriol 48 Pt 3: 935-940.
18. Nanda K, Taniguchi M, Ujike S, Ishihara N, Mori H, et al. (2001) Characterization of acetic acid bacteria in traditional acetic acid fermentation of rice vinegar (komesu) and unpolished rice vinegar (kurosu) produced in Japan. Appl Environ Microbiol 67: 986-990.
19. Snyder R W, Ruhe J, Kobrin S, Wasswestein A, Doline C, et al. (2004) Asaia bogorensis peritonitis identified by 16S ribosomal RNA sequence analysis in a patient receiving peritoneal dialysis. Am J Kid Dis 44:E15-E17.
20. Atlas R M (1993) Handbook of Microbiological Media. Boca Raton: CRC Press.
21. Felsenstein J (1993) PHYLIP (Phylogeny Inference Package). 3.5c ed.
22. Page R (1996) Tree View: an application to display phylogenetic trees on personal computers. Comput Appl Biosci 12: 357-358.
23. Jackson S H, Gallin J I, Holland S M (1995) The p47phox mouse knock-out model of chronic granulomatous disease. J Exp Med 182: 751-758.
24. Pollock J D, Williams D A, Gifford M A, Li L L, Du X, et al. (1995) Mouse model of X-linked chronic granulomatous disease, an inherited defect in phagocyte superoxide production. Nat Genet 9: 202-209.
25. Asai, T., Iizuka, H. and Komagata, K. (1964). The flagellation and taxonomy of genera *Gluconobacter* and *Acetobacter* with reference to the existence of intermediate strains, J Gen Appl Microbiol 10, 95-126.
26. Bartual, S. G., Seifert, H., Hippler, C., Luzon, M. A., Wisplinghoff, H. and Rodriguez-Valera, F. (2005). Development of a multilocus sequence typing scheme for characterization of clinical isolates of *Acinetobacter baumannii*, J Clin Microbiol 43, 4382-4390.

27. Boesch, C., Trcek, J., Sievers, M. and Teuber, M. (1998). *Acetobacter intermedius*, sp. nov, Syst Appl Microbiol 21, 220-229.
28. Cleenwerck, I., Vandemeulebroecke, K., Janssens, D., Swings, J. (2002). Re-examination of the genus *Acetobacter*, with descriptions of *Acetobacter cerevisiae* sp. nov. and *Acetobacter malorum* sp. nov, Int J Syst Evol Microbiol 52, 1551-1558.
29. DelVecchio, V. G., Kapatral, V., Redkar, R. J., Patra, G., Mujer, C., Los, T., Ivanova, N., Anderson, I., Bhattacharyya, A., Lykidis, A., Reznik, G., Jablonski, L., Larsen, N., D'Souza, M., Bernal, A., Mazur, M., Goltsman, E., Selkov, E., Elzer, P. H., Hagius, S., O'Callaghan, D., Letesson, J. J., Haselkom, R., Kyrpides, N. and Overbeek, R. (2002). The genome sequence of the facultative intracellular pathogen *Brucella melitensis*, Proc Natl Acad Sci USA 99, 443-448.
30. Eisen, J. A. (1995). The RecA protein as a model molecule for molecular systematic studies of bacteria: comparison of trees of RecAs and 16S rRNAs from the same species, J Mol Evol 41, 1105-1123.
31. Franke, I. H., Fegan, M., Hayward, C., Leonard, G., Stackebrandt, E. and Sly, L. I. (1999). Description of *Gluconacetobacter sacchari* sp. nov., a new species of acetic acid bacterium isolated from the leaf sheath of sugar cane and from the pink sugar-cane mealy bug, Int J Syst Bacteriol 49 Pt 4, 1681-1693.
32. Garcia-Martinez, J., Acinas, S. G., Anton, A. I. and Rodriguez-Valera, F. (1999). Use of the 16S-23S ribosomal genes spacer region in studies of Prokaryotic diversity, J Microbiol Methods 36, 54-64.
33. Gevers, D., Cohan, F. M., Lawrence, J. G., Spratt, B. G., Coenye, T., Feil, E. J., Stackebrandt, E., Van de Peer, Y., Vandamme, P., Thompson, F. L. and Swings, J. (2005). Opinion: Re-evaluating prokaryotic species, Nat Rev Microbiol 3, 733-739.
34. Greenberg, D. E., Ding, L., Zelazny, A. M., Stock, F., Wong, A., Anderson, V. L., Miller, G., Kleiner, D. E., Tenorio, A. R., Brinster, L., Dorward, D. W., Murray, P. R. and Holland, S. M. A novel bacterium associated with lymphadenitis in a patient with chronic granulomatous disease, PloS Pathogens (in press).
35. Ivanova, N., Sorokin, A., Anderson, I., Galleron, N., Candelon, B., Kapatral, V., Bhattacharyya, A., Reznik, G., Mikhailova, N., Lapidus, A., Chu, L., Mazur, M., Goltsman, E., Larsen, N., D'Souza, M., Walunas, T., Grechkin, Y., Pusch, G., Haselkorn, R., Fonstein, M., Ehrlich, S. D., Overbeek, R. and Kyrpides, N. (2003). Genome sequence of *Bacillus cereus* and comparative analysis with *Bacillus anthracis*, Nature 423, 87-91.
36. Jojima, Y., Mihara, Y., Suzuki, S., Yokozeki, K., Yamanaka, S. and Fudou, R. (2004). *Saccharibacter floricola* gen. nov., sp. nov., a novel osmophilic acetic acid bacterium isolated from pollen, Int J Syst Evol Microbiol 54, 2263-2267.
37. Kapatral, V., Anderson, I., Ivanova, N., Reznik, G., Los, T., Lykidis, A., Bhattacharyya, A., Bartman, A., Gardner, W., Grechkin, G., Zhu, L., Vasieva, O., Chu, L., Kogan, Y., Chaga, O., Goltsman, E., Benal, A., Larsen, N., D'Souza, M., Walunas, T., Pusch, G., Haselkorn, R., Fonstein, M., Kyrpides, N. and Overbeek, R. (2002). Genome sequence and analysis of the oral bacterium *Fusobacterium nucleatum* strain ATCC 25586, J Bacteriol 184, 2005-2018.
38. Liiv, A., Tenson, T., Margus, T. and Remme, J. (1998). Multiple functions of the transcribed spacers in ribosomal RNA operons, Biol Chem 379, 783-793.
39. Lisdiyanti, P., Kawasaki, H., Seki, T., Yamada, Y., Uchimura, T., Komagata, K. (2000). Systematic study of the genus *Acetobacter* with descriptions of *Acetobacter indonesiensis* sp. nov., *Acetobacter tropicalis* sp. nov., *Acetobacter orleanensis* (Henneberg 1906) comb. nov., *Acetobacter lovaniensis* (Frateur 1950) comb. nov., and *Acetobacter estunensis* (Carr 1958) comb. nov, J Gen Appl Microbiol 46, 147-165.
40. Lisdiyanti, P., Kawasaki, H., Widyastuti, Y., Saono, S., Seki, T., Yamada, Y., Uchimura, T. and Komagata, K. (2002). *Kozakia baliensis* gen. nov., sp. nov., a novel acetic acid bacterium in the alpha-proteobacteria, Int I Syst Evol Microbiol 52, 813-818.
41. Ludwig, W., Strunk, O., Klugbauer, S., Klugbauer, N., Weizenegger, M., Neumaier, J., Bachleitner, M. and Schleifer, K. H. (1998). Bacterial phylogeny based on comparative sequence analysis, Electrophoresis 19, 554-568.
42. Owen, R. J. (2004). Bacterial Taxonomics: Finding the Wood Through the Phylogenetic Trees. In Genomics, Proteomics, and Clinical Bacteriology: Methods and Reviews, pp. 353-384. Edited by Neil Woodford and Alan P. Johnson London, UK: Humana Press.
43. Ruiz, A., Poblet, M., Mas, A., Guillamon, J. M. (2000). Identification of acetic acid bacteria by RFLP of PCR-amplified 16S rDNA and 16S-23S rDNA intergenic spacer, Int J Syst Evol Microbiol 50, 1981-1987.
44. Shimwell, J. L., Carr, J. G. and Rhodes, M. E. (1960). Differentiation of *Acetomonas* and *Pseudomonas*., J Gen Microbiol 23, 283-286.
45. Sievers, M., Swings, J. (2005). Family Acetobacteraceae. Genus *Acidomonas*. In Bergey's Manual of Systematic Bacteriology, page 68. Edited by George M. Garrity. Springer.
46. Sievers, M., Gaberthuel, C., Boesch, C., Ludwig, W. and Teuber, M. (1995). Phylogenetic position of *Gluconobacter* species as a coherent cluster separated from all *Acetobacter* species on the basis of 16S ribosomal RNA sequences, FEMS Microbiol Lett 126, 123-126.
47. Tanasupawat, S., Thawai, C., Yukphan, P., Moonmangmee, D., Itoh, T., Adachi, 0. and Yamada, Y. (2004). *Gluconobacter thailandicus* sp. nov., an acetic acid bacterium in the alpha-Proteobacteria, J Gen Appl Microbiol 50, 159-167.
48. Thompson, F. L., Gevers, D., Thompson, C. C., Dawyndt, P., Naser, S., Hoste, B., Munn, C. B. and Swings, J. (2005). Phylogeny and molecular identification of vibrios on the basis of multilocus sequence analysis, Appl Environ Microbiol 71, 5107-5115.
49. Weyant, R. S., Moss, C. W., Weaver, R. E., Hollis, D. G., Jordan, J. G., Cook, E. C. and Daneshvar, M. I. (1996). Bacterial Identification by Cellular Fatty Analysis. In CDC's Identification of Unusual Pathogenic Gram-Negative and Facultatively Anaerobic Bacteria. Second ed. The Williams & Wilkins Co., Baltimore.
50. Yamada, Y., Katsura, K., Kawasaki, H., Widyastuti, Y., Saono, S., Seki, T., Uchimura, T. and Komagata, K. (2000). *Asaia bogorensis* gen. nov., sp. nov., an unusual acetic acid bacterium in the alpha-Proteobacteria, Int J Syst Evol Microbiol 50 Pt 2, 823-829.
51. Yamashita, S., Uchimura, T., Komagata, K. (2004). Emendation of the genus *Acidimonas* Urakami, Tamaoka, Suzuki and Komagata 1989, Int J syst Evol Microbiol 54, 865-70.
52. Yukphan, P., Malimas, T., Takahashi, M., Potacharoen, W., Busabun, T., Tanasupawat, S., Nakagawa, Y., Tanticharoen, M. and Yamada, Y. (2004a). Re-identification of

*Gluconobacter* strains based on restriction analysis of 16S-23S rDNA internal transcribed spacer regions, J Gen Appl Microbiol 50, 189-195.

53. Yukphan, P., Potacharoen, W., Nakagawa, Y., Tanticharoen, M. and Yamada, Y. (2004b). Identification of 5 strains assigned to the genus *Gluconobacter* Asai 1935 based on the sequence and the restriction analyses of the 16S-23S rDNA internal transcribed spacer regions, J Gen Appl Microbiol 50, 9-15.

54. Zeigler, D. R. (2003). Gene sequences useful for predicting relatedness of whole genomes in bacteria, Int J Syst Evol Microbiol 53, 1893-1900.

TABLE 1

Characteristics that differentiate *Granulibacter* gen. nov. from other genera of acetic acid bacteria

| Characteristic | 1 | 2 | 3 | 4 | 5 | 6 | 7 | 8 | 9 |
|---|---|---|---|---|---|---|---|---|---|
| Flagellation | Non-motile | Peritrichous or non-motile | Peritrichous or non-motile | Polar or non-motile | Non-motile | Non-motile | Peritrichous or non-motile | Non-motile | Non-motile |
| Pigmentation | + | − | − | + | − | − | +/− | − | + |
| Oxidation of: | | | | | | | | | |
| Acetate | W | + | + | − | W | + | W | − | W |
| Lactate | + | + | + | − | W | − | W | − | W |
| Assimilation of ammonium sulfate on glucose medium | W | W | W | − | − | − | + | − | ND |
| Growth on: | | | | | | | | | |
| Glutamate agar | + | + | + | − | − | − | + | + | + |
| Mannitol agar | W | + | W | + | + | − | + | + | + |
| Dihydroxyacetone from glycerol | − | +/− | +/− | + | + | − | +/− | W | + |
| Utilization of methanol | + | − | − | − | − | + | − | − | − |
| Acetic acid from ethanol-CaCO₃ agar: | | | | | | | | | |
| 2-0% CaCO₃ | W/− | + | + | + | + | + | − | + | + |
| 0-6% CaCO₃ | + | ND | + | + | ND | ND | ND | ND | ND |
| 0-1% CaCO₃ | + | ND | + | + | ND | ND | ND | ND | ND |
| Acid production from: | | | | | | | | | |
| Mannitol | − | +/− | − | + | − | − | +/− | W | − |
| Sorbitol | − | − | − | + | − | − | +/− | +(d) | + |
| Dulcitol | − | − | − | − | − | − | + | W | +/− |
| Glycerol | W/− | + | − | + | + | + | + | + | + |
| Ethanol | + | + | + | + | + | + | − | + | + |
| DNA G + C content (mol %) | 59 | 55-56 | 52-60 | 54-63 | 56-57 | 63-66 | 59-61 | 63·1 | 57·6-59·9 |

Genera: 1, *Granulibacter*, 2, *Gluconacetobacter*, 3, *Acetobacter*, 4, *Gluconobacter*, 5, *Kozakia*; 6, *Acidomonas*, 7, *Asaia*; 8, *Neoasaia*, 9, *Swaminathania*. Data for reference taxa were taken from Yamada et al. (2000), Lisdiyanti et al. (2002), Yamashita et al. (2004), Loganathan & Nair (2004) and Yukphan et al. (2005). +, Positive; −, negative; W, weakly positive; d, delayed; ND, not determined.

Table 2

TABLE 2

Calculated percentage similarities for 16S rRNA gene sequences for *Granulibacter bethesdensis* sp. nov. and strains of *Acetobacteraceae*

| Strain | 1 | 2 | 3 | 4 | 5 | 6 | 7 | 8 | 9 |
|---|---|---|---|---|---|---|---|---|---|
| *Acetobacter aceti* NCIMB 8621ᵀ (X74066) | | 96·4 | 94·7 | 91·4 | 91·6 | 91·7 | 87·2 | 94·3 | 95·8 | 95·3 |
| *Asaia bogorensis* NRIC 0311ᵀ (AB025928) | | | 95·8 | 92·1 | 92·5 | 92·2 | 87·8 | 94·7 | 96·5 | 95·4 |
| *Acidomonas methanolica* JCM 6891ᵀ (D30770) | | | | 91·7 | 93·0 | 90·8 | 88·8 | 94·4 | 96·3 | 94·5 |
| *Acidiphilium cryptum* ATCC 33463ᵀ (D30773) | | | | | 93·1 | 93·4 | 88·3 | 92·9 | 92·1 | 90·8 |
| *Acidisphaera rubrifaciens* JCM 10660ᵀ (D86512) | | | | | | 91·2 | 89·9 | 93·5 | 93·8 | 90·9 |
| *Acidocella facilis* ATCC 35904ᵀ (D30774) | | | | | | | 87·0 | 92·6 | 92·4 | 91·8 |
| *Craurococcus roseus* JCM 9933ᵀ (D85828) | | | | | | | | 88·9 | 88·4 | 87·3 |
| *Granulibacter bethesdensis* CGDNIHIᵀ (AY788950) | | | | | | | | | 95·4 | 93·2 |
| *Gluconacetobacter liquefaciens* NBRC 12388ᵀ (X75617) | | | | | | | | | | 93·7 |
| *Gluconobacter oxydans* NCIMB 9013ᵀ (X73820) | | | | | | | | | | |
| *Kozakia baliensis* NRIC 0488ᵀ (AB036321) | | | | | | | | | | |
| *Neoasaia chiangmaiensis* AC28ᵀ (AB208549) | | | | | | | | | | |
| *Paracraurococcus ruber* NS89ᵀ (D85827) | | | | | | | | | | |
| *Rhodopila globiformis* DSM 161ᵀ (D86513) | | | | | | | | | | |
| *Roseomonas gilardii* ATCC 49956ᵀ (AY150045) | | | | | | | | | | |
| *Roseococcus thiosulfatophilus* DSM 8511ᵀ (X72908) | | | | | | | | | | |
| *Saccharibacter floricola* DSM 15669ᵀ (AB110421) | | | | | | | | | | |
| *Stella humosa* DSM 5900ᵀ (AJ535710) | | | | | | | | | | |

| Strain | 10 | 11 | 12 | 13 | 14 | 15 | 16 | 17 | 18 |
|---|---|---|---|---|---|---|---|---|---|
| *Acetobacter aceti* NCIMB 8621ᵀ (X74066) | 96·0 | 95·1 | 88·6 | 92·3 | 89·0 | 88·2 | 93·2 | 86·3 | 96·1 |
| *Asaia bogorensis* NRIC 0311ᵀ (AB025928) | 97·5 | 97·4 | 89·7 | 93·2 | 89·8 | 89·1 | 92·8 | 86·3 | 98·8 |

TABLE 2-continued

Calculated percentage similarities for 16S rRNA gene sequences for *Granulibacter bethesdensis* sp. nov. and strains of Acetobacteraceae

| Strain | Values |
|---|---|
| *Acidomonas methanolica* JCM 6891$^T$ (D30770) | 95.5  95.8  89.6  92.8  90.1  88.7  91.6  86.1  95.2 |
| *Acidiphilium cryptum* ATCC 33463$^T$ (D30773) | 91.6  92.0  90.1  92.7  91.3  88.2  88.1  86.1  91.2 |
| *Acidisphaera rubrifaciens* JCM 10660$^T$ (D86512) | 92.7  92.5  91.2  95.1  91.1  90.1  88.0  85.6  91.8 |
| *Acidocella facilis* ATCC 35904$^T$ (D30774) | 92.4  92.4  89.2  91.8  89.0  88.3  89.8  84.7  92.4 |
| *Craurococcus roseus* JCM 9933$^T$ (D85828) | 88.2  87.9  93.8  90.8  92.9  89.1  85.0  86.0  87.1 |
| *Granulibacter bethesdensis* CGDNIHI$^T$ (AY788950) | 95.0  94.6  89.6  93.7  90.2  88.5  90.4  86.0  94.3 |
| *Gluconacetobacter liquefaciens* NBRC 12388$^T$ (X75617) | 97.2  96.4  89.8  93.8  90.1  89.6  91.9  85.8  96.0 |
| *Gluconobacter oxydans* NCIMB 9013$^T$ (X73820) | 94.8  95.6  88.7  92.1  89.6  87.6  93.8  87.0  95.4 |
| *Kozakia baliensis* NRIC 0488$^T$ (AB036321) | 97.7  89.7  93.8  89.9  88.6  92.3  85.2  97.0 |
| *Neoasaia chiangmaiensis* AC28$^T$ (AB208549) | 85.5  88.6  86.1  84.4  88.3  81.6  92.5 |
| *Paracraurococcus ruber* NS89$^T$ (D85827) | 91.6  93.7  92.2  87.4  86.4  89.4 |
| *Rhodopila globiformis* DSM 161$^T$ (D86513) | 90.9  88.7  87.9  84.9  91.7 |
| *Roseomonas gilardii* ATCC 49956$^T$ (AY150045) | 90.5  86.3  86.8  89.2 |
| *Roseococcus thiosulfatophilus* DSM 8511$^T$ (X72908) | 86.3  84.9  88.8 |
| *Saccharibacter floricola* DSM 15669$^T$ (AB110421) | 86.0  92.9 |
| *Stella humosa* DSM 5900$^T$ (AJ535710) | 85.7 |

Strains: 1, *Asaia bogorensis* NRIC 0311$^T$ (AB025928); 2, *Acidomonas methanolica* JCM 6891$^T$ (D30770); 3, *Acidiphilium cryptum* ATCC 33463$^T$ (D30773); 4, *Acidisphaera rubrifaciens* JCM 10600$^T$ (D86512); 5, *Acidocella facilis* ATCC 35904$^T$ (D30774); 6, *Craurococcus roseus* JCM 9933$^T$ (D85828); 7, *Granulibacter bethesdenis* CGDNIHI$^T$ (AY788950); 8, *Gluconacetobacter liquefaciens* NBRC 12388$^T$ (X75617); 9, *Gluconobacter oxydans* NCIMB 9013$^T$ (X73820); 10, *Kozakia baliensis* NRIC 0488$^T$ (AB056321); 11, *Neonsaia chiangmaiensis* AC28$^T$ (AB208549); 12, *Paracraurococcus ruber* NS89$^T$ (DB5827); 13, *Rhodopila globiformis* DSM 161$^T$ (D86513); 14, *Roseomonas gilardii* ATCC 49956$^T$ (AY150045); 15, *Roseococcus thiosulfatophilus* DSM 8511$^T$ (X72908); 16, *Saccharibacter floricola* DSM 15669$^T$ (AB110421); 17, *Stella humosa* DSM 5900$^T$ (AJ535710); 18, *Swaminathania salitolerans* PAS1$^T$ (AF459454).

Percent identity values for *Granulibacter bethesdensis* bacterium compared with representative members of the Acetobacteraceae ranged from 95.6% with *Gluconacetobacter liquefaciens* to 86.2% with *Stella humosa*.

TABLE 3

| Polypeptide | Most similar polypeptide in the art |
|---|---|
| SEQ ID NO: 3 | 61% similar to the IMP dehydrogenase/GMP reductase: Pyrrolo-quinolone quinone of *Rhodopseudomonas palustris* BisA53 accession ZP_00810772) |
| SEQ ID NO: 4 | 70% similar to the pyrrolo-quinoline quinone of *Bradyrhizobium* sp. BTAi1 accession ZP_00860719.1) |
| SEQ ID NO: 5 | 77% similar to the methanol dehydrogenase MxaF of *Methylobacterium nodulans* accession AAG49450) |
| SEQ ID NO: 6 | 72% similar to the pyrrolo-quinoline quinone of *Bradyrhizobium* sp. BTAi1 accession ZP_00860719) |
| SEQ ID NO: 7 | 64% similar to methanol dehydrogenase subunit 2 precursor of *Paracoccus denitrificans* accession P29898) |
| SEQ ID NO: 13 | 82% similar to the formaldehyde activating enzyme of *Methylosinus* sp. LW2 accession AAS88978) |
| SEQ ID NO: 15 | 54% similar to the methylene tetrahydromethanopterin dehydrogenase of *Hyphomicrobium zavarzinii* accession AAS86340) |
| SEQ ID NO: 17 | 62% similar to the N5N10-methenyltetrahydromethanopterin cyclohydrolase of *Methylocapsa acidiphila* accession CAJ01586) |
| SEQ ID NO: 19 | 62% similar to the formylmethannofuran-tetrahydromethanopterin formyltransferase of *Methylococcus capsulatus* str. Bath accession AAU91105) |
| SEQ ID NO: 21 | 46% similar to the formyltransferase/hydrolase complex Fhc subunit c of *Methylobacterium extorquens* accession AAC26976) |
| SEQ ID NO: 22 | 52% similar to the putative formylmethanofurane dehydrogenase, subunit of *Methylococcus capsulatus* str. Bath accession AAU91628) |
| SEQ ID NO: 23 | 32% similar to the formylmethanofuran dehydrogenase of *Nitrosococcus oceani* ATCC 19707 accession ABA56567) |
| SEQ ID NO: 27 | 62% similar to the mtdA bifunctional protein of *Methylobacterium dichloromethanicum* accession CAD13312) |
| SEQ ID NO: 29 | 64% similar to the methenyl tetrahydrofolate cyclohydrolase of *Magnetospirillum magnetotacticum* MS-1 accession ZP_00052771) |
| SEQ ID NO: 31 | 69% similar to the 10-formyltetrahydrofolate synthetase of *Sphingomonas paucimobilis* accession BAD61061) |
| SEQ ID NO: 33 | 62% similar to the NADH dehydrogenase (ubiquinone), 24 kDa subunit of *Paracoccus denitificans* PD1222 accession ZP_00631273) |
| SEQ ID NO: 34 | 74% similar to the NADH dehydrogenase (quinone) of *Bradyrhizobium* sp. BTAi1 accession ZP_00860091) |
| SEQ ID NO: 35 | 77% similar to the formate dehydrogenase alpha subunit of *Agrobacterium tumefaciens* str. C %* accession AAL45502) |
| SEQ ID NO: 36 | 46% similar to hypothetical protein Magn03005161 of *Magnetospirillum magnetotacticum* MS-1 accession ZP_00051109) |
| SEQ ID NO: 37 | 62% similar to the oxidoreductase alpha (molybdopterin) subunit of *Burkholderia vietnamiensis* G4 accession ZP_00425955) |
| SEQ ID NO: 43 | 51% similar to *Burkholderia cenocepacia* HI2424; accession ZP_00462538 |
| SEQ ID NO: 44 | 54% similar to *Burkholderia dolosa* AUO158; accession ZP_00984559 |
| SEQ ID NO: 45 | 73% similar to *Burkholderia vietnamiensis* G4 accession ZP_00421790 |
| SEQ ID NO: 49 | 59% similar to *Nostoc punctiforme* PCC 73102 accession ZP_00106887 |

TABLE 4

Amino Acid Substitutions

| Original Residue | Exemplary Substitutions |
|---|---|
| Arg | Lys |
| Asn | Gln |
| Asp | Glu |
| Cys | Ser |
| Gln | Asn |

TABLE 4-continued

Amino Acid Substitutions

| Original Residue | Exemplary Substitutions |
| --- | --- |
| Glu | Asp |
| Gly | Pro |
| His | Gln |
| Ile | Leu; Val |
| Leu | Ile; Val |
| Lys | Arg; Gln |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

Throughout this application, various publications are referenced. The disclosures of these publications in their entireties are hereby incorporated by reference into this application in order to more fully describe the state of the art to which this invention pertains.

It will be apparent to those skilled in the art that various modifications and variations can be made in the present invention without departing from the scope or spirit of the invention. Other embodiments of the invention will be apparent to those skilled in the art from consideration of the specification and practice of the invention disclosed herein. It is intended that the specification and examples be considered as exemplary only, with a true scope and spirit of the invention being indicated by the following claims.

SEQUENCE LISTING (49 sequences)

SEQ ID NO: 1 - DNA, 2708355 bp, Artificial Sequence (residues 1-1,354,178 of 2,708,355)
  Description of Artificial Sequences; note = synthetic construct
gattcatcgacaatggtgcgacagggccggccatcacaaagccgggaacaagaagatatatcagagccgggtacacagggcagaggctggatgcaagcccgccatgtgcaccattggcgttttcaccaccgccgggcagttcataaagaccttatgacccagccacgctcttcccggccagtatcatcgagaatactggcgctcatcgtctccgctgcgctgttcatggagttgatggacggaaccattctggccacggccctgcctcagatggcgcagagttttgacgttgcccccctgcaaatgagcgtggcgctgacggcttatctcctcagcctggcagtgttcatcccggcatcgggctggatggcggatcgcttcggcagtcgccggattttcatgggggccattgccttgttcgtaaccgggtcgatggtctgtggcatggcaaatgccctgccggaaatggtcatcgcccggctggtgcagggtgcgggcggggccatgatggtgccggtaggacggctgttactgttaaggaacgtgccgcgccatgagctggtctccgctattgcgtggatgactattccggccacattggggcctgtcctgggaccgcctgtcggcgggtttttgacgacatggctgtcatggcgctggattttctacatcaatctgcccatcggattgattggcatgggtcttgcggcacggttcgttcccaatgtgactgaggcagagcttcgtccgcttgatgtcaagggacttttgctttcgggaacggctctggcctctctgttatgggccatggaaacgctcggcagaggcccgtcaggcacagatggaatggctctgtccagcgccgccattctgaccctgatcggactgggcagcggatggctgtatttgcggcatagcaggactatccctcatccgatcctcaacccgatgctgatgcgtatccgtaccttccgactatcggtgttgggaggcgcgtgcagccgggtggtggcaggagccatgccgttcctgctgcccatgacgatgcaactcggcatgggcatgagtgctgctgaaagtggatcactgacctttgtcggggctgccggctcactgttgatccggccatgggccgccggaattttacgccgtttcggtttccggcgcgtgatgatctggaatggcgccctgtccagtacggccgtgttgctctgtgcgacatttcagccatcctggccgcatggatggttttttctggtactggctccggccgggctgtttcaggcgcttcagttcattgcctacaataccatcgcctatgctgatgtcccgcgtgaacggatgagcgaggccaccagcttctacacgacgtttcagcagatgacgctgtcggctggtatttgtattgccggtatctccgtcagtctctccatgcttgcagggccccgtacgcagcccgatatgactgatttcgcaaccggcttcgtgaccattgccactatttcggcactggccattctctgcgcatcccggctcaacagcacggatgggcaagatctgagtagaaaagcctgaccttgcccggcccgtttcagattgttctgatcaggttcaacaattcggccacatgctccggcggtgtctgcggtacaatgccgtggccgagattgaagatatgcggatgtcccgccatagcctgacgaatcgaggatacttcccgcctcatggcctctccacccgcgcgtaaagccaggggatcgagattgccttgcagcgctatttccgcaggcaccattttgcgcgccatggccggatcaacggaggtatccattccaaccgcattgaccccggtttctgaagcataattctgtagcaatgtgccagccaaccttggaaaaccgatcaccggcaccgatggatgacgcgctttcagcgctgcagtgatctggcgtgccggtgcagttacccaacgggcaaaactgagcggagacagtaaaccggcccagctgtcgaacagcatcagcacttccgcccctgcttcgacctgtgctgacagataggtgatggttgcttctgtcaggcgggcgatcagacggtcaaaagcctcgggatttgtgtaggcgaaatgccgggtgcgggggaattccttggcgccccctccatcgaccatgtagcaggagacggtaaacggagcgccggcaaacccgatcagcgtcgtttctggatgaagctgctgaagctgttcgcgaacccgtgtgacggtttccataatcggagcaatccgcgggatcagctggctgaaatcgagccggtcgatatccgcttcttcaagtttcggcagtacggggccttcaccctcggcaaaatgcagcccgtagcccaaagcccatggcaacatcagaatatcgctgaacagaatggctgcatccattccgaaacggcgaataggttgcagggttacttccgctgcccattcgggatgggtggcaagaccgaggaagctgcctgcttttgctctgacctcccgatattcgggcagataccgacctgcctgacgcatcagccagacgggaggaacggggagtgcttcaccacggagcacgcgcaggatcggtttgttcataagacctgcttaaaaaggataaagaagaaaaggaaaagggaggggaatagatagaaccctgtggataacgtggtacccggaatccggattttactacgtactttatccacaccgaaagatgcagataagtaactgatagataaagtgaaacagcatttatccagaaaacttttcacatgggtgtacgattcatgcccagtacccgtgattcgtgagtttgtccccttgtttcggtacgcatggtttgcgaccttggtggaaagaggggttatccccggtactacggtaattcactaaggtgattcaggaccgcgccttccggaagtcagcacattgctgaaggatgggcgggagacaggaaaatggattcgggtcatgaccgcacatcgcatgaatctgcatctggtctccgatgccaccggagaaacgctcaattccatagcgcgggccactgtctcccagttcgagcatgcccagatcatctatcatcgctggtccctgatccgaacccgttttcagcttcatcgtgtccttgaggggatcgaggctgaacccggtcctgtcctgtcaacgctgatagagccgggattgcgcagtgagctggagaatttctgttcccggatcgggattgcggtggtgcatgtgctggatccggttctgtccctgctgcaacaccatatcggggaacaggcaatagcccgacccggtcgtcagtatgtgctggatgccgattattttcgccggatcgatgccatgcatttcgtgttggcgcatgatgatggccaggctcaggtcgggatcaatgaggccgatctgtgtctggtcggggtatcacgctcctctaaaacgccgacctcgttctatcttgccaatcgtggcgtcaaggcagccaatattccgcttgttcccggcttgccggaaccgcccggtctggaagcgcccattgtacccgtgattggcctgaccatcgatccggaagccctgatcgaaattcgccgccaccggctcaaactgatcggtggccagccgaatgtgcagcagaataccgcttatgttgatctggagtccgtcaaggccgaactgatctgggcgcggcgtctctgtgcgcggaaaggctggccggtgattgatgtcaccagacgttcgatcgaggaaacggcggccactgtgctgcaactggtggaggcatggcatgagcggcggcggtccttgcctcccggtggttagccgcgccatagccggatccttcatcgtcaggacggagccatgccatgaagcttattcttgccagcgcctcttctgcccggcggtccatgctcgaacaggctggaattgatgccgaaagcatcccggctgctgttgatgaagatatggtaaagcaatccatgcgggctgaaggcgcttctgctgcggagacggcgacagctttggcccatctgaaggctgaacggatttcgcggcgttatccggattctgtggtcatcgggtccgatcagctgctggtctgtgaaggtgcatggttcgacaaggcccccgatctggaaagggcgcgcgcccggttgctggattttcgggggagggcgcatcatctcgtcacctcggtggtctgtgcgaaagggggcagccgtctctggcatcacgtcgagacgccctgcctgcatatgcgccgcttcagcgaggatttcctgaaccggtatctggcacaggagggggaggcactgctgggcagtgtcgggtgctatcggctggaaggaccgggtatccagttgttcgatcgtatcgagggtgattatttttccattcttggcatgcctttgctgcccttgctgggctttctgcggcagcatcaggctttgacggtataggaggaaaccagggagtcctcagggtttcccttgtcaagaaaacggctgtgaggaatacagccgttcatgaccgacagcatcaccgatctccagagcgatcagcgcccggaccgttcctatgactttgccagcgccgaacggcgctggcagttggcctggaccgagcgggcctgctttaccgttcctgatgtgcctgatccgggcgccagaacctattatgtccttgaaatgttcccgtatcccagtgggcagatccatatggggcatgtgcgtaattatacgcttggggatgtggtggcacgttacaagcgtgctcagggctatcaggtgttgcatcccatgggatgggatgcgttcggattgccggccgagaatgcggcacgggaacgcggtgtgcatccggggcaatggacctggaacaatattgccgccatgcgcggtgaattgcagcgcatgggtctgtccatcacctgggaacgcgaattcgccacctgtgacccttcctattatggccatcagcaggctctgtttctcgatttcctgaaaaaaaatctggtggagcgccgggagagctgggtcaactgggatccggttgatgaaaccgtgctggccaatgaacaggtcattgacggcaaaggctggcgctccggcgcgccggtggagcggaagaagttgtcgcagtggttcctgcgcatcaccgactatgctgaagaattgctggcagggctggatcagctcgatcgttggcccgagcgtgtcagggttatgcagtcccgctggatcggtcgcagtgaaggagccaggctccgttttccattggtcgagccgctgggtgatcagcgtgagatcgaggtttataccacccgccctgacacgctgtatggcatgtcattcgtggctattgctgcggatcatcctgtggcggcagcactggcggcacatcatcctgctctggctgctttcgttgctgaatgccgttctctcggcaccagtgaagctgccattgaagccgccgagaaacgcggtttcgataccgggttaagggtcaagcatcctttctgtgatgagacttttccggtttggatcgcgaatttcgtgctgatggattacggcaccggcgccgtcttcggctgcccggcgcatgatcagcgcgatctggatttcgcccgcaagtatgatctgtccgtcacgccggtggttttgccatctgatcaggatgcggccagcttcacgatcggcaggaaggcttatgacggggatggcattctttttaactccggacctttcgatgggctgaccccggatgccgccagacgggaagccattacccggctggaagcaatgggttgggggcagggtgtcaccaattggcgtctgcgggattggggtgtcagccggcagcgttactggggctgccccattcccatcatccattgcgatcagtgtggtccggttccggtgcccgccgatcagttgcccgttactttgccggaagatgtgacgtttgaccgtcccggcaacccgctggatcatcatccaagctggaaacacgtgacctgcccctcctgtggtgcggcagccgtgcgggagaccgatacgtttgatacttttgtcgacagttcctggtatttcgcacggtttgccagcccgcatgcgcatgtgcctgtcctgaaggaagcggcgcaaaactggctgccggttgatcagtatattggcgggattgagcatgccatcctgcatctgctctatgcccggttctttacccgggccatggccgataccggccatgtaccagtcagggagccgtttgccgggctgttcacgcagggcatggtgacgcatgaaagctatcgtgctgccgatggacgctggctttcgccagtcgaggttactcgtcatggcgagacggtggtcgagacggcaaccggcgaaccggttcaggtcggtcgcggcgagaaaatgtccaaatccaagcgcaataccgtggcaccgggagaaatcttcaaccgctacggagccgatgcggcgcgttggtttattctctctgacaacccgcccgagcgggatatggagtggaccgatgccggggctgtcggtgcatatcgatttgtccagcgcctctatcgtctggccgaggcggttgcgcgcatcgcaaaggaggaaacaaaccgggacgatgcttcatccgatgcggcgatgacgttacggcgtatgacccaccgtacggtggctgcggtgacagaagcactggagggcttcaacttcaacgttgctgtggcgcgggtttacgaattcgccaatgctctgactgaagcagaaaagaaagctgctgaaccgggcatgacagcggcccgggttgaggccatcaccctgttgtcacgaatcatcgcaccgatgatgccgcatctggcagaggaaatggccacactgatcgaacaggggccgaagctggttgccgagcaggtctggccatctgccgatcctgcgctgctggtggtgcagtcggtcactatagcgattcaggtcatgggcaaattgcgcgccaccctcgacatttcccccgatgctgatcaggacagtgttattgcgcaggctgaagccgatccgaatgttgtgcgggcgctggaaggaaagcgcgtggtcaagcgcatctatgttcccaaccgcatcgtcaatttcgttattgccggatagggttcacagggttgggtagcggtccgtccgcgcggttggccgcaaagagggaaaagctttgatccacgggcttgtctgacgcacacagacaggcccgtgtgggatagggaaaagaccatggacctgaaacgccgcacgctactgtcactgggtgggttgctactgctgcctggttgtgggtggcatgccgtctatgcgccgggcaaggacggtgcccttacccctgttcaggagcagctcagagctatctctgtggcgctgatcagtgatcataatggcgtgctgctgcgtcaggcattgcagaatcgctttgattatacaggcggaagcaaacttcctcgctatgagctgtcggttttttataccgttaataacgagagtgccgggatcatgcccgataactcgaccacccggctcaggatgcatgggatcgccaactggaccctgacggctgacgatctgaaaaaaacgattctgaccaaaggacgtgcttacacactcgatggcattgatctgtcgaatggtcagttctttgccatggatatcaattcggaaacggtcctgcgccgtatggcagaggaacttgccaaccagattacgcttgatcttgcccagtatttcgaaaaaaaacaggcagatgaagcaataaagcccgttgcttcagacagcaaaggctgaggtgcagcctgcatgaaatttgatgcacgtcaggcggaagcatttttgcgtcagcctgatcaggctgtgcgggctgtgctgctttacggggatgatcatggtttggtccgtgagcgcgggaccagtctgacacggctggtagcagggcagattgatgatccttttcgtgttatcgaactggccgcggaacaggcggccgatcttcccaatgaaatggcgggtctgtccctgacgggcggccgtcgtgtcatcagaatcagggaagcggccgacattttcgctgcccctctgcaggccggtctggagaggcagggggaagcgctggtcattctggaagcagggacattgacgccacgctccaagcttcgtgtgctggccgagaaaatggccagtgcagcctccattgcctgttatcccgatgaaggtagaagcctgtcccagactattcaggattctctggcccgggatcgtgtttccattgaggctgatgcgctgaaatggctctgcgatcatctgggggctgatcgtgccctgacgcggcgtgaaatcgacaagcttgccctgtatgtcggtcaggatggaaccgcgacaatagaggcagcacatgcctgtattggcgacctcgccggattgtcattggaagatgcactgtatgcgtctgtcatcggtgacatttcaggcgctgaacgcgccctgtcactggctctgtcggagggtacgacctcgattgccgtggtcagaatggcgcttcagcatatgcagcggcttcgcaagctgcgtgcggtgatgcaggaaaacggaacaagcgcggctgaggctgtcaggcaggcaaagcctccggttttcttcaaacgggtacccgcttttacgaaggctctcacgctctggcgggatgagatgctggccgcgatctgcgacatgctttggcaggccgagaaagcctgtaagcagagcggtgcccctgatgagaccatctgtcgtcaggcggtcatgagtatcgctctgcgggcacgtcaggctgctgccagaggggtttttaacaaggggtttaacgggtcagcagggtgatcaggccatccaattgatcaagtgatttgtagcgaatgcgtatatccccgctctgaccatcataggtgacggtgactttcagccccagatgattgctgaggtcacgttccagaacagcaatttcgggatcccgacgggcggctctttcctgcgccgtgacagggggagcgttcttgcgtgcaaccagttgctctgtttgtcgcacattaaggccttttgccagcaccgtcagcatggctgttgccggatcggcatgcgacagcaaggctctggcatggcctgcgctgagagcaccttttttgacttcgtgcaggacgggggaaggtaaattaagcagccgaagtgtattggcgatatggctgcgggatttgccgaccgcatcgcccagtttttcctgtgtcaggccgaattcctcggacaggcggcgatagccttctgcttcctccacggcattgagatcctgcctttgcagattctcgaccagggccgcggccatggcatcgctgtcggacagggcacgcaccagcacaggcacttcatgcagcccggctgcctgagcggcccgccagcggcgttcaccggcgatgatctggtaacgtccggcaagatcgggatcgggtctggccagcaagggttgcaggatgcctctggcacgaacggattccgtcaactcggccaaggcatccggttcaatggttcctcttggttgaaaggggcttggggcaagcagttccactgccagcatggcgatatcaggatgacggcgctccgtatcctgtgtcggtagatcatcgcccaataaagctgccaatccacggcccagccgcgtctggggggattttgtcataccgctttcgtccctgccttgcgttcacgcttcagtaactcgtctgccagctgaacataagcctgcgcgccggaggatttactgtcgtagagcagcaccggcttgccatggctcggcgcttcagagaggcgaatattgcgcggaatcacagtgtcatagactttggcaccgaaaaatcctcttgcatccgccgcgaccagttctgacaggttgttacgccgatcgaacatcgtcagcacaatcccttccagctccagagccggattgagcgcccgtcgcacagcctgaaccgtacgattaagttgggttacgccctccagagcgaagaactcgcattgcaggggtaccagcaccgaatctgctgcgacaagggcattcaatgtgagcaggccaaggctgggcgggcagtcaatcaacacgtgatcgaaagaaagttcaggggtttggtcagcattttttagagcatccagcgcctctctcaacctgtactcacggcggttctgggcgaccagctccacttcagtgccggccagatcaatttctgccacgatcagaaacaggttgggaacaatgcttgtgcgtatgacatcagccgctttgtggctacccatcagcacggcataggaaccatggccacgttgattgcgggggatgccgagaccggtggacgcattgccctgagagtcgaggtcgatcaacagtacccgctctccggtttcagcgagcgcggtggccagattgatcgccgtcgtggttttgccgactccccctttctggttggcaatagcaagaattttcggacgtgttttgctgttggttatcaccggagaggaaggactctcggttgattcggagacctgcccggagggttttttcaatgcccgaaaagggcttttcggtttctcagacacgagaaatttcgtctatccgtaaaatggaagcctcgggatgagtgcggcttgggcttagttgtacgcgcatgtgccactctgtcgcggcctccgtcaattcttgctctgctgtttttcccttcatgaaaagggcaacgccgtttttgcttagcaagcgtaaggcataaccaagcagcacgttcaggggagcaagcgcacgggcggtcagaaccggggcgggagcaatattacattgttcgatccggcaggcatgaacggtgacattggactctgtggctctggcggcttcccgcagaaaagccgccttgcgctggtctgcttccaccagatgggtttcccggccagtagcaatagccagaaccaggccgggcaatccaccgccggagccaatgtcgatcagaggtccaggtaatggttccagcagaggcagcagttggagagaatccaagatgtggcgatcacggatatgctccacatcattccggctgaccaggttaaccgtgcgggtccagcgtgtcagcagcgattcatacagggcgagtttttcccctgtttcacgtgaaacacccgatccggccgggaggagagtacggataatctgacagttaataaggggttgtttcacgtgaaacactgcttgcggcgaacgaaatggctgatggctgcgagggcagccggggtcatgccttccatccgggaggctgctcccaatgaagtggggcgaagggattgcagtttgtcccggatttcagcggataaaccaccaatagcgctgtaatcgatatgatcgctcagtaaaatcgtatcctcctgttgcaggacgcggcgttctttatcctgccgggacaggtagccggaataagccccttcgatttccagctgttcccgcacgcgtggatcaagatcgtgcagccagggaaaggcctgattcaatttctgatcctgttcagggtcagaaccgatcagagagagcagagggcggcggcggccatcctgtcgtacagtaatccccacctgctgcaactggacaggtgtccgtgtatcctgagcggccagcgtcaaagcgtcgttcatggcctgatcgtaggcagcaaaggtcttccatcgttcatcactgacacaacctgcttgccgcccccaacgggtcaggcggcgatcggcattatctgcccgcagggtcaggcggaattctgatcgggatgtgaacatgcgataaggttcagtaacgccatgcgtggtgagatcgtcaatcagaacaccgatataggcctgagaccgatcgagcgtaacgctatccaatccctgagctttccgggctgcgttcaacccggccatcagcccttgtgcaccagcctcttcatagccggtcgtaccattgatctgcccggccagaaacagccccggtaactccttcagctccagagagggacgcagggagcgaggatcaacgaaatcatactccaccgcataaccgggcctgataatcacggcattatgcaggccgggcatggaatgaagcagggcttcttgcacctcggctggcaggctggtggagatgccgtttggatagacggtaaaatcatccagcccctccggttccagaaacacctgatggcgggtcttatcgggaaagcggacgaccttgtcctcaatggaagggcaatagcgaggccctttgccactcagcatgccaccatagaccgcggatcggtgcagattgtcgcggatgatctgatgggtatctgcggtggtctccgagatgcggcaggatatctgtggcagatcaatgtgatggttcagggtactgaatggagtcggcggattttctccacgatcttccggaagatcctcccatgcgatgctgcggcggtcgatacggggcggtgtgccagtttttagccgccccatacggagattaagagcatccagccgctttgccagaccgatagacggtgcttcccccacacgtccggcctcggatcgctgttcaccgcaatggatcacgccccgcagaaaggtaccggttgtcaagaccacggcagaggcagacagatgccgcccatcctgcaggatcacaccctgcacggtctgttgtgtgccggagctggtgatcagatcctcaactgatccttcgatgatggacagatggggagtggtatgaagaatatcctgaacggcttttttgtagagcttccgatctgcctgggcacgaggcccgcgtacggctggccccttgctccggttcagcattttgaaatgaatgcaggcctggtcgatcgcgcgtcccatgagtccgtccagcgcgtcgatttcccgcaccagatgccccttgccgataccgccaatggcaggattgcaggacatttcaccaatcgttgctgcctgatgcgtgaccagagccgtgatggctccggtacgggctgctgctgctgctgcttcgcagcctgcatgtcctcctccgactacgatcacatcgtaggcggccggggcgggatggtcagaggtattcataaggtatcaatcctgtcgggcacgctacaaagggtggcccctactttcctatacaaaaactggaaaagacgtggtccagaatttgttcgaccccgatctgtccagtgacccggccaacagcctgacgggcgagcctgatctcttcggcgcgtaattcttccagccgggctgattcggcatcctccagatgctggatcgcgtcttgcagggcagcgcgatggcgtgcccgtgtcaaaggtgctccggtggcgtgggatgtcagcgcccgtgcttccgcttccagcatcgttttcagcctctccatcccgtcccctgtcagcgtgctgaccaacacaatgtccggtgatgaagggggtgtatatggaagatcagatttcgtgccgatcatcaaggatcgtgcctctgatgatcccggccattgttcagccgagaaatcagcctctgtcgctgtcgagatatcgacagtccttagcacgagatcagcactttcagctcgcgccagagcacgacggactccctcagcctcgatactgtcggcgctgtcccgtaatccggctgtgtctatcagtgtaaccggaacgcctgccagaactagacggacttcgatcgtatcccgcgttgtgccgggctgtgaggaaacaatggcggcatcccgactcgccagactgttcagcaggctggattttccggcattcggtttgccgagaatggtaaagatcagcccttcacgcagtttttccgcttttgcgccttcgttgagcgcctgagccatttcctgacgaagcaggagcaggtcagttcgtaaagcagcatccacttcagccggtaaatcctcgtccggaaagtcgatcagcgtttcctgccaggctaacactcttgtcagcgttgcagtccatgtctccaactgacgactcaggccaccatccagttgctgcagggcctgacgacgctgggcactggtttctgcgtcgatcagatcggcaacggcttctgcttcagtcagatcaagcttgccgttgaggaacgcacgacgggtaaattcacctgcttctgccggtctcaatccaagatcgaccagcgcgtcagccattccttcaatcacggcattgccgccatgaagatgcagctcagcacagtcttcgccggtgaagctgccgggaccagcaaaccagaggatgatgccctgatccagtatttccccactccggtttctcagtctccgcaggctgctttttcgttgcgggggcagggttccgcatagatgggtcaccgtattccgtgttgcgggaccgctgatccgtatcaccgcgatggcagcgcggcccgcaccggaggccagtgcaaaaatcgtctcctgactcatcggggagccgtttcggcaggtaacataagctcaggtactcgctctccctgactgacatggcgcatcaggatctgatcgacatcctcggtggaggaaatggtgtaccagataccctccggatagatgaccagacagggcccctgttcacatcgatcgaggcatccagctgtattgatacgcaggctcggcattgtgaatcctgccagactcatctcctttgctctggccttcatataatcccgcagtttttcagatccttttgcagcgcaggagccacgtgaatgatcgtccgggcgacggttgcaacaaacaaacagatggatatcgaagtaaagcggtggatcggtttccatcctgtggcctgtcatttcagtggtcacagattgatcactcatcggaaacaccttttatcagccatggagcagcgacggatatgatcgttctgacggattctataaagctgcttgcgtacgaatatcagtgtgccaatctcgctattgtaaaggcacttgatgcatacactcctgtatggtgtttcacgtgaaacactcgatccagcctcgccatagacgatctgccttgccagccttgtgacagtatatggaatgacgatgaccgtcgcgccaaaccgtaaccatctctctgaagcgctttccccctatctgttgcagcatgcggataatcctgttcactggttaccctggggtacacaagccctggaacatgcccgaaaaacggacaggcccattctgctgtccattggctatgcggcctgtcactggtgtcatgtcatggcgcatgaaagcttcgaagatcaggcaaccgccgatgagatgaataacgctttcatctgcatcaaggtcgatcgggaggagcgcccggatattgaccatatctacatgtcggcgctgcacgcgatgggacagcagggcggctggccattgaccatgtttctaaccccagagggtcaacctttctggggaggtacgtattttcccccggagccgcgtttcggcagaccttcattccggcaggtactcgcggccatcagggatgcatgggccaccagaagatcggcgattgaacagaatctcgggcaattgacgcgcgccatgaaccgcctctcggaaacggcagcagggcccgaggtcgatgtattattgctgaatgcggtcgatgcagcccttctgcgcaatctggatccggagaaaggcggtttcacaggggctcccaaattcccgaatgcgccggtattccgttttttctggcaggaattccatcgcaccggtcgccctgaactgtccgacgctgtgcacgcggttctgagtcatatggcgcgcggcggcatatacgatcatctaggtggcggctttgcccgctattcaaccgatgcagagtggctggtgccgcatttcgagaaaatggcctacgataacggccagattctggagctgttgtctttgggatatgcgcagaatcccacaccactttatgcgcgctgtatcgaggaaacggtggggtggctgatcagggacatgtccgttccggtcgaggggggcggcactgctttcgcggcgtccgaggatgcggatagtgagggcgaggaaggccgattctatatatggcatgaggatgaaatagatgccctgttgggagaggccgcaaccggctttaaacaggctttcgatgtcacccgggaaggcaactgggagggccacacgattctgcggcgccttaccatatcgccggaggctgatgctgaaagctgggcgcaggagcgcagaattctgttccagtcacgggaaaaccgtccccgccccggtcgtgatgacaaggtgctggctgattggaacggactggtcatcgtcggattggtcagggctgccattgcgctggaccgtgcagactggttatccgcggcggaaagcgcctatgaagcggtcagggctgcactggggtcggaggatggacgaattgcacatgcatggcgtctgggccggatcactgcggccggcttgctggatgatcaggcctccatgatccgcgccgccctgtccctttatgaggcaacagggcaggagcgttacctgtctgatgctgtcaccctcgcccagtctgcccgatcctttttcagctctgaaaccggtgcgttttatacgacggcccatgatgccgatgacgttcctctgacccggccctgtacagcgagcgacaatgccgtgccgtccggcaatggcatgatggctgatgcgctggcccggctttatcatctcaccggcgagcagagatggtatgaggctgcttccggtctgatccgtgcctttaccggacgtccgcaaagtctggcatcttcaccctatctgttgatggcggcagatttgctgacgcgcggaacgctggtgagtattcatgggcaggctgatgatccgcatctgcagtccatggtcagggaggtgctggcgcttggcgatccttccgtgctggtgtgccgtaagcctctgcatgctgctcctgacaggcagacagaccatgtcgctcaaacgtttttcgtgctggtctgtaggcagactctatgcagcgcaccgctgacaacgctggatgcggtcaaagcagccatcagcgcctcatgaatgacgttatccacgataccgcgtatgaaagatctgatcggatgtaatcagactgaatgctcctgtctttcacctcaattttttacgagaccggatcccccatgccgcagctttcccttcattcacccctgggtgttctgaccatcacggaagatgagggggctattgtttccctcgactggggagaagggatggacagccgtgatcgaacaccgctgttgaaaaaagccgcagagcaggtccaggcttatttcgatggtgatctgaaaaacttcgatcttccgctgatgcccgagggtaccggctatcgcagaaaagtctggcaggctttacaggatattccttatggaaaaacaatgacatacggggcattggccgcgaaagtcgggggttcggcacgatccataggtcaggccaatcatttcaatcccatacccattatcattccctgtcaccgtgtcattggcagcaatggcgctcttggcggatatagcgggctggatggcgtggaaacgaagcagtaccttctgtcgcttgaaaatcctgatccggatatggttcatccggcatcaccctctttccagccgtcattaccccgttcctgacaaggatttgtcatgactaaagcaattcgtatgcacgctcatggcggtccggatgttctttcatgggaggatgtgccaacccctgttccaggacctggagaagctgtcattcgtcacgctgcggtggggctgaatttcattgatatttatttccgctccggtttgtacaaagcgccctcgcttccgactgttctgggaatggaaggagctggcaccgtcatcgaaatcggtgcaggtgtgacagatattcaggttggagaccgggtagcctacgcgactggcccgttaggcgcctacgcgacagagcgcacgatcgcagccgaccggctggtcaaattgcctgattcgatcagctgtcagacagccgccgccatgatgcttcagggtctgacggcgcaatatcttctgcggcggacctatccggtcaaacgcggagatacgattctggtctacgctgcggcgggtggagtggggctgatactctgccagtgggccgcttatctgggggcttcggtcattggtgttgtttctaccgaggaaaaagcggccttggcgcgtgcccatggagccagccatgtgatcgtgtcttccaatgatcaccccgccgatattgcaggcgaggtccgccgcatcacacagggagcaatggtgccggttgtatatgacagcgtcggtaaggatacgtttgatgccagtctcgactgtctggcgccgctggggctgatggtcagctatggcaacgcttccggcccggtgccgccattctcattaacgaccttgtccgccaagggaagcctgtttgtcacacggcccagcctggcaacctatacggcaaaaagggctgatttgttggctatggcgcaggatctgttcgacgtcgtttccaccggtcatgtccatatcgaaatcaaccagacctatccgctgcagcaggcagcagaggcccaacgtgctcttgaagagcgccggaccacgggaagtacgattctgatcccctgaaacctcaataaatctgcactgagaggccgatcagacattgattattatgtcgttcggccattaccctttccgtcacggttggtatcgtgtcatgatgccgatgaaactaacggggaggcgttgatgccgactggcaccgtcaaatggtttaatgcgaccaagggttatggatttattcacccggatgggggcggtgcagacgtgttcgtgcatatctccgccgtcgagaaggccggcctgtccaagctggatgatggtcagaagctcagcttcgaccttgaagccggtcgtcagggcaagacctccgcggttaatctgaagctcgcctgatacgattaactctttccatatccggctggtcaggtctctcaacggagtacctgtctgccggatgtgcctttatgcttcatcatgagcagtgtcgggcggcacgagtcttttttcttattgcctgctttcttgagccagccagaccagttcaaccattgaccaggcgctggtctgtctccattgaggcattgaccagcagttccaaccatcggccatagaaagccagagacgggagaagcgcaatgaaccacgccgatctgattgataagatcgccaaatcaactgaccagaccaaggctacggttgatgccgtcgtgtccgctgcaattgagacgatcagtgccacgctgaaggcgggcgaggaagtccgcatcagcggtctcggcatttttgatgtgtccgaacgcgccgctcgtcagggccgtaatccgcagactggtgcgacgattgaaatcgccgcgacccgtgcggcccgcttccgtgctggtaaggcgttgaaggatgccgttaacggtaccgccgtcaaggcaaaggccaagaaggcctgatccatcgcgctaattgcgtctgatggtaggtatcctgctttggaagcaggattcatgaaaagcgaaaagcaggctgttcaatggcagtctgctttttgtttatctgggtatcttttaccccaaaccagtctggccggatttttcagggagcaactggcagaccgggaatggtaaatccgaaagcctgtatcagcagcaccatattcagccccagcacaatggcggcagcggctgaggcgacccattgtgtcacccgatgattgacgaacggtcccatcaattcacggtgtccgctgaaatagatcagggcgatcatgggggcgggcagggcgatgctgagaatgacctgactgatgaccaacgcatcggttgcgttcacgcccgccagaatgacgataaaagccggaaccattgtaaccagcctgcgcagccagactggaatacgaatatgcacaaaaccctgcatgatcatctgacctgccatcgtaccgacgacagatgacgaaataccggatgtaatcagggatatcaggaatatggcggcggcggccgcgcccagaagcggcgtcagggtatgataggcctgttctatttcagccacgtcactatgcccgatatgaaaggctgatgcggccatgatcaccatggccatattgaccatcccggcaagtgccagagccagtatgacttcccggttggaaaagcgaatcagacgatgccgggatgcgtcatccgtggcagcagcggcgcgattctgtgccaggccggaatggagataaacggcatgtggcatcacagttgcccccacgatcccggtggcgattgtcagggctgttgcatctggcagacgtggcgtgatggtcgcccaagccgcagcggtccaatccaccggtgcaatgaacatttcagccagatagcagaggccgatcgtggccactaaggccccgatgacaagctccatgacccgatatccccgcttttcaaacagcagcagggcaaaggtaatcatggccgtggccaccataccgatgatcagaggaagcctgaacagcagggccagtccgatcgccccccccagaaattctgccagatcggttgccatcgcggcaatttcgctgatgatccataacgcgatcaccaatgggcgggaaaaatggtcccggcagagttccggcaaatttcgcccggttgcgatgccgagtttggctgaaagggcctgaaacagcatggcgatcagattcgcggctgccacgacccagagcagtgtatagccgtagcgtgagccagcctgaatattggtcgcgaaattgccgggatcgacataggcgatggaagcgatcacggccggtccggcaaatagaagaccggttttccagcctctgcttttgccggcgattgccttggacaggcgtaaggaggtgcgatccgttatggtcggaccggggggtggcgcacaggtgggagtgatctgagtcatgaaatactacggttcgtcgtgagaaaaaccggtgtgtgccggacctgatccaaaaagtgtaacctgtgctacaaaacgtcaagagagaaggtgagcgctgtaaaggatggcatgctgcgctggatgcagcttgcgcggaaaggggggagcgccgacaatcagacatggcccgcgatcatgttcctgcgcgcctcgacccaacggacgtgatgtatgaaagaagcccctgccaccgtttttacccctgactccggtgagccatctgcgctctgcaatcgtgcggtggtcatcatggagaaggtcaatcaatggtatgggcgcatgcaggtattgcgtgatgtttccctgtgcgtggaggagggaagctgcgtcgtgctctgcggtccatcaggctccggcaagtcttcggccctgcgctgtatcagccgtctggaaacccatcagaccggccgtattttggtcgatggggtggagctgaccgatgaccccgcctgtatcagtcgcatacagcgggacgtggccatgatttttcaaagcgtcaatttattcccgcatatgagcgtattggaaaactgtacactggcccccatctggtcgcgcggtatgcggcgtgaagaagcagaggccagtgctgctgaggcattgcgccaggtcggcctgctggacagggcgcagcagcatccctctggcttgaatgccggtgagttgcagcgtgtcgccattgcccgcgccttgtgtatgtctccgcgtatcatgctgttcgatgaaccaaccgtggcgctgccgccggagatgaaggggcccgtgctggaggtgatggagagtgtagcaaaaagcggcatcaccatgatctgtgttgcgaatgagcttgaatatgcccgcaaggcggcagatcgcattattttcatggatcaaggcaatattctggtagatgacgtgccatcagtgttttttgaacggactgatccccctgagctgagggcgtttctcgcaaccgcctgaaatgtgcctggcagacaatcccacctaaaaaaattgggcggcacgatcgggggagatcgtgccgcctctgtttttcctgcggcacaggtggggggggggaagcgccgcagttaaaccctgaacgtgtattctgctacagggttcatcattatattggtatgatctgtttatttttgatgggcttggctgagaaaatcagcgtccttcaaaaaattcctttaccttggcaaagaatccttcagcttctgggcttgctttggtcgtggaggcttcacgctcgaattcttccagtaattcctgttgccgcttgctgagatgctgaggcgtttcgacattgacctgaatatacatgtcgcctcgtgccggactacgcaggacagagaagccttttccacgcagacggaattgctcgccgctttgcgtgccgactggaattttgaccttggcgctggtaccatcgatcacgggcacctcgatttctgcacccagagcagcctgcgtcatccgtagcggaacccggcagaaaatatttgccccttcccgctgaaaaatcggatgcggacgaatggcgacatggacgtacagatcgcccggcggtgtgccattcgggccggcttcaccttcacccgagaggcgaatgcgcgtgccatcctcaactccggcaggaatggagatctggagcgtgcgttcctgggagacggttccagccccttgacagacccggcacggattacgaatgacgcgtcccgcaccgccgcaagtggggcaggtgcgctccaccacgaagaaaccctgctgcgcccgtaccttgccggcgccctgacaggtcggacaagtatcggcgctcttgtttttgtcttcgctgcctgtcccgtggcaggactcgcaggtaacgcgtgtgggcacgcgcagcgtggctttggtgccgttgaaggcctcgaccagatcgatttcaaccgcagcgcgcaggtcggaccctgtgcgaggggcacccccacgccgacccatgaagtcgccgaacatctgatcgaaaatatcgcccagaccgccttcctggaagccgccgaaaccgccccctcctccgccaccgccattctcgaaagcggcatgaccgaaacggtcgtaggcggcccgtttctgttcgtctttcagaacatcataggcttcgctgacctccttgaatttggcctcggcttcgtgatcaccgggattgcggtccgggtgatactgcatggcgagcttgcgataggcttttttcagctcatcggcattggcgtctcgggcgacgccaagagtggcataataatcctgcttggccatgggcatttctcagctaaggtcctgtccgcggcagagcggaaaccgtgctcatgcagcagatgacagggcggggcaatcaaaaaggccgaaccacgaagaaggggcacgccattcaggcgtgcccctggtcgtgtaattccggccttttatcaagaccggagcctgacaccaggggtcaggaatgcttcttcggatcgacttcctcgaaatccgcatccacgactttttctccgttcgggccagcttctgcttcaccggttggtgcctcggactgggccttgtacatcgcctcgccaatcttcatggcaacctggctcagacgctcggtggcctgggtcagggcagcgaggtcatcgccttccagtgcggtgcgagtagcgctgatggcgctttccgcctcgcccttatcggcttcggcgatcttgtcgccctgctccttcaggtttttctcgacctgatggaccaggctttcggcctgattgcgggcttccaccagagcgcgacgctgcttgtcggcttcggcattggcctcggcttcctgcaccatgcgctggatatcggcatccgacagaccaccggaggcctgaatccggatctgctgttccttgccggtcgccttgtccttggcggagacgttgacgataccgttggcgtcgatatcgaacgtcacctcgatctgcggcacgccacgcggtgcggggggcaggccggtcagatcgaactggccgagggacttgttatccgccgccatctcacgctcgccctgatagaccttgatggtcacggcgggctgattgtcttcggcggtggagaacacctggcttttcttggtcgggatcgtcgtgttgcggtcgatcaggcgggtgaacacaccgccgagggtttcgatacccagcgagagcggggtgacgtccagcagcagtacgtccttgacgtcgcccttcagcacggcgccctgcacggcggcgccgatagcgaccacttcatcagggttgacgttgcgggccggttccttgccgaagaactgtttgacggcttcgatcactttcggcatgcgggtcatgccgccgaccaggatcacgtcgctgatctcgcctgcggacacgccggcatctttcagcgccttgcggcagggttccagcgtgcgctggatcagatcatccaccaggctttccagcttggcgcgggacagcttcagcaccagatgcttcggtccggaagcatcggcggtgatgaagggcaggttgatctcggtctccttggaggaggacagctcgatcttcgccttttccgcggcttctttcagacgctgcagggccagcttgtccttgcgcaggtcgataccttgttcgcgctggaattcggaggccagataatcgatcacacgggcgtcgaaatcctcaccgccgaggaaggtgtcgccgttggtggacttcacctcgaacacaccatcgccgatttcgaggatggacacgtcgaaggtaccgccgccaaggtcatagaccgcaatggtgccggtattcttcttgtccatgccgtaagcgagggcggcggcagtcggctcgttgatgatgcgcagaacttcgagaccggcgatgcggcctgcatccttggtggcctgacgctggctgtcattgaagtaggccgggacggtgatgactgcctgcgtaaccggctcgccgagataggcttcggcggtttccttcattttcgacagcacgaaagcgctgatctggctcggcgcgtatttttcgccgcgggcctcgacccatgcatcgccgttatcgccacgcacaatggcgtagggcaccagatccttgtccttagcgacggtcggatcgtcataacggcggccgatcaggcgtttgacggcgtataatgtgttggaggggttagtgacggcctgccgcttggcggcctgtccgaccagacgctccccgctatcggtgaacgcgatcatggagggggttgtacgcgcgccctccgcgttttccagcacgcgcacatccttgccttccataatggcaacgcaggaattggtcgtgccgaggtcgataccgatgaccttgctcataagtctgctcctttccagcggatgctgacggcccgaagcaccgcgtgcatccccgatttatattcgttcgatgatgtaagaaggagaagcgtcccgggcaagaggctgcttcaccagattccggcatggatggttaaaactgcgacatctctgtcgaagtcgaccgattcagccgggggaaatcggttgtcaggccttcgccaccacgaccatggcgggtttcagcaggcggccattcaatgtccaggccgatgtccatgcctgaatcactgtgcccggcggatgttcggcgctgggttgttcgctcatggcctgatgaaggttgggatcgaacaccgctccggtcgggtcggtgccgctgatgccattgcgttccagaatggagatgaaattccgctccaccccctccagcccttcccgcacgcgggtcagggaggcaggttcgccttcctctgccgccggcagggcggacaggccgcgccgaagattctctgccgcttccacgatgtcggccgcgaatttctgcacggcgtaattgcgggcatcgtcggcgtcacgcttggcgcgggcgcggacattcgccatttccgcctctgcccgcatccagcgttcacgaaaatcgtcccgctccgcttccagtgcggcgatgcgggcttctggtgtgtccgtggcagcgttctgcggctgctcgccggaatgagtctcttcctgatctttcggaagttcctgctgcgtttcgtcctgcatggctgtcgcctcggtttcgttcgtcatgggcggtgaattagcgcatcgacgccgcggaacaagggatgaaactctgaaactgtgtttctgcggtgtttttcgtgtccagaagcgcagatccatgccgatttctgttccgtctgtgcttcagggtatgacaggggctatgttcaaatctgtccggcgccgcccagaagacgaccaataacccgggccgtgtagtccaccaccgggatgatgcggccgtaattgatgcgagtcgggccaatcacgccgatggcaccgacgatccggttggcttcgttgcgcgccggggccaccaccatggacaggccggaggctccgaacaggccgctctcggcgccgatgaaaatccgcacaccatccgagttttccgccagatcgagcagccgcagaatggtttcctgtgcttccagctgatcgaacagcatctggatggcggccagctgcccggcctgcacggcatcggcgagcaattttccctggccacgcacgatcaggttgccaccgcgttcctcgccgctccatgtggcaagtcctgcttcaaccacctgcgccgccagcgtatcgagctgggtgcggttggcggtgatttcctccgtcaccagacggcggagatcggcgagaggtttgttgctgagccgggcgttcagataattcgccgcttgttgcagggcggagggtggcagaccgggcgggatttccatgacccggttttccacctgtccctcggatgtgaccatgatcaccagtgcccgtccggtactgaggggcacgaattcgatatgccgcagcgcaccttccgattttggcgccagcaccagtccggcagcggaggaaaggccggagagcagggtggaggcctcggtcaacgtgtcttcgagactgcgcccgcgggcttccagcgaggcggcaatactgttctgctcgtcttccgagagtgcgccgaactggagcaacccgtccacgaacagccgcaggccgcgatcagtgggcaggcgtccggcagaggtatggggggcaaacagcagcccggcatccgtcagatcggccatcacattgcgaatggtcgcaggggacagattgacaggcagacggcgggacagggtgcgactgccgaccggctccccggtttcgacatattgttcgacaatctcgcgcaggatggcggcggagcgtgtgtccaaacctgccggcagccctgctggcagagggctgaccggaaggctggcccccagaactttacccagacctgaaccgcgggggggtgatgaaacagaacgtggcatgcatgaaaacctgatctgccataacggtagaaagccggaaggggcgggtcaatgacgacgcatcctaatctctgcatattttcaggatgctgatccatgatatggggctgtggggtgggttttcatggtgggcggccttgtcagcctttccctgatccggcactccacacgacatgaagccggctcctgtcgtagcagtctggtcatgtccaaaggattgcccccatgtctgtccccggcctttcttcagcacgcccgtccggtcgtgcggctgatgcattgcgtagcgtcagtctggaaaccggttttgcgcatcatgccgaaggctcttgcctgatcaggatgggccgtaccgaagttctgtgcaccgccagtgccgagccgcgcattccgggctttctgcgtggcaccggcaaagggtgggtgacggcggaatatggcatgctgccgcgcgctacccataagcgtggagaccgggaggccgctcgcggaaagcaatccggtcgcacgcaggaaatccagcggctgattggtcgtgccctgcgtgcggtggtggatcgggatgcaatgggggagatgagcatcacccttgattgtgacgtgctgaatgcggatggagggacacgctgtgcttctgtcaccggcgcgtatgttgcgctcagccttgccttccacaaaatggtaaaggctggcgtactgaaagcggtgccgctgcatggtcaggtggcggcggtttcctgcggcgtggtgggggggcagcctgtgctggacctcgattacattgaagattccggggccgaggcggattccaactttgtgctgaccgatgcgggcggcatcgttgaaattcagggaacggctgaaggcgctccgttcagcgaggcggatttctctgcgatgctgggtctggcacgtcagggaacggcacagcttttcaccatgcagcgtgacgccattgtcgcgttcctggccagataataaccgccacgagcaggcttgagcgagagagagggatcatgagcgagacccgcagactgaaccggaatgatacactcattcttgccacgcataatgccggtaaggtgcgggaattcgacagcctgctgaaaccgtggtcgatcacgctggtttccgcagcttccctcaatcttccggagccggaggaaaccgccagcgatttcgttggcaatgcccgattgaaagcgctggctgcggcgcaggtctcggggcagccagcgctggcggatgacagcggtttctgcgtggccgcgctggagggcgatcccggtattttctccgcccgctgggccggcccggaaaaggatttcgccgccgccatgcagcggattcacgatctggctggtgaggatgaagaccggcgcgcctggttcgtctgcgtgctcagcctcgcctggccggacgggcatacggacagttttctgggccgggttgatggtgaaagggtctggccaccgcgtggcacacagggtttcggctatgatccgatgttcattccccgcggcgggaacctgacctatggcgagatcgcgcctgccgaaaaagacgccgccagccatcgtgcccgtgcgttcgagcagtttgccgctgcgtgtctgcctctggcagagtcctgataggacgcagaccgtaattttctacagcctcaaaggacaggatcatgaccgaagccaatggtcgccgtgctgatcatcctatcgatgaactttttctggaacgctggtctccccgtgcttttaccggggagaccatgccccatcacgaactgctgaccattctggaagccgccacctgggcaccctccggctataatgcgcagccatggcggttcatctatgcccatcgtgatacgccgcatttcgagacgctgctgaagccgttgatcccgttcaatcagggctgggcgaaaaatgcgtcggtgctgctctatgtggtgtcgcacaccgtgctgacgccgccgggcaaggatcagcctgtgccgaatcacagccattctttcgatgccggtgcggcctgggcgctcctggccttgcaggcgcatctcaagggctgggcgacacatggcatgaccggcgtggatttcgctgctgccgctgaggcactgaacgttcccgcggattaccggatcgaagcggcggtggcgatcggacgccgggccgatccctccgtgctggatgaggccgcgcgcgcgcgcgaggttcccaacagccgcgagccggtgcagagcaaaatcttcgaaggcacttttcgctccgcatgacggtggatgcgccatcccccgatgacgggacaacagaaccgctggcattgtatattcactggccgttctgcttgtccaaatgcccgtattgcgacttcaacagccatgtgcgggatgagattccgcaggcgcgttttgccgcggcgttgcgggctgaactggcatgggaggcatcgcggctcgggcgtcgtccgctcgcctcggtgtttttcggcggtggcacgcccagcttgatggcaccggagactgtcgctgctctgattgaagaggccacccggtattttccgccatgcgatgatctggaaatcacactggaggccaatccgaccagtgtggaggccggacgttttcgtgccttccgtcaggcgggtgtcaatcgcgtatcactggggattcagagcctgcatgacgaggctctgaaagggctgggacggcagcatgatgccgggcaggcgatggctgcgctggaactggcccatacgattttcccccgtctgtcgttcgatctgatctatgcccgacccggccagactgtggcggcgtggcgacaggagttgcgacaggctctgtcgttggcgggtgatcatctgtcgctctaccagctcaccatcgaacccggtacagcctatgaagcgtctttccgccggggggagatcatactgccttcggatgaacaggcggcagaactgtacgaggtgaccggagaagaagcggcacagttcggcatgacggcctatgaagtgtcgaactatgccagatcaggggcggaaagccgacataatctggcttactggcgctatgccgattatgcgggaatcgggccgggggcccatgggcgtgtgagccattccggcagcctcttcgccaccagacggcatcgtgcaccggagccatgggcggaactggtggagcgtcagggccatggttcgacccttgaggaagaggtcgagccacaggaacgcgcacgggaaatgctgctgatggggctgcggatcacggatggtatcgacgaagcccgtttccggcagcgcaccggcctgacgctggaacaggcggtggatcaggagattttatcgctggcgctggacaatgcctatctcagccgcgagcatggcaacctgagggccttgccggagggcagagtgcggttgaacgcgcttttgcaggccttggtgctctgacgcacatcacggtcaggtggcagtaggaggcaggacgatactcgcctccccttcaaccagcatgctgccatcttcggcggtcacagacagcgcatagatcatgccgcccgggctgttcagcagcatgcgggccgagacatggagtgtgccgaaccgttcatcatccagccgcggcacatgcagggtcacggcgcgtagacctgccagataacccggccttgccgctgccccatccagcaaggctccatgcagggcggcagcctgaagcgcatattcgatgccgcataccgcaccgagccgtccgccttcccgcaacggattatccggcagaagatgggattgagacaggcagcttatggtactgtcatcccacgccacgacacattgcaacaggcacatgctgccctgatgcggaatcagtgcagcaatggcagcggggctgtcaggattgttgcgtgttacggtcatgacaggcgtatacgcacatgaccggataaaagaggggcatgagcttccccgtgattacccccagccagaaggctgagcaggcgcagggatcgggccgccggattcatctccgccaatgcggcgagggcgggaagatcgggagcgatcagagcgggatcggcctctccggcactgaaatcgaccgacaaacggcctgcatcgtcgccttgcccggcctcctgatccggggtcagtacgaaagcggcagcgaaggcgcattccgtccgccgcttttccgccagaggcgaggcaaggggggcatcatagagacagagcagaacaggctctttttctatcccggcctctaccaccgccttgagcagtcccgcaccaaaagtatgatcgtggcagccgatgcagttggcgggggcgctggcaccatgggcgatggtccagtatccggcgggcgcattgtgaaccgaattgtgaaactgtgtcggtgacagctgcacatccgaggcattttcggtggtcgtcagtgtttccagaatcccgtgcagcaacatgccgtcgccattgccgctggcaaagatgctgcgcaatgtctgtggttgaaggccgctctgtgcgacggcctgttcggctgcatacagggcgagacgtgccaccatgccggtccggcgacgctcattgggtgacaggatggagggtggcggcggtggttcctgactggagaggtccaggggagttttgccggtcagcacgccctgactctgctcccagcccggcagacccggtccccagatggcaacacccgcgatccgtacggaggggggagaggacatggatggcatgatcagggctgtcctaccagcaggctgcaattgataccgccgaagccgaatgcgttgatcagaatacggcggggtgaggcgaccagattctcggtcagcagccgggcagtaaacgtgggatcgatctgtgacacgttgatgttgcccggtagaaaaccgtgtttcagcgacagcatggccagtgccacacccaccatgcccgccgtccccagcgtgtgacccatccagcctttggaggagccgcagggcgtctgcgtgccgaatatctcggtgatggcacggtcctccatcgcatcgttctgccttgtgccggtgccatggagcgccacgaaatcaatggcatccggagaaagtccggcactgcgcaacgcaccacgcattgcatccgtggccccccgtccttccggatgaggtgcggacatatgatgaccgtcactgctggcgccatgacccagtagcatggcgggggcttcgtcgcgttccagcagggcgaacccggcagcctcgccgatggaaataccgcgccgtccggcatcgccgggctgggtggcatcgggggaaatcagttccagcgccgcgaagccgcgcagggtcatccggcacagcgtatctgcaccccccaccaccgcggcatcgcacaacccgctggcaatcagttgctgggcatcggcaaaagccttggcggcagaggcgcaggcagtcgaaatcacgaaagccgggccctccagctgcaaccgcgcctgcacgaagcgggcaagtgcaaacagatcgtgtgtgttttcgacatccagatcatcggggagtttttctcccggcgcgcggcagcgataggcttcctcgctggtcaggatgcccgatgtgctggtgccaagcacgacggcgatccgctccgcgccataacgggcacgcgcgcgggcgacatggtccgaaaatccgtcactgtgcagggccatatcggccagacggtggttgcggcagtcgaaccgggccaatgcggatggaaggctgtattcctccagcccctccacacgtccgatccatccctcggtgatgccgaacatgtcacagcgtcgtaatccgctctgtctggtaagcagagcctgcaaggtcgtttgttcgtcccgcccgatcgcgctgacaaggctggttgcggtaatcccgagcggttgcatcgtggctgtgtcatccattcgcggacgggggggaaatggcaggtgaacccgtatcttgcggacgggccatgaagaaggccagcacaagtgcgcagaaagtgccactggcgacggtcaggccgatactggccagcagcggagtctggcatgtggccagaagtccgaagctcagcaaggtcatgccgttgcagaccagcagggtacggagggtgcgcacacgctcctccagatccagcgggactccattgtctccccgtcgcgtcaggaacagcgcataatccagagagatgccgatcatgagctgaatggctgttacgtggaacagagagatcgagaccccggcaagtttcagcagtgccagagtgacgcagagagccgcgccgatcgggatcagaacggccagcaaccgtttcggttgccgcaacccggccgccagagcgaacagcgccagcaaggcgcctgcgccaagccagcgaaaggcctgacccgtaaagcggttcaccagcccgttggtggcttcccggatatcgatgacttgtgccggccctgtgccggactggtccagcaggctctggaacgtatccgcgtcagtcagaccggtcagagaggcgataccataccagctgccaccgcgctgaaacagcatgggagccagacgtgcccgcaacagggggctgggtaaggcgtgcaggggggaagccatccgctgctgctgcgcatttttcaaaaacggatcgaaggctccgtttgcgaagggcaggcctgccatggcagccatgacccggtcatgcagctctggcgcgggtggaagagcggcctgatgttggcgctggctcgcttcactgggaagcagatcggcaggaccgagcgaggaggtgatcaggccgcgctgtcgcatctggtgcagaaacggggtcagacgctcggcatggcgtagaacatcttcctggctggtgccgctgaataccagcaggacgctggcatccggtgcgccgatctggcggcgcagggtttcatccagcgtcatctggctcgccggtaccggactcagatgagccagatcgcgttccagcggcggcaaaccggtgatgaccagataggcaatggcgagaacgggaaccaggagtgccagaggccgaaaacggtgcagccgctccagcctgatcatccatgcaggcgcagcgctgttccgcccgggcgtcttcagcagggcaggtgccagatcggccgagcggacgacagggggcagcacgaggaaagtggccagtcctgcccccagcagccccatcaccgaaaacaatcccagctgcgccagagcggggaagctggaaaagaccatcccgatcagccccagcgaggctgcgatcatggtcaggcccagcgtcatgccgattctccgccgtgttgcacgtacaggctcgccgggacgacggtggccgatccacagcaccggataatccagtgtgacacccagcatggtgaggccgaaacccagcgtgacaccatgcacgctgccgttccagagctggatcgtgaccgctgccagcgcaatcccgagcatgggtggaatcagcatggccaccagtacggcaggtgagcggaagcgccatagcagaaggcccagaatcagcacgccggaaagaatggcgatgcggtgaatatcggccttgacgatgctggaagcctgttctgcaaaaatcgccgggccggtcagatgcagggaaaaggcgtcctgatcggttggactgacggtacgacgggcttcttcaaaggaagagcgcaacagggagagggcaacctgttgttcctcgatgctcgaaccggcatgaagccgggtcagcagaagggcacgtggttgctgatccggttgttccggcgcaaaccacacgccatccactgtgcgtggaccgctgaacccgccttccagccattgtgcggctatcgcgccgaatgcaccggtcggatcggcaaaaccatagcgggctacgaccggtgaggccgctcctgacaaaccggtcagcaaggcctcgaaatgatgatgcagggcgtcggtggtaaattgctccggcgtgacggcgtcagagagaagatagcggtccgcaaaaagcttttccgcttcctgatccatgcccgcactgctgttcatgacgaggctgaacaggctgtgtcctcgcaagcgtgcagccatgctctggctgatttttacgagagcaggcgtggaggggccgtctattccggccagaagcagggtggctgcctctccctcccgcacttcccgtaacaggaagcgggacgcagggtctgtaccgggaggcaggaaatcggtgatgtcggtgcggatacggatctgtgtcagcaccagacccagacagacagcgcagagaagaaaaacggccagaagtcgtttcatggaactgcgcgtgtcacgagagcaaataatcctgttgccgcatagtctttggtaggagcggatgcttcgtccggtcaagccggacgaagacaacgcacaggatcggtcagtagaccaaaggcagagtcacgatgttgtgacatgcccggcaagatcctcaccggcttctacaggaccgaattcgccattcagggccgctgtcagctggttcttgtccagcttgccttcccatcgcgcaacaacgattgcagcgacggcattaccgatcaggttggtaagcgctcggcattccgacatgaaacggtctacgccgaaaatcagcccgattcctgcaacgggaatgctgggaatcactgacagggtggcagccagagtgacgaacccggccccggttactccggcagcgcctttggaactgagcatggcaacggccagtaacagggcctgatcaccccatgacagcggaatgttcagggcctgtgcaatgaacagcgctgcaatggtcatatagatgttggtaccatcaagattgaaagaatatccagtcggaatcaccagaccgaccacggttttctcgcagcctgcggcctccatcttggccataagtccgggcagagcaggttcggaggagctggtgccgagaacgagaagaagctcttccttgatgtagcgaatcagcttgaggatggaaaatccgttatatcgtgcgacactccccagtacgatcagcacgaacaggatggcggtgatgtagaatgttcccaccagcatcgccagattgaggatggatcggatgccgaatgtgccaaccgtgtaggccatggctccgaatgcaccgagcggtgctgcgcgcatcaggatggcgaccagcctgaagatactggcagaaagcgattccagaactttcagcaggggagtacctgcttcaccgaccgatgccagtgcaatcccgaacagaacggaaaaaaacagcacttgaaggatgtcgccgcttgcaagcgcgctgacaggtgtggccggaatgatgttcagcagaaagccgatcaggctggtatcgtgcgctctttgcacataggtctgcacaagtgaggatgaaagcttggccggatcagcatgcatgctggcaccaggctgcacgatgttgacaacgaccagaccgacgaccaatgcaagcgttgaaaagcacagaaagtagatcatcgccttgccgatgacccggccaacggttttcatgtcgcgcatgccggcaatgccggtcacaaccgtcagaaaaatcaccggtgcgatgatcatcttgaccagcttgatgaaagcatcacccagcggtccaaaagatttcgcaacatccggagcgaaataacccagcaggatactgagagccatggcaatcagtacctgtacatacagatgctgataccatttatgtggtcggcgaggctgtggtacctgtgaaaccggggccatggccattgtcttgtattccccctttgtcccgcatcaggttgcgggttataagggtgccatatgcctttttcgtttcgttataaagtcataatccaggaccagtccggattgatgcagtaaagtctgtcagcaaaaaagattaatcgggtgtgatctgcatgatactgcgatccccattggcctgcacggtatcggtctggcgcagtttgttaccgatgccatccatacggacgatgctcacaaatcccgaaatatgaccgtcgatcggtttcaggataagacgccatgcatcacctcccaatgattcataggcaatctggtaatgcttttccagcgttgccagattgccggaaagcgcaccgcggacagtatccaccaaggcgccaagtgcaggctgggtggtcagatcaatagtgtgaggtggttcgggcggatggatcagaaccagcgtatcccctgtcacacgcagcgtctctggggagggagagataatcgttttctccagccggtcaggccgttgatagaataggcttccttccgaaataatcggtttggtcagttgggaaagcgtcttttcttccctgaaatgtgcatgggatgtctcgacctgcgccagccgggccatcaactgatgcagcggatcagatggctggctggcggggggaggggaagcgggtttcaggtctgcggctatcgcctgaaaggctggaacgctgcccaatagggacaacgcaatcaggctggcaatccggctgattgagagtgttttcaccagtgccttcatccgtgtgccagaaatcatagaaattgaaccagttgtaaggataggcccgcgcatggtgttccagccgggcggtgaaagcctgcagccattcctgcacggcaccgagacgattctgtctgggcaaggtgatgcggtcggcgaagggttcgatgatgatggtatagtggcgtggcccggtcttcagcccgaaacacagcaggactggcgctgccgtaacggcggccaacagaagcgggcctgccggaaaatgggcggtcttgccgaggaagggcacaccgagcatgcgttgcggcatgtgggaacggtcggccagcagcccgatcagttctccccggccaagcgcttcctgcacgtccagtgccgtactggcccgcccgatatcgataatgtcccgcgtagcctgaggattgagactgtccagtgcagccgacagaccgcccgtatgctcccgccacatcagcggcctgacccgaaccgggcagttttccagcgtaatcagtgcgcgcaggctttcaaagctgccaagatgggcaccaaataacaatgcaccctgaccggttctggcatgatggtgcagaagatccagaccatgcacagtaattttgtagctgctgatccggccggacagcaaaaaaacgcggtccagaatcacggaggcaaagcagtagaaatgccgatacagatcgcgcaaggtcgcgggccggttgagcgctcgctgtaaaaactctctgctggcgtgacgtgcccctgtgcgggtgatcagataccatcctgctaccacaggcatgatcaggaatctgatcagccagtccactcgcaaggtcagacggatcaggagcgcaggcagaaattgtccaccgccttccttcactctggtccagtaaatgctcatcgattcagtggatcgtgctggcaggtgaagccatgagtgcttcacgtgaaacaatccacaaggacgtcatcctgccagcaaggccgatctggaggtggcggggaaaaaggttagacatgacccatcccctcctgcgggggcgtcgggtgcatggcctggaccctggccttcagtgatactccgctttcggttgagaggatgatggtgctctctccgttcgtggctgcttgagtggagatatcgactctatcccccggcagaacgggcatggaaaaacgggcggaggcgatatgaaccggagcctgatccattttcaggaatcgcagggcgtgatccagcagcagaacacccggcagcaatggcctgcccggaaaatgcccggccaaagcaggatgatcccgtgtgacctcaaaactgggctgaggtgggatggcagcatgctgatcgtctgtaacaccgtcattcatgccgtgatctttaaaaagcaattgtgttcatacgatggagcatgtcctctatcgcgttgcgcggcagtttaccaagcgcattacgaggcaatgcctcgactttaaccacgcggcgcggcaggaaggcagggtcgatccgggcacggagcccctccataatagtggtaaccgaacagcctggcgcaaccaccaacgcgatcagctttgcttccggattgttcgcgtcgtctgctttgtggaaggggagatagaaagtgccatcttctacccccggaagctccgacagaatatggctcagcccggccagagaggcgcgcttgccaccgcgtttgatcatatctgcctgacggccgagcaaccggaaggagcggtccggcagaagggcaacaatatccgcaagccttgtatccgggcagaaaggagcctgcgcaacgggctgatcaatttcgatcccgtcctgaccagccccactcccgccggcggcttcaaggcttaccccatccagtagatgccacttgtcttcagcaaccgtccggcgggtggcgaatgagccgatttcggtagcgccgtagatttcatgcacctctgtgccaaaacgtgcctcaaacccggaggccaggggcggggacaggggggcggtggctgaaatggtgcgcaacaaaggcggcgctggcagagccgcatcctgcatcgcccgcatatgcagcggtgtgcataccagcatacgcggggccggaatccgttccagcgcatgggttatatcggccggataaaaagccgggccacaccatatcgccgctttggtatgcaggggcagcaggatggacagctcaaacccgtacatatgctgggaaggaacaggcgccacgatgtggcaaggcgcgtcagtttctgtcggcagggcaaagcgagtgccgatggccctgctgcgctccaccagagcgcgccatcgtttggtatgggccaccgggttgcctgttgatccggaggtgaaagcaatggcggcaatccggtcatcgggaatgtcgtggggcgggcggctccagacggaagcaccgctcatgtcccatatcacgaaagtccatccctgttgccgtgcaagatcaatgaggtcggtatctgatgatgacagcagcagggctgttcccggataggactgaatcaggtgttcaagcccgtgcagggtgcgctcggccgtcatcagcgcaggaatgcccataatctgtgcagccgcaaaacctgtggcgaccgccagccgattcctggagggcagggccagaaaccggcatgccggtaactgccgtgtcagcagatcggcttctcccagaaacattgcgactgtgatcgccccattcgggacggccccatccggcgtcagaaaaagcgtctcgtgaggctgccggtcggtcagagccgtgctggccggtgcgcgccgggttaccgatagagcatgagtcgtaagcaaaatatatcctgacaggaagaagcataaaacacgaccggagccgtccggttaaatatcaggtcaggccggagagtaacatttgattttttgtcattcttaatctttcattcccggtcaaacagatatttcatgatcccatcatgaatgctacgggcgaggcgtgatacgttcgaaagccaacaggctgcttccggctcgttccttgaccgctctgattcttggcagaccggatcatcccgtcacgttcagtgtcgatctggaagatcatgggggtgggctggatcgccttgcagggaatgcaagccgtctgcttgattggctggcatccaaccatgtgcgggcaacgattttcaccgtgggggagttgggacgcaccgccccggcgatcatccggcgctttgctgaagcaggtcacgaaatcgcttgccatggagaggtgcatgagcggctggaacagctatccccggcgcaattgcgcacaggcctgatcgcggcgcgtcagcggctgagcgatctttccggccagtctgtcgagggttttcgtgcgcccgaattctccttgacgccgctgacgccatgggtaccgaatgttctggcagaggccgggtatctctggtcctcctctgtcatgccgacccggctgaggggagggaaggccccgattggctgggccggactgccggctcggccatttctatggccctccggcgtgctggaaatcccggtcccgctgcttcgcattggccctttccatgtgcctttcatgggggggatgtggctgcgttatctgcctttgcccttgctgcgtctggctgtaaagcggatgggggggcagccgtcatgggcctactgtcacccttacgacattgataccaaagaaaaattttcacttttacctggccgttcctgtgtagccagtatggcgatgtgggccaatcgtggtcgtatggtcgaaagaatgacgattctggcagccaatcctgctccctgttttggggaaagggtgccgctctggcggcaacaggccgtcacgatacagaaacaataggcgggtgggccaatgtcggctggttgtggccagcggaaatcaggctgtttttcaaggaaaacggggcagcatcccggaattgagattgcgttgatgctgcgaatgcagtaactgcccctttcttgcgaataattcgcaaccggagagaccgatgagcattcgtagcaatcggctggcaagtgtgcatggcgcgctgacggctgtgtttctgacagcgacgtctttttcgctgggggctggtattttttggccgggcattgtctccgcccagacggcttcatcacaaactgctccggcaccagcatcagcaccggcggcgcccgctccggttggaacgtcggcaggaagcttcgcacctacaccggatgcggcgtctaccgctgctccgaaaatcaccgaggctgctgtggatgccgatctgccgcatgatttatcggttcaggcgatgttccataatgccgatctggtcgtgaaagcggtgatgctgggtctggttgcggcctccatcctgacctggaccattctgctggcgaaggggatcgagattgccggtgcccgccgctccctgcgtcgtgatctgagcgaggccatggctgagcgttctctggctactcttcaggcccgccagcatgggcgcggtatgagtccgggcgtggctatggtcaatgcggcggcagaggaaatcatcgcctcaggtgatcggaccggtggcattcaggagcgtgtcgtctcccgcctgcgccgtctggaggccgcttatggccgccgtatcgggcgtggtaccggctttctggcgaccattggcgcgacctctccctttatcggtctgttcggaacggtgtggggcatcatgaacagcttcatcggtatttcccagtcccataccaccaatctggcggtggtggcccccggcattgcggaagcgcttctggcgaccgccactggtctggtggcggccattcccgcggtggtcatctataacagctttgcccgtatcaccggtggctatcgcgcgcagctgaccgatctgacggcggcggtcacccgcattgtctccagggatctggatggccagcgttccctgcgccacgccgccgagtaatctgtttcaagcgatcctgacggagtaaccatcatggcgatgggtgtgggcgatctggagaccgcaggcggcgatgatctggccgaggcgcatgaaatcaatgtgacgccctttattgatgtgatgctggtgctgctgatcattttcatggtcgcggccccgctggcgacggtggatgtggcggttgatcttccatcctcgacctccaaaatccagaagcgaccggaaaagccggtttttgtcagcctgaaggcagacaagaccctggccgtgggtgaggaagcggtgcctgaagccatgctgggtcaggcggttgcacagatgacgcacggtgataaggaacagaggatttttcttcgcgccgataagacggtgccttatgaggcgctgatgaaggtgatggattccctgcgggcagcgggatacctgaaaatcggtctggtgactctggatgcggcggtgaactgatggtgtctgccgcaacacctgaccggactgtacagaccatccgtccggtcgtcccgcagcccctattccccggcctggccgggttgacccttggtccgagcggcttgccggagtccggaacccgtgcgctgctgcgctattcgggggcctgtctggtgattttggggctgcatgcggccttgttcgcctatgtcagccagcttcatcctgtgccgatcggcgacagcaatgattctcctccggcggtcatgattgatctgcctcctgctgcacccacgccatcggccccccctcctgacgatatgacccgccctcaactgccgccgcagccagaggtgcagccgcttcaggaaacccaaaaactccccgaaattcccccttctccggcaccctcgccggaagcggtgttgccgcctccgcctaaagccccgccggttccgcagcatccaaaactgaagccggtgcagccgccaaagccaaagccggttcagaaaccggctgagcatgtcgaagaaaaccccagggatgctccgcctgctccggcggcaccgccctctccggatgctgcgcaggctgcttcagccgcgcgtcaggcacaggcgtcatggtacggaagggtggccgggcatctgctgcgcttcaagcggtacccccgtatggccgagcttcggcatgaggaaggcgtggtcaaggtccgcttttctgtggatgaggctggccatgtgacgggctttaccatcctgacctcttccggccatgaactgctggatgagggtgcgcgggaatggatcgaccgtgcacagccgctgccgccgccgccgcaggagataagccatggtcgcccgatggtgctcagtgttccactcagctttacgattgctgatcgctgatcatcttcgtcggtgatgaatgcagcaaaggccgccattccgggcggcctttgctttttggggctgtccagagaggtgcatcatcctgtgtccgcctcaaaagtaatatcgcaaataagaattacttgcaattaaaccatcgaatcgtctaccaccgggaaagagggacggaccagccggccgtccccccgatcgggcggtttcttccaacccctgcggtaacgggcggagcggtggatatggatcatggttttgcagaaggatggtttcctgccccctcactggctttggggtcgcaggaaagaagcattctgacggccttgcgtatggcgatcagggcggtgggtgatatcgggtttgcgatgggcgatccaccctccacgcttggatcgcagacgcaggagaacacgctgtatgtgcggggaatcctgtccggactggcggatatcaactgtgccctgcaacagaccggttatcgcggctggcagatggaacctcccggatcgctgggaatgacgcgcgatgagcgtcgatttctgcgggcggtgaaagtggccgggaccggggacaggcggctgctggataattacctgttcaagctggccctggaccggacattgcggatgaaactggcgctgatcatccaaagcattgcagcctggggacaaggcatgccggatggatcgtcacagaccgcatcaagccccggcacggctgcttcccacccaacctgtccaaatctgcccattcccaacccaacccggagtcacggaattcttccggcccctgcgctggcggcgctgcgggcacggggatgttcgccggatgatctcatcattgactggatcagtgaacaagcgtgaaaggacttaggctcatgcggcctgacaaacaggatgaacaggccgtcgaggctggggcggaggagcattcgccaggacccggtaagggcgggcaggtctgcggtcggctggcacagatggaccccgcgctcagggccggtcacgaattgccgatggtcgaacacgccctgttatggaccatgcgcgcctgggccattggcgtctcacgccgggtcgatacctctgcggcgattcaggaggtttatcagcggctcggaatcccggcggcggcggtatatctggatggtttcatgtgggcgctgtgccgtggcgccagccgtcagcttgatgtcaactgcgtctgtcagaccgttgtcagtcaggatgaggcgctgctgctggacgtactggcgctggcacaggaacagcggtacgaggccatgaccgtgctgtccggcatgacgaaaccggaggcggctatagccggatgtgagaatgccgggcagctgatgcatttgctcaatacggccgggcatgtgatgtcccgcgccagtgcggccctgcggcggcatgcgtttggaacaatggaggaaggcatgtctaccgccctgcattgagggcctgcattgaggggtggaaaggcgacagccaccgaaaaggccgtcgaacccatgttcggcggccttttatgtgttctcggccacaggtgcagagggactgtcaggcttcccggtaagacagcagcattaacccgatcaggacgaagcagaccggccagatccatccggcaatcctggcggttcggccatcggccctgatctccagccagcgagaccatcctgccagcacccctgtcagggccagcggagtatgggtcagctcgatcagcagctgttccttgacattggcaatggcgtgattatgggtcagcagtaatgcactgccgactgccgtcagcagtggaaacaccaatgcagcgcgggaatgctccatcccgccaaccctcacgcgccattcgaacaggccgaacaccacaatcaggaccacgaacagcctgtgttgcagtacctccacatcgcggagggaagcgaaaaatccttcctgccccagcggccacacttcaggatcggaacgcaccagcagaaatccggccatcagcaggaaaatcagcggccagtgacgggccatccgtaatcctgcacggttgagcagggccagcacgccgatggccgccacgaaaataccggcccagtgatgattatattcgctccaggcgatatcggcggcattacgcggcggcagatcgccggaacccggttcgaaagcgagttggggattggtatgggctgtggcggcttccgtatccagctgttgctgtttttcgatcagggcaagccggtcatgatccggggagatcaggcgtggccagaccggacggttgcgttcggcgatttcatgcagcgttgcccgatcctgcgtcagatcgatggcggggggcacggaggtcagagaggccgcggcaaaaaacaacgtgaagccgatgcctatttccgcttcggcaaaccgtttcatacggagcacgggcgtcgcaggatcacgcttcagccgctcggtgattttcagattgccatagccaagcgccagcaacatcagcagcatgacgatcttggctccgaccatgacaccataggccgtgccgtaaaatccctgccatgagccgatataataccatgccatgatgatgccggagatgagaataaaagccacgcccgccatggaaaggcgcgaaaaccgggggccgacggcttgcaatgcgctcacatcgctgatgcgggcgagcgcggctacaaagcacgggatgccccctacccagattgcggcccctaactgatgcaatccttcaataaccagcagcaggatgctgttatcgatccgtgccgcggcatgggtggtcatggtggcggccccaagttcgacggcacccgccagcagcaatggcaacagcggtgcacgcaactctccccctgccagcagcacggctatggtgaaagcggcagcgatcttgatcagccccgatacggcgaaaccggcccccagaataccgctgatcggcagatcaacggtactggaaatgacggagatctgaaggccgatggcggcggtctccgttaccatcaggccgagcgcggaccagaaagcgatccgggtgctgtcccggatgacatcaggcccgacggttcccatccgtgaagacagtgggcgggccagcagagccagaaacagaatggcccccagcatcatcgattgggcgacgatggtcagcccatgaatgatgacgctgagatagccgaaaacatcaacaagaagggacactgatatggtcgcggataatcagggagcgctttttgagacagtcagtggcacatcaccgcgcgtgatatggccatccacggccagaacctgccaatgcagcacataggctccgggctgatcgagcacagcggtgacgtcgagaatatcgggctgtccgtccggtgcgatggtcagcacggtcttgtgtttgtccgggcttgaaagtgaaatacgcgagcgcttcttgtcgagccggctgttgaaatgaagtttgatagcctggctgccaggctgaacggtgctgctggcggcgggcgtgctgtcgagcaggatggcatgggctgaagcggtttgcggcatcagggcggccagagcagccagcatgatcgcgaaaaaggcagcgcaggtcgagcggaatacggtcaagtcagactctccgataagattcaatgcccggcaaatgaacaaagagcgtgctgccggcgtgacgggactgctatccgcccgggagcagagagagagccggcggacaaggggtttaaagaggtgcaccgctgctgtcgatcaccaccatatatttgccggcgatgggggtcggggtccggtccgggcggagcagggcgcggaaactgatgtcataggctgcggtctgttcataatcggcatccagcaagccgtgccgatccagaaacaggttgagcgcggcgggcagcctgacgcatccttgtgaagcctgccgtccgatccggctttccagtactgcggggtcggtggcatgcatcagcaaccggatatcgcccctttcgccatcggcccgccagcctttgcgggcattctgccagccgaaatcccatacccgcatgccttttacccccagaccgcggatatggttttcattatacgtaccttgtgcccggtaatccagaatgcctgtgctgtgggggaaaacgccgatcggggtcagataatggtctttgcgtcccggctggccagtcgaaacatgggcctttcccagaatcatccagccggcaggatctccgccatccgccagaacgggcagcagatattgcatacgcggtgcacgatcgaccacgatcagaagctgttcccggtccagtacgatccctgcttgcttgatggctgaggctgtgagggcgatccagcggcttttttcttccggcgtgatggaaagactggtccgtggaacttcccgctgcatggcgtgacgcaggagaatagcttccgccatggcttccggcttgccgaggctggggagggatggaatcagcgggattgtctgaatctcggacggagtcgtctgaagggacggcaccggtgctgccgccgccgtcagtgtttcggccccttgggcatccatcaccgaaaagatcgggagcaaagcggcgcacatgaccatcccacgccgaaaggccgcacctgaaagaatacagactctcccttcacctgatatggaaagggatcgaacggaaaaacggaccatggatcgcatccggataaatgaggacgccgcgaagcgattgagcgactctatcctcaaacatcgtcgggggaacgaagtttgtgcgtcagccacgtaaatgtgtggtgtctttggccggtatcgcgcaagaaaataaccaggaaatcatcttcggcattctcccccgcaatattataagcaaaaccggggttgttttgttcgttcggttacgttaaatggcttcagaacgtacgatcattgcattaaactgatagaaaaatgcaatgacacgggcagaggggagccagatgtctacggaagcgaacaagccgcgcggcaatcagcatcaggaagcaaaaagcgacgccgagatcgcgcaggctgcatttatgcgcccgattgtcgatgttgcggcagaaaagctgggcattgccgctgagcatttggctccgtatggccactacaaggccaaaattgatttgaattatctatcgtcgctggacagccgtccggatggtaagctggttctggtgaccgcaatcagccccaccccggcgggtgaaggcaaaaccacgacgacagtgggcctgaccgatgcgctgaaccatatcggcaagaaggcggttgcctgtctgcgtgagccttcgctgggtccgtgtttcggtgtgaagggtggcgctgccggcggcggatacgcccaggtggtgccgatggaagatatcaacctgcatttcacaggtgatttccacgcgatcggcgcagccaacaacctgctggcagctctgatcgataaccatgtctactggggtaacgaactgggcatcgacccgcgtcgcattggctggcgccgtgcggtggacatgaatgaccgtgccctgcgctccatcgtgtcctcgctggggggcgtctccaacggctatccgcgtgaggatggcttcgacatcaccgtggcctccgaagtgatggcgattttctgcctcgccacggatctggatgatttgcagcgccgtctgggcaacatcatcgtcggtcacaccaaggaccgtaagccgatccgcgccagtgagctgagcgccgccgggtccatggccgtgctcttgaaagatgcgattgcgccgaatctggtgcagacgctggaacataatccggccttcatccatggcggcccgttcgccaatatcgcccatggctgcaacagcgtgatcgcgacccgcgccgcgttgaagctgtccgattatgtggtgacggaagcaggcttcggtgctgatctgggggccgagaagttcttcgacatcaagtgccgcaaggctggcctctccccgtctgccgtggtgatcgtggcaacggtgcgcgccctgaagatgcatggcggcgtagccaaggatgcgctgaagaccgaaaatgtcgaagccgtgcagaagggtttcgccaatctggaacgccatatccagaacgtccgcaagttcggcgtgccggttgtggtcggcgtgaacaagttcagtgccgatacggatgccgaattccagatgctgcatgatctgtgcgcgaaaatgggcgtcccttgcgtcagctccgaccattgggccaatggcggcgcgggtgccgccgatctggcgcatgaggtggtcaagctggtggaaggtggctccgccgatttcaagccgctgtatccggaggatatgcccctctgggacaagctgcgtacgattgctaccgagatctacggcgcgtccgatatcacagccgatgcggccgtgcgcaagcggttcgacgaactgcaaaaagaaggattcggtcatctgccgatctgtgtcgccaagactcagtacagcttcagcaccgatgcgaatttgcgtggtgcgccatccgggcacgtcattcccgtgcgtgatctgcgactgtctgcgggcgccgaattcgtcgtcgcgatctgcggcgatatcatgaccatgccgggtctgccgaaagtgcctgccgccaacgcgatccgtctggcatcgaatggtactatcgccggattgttctaaggcacttgccgggttttctgctcaccgtaatgtgcgcgtcgcaaacgatggtctgcttgcgatgcggatcaatatcctgagggagttttctatgacgggtcgtcattttctgcacgtgccgggtcccaccaacattccggatcgcgtcctgcgtgcgatgcatgttcccagcgaggatcatcgcaacccgaccttcccgaacctgaccctgccgctgttcaagcagctgaagcgtctggtccgcaccgagaccggtcaggctttcatcttcccgtcttccggcacgggcgcctgggaagcggtgatgaccaacaccctgtccagcggtgacaaggttctggcctcccgcttcggccagttcagccatctgtggatcgacctggccaagcgccatggtctggacgtgatcgttcaggaagaagaatggggcacgggcgcttctccggagcacatccaggccgagctggaaaaagacaccgcgcatcagatcaaggcggtgatggtggttcagaacgaaaccgccaccggtgttaccagtgacgtggccgctgtccgcaaggcgatcgacgccgcgaagcatccggcgctgctgttcgttgatggcgtcagctccatcggctccatcgatttccgcatggacgactggaaggtcgacgcgatcatcaccggctcccagaagggcctgatgctgcctgccggtctcggtattgctgtcgtcagccagaaggcgctggaagcgcagaaggccgcccgcgccaacaacccgctgcgccgcgtgtatttcgacttcgaagatcagtcgaaggcgaatgaaaccggctatttcccttacactccggctctgccgctgctgtacgggctgcgtgaagcgctgcagatcatcctcgacgaggaaggtctggataacgtcatcgctcgtcaccactacctggctcagggcgtgcgcgaagcggtgaaggcgtggggcctgacgctctgtgcgaaggaccagaaatggtacagcgacaccgtcagcgccatcctggttccggaaggcttcaacggcgccgatgtgatctcccgcgcgttcaagcgctataacctcgctctgggcgccggtctgtcacaggttgccggcaagctgttccgtatcggccatctgggcgacctgaacgagctgatgtgcctgggtgccatcaccggtgccgaaatggcgatgcgcgatatcggcatcgacgtgaagccgggcagcggtgccgctgctgctgaagaatactaccgcacgaacggcaagtaattgccgcatgatgggggacgcctgaatgcgtcctccatcataaaggccggggcggtccttcggggccgctgtccggatacggaggaaagtctccggtttttcccttcgatgccaggattgcgtccatgactcagaagatcgtttttctcgatcgtgaaacacttggtgccacgatgcgcaaacccgtttttgcgcatgaatatgtcgaatacgacgtaaccggccccgaccaggtggtggagcggttgaaggacgcaaccatcgtcatcaccaacaaggtgccgctgcgcgccgatacgctggctcagcttcccaatctgaagctgattgcggtcgcggcgacgggtaccgatgtcattgacaaggtggctgccaaaaagcagggcatcgttgtctccaatattcgcggctatgcgttcaacactgttccggaacatgtcgttgcgctgatgttcgcgctgcgccgcaacctgctggcctatgccgtggatgtgcagaacggcgtgtggaacaaggcccgccagttttgctttttcccgcatccgatccgcgatattgccggctccaccatgggcattatcggctatggtgcgctgggcaagtcgattgccgaacgggcacgtgcgctgggaatgaaggtcattgcctatgatgcgttcccgcaggaagggctggtggatttcgaaaccatcctgcgcgacagtgacgtgatcacgattcacgccccgctgaccgatgagacgcgcaatatgttcggcgcggctgaattcaggaagatgaagaacagcgcgatcctgatcaacactgcgcgcggcggtctggtggacgaagccgctctggcgcaggcgctgaaagatggcgaaatcgccggtgcaggtttcgacgtgctgacgcaggagccgccggtgaacggcaacgtgctgctggatcccaccatccccaacctgatcgtgaccccgcatgtcgcctgggcgagcaccgaggcgatgcagattctggccgatcagctggtagacaatatcgaggcttttgtctccggcaagcctgccaacgtagtcgagtaagatcgtctttcacatcaggactgtctcaggcggagaggaaacgaaactatgacagcgaaattgctgtatcagtttgatacggactggaccccgagcgttttcgacagcgttgttgcgtatgatggcggtgcggatcatgtgatcggccatgccaatgtgacgccggagaatgtcggtgctctggtcgatggtgcgatctttacgcgcggcccgaaggaaaagcgtttcaccgcattgtggatcggcggtggcagcatggaggccggtgaggctgtgctgagcgcggtgaagaagaaattcttcggtaatttccgcgtctccgtgatgctggacagcaatggctccaacaccaccgctgcggcgggtgtggcgttgctggccaaggcggctccgctgaagggcaagaaggcgatcgtgctggccggaacagggccggtgggcatgcgcgctgccggtttgatggcgctcgaaggggccgatgtcaccatcaccggtcgccagaaggaccgcactgaaaaagccgctgctgcgatcagcaagcgtttcggcgttgaggtgaaggcggtcgaggccgctgatgccgctgcgcgtgaagccgttattcaggggcagcaggtagtctatgccgccggtgcgatcgggttcgaattgctgtccgaagaggcctggaaaaagacctcctctgtcgagctgctggccgatgtgaatgcacagcctccgctgggtattggcggggttggtgtcatggacaagggcaaggaatacgaaggcggcaccggcaccgtgaagggctttggtgcgctgggtatcggcggtctgaagctgaagctgcatcgcgcctgcatcgcccagctcttcgagaaggacgatcaggttctggacgcggagggcatctacgccctggcgaaggaaatggcgtgatgaccgcaggcgtctcgttcaaggacgaaagcgtcgaggctttcctcgaacagctggcgagcaaggcttccacccccggtggtggaagcgccgctgcggtgatgggggccatcggtgcggccctgtccagcatggtctgcaacctgaccatcggtaaaaagaaatatgccgaggttgaggaagagctgaagggcgttctggcgcaggccgatgcgctgcgtctgaagctgattgcggcgattgaagaagacgtgcaggctttcgatgcggtcatgggcgcctatggcatgcccaagaccacggaagaggaacaggctgcccgcaagcaagcgatccagaaggccctgcatctggctacggatgcgccgctggactgcgcgcgcctctgccgtgatgccattgatctggcggagatcgtcagccgtaaggggaatgccgctgtcatcagcgatggcggtgtggctgttttggccgctcatgccggtctgcgtagttccgccctgaatgtctatgtcaatgccaaggccatcgaagaccgggcatttgcggaaagccgtctgcaggagcttcaggagattctgggcagtgcgggcgaaaagacggaagcgacttacgagctggtgagatcgcagctcgtctgagtgatactccgggtccgaagcggctatacggcatgtttccgacccgatcctgtctggcgcttacctgagggggggaaggcgcgcatcaacgcgaagggagagacgtagatggacgtccatgagtaccaggcaaaagaattgcttgcgagcgccggtgtggccgtgccccgcggtgcaatcgctttcagcgctgatcaggccgtgtatgccgcgaccgaactgggtggctggcactgggcggtgaaagcccagattcatgccggtgcgcgcggcaaggccggcggcatcaagctgtgcaagacgtatcatgaagtgcgcgaggctgctgccggtatgctcggcaagcgtctggtcacgcatcagaccggtccggaaggcaagcctgtccagcgcgtgtatgtcgaggtcgccgatcccttcgagaaagaattctatctgggctttgtgctggatcgtaagctggagcgcgtgcgtgtgatcgcctccgccgagggcggcatggagatcgaggaaatcgcttccaagcatccggaaaagctgatccaggtgatcgtggagccggcggttggtcttcagcagttccaggcccgccagatcgccttcaagctgggcctgtccagccgtcaggtacagcgtgcggtgaccagcatcatgggcgcttatcgcgcattccgcgatcacgacgcgaccatgctggaaatcaatcctctggttctgaccaaggatgaccgtattctggcgctcgatgcgaagatgagcttcgacgacaacgccttgttccgtcgcaacaacgtcgccaacatgcatgacccctctcaggacgatccgcgtgaggcgcaggctgccgagcacaacctcaactatgtgggtctggaaggcgatatcggctgcgtggtgaatggcgccggcctggcgatggcgaccatggacgtcatcaaatatgcgggtggtgagcctgccaacttcctcgatgtcggcggcggggcaagccccgagcgtaccgcgacggcgttccgtctggtgctgtccgacaagaacgtgaaggttgttctggtcaacatcttcgccggcatcaaccgctgcgactggatcgcggaaggcgtggtgcacgcggtgaaagaagtcgatctgaagcttccgctggtggtgcgtctggcaggcaccaatgtggaggaaggccgccgtattctgaaagaaagcggcatttccgtcatcatggccgaaagcctgaccgaagcggccgaaaaggccgtcgaggccgcgaaggccgcggcgtaaggggaggcaggaccaatgagcattctgatcaataagcagaccaagatcatcattcagggcttcaccggcgacaagggcacgttccacggtcgcgagatgatcgattacggcaccaatgtcgtcggtggcgtgacgcccggtaaaggcggccagacccatctgggtcgtcccgtgttcaacacggtcgaggacgcggtgcgtgaaaccggtgcccaggcgtcgatcacctttgtggcacctgccttttgcgccgatgcgatcatggaaggcgccgatgcggggctggagctgatctgcaccatcacggacggtattccggcgcaggatatgatgcgcgtgaagcgttatctgcgccgctaccagaaggatcgtcgcacgcgtctggtggggccgaactgcgcgggcatcatcagcccgggccaggccatgctgggcatcatgccgggccatatctacaaggaaggccatgtcggcattgtttcccgctcaggcacgctcggctatgaagccgccgcgcagctgaaggagctgggcatcggtgtgtccaccagtgtgggtatcggtggtgacccgatcaatggttcttccttccttgatcaccttcagctgttcgaagccgaccccgagactcatgccgtgctgatgatcggcgagatcggtggcccgcaggaagccgaagcggcgaagtggatcagcgagaacatgtcgaagccggtggttggctacgttgccggcctgaccgctccgaaggggcgtcgtatgggccatgccggtgcgatcatctctggcgaaggcgacagcgccgccgaaaagagcgagatcatgcgctcctacggtctgacggttgctcccagcccgggtgaactcggctcgaccgttgccgcggtgctggctgggcgtcaggcagcctgatccggcatgacgaacatgcagcggtctgacatcatgacaggcacttcccggccggatgtttcggcagccggccggggaacggcttgtcttctgcgagatctgctgctggaagtggcggcacgtcatcatcccgatatcgtgccggctttgacgggggaggggcgctggtccctctccaccatgacaccgcaggcgctcggcagggcgttgcaggcgcagggcatctggtttcagcttctgtcgattgccgagcagaaagaagccatgcgtcagcgccgggcggtggaaaaacagggcagccgcgccgatgtgcgcggtaccttcgatgccgtgctggcggaagcgaaagccgctggtatttcggctgatactctgtccgatacgctggccggtttgcgcatccggccggtggtaaccgcacacccgaccgaggccaagcgtgtgacggtgctggaaaagcaccgcgagatttatctgctgttgctggaactcgacaacccgcgctggaccgagcgggagcatgcgcgtctggtacgccgtctgcgcgatcagatcgaattgctctggctgaccggtgagctgcgactggagaaggtctccgtgcagcaggaggtccattggggtctccattttttccgcgaaagcctgttcgagatcgtgccgcaggtggcggcatcgctcgaagaagccgtggctgcgcaatatccggatgctcctgccccctctccgcgtcgcgatgcgggaggcttccttcaattcggttcctgggttggcggcgatcgcgatggcaatccttatgtgacgaatgacgtcacgcgttggaccctgcgggaaaatgcgcaggccagtctggagcattatcgcaaacagattgcccgcctcatcaaatccctgtcggtgaccgaacatgcgctgaccattccgcaatggttcctggcgctggtgcgggagcgggtggaggcgatgacggatgctccctctctggcgcagcgtaatccgggcgagccgtttcgtcagttcctgaccgtgatggatgtgcggcttgaagacacattgcgtcttcagacggggggcgatgcggactttggcgccacgtctcatgcctatcccagcgctgatgcgctgatcgacgatctccgcgctatggaaaaggcgctggaagacgcaggcagccccgaaatcgccgccgatctgatccggccgttacggtgcagtgccgagatcttccgtttcagtacggtacggctggatctgcggcagaactccacgcgcctgaccaatgcgttgcatgcctattggcgcgacgtgaccgggcagggactacaaagcgagccgccctcagatgacagtgctgaatgggaagaattcctgctggatgctcttcagcaaccccgcctggcccgcctgaccccgcaggactggccggaagatgcgcgcgaggtgctggagatgtttcagctggtcgccgaaatgcgtggcaggctggatcgggaggcattcggcagctttattctgtccatgacccgttcggtggccgatattctcggtgcctatgtgatggcgaaacaggctggcctgttcctcgattccgtcggtatggagctgtgtgaactgccgatcgtgccgctgttcgagacgatcgacgatctgcgtgccgcaccgctgatcatgcgccgcctgctgaatattccggtgatccggcgctcggcccgtcggcagggcaatgtgcaggaagtcatgatcggctactctgacagtaacaaggatggtggtttcatctccgccaactgggagctgttccgtgcgcaatcccgtctggcacaggtcgggcaggatgcgggcattgccatcgcgttcttccatggccgtggcggcagcgtcagccgtggtggcgcaccgacccgtcgggctattgccgcccagccgcccggctctatccgcggacgtttccgcgtgacggaacagggtgaggtggtcagcgccaaatatgccaataagggcacggcttcctatcaggcggaactgctggcggcgagtgtgctggatcatgctttgcgcagtgaaagactggctgattccattgcctctgtccgtcctgaatatgaagatgcgatggaggctctgtcaggggctgccaatgcggcctatcgcagtctgatcggcaatccgcacatggtcgggtatttccagtcggccagcccgctggaagaattcgccttgctgaatatcggcagtcgtccagcgcgtcgtttcggtgcgcgttcgctgtccgatctgcgggccattccttttgtgttcgcctggacgcagaaccgccatctgatcaccagctggtatggtgtcggcagcgccatctccactttccttgatgtgcggggtgagcgcggcgaagaggtgctgcgtcgcatgtttgcggattatccgctgttccgcctgattgcggatgaggtggaaaaggcactgttgttcgtcgaccttgagattgcccgtctctatgccggtctggtgccggaagaggaggcgaggcaggccatcctgccattggtcgaggctgaatatcagctgacctgcgccatgatcacccggatcagcggggatgcgcaggtgggcgagcggttccaccgttatcgcacccgcctgaccgagcgcctgccggtgatcaatgctgccaatcgggagcaggtggagctgctgcggcgcttccgggatgccccggatgatgcggtgaaatcggctctgctgctatccatcaattgtattgctggcggcttcggtaccacgggctgaacccgtcgcttattgtccaaaaaaggggaggaagccatgagcttcacgctggtcgaacaagcaacgccgcgcctgcatcgctctgaactggcggtgccgggttccaacacagccctgttcgagaaatcggcccgctccgccgctgacatcatcttcctcgattgcgaggacgcggtggcgccggatgagaaagatcaggcgcgcaagaacatcattcaggccctgaacgaaatcgactggggcaacaagaccatgatggtacgcatcaatggtctcgacacccactatatgtatcgcgatgtggtcgatatcgtcgaagcctgcccgcgtctcgatatgatcctgatcccgaaggtcggcacggctgccgatgtctatgccgtggacatgctggtgacgcagatcgaacaggccaagaagcgcgaaaagaagatcggcttcgaggttctgatcgaaaccgcactcggcatggcgaatgtggaagctatcgcccagtcttcgaagcgtctggaagccatgagcttcggcgtggccgactatgccgccagcacgcgcgcccgcaccaccgtgatcggcggcgtcaatcccgattacggcgtgctgactgatcgtgatgagagcggtaatcgcgattattactggatggatcagtggcatttcgcacagagccgcatgatggtggcctgccgtgcttacggtctgcgcccgattgatggcccgttcggcgatttcaacgatccggaaggctatcgcgctgctgcccgtcgcgccgccgtgctcggttatgaaggcaaatgggcgatccacccgagccagatcgcactggcgaacgaggtgttttctccgtccgaagcggaagtgaccaaggcgcgccggattctggaagccatggaacaggccgccaaggaaggtcgtggcgctgtatcactggatggccgtctgatcgatatcgcgtccatccgtatggcggaagcgctgctggccaaggccaaccagatctccggctaattattgatcgctgctatcaaaggaaatggccggttcaaactgaaccggccatttttgctggtgagaatcgtggaaagatcagatgcgataattacgacccgagaaacgggctgacagtttctcgatcgggatgaagcgcgtggtgccgtggtcgaacacctcgatgcgtccatcctcgattccgtagacccagccgtatatctgaagattgcctttctcgattccggcagcaacggcggggtgcgatcgcagatgcttcatctgcaaaagcacgttctgttcaaccagagcctgcgtgtaatgatcgccttccagatcgccatgatgttcatggaccatgtcgcgggcttccagcgcgttgctcagccagttgcgcacggtgggcatggcatccagttccttggcttccggatcgcgcagtgccttcattgccccgcaatcggaatggccgcagatgatgatcgtatctacttttagagccgtcacggcatattcaatcaccgccgagacaccccccagcatatcgccatatttcggaacgatgttgccgatattgcggcagacgaacaggtcgcccggctcggcatgggtgatcatttcagggctgatgcggctgtcagcgcaggtaatgaacagggctaccggattttgccccttggccagcgcctcgaactgacttttccggatcggaaaaacgcgttcccggaaatgtctggcaccttgtaacagtctcttaagtcggccgttactcttcattgctgggacactctcctgaaaatagatggcgtgatatcagtatggcttatgtcgattgcaaacaaggaagcagagtgtgacgtattatgccaatgaccaggcgatccatgcccttgtcaccgggggcgcaagtccgctgggtcgggcgctcagtcgtcagcttgcggcagatgggtatcacgttctggttcatgcacattcaagtctggataaggctcaggccttggtggccgcaatccgtgcggatggcggaagcgcggaagcactgagcctggacctgtcggattataagacggcgaatacggtattctctgacctggttgagcgtaaacccatccaggtgctggtgcacaacgccgggacgcatgacgatgttccgctggcagggatggaaatcgagcagtggcgttcggtgcttgatgtctcgctgaatggatttttcgcctgcgtcagaccgttgttgttgcccatgatgggaacgcgctggggacgcatcgtggcgatctcatcggtctcggcgctgatcggtaatcgcgggcaggctaattatgctgccgccaaggccggtctgatcggtgcggtcaaatccctgtcgatggaagtagcggcgcggggcattacagtgaacgcagtggcaccgggcattattgaaagccctgcgacggctggcatggatccggagatgattcgccgggccgttccagcgcgtcgagccggcaaaccggaggaagtggcggcggctgtctcgttcctgtgcggccggaacgcgggctacatcaccgggcagaccctctccgtcaatggcgggatggcatagaccagcgcagtctgaaaagacgcgggcctccgtgccgtgatcccggccggagtctgtcgccgatcagggagcatatccctcccaacatcatgaagacgaccatggggcgtggtgtgccatcggccagcaccgcaacgcctgtgccaaataaagcgcccagcacatattgaagtgtgcccatcagggcagaggcactcccggcatgggccgcgtgtgggctgagcgcgccgactgcggcggtcggggtcaggaaaccctgaatcgactgggcgagaaacagcaggatcatcattccgatcagaccacccaggccggtatagacattcacgatcagcagagagaccagccaaagatagagagtggtgccgatccgcaaaacacgatgcattcccaaccgtggcagggccagattattaagctggctgcacccgatatagccgaccgcgttcatcccgaagatcatgccataaacggtcgggctgatatggtaatactggataaaggcggcaggggagccggccagataggtaaacagggctgccacacaaaagccgctgagcatggcatgggtgatgaacacccgttcgcgcaggatcgtgccgtagcggatcacaatactgccgggggacagcatcagtctcttttccggtgccagggtgtcgggcaggaacatgatcaccagcaccacgcagaccgcgccatacaggctgcccagccagaaaatggcccgccatgacatgacagacagcatcatccccccgagtgtaggcgccagcaacggcaccacccccatgatcagcatcaggcgggagatcaggcgcgcggcttcatgcccgtcggacatgtccctcacgatggcgcgtggtgtcaccatgccggctgatccgccaagggcggcaatcagcctgaacagggtaaagctccataaatccgtggccagggcgcaccccgttgaagccagcgtatagatcagcatcccggcaatcagcggaatgcggcggccaaaccggtcggacagggttccattggtcagatgcccgatagccaggccgacgaaccatgctgccagggtaatctgggcggccccttgataatggccgccaatatcagcctgcaactgcgggaaggccggcagatacatgtcggtggacatgggtccgacggaggtaacaagacccagcaggatgatcagggggacggaaagacgcgcggaaggcatgacgccgcccgtactactcccggtcgatcaggagcagcgaaaacttcgcaggggcaggaatgcaggaactctgttccttgactatttaaaggcgatcttcttgacaggatgaatataaactgcttagggtcaccctgaaaccggcaattctccacgccggcgcatgatcctccattcctgtctccttcgccggtctaaccgcgcgatgcgtgtgtggacggtcgatctggtgacattcccccttctgatgctgttcctcttttatatatacttcgggcgcccatgcacctcgccgaattaaaggctaaatcccccgcggacctgctcagctttgctgaaagcctgcagatcgaaaacgcatcatccctgcgtaaacaggatatgatgttcgccattctcaaaaatctggccgaaaatgatcaggcgatccatggcgaaggaacgctggaaatcctgtcggacggtttcggcttcctgcgcagccccgaagcgaatttcctgcccggtccggatgatatctatgtttcgcccagccaggtgcgccgcttcggcctgcgcaatggcgatacggtcggtggacaaatccgcgcgcccaaggatggggagcgttatttcgccctgctgaagcttgatacggtcaatttcgaggcgccggagtccgtgcgccaccgcatcaatttcgacaacctcacccctctttaccccgatcagcgcctgaagatggaggtggagaactttcagtccgtcgccaaggggccgggcaaggattgcactccgcgggtgattgacctgatcgctccgatcggtaagggccagcgcgccctgatcgtggcgccgccgcgtaccggcaagacggtgatgttgcagaatatcgcgaccgccatcgcggaaaatcatccggaagccttcctgatggtgctgctgatcgacgagcggccggaagaagtgaccgatatggcccgcagtgtgaagggagaggtcattgcctccacctttgatgagccggcaacccggcatgtgcaggtctccgagatggtgctggaaaaggccaagcgtctggtggagcacaagcgggatgttgtgattctgctggacagcattacccgtctggcgcgtgcctacaacaccgtcgtgccgtcatcgggcaaagttctgaccggtggcgtggatgccaatgcattgcagcggccaaagcgctttttcggtgcggcgcgtaatattgaggaaggtggcagtctcacgattattgcgacggctctgatcgataccggcagccgtatggacgaagttatcttcgaagagttcaaaggcaccggcaacagtgaattggtgctggatcgcaagctgtccgacaagcgcaccttcccggcgatcgatatcaccaagagtggtacccgtaaggaagaaatgctggtggataaggccactttgtcgaagatgtgggtgctgcggcgtatcctcaacccgatgggcaccaccgatgcgatggatttcctgctcgacaagctgaaatacagcaagacgaatcaggatttcttcgatgcaatgaacacctgataaaatggcccggaaacgggccattttttttgtctttacgccgcatcaatgttgcgaaaaatttcttatttctaattttattccgacatgcgaagtatcccttagtatatctgtaaatacgggggttattcgcgcagtggttgtattttacagacttcgttcagcccatggtactattgtctgcgccagcaccagtaatgggcaattgtctcatcttccggttgataaaatagccggttctgaacatgaacccgtttatattgcccgttttgcgcatgcaccgctttatggatttgcttttcggctatccgggccaatcagtttatcctttatcggaaatcaggctgaacaatccagtcttgtagggataaaaatttatcaggccgatacagggaaatttacgcttttttcttttcctggctattatttctcctccgttctgggaggaaagcagaatgcttgcgccgcagccagaggtggatgggaaatttatacgctggaacaaactgccgacatccagccgcctgatgatgtcgtgcaatgtttggcccatcttgagacaatcctctccaaaccgctttctgttgagcgcctgatccagagtatagagcctgcagatgcgtctgataccgctctggtcagaactgtttttcaggctttatttttcctcctgccttatgatgatattgatagattatcaggtcggattgcaggcgatctggatcttctcaatgctgtcagagccatttttcccgatgatttctggttgcagacggcactgccggatttaaaaaaatggcagatcgatcaacggttgctgcctgaaacgcttagtatcggaccggatagggattatttgcaacggacgggtcagaattctcatccgacttcggtagggtttttttgtaatttttctgcaaggtcgcagatagaaccacggaaaaatgcctgcgtggtaacaacggcacgtaatgaaggcgtctatattctggaatggatcgcccattatcaggcactgggttttgagcatatatttttttattcaaacaataacgatgatggctcagagcagcttcttaaagtgctcgccaaagaaggaattattacctatattgataatgtcctgggagccgggggcagcgcgcagtcaaaagcattcgggcacgctcttagtcaggcaccttatgtgctggattttcgatgggcactgctatgtgatcttgatgaatttcttgttctggatcgtaaatgtttctccggtatgcaggattatcttgaatggcaggaggcatttccaaccgatttgattgcgatcaactgggttgagtttggccccaacggccagagcagatggaacaaccggcctctgatggagcgttttcaaaaacgcccggctgaggcactgcctgctgtcaaatccctggttaagcctcacagattttttcattcccaaccccattttcctgttgtggaacggaacagaacaatctggagaagggatgccggcggaaataaattgccgtatattccgtcagatgaggcaacggccgcgaatgcaaatctgcatgaacgatatgcttcgctcaatcattactggcataaatccgtggaagagtttctctggaaagcttccagaaatcgggggaaccgcccgatgacaacagaacaaacaacacaaaatgttaatcctgaagtggcgcagaggtatctgactttatacaagtcaaataatcaaaaagatgcagattatacaggatattttgttgataaaatttatcaaaacaaagaaaaacttctcaatattccatcgatcagacaaataaataacaatatcgaagatttatttaaagaaaatatatataaaacagtacagttttttaaaaatgatgcctcatttattgaaaatcctgtttgcagagctttgcttgaattgttgaaataaaaaaatcggaaatgggtctcatgcaggtaaaaactgtgctgaaaaattttgctctggtatgggtatgtggcggaactttgctttggactggtcctgcctctgctgcacaggtcgagagtcattccgatttagcaaaaatgattgagaataccaatgtactggcaattgtacatgatctggaaaacaagaaaaatacgcttttccaaagtccggaggaaataagaattttatcaggcccttttgtcgtctcgaagcatgtttcaggtgctgaagattatggtgtggcagcggcttttatagctaaccagccccgttctcctgtgacagcagccgggattacaggaggtttttattcaaggccggagatgcgtgcagaatatggtggccgggataccgccgggatttatgtgaccaataatgccttaccggcactgatttttttacctgatgctcaactcaaagatcagaacaatccgactctgatggatggcacatccagcaaaaaatatatcaaggatgtgacaaccaaagcaaaaaaaatcatacccccttcggtggcggagggaacaagaattgttaccagcctgtcagcagatcaggtcaggcagttacagcccggtatgtatgtcgaggcagggaaaggatggagtgctgctctcgttaattgggatcccggggggcattggcttgatgtcgatagctgggtggcatccactggaaaaacgacccttattggattccgtccggtgtcggggaacgggactattccaatcagtgtcggcatcacaagtcgggtttatggaatcaataccatcacacgctgtcagaaagatgcttttttacagcgtgaaaaatatccaccctcctgtatcaattatgaaggctccaatatcaactgggggccagacgtcaaaagggatgaattcaatcctgattctgataggccgaatatgttcggcatttatctcagtgcggatggcaatcttcaaggcagtgcatttctggcccaaaatcactgggacaaagggtttgtgacagggcgcaatgccggtgtatatgcaggattccttcatgccggggacaggcatccccaggaaggcagttttgtgacacagcaggaagcaggacgtgctttttccgtcagacctgaatctcgccttcatgcggggacgggtgaacggccttttgaagtaaatgccgccaatggatgtatcaccagttcggcgatggtcgggcaggaaagccagcattgcacagtgactggaaaaacccagtctcaggcagcgattgagttaacacgtgatggaaaatcaccgtctgtcaattctcttctggttgtattgccggacagatcacaaatgcttctgcatgcaactgtgcaggcatatcagccggaaaataaaaaatcaggtgcgtgggagctacgctgtctctacacaagggaaggcaaagcgatcaccattcatggtcaaagcctgacaccttttctgccatccagcgctgtcgcagatatgcatgtcgcgtgtatagccgggagtgcgggcatgcaagcctctattcaggtttcatcggacagtacagctgcaacagtctggcaggctgcttatgatgcggagactgtgacccacccttgatcggggagtttattcttatcgtaaaattgtggtccccttgtttccatatccaacaatggtaaagataatttctgaggcgacgaaagggatgggtatttgactgtctccccatcgccgtcatcggtggcgcgcacgtgttgggagttcgttttttgagatcatcgcggtactgacggacaaatggtcatgagcagaattgccttatgcatgaatgtccgcgatgagggccgtgatattgcggaatggatcgcgttccacggcgctgttggctttcactcacagattattttcgacaatcgctccaccgattcgacccctgagataatcaaggcggcatcgaaagtgctcgatgtacgctatcatcattgggatcgtaccgattcacggtatcaagtcgacgcctattttacagcctgtcatgtctatcggcatgaatttgactggatcgcttttgtcgattcagatgagtatctgatgccggaattccctgttcacatagcggaatatctggatggtttcaaagatcgggaaatagggggtatcggcgtcaactgggccacttatggttccagcgggttagtcgattttccgtccgggctgattacggaaagtttcaccagacgttccggtgcagattttttccccaatcggcatatcaagtcgattgttcgtccactgtcagtcatatcctgcgataatccacattggttcaacacggatgcgccttatgtggatgcagccggcaattccctggaatggtatgtttcagatcagggtgaagtggtgaaagggctaacgaaagccatccctgattataagggggcgcgaatcaatcattattttacccgttctctggcgcattggaagtgcaaggttaatcgcgggtatccagcggatattgccatccgtaaaatggaagaattcgaatactataacagaaatgaaattgaagatccgattgctgttcgatacatgcccaatgtcctgaaaattcttgatcgtattggtaatccctgagattcgattgcacatccgatcagaagtggaagggcttgctgcaaatagggcgcgtggctagacgattgagggtgggtgcgcccttatggcaatggcaggagcatggtggtgtttgcaacggctgatctggtggatgcctatcaggatcgtctcggctcctgctttatccagtttgccagctatggcggccaggcacgtttcagcgggccggtccggactattcgtacctatgaagacaatgccctgatcaaggcgaccctctcttcccccggccagggtgctgttctggtcattgatgggggtggatcattgcgctccgccctggtgggcgatgtgattgctggcttggcggtcacaaatggctgggtcggcatcgtcgcctggggcgtggtacgggatagcgtggcgctcaaaaccctgccgatcgggatcaaggcactgggaaccaatccgtggaaaagcggcaaagccggttcaggtgtattggatgagcctgtttctttcggtggcgtgacctttgcaaccggtgactgggtttatgccgacgaagacggactcctcgtcagcccaggcggtgcgctgcctctttaatattatcagactgacacagggatacgcttgcatctgccgggtgcaaacggctagggtccacctcaagatataaatatatccttatgtattatggagagtagcatgcccgatacagcggtcgctgaagactacaaggttcgcgatattggtctggccgactggggccggaaagaaatccggatggccgaggatgaaatgcccggcctgatggcgctgcgggaagagtatggcaacagcaagcctctggcaggcgcgcgtattgccggctgtctccacatgaccatccagaccgctgtgctgatcgaaacgctgacggcgctgggggcgacggtgcgctggtcctcctgtaatattttctcgacgcaggaccatgctgcggctgggatcgcggccgccggtatcccggttttcgcctggaaggggctgtcagaagaagaattctggtggtgcattgagcagactgtccgtggtccggatggctggaccccgaatatgattttggatgatggcggtgatctgaccgtgctgatgcacgacaagtatcccgagatgctgaaggatgtccgtggcctgtcggaagaaacaacgaccggtgtgcatcgtctgtgggaaatggccaaagccggtaaactgttgaccccggcgatcaacgtcaatgacagcgttaccaagtcaaaattcgacaatctgtacggctgccgtgaaagcctggtggatggtatccgccgtggcactgacgtcatgatggcgggcaagatcgcagtcgttgccgggttcggcgatgttggcaaagggtcggcggcgtcgctgcgcaatgcgggttgccgcgttctggtgaccgagattgatccgatctgcgcattgcaggcggcgatggaaggttatgaagtcgtcaccatggatgaggccgcctcgcgcggtgatctgttcgtgaccgccaccggcaatgtggatgttatcaccatcgaccatatgcgcgcgatgaagaaccgggccatcgtctgcaatattggtcacttcgattccgagatccagatcgagagcctgcgtaactatcgctgggaaaacgtgaagccgcaggtggacgaggtcgtgttccccgatggcaagcgcctgatcatcctgtcggaaggccgtctggtcaatctgggtaatgcaacaggccatccgagcttcgtgatgagcgcgagcttcaccaatcaggttctggcgcagattgaactctggcaggcaaagccgggccaatatctgccgaaccatgtctatacgctaccgaagcaccttgatgaaaaggtggctgccctgcaccttgccaaggtaggagcgaagctgacgaagctttctgacaaacaggctgaatatattggtgtttctcaggctggtccgttcaagcatgatctgtatcgttactgagtattattaatatctgatattttttattgattattgttagtaaaggcggcctttcagaggtcgcctttattatttcaagctgttttgaaagccacctgcggcttgacgtgaaagaatcataattttattctattgaatgataaggaaatttgcttcataaatcttcacaaaaggatgcacgcacagtctgaagctatgacttaagagccttacccaatcgcatcgtgcagcgggagaaaagggtaaggagcaatgaaaaataaaatgctgtccgtatgcgactttcgcgtggtgtcctgcgttctgcgcgaggcttccactcaggaacgtcgccaataaacagtgtagcaaaaattgctcacagagatgtccaggatgatgaatacgccacgtaatacggtgcagatccatgctgcatcggctcagggcgggctggtgacaccaggtctgcctacaatgagggagatgcctgtggtggcttatacccaggccttgcagcgcgctttggcacggatgccggccgcagaggtggccaaggattggctgtttctggaaggatgggagcgctctcccaccatggcaatggcctttgcgttgcgtgtgaaccagattcgtcgtgccaaccctgaactcgccgcggaaatccgggcagagatcgcaaatggcaggccgctgacggatgaggaacgcgcctctctcaggaaacagaaaagcccctcttgctaaagtttgatgaccaagctatatgcccgccagccgctggttcggacgtgatggagccagcaaggatggggccatagctcagttgggagagcgcctgaatggcattcaggaggtcgtcggttcgattccgattggctccaccaaatatttaaactccacctatcccgggttggagtttttttattgtcagcatcatggatgttctgttcctgtcgtccggcatacggacggatagccagtatgtctgatgccagggatcgactgatgcaatggcaatatgcgcgccatcatccagcatcctgtgaagggcatgccattggcgtaaaccgtcacagccgcgcatgaagatatcggaatgccggtgcagcgaaagacgtgtaaaatccagcccaagcccctcgcctgaacatttggaaatggcctctttcaccgtccagagcgccagaaaatcatcgatatcgccttctctattgtcctgttcatggcacaggatagaccatggcaatcttgtatccgatggcggtttttcttccacatcgataccgaccggatttcctgcccgcacagcgatcaccacatgctggccgctatggctgatgttgaaatgaagattgccatgtgtgagggagggcttgccgtttgcatcgaccttaaaagcgagatctgccggatgcagatcgagcaatccggccagcagccagcgtttaagggtatgcgctgcctgatgacggtttcgatccgctggaagccggtacatatcccggcgcgttatttcctgctggctcagccaggatggtagaaagcacaacgctgcctcgaccgggaacgtggccacaaccatggtgtcgtttgtcatggaaagcggaaaaaatgccgacgtgacaggcgaggcgctcaaaggcatcctgccgcagacagaagatttcaatctggattttccagtctggcgtaccatgtaaagccatatacgatggcagtgattcttatcatgggacaaaggtgtcacaatgtcggtggatgtgaaataccagacgacggcaactgcaactggcggtcgggatggcagtgcccgcacggcagatggtcggtttgaagtggcgttatcgactccgcgggagctgggcggtgcaggtggagaagggaccaatccggaacagctttttgcctccggctatgcggcctgttttttgggggcgctcaaggtggccgggcaacaactgaaacagaagattccatctgatacttctgttaccgccacgatcgggattggcccgcgttctgaaggcgggttcggcattacggcccagctttcgatccatttgccgggtgtcgaggcggcagaggcacataagcttgtggaaacagcccatcagatctgcccttattccaatgcgacacgcggcaatgtcgatgtagggctggtggtcgcgtaaggctgtatgcccgttttggaaaagcgtatgaaaatagggattctccagaccggtcggccacctgctcatctggtggccggatatggtgattaccctgcgatgctacgtcgtctgctgggtgatcggcacgattattccattttcgatgttcaggggaatcagtggccgcaggaaagagagtctgatcgcggcggttgcgatgcttatgtgatcaccgggtcggcggccggtgtgcatgatggccagccatggatagaaacgctggggaatttcctgcgtgagcgggcaggcaagagcaaactcgtcggcatttgctttggccatcaggtcatggcggaagcgttcgggggcagggtggagcgggccaggattggctgggggctcgggctgcaccggtatcggctgcgttgccagaccgcctggacggatccggtggaggacattgccattccggtttctcatcaggatcaggtagtggaaaagccgcctgcagcaaagatcatagcatccagccatttcaccccgtttgcagtgctggaatatccgtcgcttggggcgatctcattccagtgtcatccggaattcgatccggattttgcagccgaactggtgcatatccgtccaccggagcaggtggaccagaaacagcgaaatcaggctttggcgtccttgcaagggccgcatgataatccacgtctgggacagtggatcaatcgctttctgatgtcctgaattccggcggctcctccacgcgggttacgctgccaaaaccgggtgcaggggcggagaggtcaaccggccgcgccgctgccagcgcgcagagaatgcgcagcgggccgccatgagtcacaacgattcgattttgccgatcccgcatccattctgcccagatctgatcgatccgatggcgcagggtgcgtatgctttccccgttggggggcgtaaaatcatcgggtgatgccgcccagtcatccagtgtggcgcggtcgatatcgtcccagcgacttccttcccagtcgccgaaatcaagctcctgaagtcttggatcgatcatgattccggggggctggatgtgcccggccagccagtcggccagccaattggccagccactggcagcgcaaggccggactgctgacgatcatggcatcccgcatatctgtcagttgcgccagaatggtgcgggcggtctcctcccgatcatcggccagcgggacatcaaggcggccatagcagagtccgtcggcaatggctggtctggtatggcggatcagggccaactgcatgatgggcttacgatccggctggctcggttggagttgcgtcgctgttgtatgacggtgcctgcaagacgcctatcccgcgaagataggtgatgacagccttggccgcatcgtcggcagagggatgcaccatcagctgtccatttccttgtgcgccggctttcgcaataagacgaggacgcgcacgataagggcgttcctcgatatcagatgaggatactacgaccgtgctgtcactctgcgggagcaagctggaggcttcgatggtctcgatcacgcctttccgcatagcggcaaaggcgaagggcaacggtctcggggctgccggatgcacggtcagcacgcagggcaactggatgctgacggcacgccttgcaccctttggcctggcctgaagcagatgaaggatgttccctgctgtcgtgtctcggtcaaaggcggcaatatctgcggcaatcggccagcccagcgcctgtgccagacgatagggcaatgtgccgctatccataccgccttgtgcgcgacggcctgtcaggatcagatcgggcgggttgcagcggatgaaagccagcagcgcgggcagtggatcgacattggcatcctgacgcagcatgacgatccggctcaacccatggccgggtatatcacgcaacggggcggcttcaggcccggcatgcaggccggagacatgcgcgcctagttgccgggcaagggcgatggcctgtgtttcttccatcacgggggctgaccggccggagacgggatggcatccggctgagagcagcaccagcacgttcagacggttggcgatgggtgtgtcggactgggtcatgatgtttccctgccggggctgtgatcttccggattggcccttcccggatgagcatcgcgttccgttgccagagccgcgagaatggccggcatgacctcctgcgcatcggcgacgatggcaagcccggcccgggcgatcatggcggcgtgcagatcggtattgactgcaacgacatgctccacgcccgccacaccctgaaggtgctgcggcgcgccggcaatgccgagtgcgaaataacaggtggcatcaaggatactgccggttgccccaacctgccggtcgcgtggcatcagcccggcatcgcaaatcacccggctggcacccggtgtcgcgccgagggctgtagcgagagcgtggaaggccgcaaaatcggtgatgccattcccggcggagacgacgaatgatgcttccgtcagggccaactgtccggcatccgggggaacgtcgcgccagcccgtcagtgcgcctgtctccatctgtggcagttccagcgggatagggcgcgcttcgtgccggatgccggtatggggcgcggcacggtcggcgctcaatgccagcagcggcggaggcaccatccgttgctcacggcggcgcgcatggctgggacggatcgcctgagacgcggacagggcttcgatatcggtggcgatgtccagcccggacaaggcggcgacacggcgggccagatcgccgccatcagggctttccgggaacagaacgtgtttcggttgcaggtgggcaatcgcggcgaccagagcggcaacacgcgactcgacggaatcatcctcgtactgaatgaggcggtcggcaccgttatcacccgcctcggccagtgctgggccgaacagtacgacggcaccttgtccggcggcacccgctttgtcagcgaggattcgggctgcgcccagtatctgccggtcatgcggtgacaggcgtccccccgccgcatcaggcacggcgaggatcaggaaagcgggatcgtcgatcatgcggatgcgcggtgcggcttcctgtctctggccggcaggagaggcgatggaggaagctcctccatgccaggcgcgatccagacgcgggcgagtagccggggagggcacggcctgcaccagcgcctcggcccgcgggttgcgacggcggcggccaaagggagacagagaggaggaggctccaacatccatcgcgagcgtcgcaagctggtagcgtggccgctcccctccgctcacacggcgcgcctctcgcagggcgcggggatcgagacgggggcgggtcatgccacaccctccggcaggatggtttgcgatggttgtgccacccgggttttggcatgctcgatgctgtccagcagcaattcggcaatatccttgacttcggggcggtctccggtgacgccctccagcatggcggtgcagccgggacatccaaccgcgacaatggaggcacccacgccctgagcatggctcatgcggatatcggggatacgtttttcgcccgcaatatcggtgaccggtgcgccaccgccaccgccgcagcacatggcgcgttctccatgacgctccatctcgacacgatgggtggcaagacgatccagaatgcggcggggtgcatccacctcaccattgtaacgcgcgagatagcagggatcatgataggtgacggggcgagtctcgaatttcacaggattcagcttgcccgttgcaatcaactcatccagcaaggcggtatgatgcagcaccggccatgtcgctccgaaagcgcggtattcgttgcgcagcgtgtgcagcgcatgcgggtccgctgtgacgatgcggcggaaacgacggcgtttcagcgtggcgatattgtcctgtgccagacgttggaacccggcctcatcacccagccgccgcgccagatcgccgcagtcacgttcctctgcgcccaatacggcgaaatcaacgccggcctgttgcatcaatgcgatcagtgcccgcaggctccttccatagcgcagatcgaacgcgccttcgcccagccatagcaggatatcggtttctccctgttcctccagcacgcgcagagtcatcccggcagtgaaatcggtccgtgatgccagcgcccgtccgcccgcatcatcggcataacgcagatgatgcagtggctgggctgctttttccggaatagcgcccagctccagcgtctggaaacggcgcatatcgacgatcgcgtccacatgctcgatcagcatcgggcattcatgcacacaggcgcggcaggtggtgcaggaccacagcgtatccggatgaatcactgcatccgcgccgatgatcggatgatgcgcgccgccatgccccgccacgggacgtgcctgtgggtaggggctgcccgtataggcgtcgccgccatgcagggcgaacgtcagatcctgaatcagctttttggggttcagaggttgtccggcggcaaaggcgggacaggcctgttcacagcgtccgcattgaatgcaggcatcgaaacttgccagacgattccaggtgaaatccgcaggtgttgaaacacccgactgccccgcttccagatcgagcgcaagcagtgctgtatcgcggcccccctcgaaacggcccggacgcggatgcgccgccagatgcagcgatccggcgactgcatgccgcatgggtccgttcggcagatgtgccaccagtgccagcccgccggtcagcgtcatcactgctcccgcggcccctgccgcgtggggcagcacatcaggcagcatgccatgcaacgccgcaccgatcgcggcaatcagcccaccggtcagataaagtccaagccagagcggcaaagtcagaaagcgaccggctgacagatgcggtggcgttgtcgggctgcgtcgtgccgcgacatgacgcgcaccgctcagaccgaatgcatagaatgcggcggtgacgatccagaacagggaggccaccatgccgccccgatgcagcactggcaggagggtggagagcagcgtcaacaccgatccggccagcaggccacccgccaccagtttgtgcatcctggcgttttccggtcggcgctcgacgacgtgatgtacatccaccagatagcggcgcggcatggcgatcagcccgcgaacccaatccacatgtgttttctgtccgacccgccagcgcagggcgatgcgtagcgcctgaaccacgaccagcaggaccagaaaccagatcaccagcagcaacggtgtgcccggatgcatggcggggactccttccgtgactggttacagatccttgcagagccgaagcgcgtcgtacatcgccgcatggatgttgcggccagccaccgcgtcaccgatccggaacaggctgaaatgtcctgtttgtgcgtcagcttgcgatgtgccttgcagcaaggagggaagatccgtcacgccatgattgctggattgctctttcaacgcaaaataggtgtcctcgaccggcagcgtgccgaaatcggcgaccacctgatcgattacacgctcttcctcggcatccgtcatcgtgttgcgcagcaccgccaccagacggttgccttcacggtagacttccatcaattccagattgggcgagaggatgacaccaagtttgtaaagctcccgcaaatgcacgggttgattggtggtgccgacttcctgcgcaatcatccggtcatgggtgacgaattccaccagcgcgccgcgctgggacatcacctcggcgacggaggcggcattgtgctggcccatttcgtcatacagcaggacactgccggcgggctggacccgtccggtcagaatgtcccagcttgaaatgatatgttctgcccccggaatatggccgggattgggcaggccgcccgtggcgatgatcaccgtatccggttgctccgcctggatcagcgcggcggtggcttcggtgttcaggcgcagatcgacgttcaggcggcggatctgactcaacagccagcggggaatgccggacagggcttcgcgccatgttcctttggccgcgatgttgatctggccgcccacttcgccggagcgttcgaacagcacgacctgatgaccacgctcggcacagacccgtgcggcctccagcccaccgggaccggcgccgacgacgacaatttttttctggcgatccgcttttgcgatgacatgcggcatggtggcctcccgccctgtcgccgcattctgcaaacacagcgcatcaccaccgacatagatgcggtcaatgcaatatcccgctccgacgcattggcgaatgtcgtcttcccgcccctcgctgagcttgcggaccagatgcggatcggcaatgtgcgcccgcgtcatcgccaccatatccacatgcccttcggccacggcgcgggcagcggtcgccagatcggtcacgcgctgggcatggaaaacggggacatcgacctcccgcttgatcgcgctggccagatgcaggaacggtgcgaccggaaaagccatgttcggcaggctgaccgcatgcgccatgtcgtcgcgtgcctgaccgcccagaatgttcaggaaatccaccagcccctgccgcgcatattcggaggcaatggccacgcattcttcctgagacaggccttgcgcatacaactcgtcacccgacatgcgcatgccgatcagcagatcgtctccggcggcttcccgcatggcgcgcagtacctcgatgccgaagcgcatacggttttccagcgagccgccgtaacggtcggtgcgtttgttgacatcgggactccagaactggtccagcagatgaccatgcgccccggaaatctcgaacccgtccaggccgccttccttgcagcgacgcgccgcctgcgcgaaatcggcgatgacgcgatcaatatcttcctgctccatcgccttgggcagggaacggctggcaggttcgcggcggacggagggcgccatgaccggcaaccattgatccgtatcccatttcgtgcggcggcccatatgcgtcagctggatcatcagctttgcgccatggcggtgaatccgctcggcgaactcctgaaaatacggaatgacgctgtcatccgtgacggcaatctggttccacggcgttgccgggctgtccgccgagacggaggaggagccgccgaacatggtcaggccgattccgcctttcgccttttcctcatgatagagctgatagcgttctttgggcttgccatcctgaccatagccgggggcgtggctggtgctcatcacgcggttgcggaaggtgacaccgcgaatggttaacggtttcagcagggcatcggcattggcgatcatcggcacattccggggcaggcgggtgggaggagggcaggcatcggcggtggctcaggcgcgtcagggtgcactcacgcgctcatggcgcggcgaatgcccgtaacgcagccggtaggcgttgctgaaagacgcgccggaggcaaagccgcaggcaacgccgatttcagtgatgggcatggcagtctggcgcagcagcaactgggcgcgctccagccggacggaggcggcataggcggcgggtgtcatgcacagatgctgcttgaacagccgttccagctggcgtgacgacagcccggccagagccgccgcatcggcgacggaaaggggatcatcggacgggttctgcgcattggcttccagcagcgccacggcatgggccagccgcggatgccgggcagcggtacggggcagatgctgcctttctccgccctgacgaggcttgatcaggaactgacgcgctacggcgtcggcggcacgcggaccgagacgggcggctatcagcgccagcatcatgtccagcggcgcagtcccgccggtgctggtgaagcggtcgcgatcgatcacgaataactcatcccggaatacgatgtcgggaaattcctcacggatggcggccagatcttcccagtgaatggcgcaggcatagccggacagcatcccggcctccgccagcacgaaactgccggtgcacagcgcaccgagggcaccgccgcgacggatatgacgttgcagcgcggggaacaggcgacgggtagtggcacgcctgatatcaacgccgccacagatcagcagcaggtcgatcggcgcggcatcggccagcctgaccgtcggtcccaacgacaggccattgctggcctgtgccggttcgccatccggcgtcagcacctgccatgaataggcatcactgctggtaacgcgattggccatccggcacgcctcgatggcggaactcatcgcaatcatcgagtaattcggcagagtcagaaaaccgattctgccgatctccgcagggaggcgtgcaggtgtgtcgatcatcgctcgacaaccagatccgtcagcggcctggagcagcagggcaggaacatgccctgatcgacttctttctgtcggatgccgccattatgcttcatctcgacccggccggagaccagtttcgacttgcacgtgccgcacacacccttggagcaggaagctggcagtttcagcccggcccgccgaccggcctgcaagacggtggtatccggatcgcagtcgatctgcctgtcgcttttgctgaaggtgatggaaaaaccacccgatgcggcgacagcctctgcttcagcggcggcttcgggttcttcctgggccagtatgccgaaatcaaagctttcctcatgatggcgacgcatgtcgaatccggcttcggccaggatcgtttttgcggctgccatgaacggtgcgggaccgcagacgaacacttcgcgttccatgaaatccggagcgatccgggtcagcagcgcggtgttcagacgaccgcgatatccattccatatttcaccggcggaatccgtctcgcacaggaaggcgacgctgaatccatgccgtgtgcgcgccatcagggacagctcgtcacggaagatgatgtccgccggactgcgcgcggcatgcacgaaaaccgtatcggcttcggccgccagatcgtattgcgtgcgggccatggccatcagtggcgtgatgccgctgccgccggacaggaacagatatttcggcgccggatgatggacgttcgtgaaatcgcccatcgggccgacggcacgaatgcgcatgcccggtttcagagtgtcatgcagccagttcgacaccggcccgttcggcacccgtttgacagtgatgctgagcagatccgggcgtgtaggggcagaggagatggtgtagcagcgattgattttctgcccaccgatttccagatccagtgtcacgaactgtcccggcagatgccggaacagacacggattggccggcgagaagaaaaacgttcgcacatcatgtgtttcctgccgtacggcacggcagatcagcacatcatccgcatcggcattccactgcgccggcagggcggagaggggcgagaaagcgttcactgtgcgccaccctgctgcgctgctttcatgcgggagatgtaccagttgctgaatttctcaaccagcatctcggtataaggggagtatgggccgggctgataggcaggggtgcgcacaccttgctgggttataccgaccagatcgctatcctgctggttggtggcttcccacacgcttttcagatgatcgaggtcataatcgatgccttcgcgcgcatccttgtgcaccagccatttggtgcgcagcaaagcggtttcggcatcaatcggaaacaccgcgaaagtgacgatgtgatcgctcatgaaatgatgccaggaattcggctgggtccagaaagacagagcgcccagcttgcgttccgtcaattcccccagcaatttcgtgcaggcgaccctggtgtcgggagtttcgctttcgccggcaccggaaatcggcaggcgctgggtgcggaaaccggttacgcgatcgtcaagatggtcgatctcgcgggagggaaggccacgcgcttcccactcggcggtgttattgttgacgaggcagttatattcctcggcggctttctgtccgtcctcatccagtgattcaggcgcaaagccgaacccgaattcgaaaatggaggcggtcagttcgggatgggaaccggcgcagtgatagcactcgcggttattttccatcaccagcttccagttgccgcgttcgatgatatccatctcgaacgcgatcttggtgtcgggaatggcatgcggggtcagatacggtgtcatctcccgcgccatatcctcgatatcggccggcggttcatcggcgaaacacaggaagatcaaccctgcgacattgcgcacgtgaaccggcttcagaccatgacaggacggatcgaaatccgcacccatatgatcggcatgcagcagcgggccttcggtggagtaggtccacatatgatacgggcagaccagatttccgacgctgcgcttgccttcggggacaatgcgggcaccgcggtggcggcagacattgtggaaagcgcgaatgtccatatcgtcgccgcgcacgacaatggcgctgaaacgaccgatctgcagggccatgacatcgcccggttcggcaatatccggttcgacacccacataaatccagtgtttgccgaaaatcgtctcgatatcggcatccagaatgtcgggtgaggtatagaacggggcttccagcgtatagccgggcttgcgccgtgccagcagggaagggagagaatccggggtaaagcggagatcgtcgggcatgggacgaaccttgagggaggtggcgttcagtcctacttaaaagccgattttattctgcaatttattagaaacgacattttttttatccatcccggtatctatgcattttgcgcagaggtcggaaaggattggaaggaacaatgcgttctcctgctgccggtcaggagaggcactttatggaaagcgacggtttttcttacagggaatcggcgtaaatccgggaagaagtcaggctgtcccgctccggcagcggatcattggattccgcagcggggggcgcattgcgccgggctgcgctgggggccacgccatgcgcagccttgtagaggcgggagaaatgggcgcagtctgaaaaaccggcatccagagcgatttccgtcacgctacgctgggtattgtccagcaggaaacgggcaaagcgaagtcgtaatgagcggtatacggcggctggtttctgttgcatcgcggcggcaaacaaccgttccagctgtcgtgccgacagctccagccgttcggcgatggcgctgaccggaaggggttccgccatgttctgctccatgatcagcagggcacggcgcacgcgcggatcagtcacacccgcggccagcggcgggtgcggctgggcggcggtttcaccgcgcgcttcatccagcagcagcacctgacggcttttcatggcggtggagcggccgagatgtttttcgacaatccaggtcgccagatcggccgctccaccgccccccgcacaggtgatgcggtcgccatcgaccagaaacagccggtcggccagcacggcctgatcgggaaattcgtcggtgaagtcctgatgatgataccagctgacacaggtcgtgcggtctttcatcaatcctgcccggcacagcagaaagctgccggtgcacagaccgaccagcgtcgtgccggccctggcggcggattggaggtaggcaaccgtctcctgatcgaatggacgccctgcatgcagcaggccaccgacgacgacgatatagtccagttgtctgggatcgatgaaaccggtggtcgggccgatggtgatgccgcaactggccgtgatcgtacctgggcggctgcccatgatggaccattggcagcggatcgggcggctcatatcgccttcatccgccgcaaggcgcaggtgatcgacgaacagggagaatggcgccagcgtaaagctgtccgccatgacgaagccgaccgtcaacgcccggcggcgtgggggatcagcactcggtgaagttaaccgcaaggccaccttggctggtctccttgtatttgctctgcatgtcggcaccggtctggcgcatcgtcgcaataacgcggtcgagggagatatggtgcgtcccgtcgccgcgcatggccagagaggcggcgttgatcgccttgatcgcgccgaaagcgttccgctcgatacagggaatctgcacaagccccgccaccgggtcgcatgtcatgccgagatgatgttccatgccgatttcagcggcattttcgatgcgggcattatcggcgcccatcgcggctgccagccctgcggcggccatggagcaggccacgccgacttctccctgacagccgacttccgcgccggagatggaagcgttcatcttgaacagcgcaccgatggcgcaagcggccaggatgaaatcctgcatgcccgcctccgatgaacccggcaccatatcacggtaataacgcagcacggctggtaccacgcccgctgcgccattggtcggggcggtgaccacccgcccaccggcagcgttttcctcattcaccgcgatggcgaacaggctgacgcgatccatcgtatcggtcggaggccggtcattgcgggcctgttcggattccattttacgcagcagggaaacggcgcggcggcgaacgttcaacccgcccggcaaaatgccttcggtgctcagtccgcggtcaatgcagcgcatcatcgtgtcgatgacgcgggtgatatgagcatcgacctcttctttcgggcgcacggcatattcgttggtgcgcacgatctccggaatacgcagcccggtttcttcaccgatgcggagcagatcgatcccggagcggaattcatagggggcggaaggtccgtcaatgaccgctgccggtgcaaaagcctcccgcaccacaaagccgccgccgatggaacaccagcgttcatggcacagggtttcccctgccgcatcataggcggtgaaggcaagcgtgttggggtgttcgggcgtttccgtgagcatgtcgaagatcacgtcacgctccggcaccagacagatgggatgccgtccgtccagcgacaacatccgatgagcctcaatccgggcaatcatggcttcggcggcatcgggatcaaccgtatcgggttgttccccggccagaccgagcagcacggctttttcagtgccgtggccttttcccgtccatgccagcgacccgaacagatcgacgcgaacccgcaccacctgctccagacggtctccgagccccagaatgaaggcataggctgccttcataggccccactgtatgggaggaggatgggccgataccaaccttgaacagttcggagacgctgatcatgctgatctcttctggttgtcaggccgcctcgcggcgggcttcgtcaagcaattcccacacataaggggcgaaagaccgccagacttccacatgaaactgcgtggatgagagacgccagagcacgatttccgccttgtggtagagagtgcgcgtgcacatgccgaccgggaaagccgcctcggacagatcaagcgggcaaccggtgttcagcgcgtctaccgcccgctccccctcgatcagcaggcctgtttgccgatgggacacatcgaccagcgcatgcggcacatcctgcagggcggcttccagggccggggcgagatcattgatttccgtgctgaggatcagcgtttcttccggtcccatccataaggcggcacgctgcccctgtacggcagcgcgcagcgccggcggcagggcgaagccaagtgcgccattgatgcaggcgcggtcggtttcacgcagatgcagggtcaggcgccgctgcgggggcgtcacgctcagcgcggcaatagctgggctgatgccagccagtggcgtgtggcgctggggaaaggtcacgtcagccattgagccgtactccttccggatcatagaacacaaactcggtgactttcgcggcgatggttcgaccgggcatcggaatatacacggtctgcccgattctggaccgtccgcccttgatcatcgccagcgcgatggagcggcccagcgtggcgctgcgataggcgctggtgacgtgcccgatcatgggcatcggcagcggatgcgccggatcggccacgatctgcgcgccttcttccagcacgatagccggatcatccgtcaacagcccgacaagctgcttgcgattcgggtctttcatcgacgtgcgctcaagcgagcgtttgccgacgaaatccttcttcgccttgccaatggcccaggccagcccgacatcatccggtgtggcagtaccatcggtttcctgaccgacaatcacatagcctttttcggcacgcagcacatgcattgtttccgtgccgtacggcacgatgccgaagtcctgaccacgctcatatactgcttcccagatcgcacggccgtaatccgccgggacgttcagttcgtagcccagctcaccggtgaagctgacgcggaacagacggccaggcaccccggcaatggtggcgtcggcgacgctcatatgcgcaaagtcgttcagatccacaccctcgatcagcggcgcgatgatgtcgcgggccttcgggccctgcactgcgatcaccgcccattgttcggtggtggaggtcagccagacattcagttcaggccactcggtctgccggtaatcctccatcatcgccagcacgcgcggggcgccgctggtggtggtggtgacgtggaaacgatcctgcgcaatgcgcccgatcacgccgtcatcagtgatgaacccgtcttcacgcagcagcaggccataacggcatttgccgggtttcagcttgtcccacgcattgacatacagacggttgaggaactctgccgcatccggtccgaccacttcgatcttgccaagcgtggaggcatcgaaaataccggctgcggcacgggcccgggcgcattcgcgcagcaccgccgcatccatatcctcgccgtcctgggggaagtagcgggcccgtttccagatgccgacatcctcgaacaccgcgccatgttcttcggcccaaccatgaatcggcgtcttgcgcagcggatcgaacaggtcgccccgcgctgtgcccgcaaacgcgccgaacgtaacgggcgtatagggcggacggaacgtggtcaggccgatctgcggcactggcgtatccagcgcaccggacacgatgcccagcgcgttcatgttggaggtcttcccctgatcggtggccatgccggtggtggtgtagcgcttcacatgctcgatggagcggaagccctcccgcacggccagtttgatgtccttggcggttgcatcgttctggaaatccacgaaagccttggcatagggggagcggcggttatgcggcacctcgccgatgaagccgcccgtgccggctgcgggggcactgacctggaaaatgcggctgttgccgcctttcgcagcgtccagaccggcggaatatccgtcttccagcgctacagcgaggccgaaatgacccgcacaggcaccggcagagcgttcattttccgcgtgtgcgccgggcacgtaaatctgacgttccgcatcatagaccagttggccacgggactggctgaacagatgcacggtgggggtaaacccgccacacatcagcaccagatcgcagcggatatgttcatcacgtccctgtttgccgccaattcgggcggaggacacgcgcagatgaccgccggtgccgatcacggccgatcccatccggatcggaagacgggcagcacgagccgcggcaatgcgctctccgtctgcctgttcacgtagatcggcgatggcggcaatctcgacgcccgctttcgcaagcgcgactgccgtgctgtaggcttcgtcattggcggtggcgatcaccgctttggtgcccggtttcacgccataacgctgggcataaatacgggcggaatcggccagcatgatgccgggacggtcattttccggaaacaccagcggtcgttcgagggagccggtggcaagaaccacctgtccggcgcggacatgccacatccgctcacgcggggtgttgggaaggatggcaggcagatgatcggtgatgcgctgtgccagacccacgaaattatgggcatagtaaccgaacgccgtggtgcgggacagcagggtcacgcgcgggtcggccgcaagctgcgccagcgtgtccgacagccacagctcggcaggcttgccgtcgatctgcgcaccgttcggtgccagcagggagccacccatttccgactgttcgtcgcacaggatcaccctggcgccggcatcggccgcagccagagcggcggcgagaccggcaggtccggcaccgacgatcagcacgtcgcaatgcgcgtaacgctgggcgtagtgatcggcatccggggcggtcggggctttgcccagaccggcggcgcgacggatcaccggctcatagagcctgtcccaggctttgcgcggccatttgaaggtcttgtagtagaacccggcagggaagaacggccccagcgcgttgttgatcgcgccgatatcgaaagacaaagacgggctgcgattctggctttccgcgaccagaccgtcatacagctccacctgcgtcgcgcgcagattgggggtgtagcggctttgctcggcgcccacgcccaccagcgcattcggctcatcggctccggcgctcagcacaccgcgcggacggtgatatttgaacgaccggcccatcagatgcacgccatgggcgagcagcgcggaggcgagcgtatcgccctgcgcaccctgataggtcttgccgtcaaaggtgaaggacagcggtttgtcgcgccggatgcggccgccctgcggcagacggaagggcgcggaatgaatgctggggctcgtcatgagcgggactcgccgattttataggtactgaggatgacgtcggtgcgggtatcacgcaccgcgttgaagaagcggccgcagccatgagcgtgccgccaccgttccgcgtgctctcccttggggttggagcgcatgtagagataggcggtccattcctcatcactgagcatggcggggtcggctgggcggaccagatgcgcttccccgccataggtgaattcgagttcgggtcgctgaccgcaataaggacaggttatcagcagcatcgtgtcgcccttccgtgccgggatgggaatgaattaatgcgcaaccgccgcagcggctgcttcgtcgatcaggaagccgtcccggaaccgctcgatggtgaacggggcgttgattgtgtgcggctcgtcacgggcgatggtataggccagcagatgggccgcgcccggtgtggccttgaacccgcccgtgccccagccgcaattcacatacaggccggggaccgatgttttcgcgatgatgggggaacggtccggcgtcacatcgacgataccaccccagttacgcagcatgcgcatgcggcggaacatcgggaacagctcgcagatggcatccagcgtatgggtggcgatatgcaggccgccgcgctgggtgtagctggtataggcatcggtgcccgccccgatcaccagctcgcccttgtcggactggctgatataggcatgaatggtgttgctcatcaccacgcaggggaagacgggcttgaccggttccgacaccagcgcctgcaacggataactttcgagaggcaggcgaacaccggccatgcccagcaccatgctggtatggcccgcggccgacacgccgattttcgtggtgcggatcaggccgcgtgtcgtttccaccgcttctaccgcgccggatgcattccggcggatcccggtcacttcgcagttttgtataatatcgacgccaagggcatctgccgcccgcgcataaccccatgccaccgcatcatgacgggccgttccggcccggcgctgcaacgcggctcccagtacgggatggcgcatattgttggagatgttcaggggtgggcaaaattcttttgcttcttccgccgtcagccattcattatcgacgccgttcaggcgattggcgtgaacatggcgcttgaagctctgtacgtcgtgaacgttatgggccagcatcagcacgccgcgctggctgaacatcacattatagttcaattcctgcgtcagcccttcccacagcttcagcgcatgatcgtacagggccgcactttcatcaaacaggtaattggaacggatgatcgtcgtgttacggccggtattgccaccgccgatccagcctttttccaggactgcgatgttacgcagcccatgttccttcgccagataataggcggcgccgaggccatggccacccccgccaatgatcacggcatcataggctgctttcggttcggggtctctccactgacgctgccagccgcgatggccgcccagtgtgttccggatcagggataaagcggagaatttctgcatgacgaactcctggcgcgtcttgcgatatcggcggtttcagcgcggtcgcagaggcggtgcatccctgtattcgcatgacggggttgcgtcatgcaggtatgaaacagaacattttattgaatgattgcgacagacgcctttttgtgtcggaggcgtcatgtcgctaacattcatgttttttgtcgtgcataagcatgccgaccctgccatcttcctgaaatgataaaagcgacgggtttccaagagatgatgaagtccggcatcaggggcggatcataaaaacaaccgccttctataaataaagcagcctgatttttccgatacaccggaggaaaagactgcaacaaaaggggggcctcccattgcataagcgaatggaaggctgatgaggaaacggaagatgaagcttgcttctttctcctggggggatcgggggcattcagacttccggctgaacatggcgattgcgacggttcatggccggggtaggcgatagtcttgccctttgtatcgatggaggaatgaacatgctgaattccgtgactgcgcgcttgcgtgcggtcttgatggcgggtgtgagttttggcctgtttgccagcactgcggcccaggctgatccctcttcctgtcgtaaggtgcgcctgtccgatatcggatggacggatgtttccgccaccacagcggtgacggcggctttgctgaaggatctcggctatcgcccggatgtggcgcttctgtcgcttccggtcacataccggtcgcttgcagacaagcagcttgatgttttcaccggcaactggatgccttccggtgccgctgaccggaaaccttatgaggcgtccctcgatattataggccccaatctgaccggggctaaatatacgttggctgttcccgcatatctttatgatgccgggctgcatgactttgccgatatcagcaagttcgccgacaagctcggcaacaagatttatggcatcgagccgggcaatgacggcaaccgtcacattctggaaatgatcggcagcaacgccaataatcttggcaagttcaagctgattgaaagcagcgagcagggcatgctggctgaaatagaccgcaaaatccggaacaaggaacccatcgtgtttctgggatgggagcctcatccgatgaacacactttacaagatccagtatctgaccggcggtgacaaggaattcggcccgaactacggtggcgctgaaatcttcaccaacacctggaagggctattcagagaaatgcccgaatgtcgggaagctgctgcacaatatgcatttctcgctcgatggtgagaataaaatgatggatgcgatcatgaatcatcatgtcgatccaccgaaggctgcgaaagcctggctccgcagcaatcccgacactgtcaaaacatggctggatggcgtgacgacttatgatggttcgccgggctgggaagccgtcaaggctaaactgggcgactgatcagtaaggaaacgcggcgatggaatggattaccgactggatcagtgacaggaaaattcctgtcggcgcatggattgctcgtctgatcgacttgttaaagcatcatagtcagggcctgtttgacgcgatctctgttgcggtcagtgccgttatcaatggcttttcttctctgctgttgagcgtgcccggtccgctgatgatcgtgctcctggcggtgctggcctatgtgatgcgacgatctgtctccattgccgtgttcactgcggcggccctgctgttcattctgaatcagggctattgggatgagacgatgcagactctggcgctggtcctgagttccgcgctggtttccaccctgatcggggtgccgctgggtattgcggcggcgcatcgtccttggctggcgcaggggatgcggccggtgctggatctgatgcagaccctgccgaccttcgtctatctgattccaaccctggtcctgttcgggctgggggcggtgccgggcttgatttccacagtgattttcgcactgcctgccccgatccgtctgacgcagcttggtatttcctccgtgccgagacctctgatcgaggccggtgaagcgtttggcgcaacgcgctggcaattgctgtggaaggtggaactgccgggggcgaagaccatgattctcgccggtctgacccagtgcatcatgctgagcctgtccatggtggtgatcgcggcgctggtgggtgccggcggtcttggtgtgccggtcgtgcgggcactcaatacggtgcgcgtggataccgggtttgaagccgggctggcgattgtgctgctggccattatgctggatcgtgtgttccgcccgtctgaggatcaatcatgatgatcagcgataaacagggcagcccggatgctgtttccgttccggccgtcgagtttcgggatgttgacatcctgttcggcggatcaacgcaaacccggcgtgaggccatcggtctggtcgagtccggtgtcagccgggcagatattctcgaacgcaccggcgttgtcgtcggtgttgcaggggctaatctgaaggtcggccacggtgaaatcagtgtgttgatgggtttgtcgggttccggcaagtctacccttttgcgtgcggcaaacggattaaacaaggtaacccgcggctccgtcctgctgcgtcatggcgataacgatgttgtcgatattgccagttgtgatgccagaacgcttcgcaaggcccgtatggaacgggtagcgatggtctttcagcaattcgctttgctgccctggcgcacagtgcgggaaaatgtcggtatcggtctggaattacgcggcgtctccactgccgatcgccgtgtggtggtggatgagaagctggaattggtcggtctgagcgcatgggctgatcgctacgcgcatgaattgtcgggtggtatgcagcagcgtgtcgggctggcccgtgctttcgccaccgatgccgatatcctgctgatggatgagccgttcagcgcgctggatccgctgatccgcgccaaattgcaggatgagctgcttcagctgcaaagccgcgtcaaaaagaccatcgtgttcgtcagtcatgatctggatgaggcactgaagctcggcaatcacatcacgatcatggaaggtggccgcatcgtgcagacgggtacgccggaggatatcgtcctgcgtcctgctgaccattatgtcgaggaatttgtccggcacatgaacccgctgaatgtgctgtgtgccgagacgctgatgcggccactatcgacattcgcgcgggaaggcgatgtcgtgctgctggatagtgcccgcactttgaaagtcgcattgggtgggggaggagtcattctctccgcttcgttgaacgacgtccaggttccggtctaccagattgaatcttttgatccggagagtgatggtcaggtaccgcaggggatcgcggctgtgccgctgtcggccgggttgcggatggtcgtcaatctgcgtcaggcaaccggttatcccgtgctgctggtggatcagggccagctgcgtggtgtgtgcgatgatggtgaaattctcaaggcgttcagtgggctggagcgacgcagcaatcaggccgtcctgccggaactggtctgatctgcctgatcggcggtttctttcgatgtgaaacgggcaccctgatagtaatcagggtgcccgctttatgtttagtttaggattggtgccgtgatcagcctagggcgctgggctggaccggattattgatcatggccatcaactcccgccgggtttctggattggtgcggaacacacccagcatgcggctggtgaccatgctgacgccggtcttgtgcacgccacgagtcgtcatgcattgatgcgcagcctcgacgataacggccacgccgtgcggctgaaggactgagtcgatcgtattggcgatctgcgcagtcagtttttcctgaatttgcaggcgcttggagaaagcctccaccacccgtgccagtttgctgatgcccacgacgcggtggcgcggcagataggcaacatgggcgcgaccgatgatcggagccatgtgatgttcgcagaaactctcgatgcggataccccgaagcaggataatctcatcatatccctcggtttccgagaatgtccgttccagcaccttcaccggatcatcgtgatagcctgcaaaccactcctcataagcacgaaccacgcgggagggagtttcctgaagaccttcgcgggtcggatcatcacaagcccaacgcagcagggtacgcacagcctgttcggcttcctggcggctcgggcgagtggtctccggcatgcccgcctcggcagggagatcagaggggcggagcgaaggcgcatcggtcaactcggtagtcctcttgcgtaagggcaggggatgtaggcaccgcgatgagacgcggtcatggtcgtttatggggtgatgagggcgctacgccaatgccggaagatgcggaaccgggttttcagtcaggcagccatatcaatgcagctttgtgttctgatgggggctgtcgaggctgaaggccggaatggtgatgtcgaaggcctcaccggaggacgtttcgatcatatgatatgttccgtgcataaagccggagggcgtatcgagcggcgtgccggacgtgtagttgaattcttcaccgggttccagcacaggctgctcccctaccacgccgtcaccgtgaatatgctgggtatggcccagcgcattggtgatatgccaggtacgttgaagcagctgaaccgtggaagaaccttcattggcgatacagacccgataggcccatacgaaatggtgaccatcggggcgggactgatcggccagatagattggctggacggtcacccggatgtgccgggtcacgcagacatacgtgttatcatcgctcatgagaggatcatcaatcgtgtggtgctgacagacatgtctatagaatgaggggcctcgcccctgatcgcaatggcgccaggccggattggggtcgcacaatccggcctctttctcaggcgtggcgggttttcacgccgctccgttcaaggcttgtgccagatcggcgcacagatcctctgcatcctccagtccgacagaaagacggatgacgccatccccgattcccagcctggcccgttccgcctccccgatccgcatatgggttgtggtggccggatgggtcacgagggatttgctgtcgcccagattgttggagatcgcaatcagttgcagccggttcagcacccggaaggcggtttccttatctcccagatcggcggtgaccagcgtgccgcctgcgctcatttgctgccgggccaatgtgctgtgcgggtgatcctcgcggaacggatagagcacccgtgccacctcccggcgggtggccagaaaatccgccacgcgggcggcggaggcggaggctgcatggacacgcagcgacagcgtttccagccccttggtgatcacccatgcattgaaagcggacagggtagggccggtattgcgggtgaatggctgcaacacgttctccacccagtcattgctgccgagcacagccccccccagcacgcgcccctgtccgtccgcgtgcttggtcagggaatagacgacgacatccgcccctagctccagcggcttttgcagcaagggcgtggcgaagacgttatccaccacaacgatggcgcccgatgcatgggccagatcggcaatggcccgcaggtcaagcacatccagcatgggattggagggggtctccagcagaaccagctgtgttggtgtggccagcgcatcgcgccattgatcgaggtctccgccatcgacgaaaacggcctcaatcccgaaacgtggcagcaggttggcgacaatccagtagcaggagccgaacagggcacggctggcgacaaccctgtcaccggctttcagatggctcagcagggctgcattcaccgcggccatgccgctggctgtgacccggcaggcctcagcgccttccagcagggtcagacgtttttccagcaccgaaatggtcgggttgccgaagcgggagtactgataatgctgctcggtgcccagaaaggtgttttcggcctgctccgcgctgtcatagacaaacccggagctgaggaaaggaacctctgccgtttccccgaaatggcttcgctcggtgccgccatgcacaagggtggtggcgggacgccaggcggaatgagatgcagagtggtttttaaactgtgtcatgaccttgcgggcctccttcactggcccggcctcgacagccataggggtgcgaacaacgctccccaggcctctttagcgcgattatttaacctcgccgcaagctggccggacaaatcgcgagggagaggacttcttaatgcccaccggattgcgtcgtcaacgtctccgccgtataggaaagacacaggcgggtgtagttcaatggtagaacggcagcttcccaagctgcatacgagggttcgattcccttcacccgctccataatttccctgatcaatcaatagcttgtgtgcgctggcgcggccttcgctgccacgatttgttccgctgtgccaaatccgtgccaaaactgtttcagggacttggcacgtgttttccccatggagcatctcgcttaagagaggttctgcaggaaaagaaggcgatgattgccgagtctgcaaaggcaccttcaccggtaacagtcctgctatgcgcccctgcttttcatcagaggcgctgcaattttatgaaagcaggcccgaaaccctctcagcagttgctctggcagaaaatgggttctgaccagtgatcagttgaccgtccgctacgacatgggaaagaaatggcaatactgccttttcgtaacgcgctccccgcgccttcatttcagcttccgcgctatagggaagcttcttgacaagcccgctgattatctcttcggtccaggaaaagcccgttattttctttccggcaacgagaagcttgccgtctgtcagccgagtattcagcagaccacaatagccatggcagacagcagatacgagaccaccgttttcccagattgcgcgcgtgatggcctgaattccttcgttctcgggaatatcccacattacgccatggccccccgtgaaatagatcgctgcaaaatcctgcggatcgatttgctctggccgtgcagttgttgacaggagcgacttatgtcccgggtcggccagccacgcttttgcggaggcgccgagcagaggccatctcagggaacgcgggtccagcggtaccgggctacttttgggactgacgagttgctgttgaaggcctttggcgccgaatacatgccaagcgtctgtcaattccgacaaccacaatccagtcggatcatgacccgtattattgaaatgcccaacattggtaacgacgtgcaggacacacttttgcatgacggagcctccagtctgccggtgcagcctaaggcccccacgagataccctgactgttttcacgaatgcagtgatagaagtcgtcaggacgatggccgcttcactatgtcgtggcgacggctcagtcgacctctgcaacctaccaatcggcggggcctctttatactgctgcctttctagtgatcggcggtaactgttttatcgacccgctgtctggtcctgttcgaggcgagcgatatacagacgggttgttgggtcaatatgacgctcgatgaagagcgccatagactgttcttcttcaagtgactggttaagagaagacgtcgcctgcggatcttcgcaaagttctgacaatgtgatcaatgcatggtaagatgcaatttcgtaattttcaaaggcaaggttggcgaacgaatttttcaggatttcgtctccggcaaaggcatgtcccagtgcagccatattggccattaatgacatggcagcatccttaatcattgaataggtgctatcataccgaataagaagctgttcaatgcgctcagcctgacgttgggattcattgacatgttcgaccatacgctgtgacaactctggatagttctccaagcggccaatttgcctttgtaaaagttctacagcttggttttcgaccgcatgttgattacgcaaacctaaaatgaaaacgtctctggctttttctgatgtgggcataagatgcctcctttcttgaagatcatgtaggtgtatttgtaaggggaacgttctcgctcaacacgattatggcattgatcagaatagatgtttcgtgctgcctgaaatgccgttccaatcacgggtttattggtagcttcgacaccaatacgctactttctagtctgtatcataggaattgccacatattttgcagcttttacctaacaaacaaaaaataaatagcatgagccattttaataaacgatttccaagatcggtaagtttcatctaagaataatgatatttcggtttggtagaatcttacaaaggaggataattattttaattctaaaaaatgttgctaaattaagggaattattaatttttcctgatatgggctagaaaagagtatcatcatggcaaagcaatcgaaagaacagcaggctacgatcaggcgcgtaatgcatgagttcaagcatggtgaactcaagacgcgggcacagggtgggaagaatgttcagacccaccagcaagcgatcgcaattgcattgcatgaagccggcgaaacgaaccaggagtcagaccaaaaaaacaagcaaaacctgaagagaacaaaggaaaaagaaagaaaggggcagacggctcaggctaaaaaagagggcaaagcatcacaggaccgaatattgaagcgcgaccatgcgcgtgataaacggggataggattgtcctgcacattatcatggttttttccctgccagtatttgtgtgcggggttcatgcgtctgaatgtagcatcttgcttattgtccagattcatttgcagtggttttgctgcaattgacctggaaatgaaagaaaacagtcgattcacatcctatccggatagaagacgtgcgcgatataaaaatattccagaaattaagattatttttataaaataatgcaagatctataaaggaaatgatctctaaaacaagtagaatatttacacagacaatatttttttccgttcctgtttcatagagcggaaactaaagggttgccggcacgcaacttcgcttggacggtgttgttagaagtggcgggccctgtatcgatcggatgggaaaacagcggcgatacgggcagaattgggccctgtaacgatttaaatcgaaaaagcgaaatggagaaaatcatgccgacaaaggaaaagactttgtctgacgcgttttatgaaacgctgaaagatatctattttgctgaaaagcaaattgtaaaggcgctgaaaaaatctgagcaagtagcgcaggaaccagagttgcggaatgcctttgagacgcatcgaagtgagtcgatgcagcaaatagagcgtctcaaccagatcttcgagctgataggtaagtccccacgtgcgaaaacttgtgaagctatgcaaggaattcttgccgagatggaggaggatttggaagaattcggtggatcaaattcgtctgatgcagtgttgattggcactgctcaggcgattgagcattatgaaattacccggtatggcacgctaaaaacatgggcagctaatcttggtctttctgaagcagaagaattgttggatgaaactctgcaagaagaaaagagaactgatgccctgctaaccgaaattgccaataagcttagcaatcaacgggccaattcccagacaacgaaataacatatgaagaaggaaaacaactggcgctgcaaaaaaaatttccaatagtcagtttgacagcgccagtttgatggaaaaatccaacgaccgagtaagagaacaaagaggaaatcaaattgccatcataaaaaatatgattttggcatgtcacttacgggatgatattttcgtcgactccgtatgcctaagaatttctataatgtattggatatgggaaatctaaaattcagatccaataaatttcattacgtcgtcataaagccttcctacgaggtctgaaacaaaccataaggcaaatactggcttgtattctgccctccatcacggaaatcagggggctggtaaatggcccccatccggtcttacccaacataaaaattggtttgataggggaagcattgcacatacgatgatgatacgatcgtacactttcagagctatgacattttaggcctgtctttgcatgcccgggttgataacgctttcacagcgcatgttctttttgccctgctataaaatgcttccgtgatttatttgtctgccacaggaagcatgtggcagacggagcatgtgtgctgatttacagcatgggtctacctccagtgacgggaataatggcagcggtaatgtaactcgcttcatcagatgccaacagaacataaggaggagcgacttccgccggctgtccggctcgacccatcggtgtgttctggccgaatgttcgcacggcttcgggcggcattgtcgaggggatcagcggtgtccagatgggccctggggctacggcatttacacggataccctgtggtgcaagaagttctccaagtccagctgtgaaatttgcgatagcaccctttgtcgtcgcatatgccagtaaatgagctgatggggaatccgcattgatcgaagtggtgttgatgatggaagcgccctgtttcatatgcggtacagcggcctgcgagaggaagaacatgctgtaaatattagtgcggaacgtggtgtcccactcagcctcgtcaatatcatcgagtttttcgatgcttttctgatgggcagcgttgttgacgagaatatcaataccgccaaactcatccactgtccgctgaatcagcataagacaatgctgtctgtccgctacgtcgcctgacagcagaatggccttgcgcccggcctgttccacccatgatgctgtctcttgcgcatcatcatgttcgttatagtaggcaatagcgacgtcagccccttcgcgtgcgaaggcgattgcgaccgctcgaccaattccggaatcacctccagtaatcaaggctttttttccgttcagccgccccgagcccttataggtggtttcaccgtggtcgggctttggtcgcatggcatcagtccggccaggcggttcttgtgtctgtacagaaaaggtttctgcggtgtttccggtcatcgatctctccatgctggtgagaatgcgtccggccgtacaattgcgtatcaatgggccggtaatgcgttgccgtgagacatccgtgatggatggaatgcggcaggccagtaccttctacgcggcaaggtcaggatagtttcggtgaataaagccttttctgctagcttgtttagataattgcttattcaaaacaaatcttccggatcatcaacggatacaacgctgatttcgatatgggtattgattggtgcaaccatcaatactgcggggttattcaactcgctgacttgaaggcgatgaccagaaccataagatcggctctgctgatctttccaaaaaaggctgattgtctggtcagcctgttttctgtgattggccgccgggctgccacaggatatcagcgcctgcgttcaggcgacgcgccaaaataaaaagaagatcggacagacggttgagataacggatgatttctccatccaccgcctcggttctggtgaggctcatgacccgccgctcagcccgtctggcgactgtgcgggcgagatgagcatgagccgccccttcggtgccgcccggcaggataaaactgcgaagaggaggcaggctccggttccagtccgtggaccatgtgtccagcctggcgactgcgtcttcccctatgcctcgggcgggggatgcattgttctcgggggacggaaaacagagcacggcaccaaggtcgaacagatcgttctgaatagcgtgcagaatgatgcgctctgcctccggcacatgcagcgtcagcacgcccagcacggcgttgagttcatcaaccgcgccaagagcctcgattctggctgcatctttaggcaggcggctgccatcggcgagggaggtcatgccgccatcaccgccgcgtgtcgtgacccggtctattctgatgctcatggttgttctctccctgtgcagacaggtttcaatgcgtcacgaaattgacggaaaaagggaaaattgccgagacagggtgaccatcctgcatggcgggatgaaaccgccattttttcagggcctgtaaggttgccacatccagcatcgcgtagccggagctggagatgatctcaacctctccaaccgagccatccggttgaatgtggatgatggtatcgaccgtgccatgttctcccctcagcgcggcttctcgtggataggccggtggtttgttgtggaacttcgcatccggtttcgcgggaatgaccggccccgttacgattccggtgccgctatcgggatcacccaaccggacttctgtactgccgagatcggtttgttcccatgacggcgatgaagacgaagatgaagacggggcaggcgttgcggagggaggggcgctggcggttttctgcggctgtttcggcgcatcctggggggaaggggcctgcacgccggcaggaggtgctggaacatcaccggccatatcggcctgcggcattgccaaagggggaggtggtgaaggcggaggagccgcgggagtcgtttgatccgatggctgttgagacgggggttgcggagcaccgccagccttccgggcggcatcgccgacgctgggcgtgtcctgcaccaccatttcaatctgggcctgtgaagggggcgtttgcggtgacggtggggccagccatccggcaggaagccattccggtgctgtcagggccgcgagcaacagcagatgcagcagcagcccggccagcagcgcccagccaaatcccgtcctaaaggacgatgatgcccccgtcctaaaggatgatgacgcccccgtcctaaaggacgaggatgccgttatgctttgccttgctgtcaggttcgacatgaatcgtggtgaccagatgcgcgatttccgcctggagtgcggcctccaccttgtcgcatatggtgtgcgcctcggaaaccgtcatatcgcccggcacgacgaggtggaactggaggaatgtccgctgtcccgagcgtcttgtgcgcaggtcatgggcttccagcgcgccttccgcatgcaggctgactacggatcggatgcgctccagcacatccggggtgggggcctcgtccatcagccctccgactgattccctgatcagccgaaagccggaccaaaggatgtagaccgctaccagcccggccagcaaaggatcaagaatcggttgccccaccagccacgcccccagcaagccggccaccaccccggaggaggagaccacgtcgttcagcagatgggaggcatcggccttcagcgaaggggaatgggtgcgccgtgccgttttcatcaacctccagccccacaggccgttgagcatggtggcggcgccgttcagggctatgccggaaaacggagcatccagcagaatccggggttgctgaatcgcatgccatgcttcctgaaaaatcgccatggcggcgaccagaatcagtgccccttccccgacagccgcgaaaaattcgatcttgccgtgaccataaggatggttgtcgtcggccggacgctgcgcatagaccaacgccgcgaatgccatcagggaggcggcgacattcacgatgctttccatagcatcggaaaacaacgcggtgctgttcgtcatgcgccaggcgagcagcttcaaacccaggacgacaatcccgatcacgatggtgcctgaggcgaccattttcgtccggcggcttgaagtctcgttatgcgccgcctgatccatcagctgcttcccctggtccttgggcagcgccttagcagacgcctcagttctgtatcaacgatcgctgacaggtggcgggtgcaaccttgacgcaggggagggcttgaccggcagctgctactcatccaggcggatgacgaccttgccgaaatgggtggcgctttccagatggcgataggctgccactgcttcggcaaaaggaaagacgcggtcaatcactggcctgatccggtgctggctgatggcgacgttcatcgcctcgaacatcgcgcgggagccgacatagatgccgcggagagtctgggaccgggccatcagaggcagaggattgatctcgttctgaccggtgagcacgccaatcagatggatctggccgcccagccgcgtggcacggatggattgcggaagcgtgccggagccgccgacttccacaacgtgatcgacgccaagacctccggtcagggcagttgcggccttatgccagtcgggccggctacggtaattaatgccttcatcggcccccagagcctgggcgcgtgacagctttttgtcagaggacgaggtggtaatcacgcgcgccccagcggccttggcgaactggatcgcaaagatggagactcctccggtgccctgtgtcaacactgtctggcccggttgaacgggtgtgccgccgaacagggcgtgccatgccgttactgcggcacagggcagacaggctgcttcttcccaggagagatgatccgggatgcgcaccagaccatcctgttcgaacaccgcatattccgtcagcacgccgtgaatggcgcccccgagtgcgctggccccgtcccgttcggtgatcgggccatcatgccagctctggaaaaagcagggagctacccggtcgccgggctgaaagcgggtgacatcctccccggtttcaacgacctcgcctgccccgtcggagagggggatcagatcaggcggtaccggactgagcggatactgtccgcgtgcgaccagaagatcacgatagttcagagaggccgccctcaaccgtaccagcacctgtcctcgccggggtttcggttccggggcctcggtcgtgtaaagactgtcaaatccctgagggacaattccgtgcgggccgggcaggcggtatagcttcatgagacgtctccgattctcgcggtgacatgcgggggacggtatgccaatcgggcagtatggcgggcagtatggcaggcggaccggataatggcgacttatgtcaggtcaattctgcaggatgacgaatatattctgttcgtcacccgcttgcactgggtgatctatgcgcgggctatggtctgtatcatggcggctccgcttctgtcgggcaccgtggccggcgcagtggagagtcagggtgtgcgtacgctcgcgctggggggcggattgattcttatgatactcggcctgtatgccgcgctgaaggcgtggtggaggcgtttcgggacggaaatcgtggtgacggatcgccgtgtaatctacaaacagggcgtgctggtgcgtcggaccgtggatatcaatgtcgtcagaattgaatccgtggatgtagagcaagggctggtgggccgttggctgggctatggcgatgtcacgttacgcggcaccggtggcggtatggagactatccgccgtgtcgcaaggccgctcgatcttcgtaacgcggcgctggcggaatgacacgcctggatctgctccgggcggggccggatattctctatcaggaccagcattttgtggtgcttaacaagccggccgggctgcccgcgcatgccggtcctgcgggaggcccaagtgtggaggactggtttcccctgctttcccgccgcaaggaggggccatggctggcgcatcggctggatacggataccagtggctgcctgatcatcgcgctgcgcaagacgccgctgctggaggcgcaggccatgttcgcgaaagggcaggccggcaaacgctactgggcggtggtacggggggcacctccggcagcggaggggcggatcgaccgcaagctgagccgtcgtagcgagagcggagaagccgggcgcgggcactggcgtatggtggaggatgcacagggtcagtcagcctccacatcatggcgtatcatggagcatcaggatggtcttagctggctggaactgtcgcccttgaccggacggacgcatcagctgcgtgtgcattgcgccctgcttggctgcccgattctgggcgatcctgtttatggcgatggcagggatgcgccgctttgtctgctggcatgcgaaattcgccttcccctggacccggtcataaaagtgcgcgcacctgtgccagcgcatatgcggcggtacggattcaattttccgtaaaggtaaggcagtattatgcaattctgagtgggatttttatgcaacattaacgttatttacaataatatccttttccttcaaagcattccatgattttcagcatctggtaacggatacaaattctgaaggacaaaagaataccggagatgaaaagacccgtcagacttttaaaccattcggtgagggcgagccgtaaatttggaattgtcataactgtctgcctccagatcatgaaaaaatgtgaaagctcgcttgccggggatcgtcagggctgcaatgactagcaccgtttgaataaggcttttcaggagtgcgggcttcatgcggattctggttacgggtggatgcggctttattggctcggccgtcatacggcatctgatccgtgataccgctcatagcgtggtgaacgtcgacaaaatgacgtatgccgcctccgaagatgcgttggaggaggctctgaccgatcctcgccatacgctggtgaaggccgatatctgtgatgcaacggccattgcgcaggtgtttgccacccatcgcccggatgcggtcatgcatctggcggcggaatcccatgttgaccgctccattgatggcccggcccagttcgtgcagaccaacgtggtcggcaccctcgtcatgctggaggccgcccgtgaacattggtcggcacaccgccctgaagggggggggcgtttccatcatatctccaccgatgaagtgttcggagcgctggaaaatggcgatcctccgtttacggaaacgacttcctatgatcctcgcagcccgtattcggcgagcaaggcggggtcggaccatctggtccgtgcctggcaccacacgtatggaatgccgactttcgtttccaacactaccaataattacggcccctggcagttcccggaaaagctgatcccgctggtgacgctgaatgcgctggaggggaaagaactgccggtgtatggcgacggctccaaccagcgtgactggctctatgttgatgaccatgccgaggcgctggtgcggacgctggagcggggcgagccgggtggcacatacgccatcggtgcccgtcagccacgcagtaatctcgaggtcgtgcgcaccatctgttccgtgctggatgaacttgtccctgatgcgggcggaaagcgtgaacgcctgatccggttcgtgacggatcggcccggtcatgatttccgctacgagatcgacccctcccgtgcggaggccgcgctggactggaaagcaccgcatgatttcgaaaaaggcatccgccgtaccgtgcaatggtatctggatcatcgcacgtggtgggaagggattcgcagtggccgctatgccggccagcgtctgggaacggcgggctgaatcatgaaaaaaggcatcattctcgccggtggctcgggcacccgcctgcacccgatgaccctggctgccagcaagcaattgctgccggtctatgacaagccgatgatctattatccgctgtccacgctgatgctggcggggatacgcgatatcctgatcatctccaccccggaggatctgccgcagttccagcgcctgctgggcaccggggatcggttcggggtaaagttcaactatgccgtgcagcccaagcctgaaggactggcgcaggcatttctgatcggacgggattggctggaaggtcaggcctgtgcgctggcgctcggcgataatctcattttcgccgatcacctgtcggtcatgctgcgcgccgccgccagccgtccggaaggggcgacggtattcgcctatcgtgtgcgggatccggagcgctacggcgtggtatcgttcgatgatgccgggcgggcactggaaatcgtggaaaaaccggcggcccctcaatcaaactgggcggtgaccggtctgtatttctatgacgaaaaagtgtcggaatacgcagcggcggtgaagccctccccccgcggagaactggaaatcaccgatatcaatcggatgtatctcgaaagccatacgctgcatgtggagcgtctgggccgtggttgtgcgtggcttgatgccggaacatgcgactccctgctgcatgccgcgacctttgtgcagaccattcaggatcggcagggtctgctggtgggctgtccggaggaggtcgccttccggatgggctttatcgatgcggatcagctgaaggcgcaggcgcggctgcttgcgaaaaccgagctgggccgcctgctggccgaactggcggaaggggcgcagtaagcgttttttccgcctgtttattctctggatgaccgacataattcaggtgtgcgatgaaattcgaacggctggctattcctgaggtgattttggtgacgccggaccgcttcggcgataatcggggatttttctccgagacctatcagcatcgcaaatacgcggaaggcgggatctccggaactttcgtgcaggataatcacagcctgtctgcccagcgtggcaccattcgcggcctgcattgtcaggtggcgccgaatgtgcagggcaagctggtccgctgcgtgcgcggggcgatatgggatgtcgctgtggatgcgcgcactggctccccgacctacggccagtgggtggcggcggagctatcggcggagaactggcagcagctctgggttcccggcggctttctgcatgcgttctgcacgctccagccggatacggaagtcatttacaaggtcaccggcgattacgataaatccgccgagcgcggcgtgatctggaacgatgcggaactggacctgccctggcccgttgcgccggaagaggttgtgacgtccgagaaagatctccagttgccgcctttctcggcggcaaaaggctggttcacctacggggagcagtgagcatgagcggccctattctggtgacgggtggcagcggtcaggtcgccctcgcgcttgaggaagccgcgaaggcacggggtgtttctgtccgacgggtagggcggccggaattcgatttcgaccgtccagactcgattgaaaccgtgtttcgtgaggtgtcgccttctctggtggtcaatgcggccgcctatacggcggtcgatgcggcggagagtgatgtcgcggcggcggagcgggccaatcgcgacggtcctgcccggctggccgagctatgcgcggtggcggggattccgctgattcacatctccactgattatgtgttcgacggcagcaaaggtgcgccgtatgtggaaaccgacccgaccaatccgaccggtgtctatggtcggaccaagctggcaggggaggatgcggtgctggccacctgccgtcaggccattgtgctgcgtaccgcgtgggtcgtgtcccataccggcaagaatttcgtgaaaacgatgctgaatgccgcccgcaagaccgacacgctgcgggtggtggccgatcagcaaggcaatcccaccagtgcggccgatctggcggaagccattctcgacatcgcgaagaagctggaaaaaggctggaacgacacctatttcggcccgacccatgcagcgggaaccggtgccaccacctggcatggtctggcggaagcggtgttcgaacaggcggcgaagcatggcgctccccgacctgccgtgcatcctatcaagacgtctgactggccgaccccggcccgtcgcccggctgattcaaggctggactgcacccggctggaaacggtgttcggggtgcggatgccggactggcagggcagcatcgcccttatcgtcgatcaactcagcacggaaggtgcgccgggctgaccggattgagcacggccgaaccgcctgtcgccattttgctggcgacctatcagggtgcccgctacctgccggagcagctggatagtctgctggagcagactcatcggaactgggtgctgttctggcgggatgatggttccaccgatgcgaccattgccgtgatggactcatttgcggcaaaggccggcccggagcgctgccaccatgccggaggtccatccggactgggcgcatgcggcagcttcctgtggctgttgcgccatgcccatgcggcgatgccggaggccctgctggccttttgcgatcaggacgatgtctggctgccgcagaagctggcacgcgcagtcgcgcggatacaaaggcttgatccccatatgcccggcctgtattgcgcacggcagaggctggtggatagtgatctgaagcttctctctgtttctcccccctttgatccggggctggagcaaaccctgtccttgccgcgggccctggcgcagaatgtcgtgaccggatgcacggcggtgctgacccctgcattgggctcgctgatgctggtcaggcccccgccggaagagggcatgcatgactggtgggccttcattctcacggccggctgtggcggcgtgttcatggctgatgatgaggccgtcattctttaccggcagcatcaggataatacggtgggggcaccctcctcgacgctggtgcgggctattgcggccttgcggcgggggccgcggcgtttcatgaccctgttccggcagcatctggccgtgctggcggagatggaaacctgccttactccttctgcccgcaacgatctggcgcggatgcggcatgccatgcagggcggcccgatctcccggctccgcgggtggttgatccccggcctgcgtcgccatggtctggctgaaagctggctgtttcgcctgtggtttctgctcggctaacggacgtcgtggcgcactcttgacgatgtcacgacgggccgcgcctaatctctggacgcttgagggagcaggaaaagacgatgacaggcccggcccgtgtgcagtcagtctctttcgggcggcgtgccgtgctgggtgcgggcgttggtctgggattttgcctctgctgcctgcgcccgacccgcgccgcagcgcctgactgggtttttcaggaggctgcgccgggcattttcgtccgccatggcgtggatgaggacgcgaccgccgagaatcaggatgccattgccaatatcggcttcgtcatcggccggcgttcggtcgcggtgatcgatccgggcggctgtcttgaggacgggcggcgtctgcgggcggcaatccgggcgcggaccagtctgccggtcagtcatgtgatcatcacccatgtgcatcccgatcacggcttcggtgccggggcttttctggacgaccatccggtgattgtcggccatgccaggctgacggcggcccttgcggcacggggcacgttctatcgtgacaagctggatgagattctcggcaaaggtcgggcagggccggtggtgatgccgaccatgccggtccgagacatagccgagattgatctgggcaatcgcgtgctggcgctgacggcgcatccgaaggcgcatacggatgccgatctgtcggtgctggatcgctccactggtacattgtttaccggagatctgctgtttgtccgccgtgttccggcgctggatggcagcctcaagggctggcttggcgttttgaagacgttaccggcgatccgccctgcacggatggtgcctgggcatggcccggttgatgcggcctccctgaccggatggagcgccggggtggaagctttgcggctgtatctggacacgctgctgaccgaaacgcgcaaggctattgctgataatgtcccgatcggtcaggccgcgcatcaggtagcggtcgggcagaaggaccgctgggcgctgtttgcggattataatggccgcaatgtcgaggaagcctatcacgaacttgaatgggaataagggtgcagccgcgtttgtgcgcttgacttgcggggcagttacgccgagggtcgcagcatccgaggggggccctggcagagggctgagataccgtcaggccgccattatggcaggcgcatggtgaccctgacacctgatccggttagcaccggcgtagggacgggatcgcgccgaaaacgggcatcgcccgaacggtaccctttctccgcgttggttctgtagtcggttcgcggagcttgaggaaacgcgcatgaccgttcagaccaaacccaccactgtcactcttggcccgatcacgggttcccgcaagatttacgtgcctgtcgagggacgggacgatatggcgatcccgttccgggaaatcgcgctcgatccttccgccagggaggagccggtgcgggtctacgatacatccggcccgtataccgatccatcctcgcatatcgatcttgagcagggtctgctgccgctgcgcgcaccgtggctggcccggcgcggctatgccagcgtcaccccgcgcgaggtgaccgcggccgataacggctatgccccggcggatcgtctggtgacgccctgtcccgccccgcataccgtgttcgagggcaagccgggccagttggtcacccagcttgaattcgcccgtgccgggatcatcacggaagagatgatctatgtcgcgcaccgcgaaaacatgggccgtgcccgcatgctggaaggggccgaggcccgtcgcgccgatggcgaggatttcggtgccagcatccccgccttcatcacccccgaattcgtgcgggccgaggtggcggcaggccgggccattattccggcgaacatcaatcacccggagatcgagccgatggcgatcggccggaatttcctcgtgaagatcaacgcgaatatcggcaactccgccgtgacgtcctccgccgcggaagaggtggagaagatggtctgggccacacgctggggcgcggatacggtgatggatttgtccaccggccgtaacattcacaatatccgtggctggatcatgcgcaactcgccggtgccgatcggcaccgtgccgatctatcaggcgctggaaaaagtgggcggtgaggcggagaagctgagctgggaagtgttccgcgacacgctgatcgagcaggcggaacagggcgtcgactatttcaccatccatgccggtgtgcggctggctcatgtgccgctgacggcgtcccgtgtgacggggatcgtctcgcgcggtggttccattatggcgcgctggtgcctgtcccatcaccgtgagagcttcctgtatgagcgtttcgacgagatttgcgagatcatgcgcaaatacgacgtgtcgttctcgctcggggacgggctgcgtcccggctccatcgccgatgccaacgatgccgcgcagttcgccgagctggaaacgcttggtgagttgaccaaaatcgcctgggaccatggttgtcaggtgatgatcgagggtccgggccatgtgccgatgcacaagatcaaggccaacatggacaagcagctggccgtctgcggggaggcgcctttctacacgcttgggccgctgaccacggatatcgcgcccggttatgaccatatcacctccgcgattggcgcggcgatgatcggctggttcggcaccgccatgctctgctacgtcacgcccaaggagcatttggggctgccggatcgtaatgacgtcaagaccggtgtcatcacctaccgcattgccgcccatgccgctgatcttgccaaaggccatccctcggcccggctgagggatgatgcagtcagccgtgcccgcttctccttccggtggcaggatcagttcaacctgtcgctcgatccggatacggcgcaggccttccatgatgagaccatgccgaaagaggcgcacaaagtggctcatttctgctcgatgtgcggcccgaaattctgttctatgaagatcacgcaggatttgagggaagaagctgcacgcatggcggggatggagtctaaaagcgccgagttccgcgacatgggtgcgacgctgtatgtgccggaacacgccccggcgaaggaggaccgctgaccgaccgatctgtttccccggatcttgatccctctgccgtgattctggaggcgattggccagcttccggatgatgaaatcgatctggcggatgccgcattgcagcttgcccgcaggggcaggctgctggcaggtgagtcctcccgtgcggtcgaggagcagattataacagcgcgggcgcatctgacggagctggcgcaggatgtcgccatgttggctgcggggatggaggaaacagacctttcagcacgggcggggatactggccgggttgttgcagggcagctatggctatgcgggcgatgatacccgctttcccgatttcgccgatcttctacgggtgatcgaacggcgggccgggttgccggtggcgctcggaatcctgtggattcacactgcccgggcggcggggtgggaggcatatggcctcgattttcccggacggtttctggtgtgtcttcaggaggaagacgggcctggtgccagcgcggagcggcgcatcgtgctggatgtctttgaaggcgggataccgatgactgtgccggccctgcgcgatctgctgaaaaaggccgagggcgcctctgccgagctacggcccgatcaatttcggccgatgagcaatcggggggtgctgctgcgccttcagaacaatctgcgcgcacggtatctggaactgggcgcgatggaggatgcgctggcctgttctgaatcgatgttgatgattgcgccggatgaagcaccgttgtggcgggaaaccgcactgatgaatcagcggctggatcgcgtttccgccgcgttgcggtgtttcgaacgttttctcatcctcgatccggatagtgagagcgcgcgccgggcgcgtgcggtgatgcaggatctgcgttcacgcctgcactgatgtcgccagaaaagccatcgctgcaagagtcatcgaaagatcgtggcgcaatcaccgtatccggctttagcctgccaaaggctgcatgatccagcatgggggtctggcaatgaccagaagcggattgttcatcgatctggcgcaggcttttggcacggtgacggaagcgcggcatcgtctggacagggcctgccgtcatccggagcaggattgtgtggcgtccctgttgccgctcgcttccctgtccgaccatgcggcatcacaggccgatacgctggcccggtcgctggcagagaggttgcgtgagcatggaccaggcaatggtctgtcggcgctgatacaggaatacgatctgtccagccaggaaggcgtcgccctgatgtgtctggcagaggcgctgctgcggatacccgatgatggaacgcgggatgcgctgattcgcgataaaatcggtcgtggcgaatggcatacgcatctgggttggacacgccctttatttgtcaatgcggcaacatggagcctggtgctgacggggcggctggtcgccccttcctctgcctccactctgggggcggccttaaccagattgatcggacgggcgggggagcccgtgatccgccatgcgatggatcgggttgttcgtctgctgggtacgcgctttgtcgcgggcgagacgatcgaagcggcgctggccgctaccagtctgctctggacgcagggatttcgtcattcctacgacatgctgggtgaagcggcgatgacccgcgccgatgcagatcgatattatcgtgcctatgaacatgcgattgactgcattggtgctaccttgcgggcgcgtggatatgagccagcggaggatatgactgccctgcttgaggcaccgagtatttcgatcaagctttcagccctgcatccgcgctatgaacatacgcaacatgcgcggattatgcaggatctgcctccgcttttgagaaatctggccgccatggcccgggcaaacgggatcgccctgactatcgatgcggaggaagcggatcgtctgcctctctcgctggatgtactggcggctttatgtgctgatcctgtcgtggcggggtggaatggcatcggtttggccgtacaggcttatcagcgccgtgcgccagcggtgatcgaaaatctgattgatcttgcccgccatcatgacaggcgcctgatgatacggctggtaaaaggggcctattgggacagtgaaatcaaacgtgcacaaatcgacggactggaaagttttccggttttcacacgaaaatcttataccgatctttcgtatgtcgcttgtgcacggatgttgctggaagcacccgatgccgtgttcccgcaattcgccacgcataatgcccgtacagtggctacgattatcgcgatggcagaggagataaccggcgtatcattcaatccaggccaatatgaatttcagtgtctgcatggcatgggcgagacgctttatgccgatgtggtgcgaccggatggtctgaacaggccatgcaggatctacgcccccgttggtaaccatgaaactttgctggcttatcttgtgcgccgcctgctggagaatggtgcgaatacgtctttcgtcaatcgtgttgctgacaccgctatttccatcgaccaactcattgctgatccggtgcaacaaatcctcgcaatgcgaacggagtgcggtgtacctcatcccaaaatccggtctccgcgaagtctgtacgggccggagcgggaaaatgcatgggggattgatctgacagatgccacgaggatggcacagcttgccgaagcatgcatcacgctgtcgtcaaaacgatggctggtttccatagaggaggacgcggatagagaacgcatttccatccgtaatccggctgcttcatgggatcatatcggcgacgtcgttttcgccacggcggaagaagcggatcgtgcaatcgcacgcgccaggcaagcggctccctcatgggctgcggagcctccctcccgtcgcgcagcctgcctgagagacgctgcagatgcgatggaacgcgatgttgccctgttcatcaatctggctgtgcgtgaggcaggaaagacgatccctaacgctattggagaggttcgggaggctgttgatttcctgcgctactatgcggctggtattgagaatggatggaatgcacagacgcatcctccactgggtgtggtgacatgtatcagcccgtggaattttccactggccattttcacaggccaggttgcggcagctttggcagcggggaatgctgtgctggcaaaacccgcagaggaaacacctttgatagcggctgaggcggttgctgtcctgcatcgtgcaggtgtccccacggcggtgttgcagcttgttcccggcgatggcgcagtaggggcgaggctggtcgccgattcacgcgtcaatggcgtcgtttttaccggctctaccgaagcagcccgtttcattcagcgttctttgtcatatcgtttgaatacgcatggtgatccggttccgctgattgccgaaaccggcggacaaaacgccatgattgtcgatagcaccgctttgccggagcaagtggtgtctgatgttctggtgtcggcttttgacagtgccggtcaacgttgttcggccctgcgtgtgctgtgtcttcaggatgacattgctgatctggtcattaccatgctgcgtggagccttgcaggagcgtgtgacggcacgccctgaccggctggataccgatatcggtccagtgatcagcgctgctgccagagacgcgattgaggaccatattgcagccatggcacgggcaggctgcaccatgcatcgtgcggctttgcggcaggagacggaggatggtttcttcgttgctccgacaatcatagaacttggatcacatccaatccccgacaaggaagtttttggtcctgttttgcatgtgctgagatttcgcagggatgatctgtccgatgtgatcgccaggatcaacgcaaccggatatgcgctgacctttggtattcatagccgtattcaggaaaccgtcgatcatgcccgcatgaaaagtacggccggaaatatctatgtcaatcgcagtatgatcggcgccgtggttggtgtgcagccttttggagggcacggtctgtccgggactggtccgaaggcgggcggtccactttatctttcccggctggtagagcatgagccactatcaccggtgaaacagttttttattgagaaagaaaaaaacgctgtaccagcctcgataaaaatctggcaggtatggatacagcagcagggaattgaacctttgtctctcccgatcctgcggtatgatcgggatatggtgctgcccgggccggtgggagagcagaatatttatcgcctgtcgccccgatccagtctgttatgcatcgcttccgatctcgaaagattatcgtatctggtacaatcggctctggcggcgggtataaagcatattgcggtctccattcccgctgacatcacatatgtattcaacacattgccggatgcattgcgttcgacagtggttttggctgcacccgatcaggaagacagtgcggatactgtattgtttgagggggatgatgcggccctgattgccttacaaacgcgtcttgcccatcaatccggcagaatcgtaccagtctatcgtatccgcaggcggggcagagatatcccgttgctggctttggttgcagaatgcacgatcagcatcaacacggctgctgccggggggaatgccgccctgatggcaatggcataggcaatgacggcttaagcatccatggcctgatacgaaaaaagggaggatgcccgcggcatcctcccttcttcgtatccaagcgggataataagtcgatcagtgatcgccgtccggggcgtcgctgttcagctgcacccagttctgcacgcccatgcgattgatcatgtcctgctgggtttcgatgaagtccacatggtgttcttcgtcacgcaggatggaggccagaagatcgcgggtggggaaatcgcggatgctttcggcataggcaatgaattcacgcagatcggcgatggcggtgacttccagttccagatcgcgctgcagaacttcttccggcgtttcaccgatcagaacatggttcagacgctgcacattcggcaggccttccagaaacaggatgcgcttgatcagctcgtcggcatgcttcatttcttccacggattccttgaattcgtggcggcccattttcgtcatgccccagttttcgagcatgcgggcatgcaggaaatactggttaatcgcggtcagctcattggtcagaaccttgttgagattctggatcgttgtggcatcggccttcattggtctcatctcccgttttcaactgcggcggaccctatccgaggggccgggcgctgataaagcctgatgattgcaagcagatcgcagctagggcggggtgaaactgtttcgcattcccgcttgtgcgggagatgataggaagatgcatttacaggaaagtatattcctatgatttttcaatgaattgctttcacgcaaccggctctggcaaggcctttcagtcgcctgcttcgagactcagaatgctttcgtcatttgcaatactgggtatcattttaagcatagcttgggcgcacctgccgcattgcgcagtgcagccgcaggctcggtacagctctgccagacggcaggcgccagcctgggcggcggcgcaaacctgtttatccgtcaggccgttacagatgcagatatacatcgatggggcaaacctggattcgaataaggcgggtgtgaatgaggctgcttagcttggttggtatgaaaatgcaaatagattgcaattgcagatgacggcattgggcggcagcgtgttttcacggcatgatgaggccggataacgaccggtatccgacgattcgtcatgggacggcaggggccggcaggcagggaacagggcgatggcaggcggcttgcgggtggcggtccagatggacccgatggacagcatcaatattgcgggcgatagtagttttgcgctgatgctggaggcacaggctcgtggccatgcgctgtggcactacgaagtcaggcatatggccttgcgggaagggggacagtggcaagatggctcgacaggagcacggctgctggcgcgggcacatccggtttcggtacggaggatcgacgcggcctattacacgttcggcccgacggagattctcgatctcgcgaccatggatgtggtgctgatgcggcaggatccgcctttcgacatggcctatatcaccgcgacccacatgctggagcatatccaccctcacacgctggtggtgaatgatccggcgggcgtgcggaacgcgccggagaaaattctggtcacccattttccggatttgatgccgccgacactggtgacatgggatgtggaggcgatccgcgctttccgtgccgagcatcgtgatatcgtggtcaaaccgctctacggcaatggcggggccggcgtgttccgggtcaaggaagatgatgaaaatctaggctctctgctggaaatgtttttctcccgctcgcgggagccactgatggtgcagcgctatgaagcggcggtgcggcagggggacaagcgcatcatcctgattgatggggagccggtaggtgcgatcaaccgtgtgcctgccgcaggggagagccgcagtaacatgcatgtcggtggccgtcctgaagccgcggggctgacggcgcgggatcgggagatctgtgccgcgatcgggccggtgctgaaggagcggggcctgattttcgcggggatcgacgtgatcgggaactggctgacggagatcaacgtcacctcgccgaccgggcttcaggaaattggccggttcgatggggtcaatctggctgctcgcatctgggatgccatcgaaagccgcaaggcagcattggcggcctgatacagatcaggcagggcaaggccatgatcgatctggttctgttcgatatggatggggtgctggcggaggtcgataaatcggctcgtgccacatggctcggtgcgctggccggatgccgggcggaggatgtgcaacaggctctgtgggactcaggctttgatgatcagggcgatgatggccgtctgcgtggggaagcctatctgacggcattcgggcaggtgctgggctatccgctctctgtgcaggaatgggcggaagcccgtcgtattgccacccggccgaaaccggaggtgctgtcgctggtggcgcggctccatccccggattggacgcgccgtgctgaccaacaatgcggatattttgcccggctgcatggcgatgatctgtccgccggtcgcaaccctgttcggcggtcggatttatgccagcggcgcgttcgggagcgccaagcccgatccggcagtgttccttgcctgcctgaagcagataggtgtcaggcctgagcatactctgttcatcgatgatcgggcgctgcatgtggagggtgcccgtcaggccgcatgccatgggctgctgtttacctcggccgaggctctggaggcggagttgaaccggtatggtctgctccgtccggtggctgagatgtcagcgtaaatggtgcatcggtcgcgatttttacgcatccctttgctgttgatgagtgtgagcatgtttggctgcaccccggctccggcccggatgccatggccgctcatgatcgcgcatcgtggtggaaccggggatgctcctgaaaacacgatcgaggcgatccggcaggcaatggcgcatcgggtggatgccatatggctgacagtgcaactcagccgtgatgggattccggttctgtatcgcccggctgatctgtccacattgacggatggcgatggaaaaacagcggctttcacggctgccgagctgtcccggatcaatgccggttggcagtttcgccgcggagattcttatccctggcgcgatcatccggttggtattccgacattgcgggcggctttgcgggccattccgtctgatatgccgatcattctcgatatgaaggctctgccggctgcgccccagaccagggcggtggcgcgggtgctggaggaggagcaggcatggggccgggtcacgatttatgcgactgatgcagcctatcagcagagcttcgcagcctatccgcaagcaaggcttttcgaatcacgcgatgcaacgcgggcacggttgctgggtgttcagcttgatcagcgctgcgatcatcctccacctgcgcatgcaagggtggcgttcgaactgcaccgttccctgattgtggtggagcatttcacattgggagaaggccgttccacggtccaggcaacgatgtggacaccggccaccattgcctgtttccgccggcatcctgatgtgaagatcgtggcgattgcggtggacaatgccgacgatgacaggcttgccgcctgtctcggggtggatgccatcctgacggactcaccgcagcacatggtggctttgaggcagcaggaaccggcagggccacgctgtgacaggatccgccacgaaagataaaccggccggcttattccgcggcctcggcctgagaaatacgggctggcggacgcacgcgtaaacggcggatgcggcgcggatcggcttccagcacgcggaattccataccggaggaatgaccgatcacctcgccacgggcgggtactcgtccagccagcgtgaacaccagccccccgaccgtatcgatatccgcttcccgttcatcctcggtcaggacggcaccgaggcgtttctcgaaatcctcgatcggaatacgggcatccaggtcgagcgtgccgtcaggccgctcggtgatggagggagcggcctcgtcatgttcgtcactgatgtcgccgacgatggtttcgacgagatcctcgatcgtcaccagcccgtcgacaccgccatattcgtcgatcaccagtgccagatgcatatggtgctgccgcatctgcaacagcagttccagaaccggcatatgggggccgaccagcaaaggtttgcgcagaatatccgtcagccggaattccgccggatcaccgacataaccgaacacgtccttgatatggatcatgccgatcgcgtcatccagctcctcattgtaaaccggcagccgtgaatggccttcctgccggatcagtgccagcacgtcctcgaacgcggtgtcggcgcgaatggcgacgatatcggcgcgcgggaccatgacgtcgtccgccgtggtgccgcgcaggcgcagcacattgccgatcagggcgcgttcctgccggtccagctccggcagttctcccggtaactgggcgtgactggcggcttcctgcaccagctcggcgatgctgtcgcgcacgctgtgctcgacggctttgtgcagcaggcgttgccgcagccgggccatgacgctaccgcgtgggatcggcaggcgaatggggaaaggttcctcgtcgttcatgaccgtttccacggattgggcatgcccagactgcgcatgatacgggcttcttccgcttccatgcgtctggcgtctccggcgtgatggtgatcatgcccgtgcagatgcagcacgccatgcaccagcagatgggccagatgatgcaccgggcgtttgcgggcggcctttgcctcccgcagcacgacgccgagcgcgagaacgatttcgcccccttccgcgccgggcattccgaccggttcgaaagtcagcacattggttggtttgtccttgccgcgatgccgtgcattcaggcggcgcacatcacggtcgcaactcagtaccacacagtcggccgtgctgccggctgctctggcgacccggcggatcagcctgtcggcatgcgggatatgccgccgccaggccggttccgtgacgatgatctcgggcacgatgtaaccgggtgagaccccgtcctcatccgtatccgaagggaaccccgcgggcgcaaaagaggcactcgcggggttgggactacttgccgggtccattgatttctgaccgtgctcctgatcgtgtgcgctgttccgtctggccatgtgtgtccgcatcacggcttcggtcctgctgggcagccgagcgctggtcgtaagcgtctacaatggccgcgaccagcgggtggcgcaccacatcccgcttgtcgaaacggcagatgccgagggcgggaatgccctccagcgtgtcaagcgcgtcccgcaggccggagcgctgcccggccggaagatcaatctggctgagatcaccggtgatgaccatgcgtgtgccctcgcccatgcgggtcaggaacatcttcatctgtaccggggtggtattctgggcctcgtccagaatgacgaaggaatgggccagggtccggcctcgcatgaaggccagcggtgcgacttcgatttcgccggtggccatgcgccgtgcggcctgatcgcccggcatcatgtcgtgcagcgcgtcatagagcgggcgcagatagggatcgaccttctccttcatgtcgccgggcaggaagccgagccgttccccggcctcgaccgccgggcgggacagcacgatccggtccacgcgcccagcctgaagcatggccacggcctgagccacggcgagataggttttgccggtcccggcagggccgatgccgaacaccatttccttggtgctgagcatttcaatataggcagcctgccccgcgctgcgcgggctgagcgccccgcgtcgcgtgcggatggagggcagatcggccagcggcaggcgcggcgagcgatctccttcctcgaaacggcttttggtcaggcgcactgctgcatctacgtcacccatggtcacgtcctcgccccgttcgagcttctgccacaaggcagcaagcgccagtttcaccgcttcgaccagatcggattcgcccgcgatggcaattttgttgccacgacaggatatccgcactcccagcccctgttccagccgtaccagatgacggtcatgatcgcccagaagctgcggcagtaacagattattggcgaattgcaccgtgacggttctgtggtcccgctctcggtcacccgggcgatacggactggtctttcccggcgcaagcgccgcctgtggaagggcggaggaagcccctgctttcggcagggaggaggcgagagccggggaaagttgggtcacgcgcaggtgagctcctttggatggggtgcgcaatccgggagagtggcggacagggagttggtgtgcgcggcggtgattgtcaccggcacctcctgtccgatcagggttgcaggggcatcaagatgcactgcctgcaaccaaggggagcggccgccgatctgccccggatgccgtccgggggtgaccagcagcacattgacggtcttgccgatgcaggcggtattgaaggcttcctgctgggtgcggagcagggcctgcaaccgttgcagacgctcatccatcacgggctccggcacgtggttgtcacgctccgccgccggggtgccggggcggggagaatatttgaagctgtaggcctgtgcgaagccgacacgctcgatcaggcgcatcgtatcctcgaaatcttcatcggtttcacccggatggccgacgatgaagtcggaggacagggccagatcgggccgtgcctcccgcagacggtcgacgacccggaagtaatcctcagccgtgtggcgccggttcatggcggcgaggatacggtcggagccggactgaaccggaagatgcaggaacggcatcaactgcggaatatcccgatgcgcggcgatcagatcatcgctgacatcgcggggatgggaggtcgtgtagcggatgcgcagcaggtccggaatgtccgccagcgcccggatcaatcgggccagtgtccagacctcaccgtcctctcccagcccgtgataggcattgacgttctggcccagcaaggtgatctcccgcgccccgccgcgcaccatgcgccgcgcttccgccagcacggagctggccggacggctcacctccgcaccgcgtgtatagggtacaacgcagaaggagcagaatttgtcgcatccttcctgaatggtcaaaaaagccgtccgtccacccgccagacccggcccgtgctgaggggcggcggcctcgggcaggtaatcgaatttatcctccggcgggaaatcggtctcgatcacccgctccccgttcatggctcgccgcaccatgccaccgagccggtgataggtctgcggcccaagcacgatatcgacatagggtgcgcgggcgaggatctgttccccctccgcctgtgccacgcatccggctacggccagcagcatgggctgcccctcgcgggcgcgggcttctttcagcaggcgcagacgtcccagttccgagaaaaccttttccgtggctttgtcacggatatgacaggtattgagcacgatcatatccgcgccttccggctcggcatgcgcggtatagcccagcggagacagcacatccgtcatccgggcgctgtcatacacattcatctggcaaccccaggtaatgacgtgcagacgctttgtattggcgcgtgcgggcgtatccccggttgtagccgcgggtccggaccggtcctgatcggcggtggatagggtggtctgtaacaggccagtcatgggcaattctccatcctcccggtgcggaaggctccggcacgagaaaaaacagcaattgcctcagggcgcggtcgggtcaagcgcaatggccgaataggtctccctgcaataatcgcagtgtcggctcgggagggggatttctgtcaagcgcgatctgatggcaatcgcattttttagggcgtactgcgtttttcaggtcgaggtggatcgggcacacggccctgtttcaacgcatcggtcccggcggtgacggcggcataaaccgcattggtcagggccttgcgatccggaaaatcggcgggttccaggggcggatgcagcatgacggaggcccgtagccctttccattgcgcaagccgccagaaatgcgccccgatcgaggtcgcaccataataggcgaatatagcccgggtagagcgtccggtcggcatggaagccagccggtcgtaaacgatggagacaggctgcaccagcggcggattgggtccgaccgccagcgacaggaaggcagaccggaatggcaatacgcgggagccatcggaggtcgtgccttccggaaacagcaccagattatcgccgttttcgaggcgggatgtcatggcatcccgctccttcagggtggagccgcgctggcgactgacgaagatggttcgtcccagccgggccacggtcttgaccaccggccagtccgcaacatcgtccttggaaacgaaacaggcatgcagggtggagccgaggcagacgatatccagccatgaggaatggttggacacgaacagaacgggccgtgccctggtgccgtccttcaatcggccgcgtttggccttctgcccgatacagcggactttcagccccatcagacgaccgaacatccaccagaaaatccgggcgaagcgcactttggccgggccgggtaacaccacaagcacggactggatggtaatggccgtcagcgtccacagaatcaggaaaacggtccggcgaatggcacgaacccggcgcagaatccggccatggggccggaaaacaccctgccattcatccggttcggatgcggtccggctgtcgcctggcggctcaaacgggatgagcaggggacgggtcgggatcgtctggtcagctgtcatgaagcacaatcatcacacgcgattcattacacagccagacgtatatgcccagaggctccaccgcaacggcgtcatcctgttgccattaaatcgtcaaatcgcgcttgtcatcggaataccggcgtcatcccggtgcgttgcataagcttatgatcattcatccatacggtgtcgggttggtaatgattgttcacgagcctgttatcatttggttcctgaagatttttgggggttttcaaagccggtcaggctggtagggagaaaggatgaccagacgcgccccctctgacgcgccagcccttctgtgcccggcgatccgctgtggttccgtttctcgcccggaaacggttttccgtttactgatccggatcgccatggccggggtcggaatgccggcgcttttcatgcatggagcggatttgaggctggtctcctccgcatgggcggccgacccgcaaccctatacggtagagctggccaaaaccggtgatgccgccattgatcaggccctgacggacagtgcgaccctgatcagcttgcgcacgtcctctccggtcggcggatttgcgctggtcgcgcgggcgcaatccgatctggaccggttgcagacggccctgaacagtttcggttattacaaaggcaaggtgacgatccggatcgccggaaaaacccttgatgaccccgatctgccgaccctgatcgaacgggcgccgaaacagccgcctttgacggtgaccattaccattgagaaagggcctctgtttcaccttcggcatgttcgcgtggaaacaccgcccggtaccacgctgccggatatggcccgcaatgtgctgccggtcaaaaccggcgatattgctattgcggccaatgttttggcggggcagtcggctttgctcaatgtcttgcagaataatggctatgcccttgcgaaagtgcaggcgccggaggcgttcgagcgtccggatcagaatgtgcttgatgttgtctacaaggtgacgccggggccgcgggtcgatctggggccgattacgttctcgggtctgaagcataccaacgcgtcctatgtggagcggcgcttgctgctgaagtccgggcaggaatatcaggccgataaaatcgccagggcgcgtcaggatttgttggcggccggaattttcagctctgtccgtatgcgggcggctgatcggctgaataccgaggggcgcctgccgctgcggatcgagtttaccgaaaggccgcgccatggcgtgtctctggatgggctgtattcgaccgatctcggcggcagcctgaccgggacctggacctatcgcaatattttcggcaacggtgaaacccttgccctgtcggcggcagccaccgaagttgcagcgcaggtggcttcccagcccggttacaatatcggagcggtctatacgattcccgactggttacggcgcaatcagtcgctccaattctatgccaccggtgtgcgggagtacttttattcctatgaccgcactgcgattatcgtcggggcgacactgacacggaaactgagcgatcactggaatggcagcatcggcctgaccggcattcaggaaagggtcgggcagcaaggcgtcaggaccaattacacgctggtgcaggtgccggtgacgatcaaatacgacgataccggcagcctgttcgagccgacccatggctatcgcgccatcatcagcgccacaccgacggaaagtctggcttccggcggcaatggaacctcgaagacctttgttctgatgaaggcgcagggatcgacttatatcaatctgtcccggcgggaagggcgcagtgttctggcgctgcgtgccctggtgggggcggcgccgggcgtgtcgctgatggatctgccgcctgatcagcgtttctatgccggtggcagcgatacgatccgcggctataaataccagttcgtcgggccgacttttccgaacaatgacccgacgggcggtactgccgtggatgcggcgacggtggagttgaggcagcgtttcggctccagctatggcgtagcgctgttcgtcgatgcgggtcaggtcagccagaatggcggcccgttttcgggtgatctgcgggtcggtgcgggtatcggcgcacgttattatactgcgatcggaccaattcgggtggattttgccctgccgctgatgaagcagcggggcaacagcagcttccaggcctatatcggcatcggggaggctttttgagatgcgccgtgtcctcaaatggcttctcgggatcgttctgacgctgctggctctgccggtgctggcgctggtgttgttggtggccgggttgaataccgggatcggacagagacaggtggatcggctggcaaactccatgactggcggtatggtcgtgatgcaggggtttggcggcagttttccggatggtctgcgtatagcccgtctggaactacatgacgcgaaaggaacctggctggagatcgaccggctggtgctggactggcggattttgaggttgctggggcgggaggtccggattgacgtcctgactgccgaccgcatcgccattccccgtctggcggaggccgcatcgggcggggaagcgacgcctgcctcatcggggcaaggtttttcgctgccggtgcaggttgtgctgaatcatctgcggatcggcaggctggaggttggcaaaccggtcgcgggcacggctctggtggccatgctggaagggcgggcagtaatccgcaagcttgatctggccgccacaacacccgacaaaatcgcacaggcggatctggcgctcgatgtccatcgtctggatggaccggatcagggagccgaccattatcatctggatgcggcggtcgatcagacccgtatcgccgcccatgtcaccgcgcaggaggcagtgcatggcctcatcgccaccatggcggccctgccgggtgttcaggggatcaacgccgatatcaaactcgatggtccgtggcaggcggcccatgttgccgccactgtctcggccctgccgttacaggcggaggtcaaggggacggtcgatacgctcggtcgttccgcgctgctggatgtagacgctcatgcaggggccatggagcctcgcccggatgtgcaatggcgctctgtgacgctgacggcgcatgtggccggtccgtttctcaagcccgatgcgaaagcgcatatcgttttgaagggtttgagtgcggccggagcctcgttttccgtgctgacggcggatgccgatggcaatgccggatatgtcaccttgcgcagccgggtggatgatctgaggattcccggcccgaaaccggatctgttggaggccgcccctctgttgctggatgcgtcggtgcgtctggatgatccatcccgtcccgtgacgttcgcactgtcgcacgcgctgctcgctttgaaaggcgatgcacgtactgcgggaaagatgaccgtccatgccgccttgtccctgcccgatctgacaccgttggcggcgattggcggggtcgatctgaagggcgatgccgcgctgcaacttcaggcggcgatggagggggacaaggctgatgccgatctgaatggtaccgtatcggtcacgggtggcatggcccccattcccgcgttactgggcgagaaagcgcgcgtggccctgtctgcccatatggaggggcaaggggatggggaagggcgacgtgtcactctctccaaccttgctctcaatggcaggaccttgtctgtcggggcgaaaggcggcctgaacggtcagactgcggcactcgactggaccctcgggctgagcgatctgcatgcactggcggcgacgctcaaggggaatatgcaggcggctggcagcgtgaccggtccgaccaccgatctgaccgcccatgccaccgtggatggaatcgtggaggcgcatcaatcggggcaggaggtgaagtccggtccattgcatctcgctctggacgcggtgcatctgccttcggcaccggaggcacatctgatcgccaccggtacgctggacaggggaccgttggcgctggatatcaaagccggccgtcgacccgatggagcgatgcaggcgtctatcggcaaggcagactggaaatctctccatctggatggggccatggcgctggcggcgggggcgaaaattccccatggcgcgctggtgttgaattttgccaggcttgatgatcttcgacctctgctcggtcagccgatcagtggctctgtcgcggcgaaggcggatttttcagatgcgctggccacgcttcatctgactgccacgcgtgccggtctgcccggaaaggctgctgtcgcaaaggccgatctggatgcgaccgtcaaatcgcctgtcgctgatcccgatgtgaatgccaggctggaggtgcgcggtatcgcggccagtggcataaccggtaatgccagcctttctgcacagggtcggcagagtgcactggctataagattgaacacggcgcttaacggcgtggtgggggcaccgcttcaggccagcctggcggcgctgctggatgtgccggccggacaagtggccctctcggcattgcaggccggctggaaaggtcagacggcgcggctgctggccccggttcgcatcggctacaaggatggcgtgacgatggaccggctgcggctgggcgtggcgcaggccgtgctggatgtagcgggccgggcgacgccgaagctcgatctgcgggtggccctgaccaatctgaccgccgatttggcccgggtcgtagcaccggatgtgaaggcggccgggcggctggatatgcaggcggttctgaagggagaacccgcgcatccggccggctccgcctccatcaccgcacgcggtctgcgcatgttgaccggggatgcccgtgctctgccgccggctgagatcgtggtgaaagccgatatggatggccgcacggcccggatcgatacacgtctgaatgctggttccacgaccctgacgatcgcgggcacggtgccggaagcggcctccggcccgttgaatatcgcggcgcgggggagggccgatctgcggattctcgatccgatcctgtcggcgcaggggcggcgtgtgcagggcatgatgatcgtcgatgcaagggtgggtggcaccattgccgcccccaatgcctccggcacggtacggctgacgggtggcgatgtgcaggatgtcacactgggtctgcaccttgcccggatcgaggcccttatcagtgcggcaggggatacgctgcgcatcgatcagttcagcgcgggggccggacaaggcacgctcagccttggcggctcggtcgggatcaagccgccgatgccggtcgatcttacggtgaaggccagcaacgccacgctgatcgccagcgatctgatgacggagcggttggatgccgatctcaccctgcgcggccagatgacaaaggaactgacagccagtggtcatatcaaaatcctgcgcgccgatatcagggtgccggagcatatgccctccagcgttgccgtgcttgatgtgatcaaacccggccagaaaccgccaccgccacccaccccatccggtcccgtgattcgtctggatgtgacgctcgatgcgccggagcagatcttcgtgcgtggccgtggtctggatgcggagctggccgggcggttgcatctgcatggtacggcgagcaatccgcagaccgatggcggttttgaattgcggcgcggccagttcagcgtcgccggtacgacgctgaatttcaccgagggccgtgtgaccttcgatggcagcacgaccgacccggcgctggatttcacggccagctccacctccggcagcgtgacggccagcctgcatgtgggcggtcatgccagcgatccgaaaatcaccctctccagccagcccgaactgccgcaggatgaagtcctggcccggctgctgttccaatccagcatggccagcctgtccccgttccagatggcggaaatcgcggcggcgctggcacagttgagcggtgcgacggggggtggtgatccgttgaactcggtgcgcagtgcgctggggctggaccggctgtcggtcggcggaggctctcagaacggggccaccacgccgaatagccgtaccaatcagggaccctcggtcgaggcgggtaaatacgttgcgcggggcatttatgtcggtgccaagcagagtgtgggtggcccaaacagcgtcagcgcggcagaggtgcagatcgacctgacccgcagattgaagctgaaggccgatgccggttcggggccgggagccaatgcggtcggtctgtcctacgggttcgattactgatcccgatgcgctgacgactcgttctgaccggcagcaatctggatgatagaacggccagcctgattccgccttctgtcgatccggcctacactgtcccggtacagcaaacgggaccggatcgacggtggtgacagtcttgaggcggatgggtctgtggcttgcgggcattgctctgttgataggggtggccctgccagcacaggcggcggaggggggcggcaaggatacggactggccgcatcctctgggtggcgatcatgcccggcgatacagcgcactgacacagatcaaccggcagaccgtgaagcgtctgcgcccggtctggagcttttcgaccggtgtgctgcggggtcatgagggcgggccgttggtggtgggggatacgatgtatgtccacaccccctttccaaaccggctgttcgcgctggatctgaacgatgacgggcgcatccgctggagctacacgccggtgcaggatccggccgtgatcgggatcatgtgctgcgacacggtcaatcgcggccctgcctatgcggatggccgcctgttcctgcatctggcggatacgagtctggtggcgctggatgcccggaccggcaaggagttgtggaagatcagggacggtgatccggccaaaggggaaaccggcacgtccgcccccctcgtggccggtgatctggtgctggtcggcaatagcgggggcgagttcggcgtgcgcggccatatgacggcctatgcggtcaaggatgggcatcgcgtctggcgcgcctacgcggtggggccggatagcgacacgctgatggatcctctgcacaccacgcagatgggccagccggtcggtgcaaattcttcgctgtcgtcatggagcggggatgcatggaaactgggaggcggcccgtcctggggctggatttcctacgatccggcgctggacctgatctattacggcaccggcaatccgggggtgtggaatccgctgcaacggccgggcgacaatcgctgggccatgagtgtctttgcgcgggatcgcaaaaccgggatcgcgaaatgggtctatcagttcaccccgcatgatgcctgggattatgacgggatcaacgagatgatcctcgccgatattcccgtgaacgggcggcagacaaaggcgctggtgcatttcgatcgtaacggctttgcctatgtgctggatcgggtcagcggcatgctgcttcaggcaaagccgttcgatccatcgctgaactgggcgaaagaaatcgacctctcaaccggaaagccggtgcgtaacccccgctatgagccgaaggaggaagataaagcgaccaaaggcatctgtcccagttctctgggcgcgaaaaacgaacagccggctgctttctcaccgcaggctgggctgtttctggtaccggtcaaccgcatctgtatggatgaggaaccgtttcgcgtctcctatcaggccgggcagccttatgtaggggcaaacctgaccctgtatcccccaccttcttccccgctggggacgaaagatctcggcgcgttcatcggctatgatgccggtcagggccggatcgtctggacggatgcggagcctttctccgtctggtccggggcgctggcgacggcgggaggcgtggcgttttacggaacgctggaaggctggctcaaggcggtggatgtgaaggatggttctttgctctggcaatataaaaccccgtccgggattatcggcaacgtcatgacctatcgccatcacggtcgtcagtatgtcgcggtgctgtccggtgtcggcggctgggccggcatcggtctggctgaggggctggggacggaggatagcgaaggcaccggggctgccgtgctgaaccgtgccctgaacaattatacaaggcttggcggtgttctgacggttttcggtctgccgtgacgggcatgtccccccgacatccgggtcgtctggataaaacgggctggatcgggttgatcctgctgggggcgatcgtgctgtcggctgttttcgcgccctggttatccccttatccgcctgaattgcagctttccgacgggctggatgctgatggggcgccgctgccgccctgctggcgctttccgttggggacggatctgctggggcgggatgtgctgtcccggctgttatggggcgggcgggatgcgctgctgatcggtggggtggccaataccgttgctgtcatgaccggaaccctcatcgggatgtgtgccgccatggcgacaggacgtgtggggggctggatcggggccgggctgatgcggctgaccgatctggtggcctcgatccctgtgctgctgctggcggtaacggtttcggcggtgctgcgcccctctatctgggtggtgatgctggtggtggcgctggcaggatgggcgccggtcgcaagggtgatttatgttgaaacctccggcctgtccgcgcgcctgcatgtgcgggcggcccgtgctttgggggtgggctggggaaggatcgtgctgcggcatatcctgccgttgctcgggccggtgattgtggtctggggtacgctcgggatcgcaggctcggtattgctggaagcgacattatcctatctcggggccggcgtgcagccgcctgaagcatcctggggcagcatcatcaatgaaaatcaggcctatctgctgattgcgccatggctggtctttgcaccgggtggagcgatcctgctgctggcggcaggggcgaatttgaccggctccgcgctgaagcgccgctggatgccgggtgggacggagcaggataccctgtgagcctgttcatcctccggcggctggtacaggccgcgttgaccttgctgggggtggcggcgctggccttcctgctgatccatctgatgccggcggatcaggcccgcagcgtggccggacgctcggcaacgctggagcaggtggcgaggatccgtcacgccatggggttggaccggtcgctgatggcgcaattctccggctggatcggcgggttggtaaagggtgatctggggcagtcgctggtgcagcgtgtcccggtggcgctgctgatcggggagcgcctgccggccactttttctctgctggtgggggccgtgctggcggagattgcgatcggccttcctgccggtctgctggcggctcgcgctccgggccggtggctggaccggatggtgatgggtggatcggtgatcggcgtttcgctgccgcctttcgttgtggcgctggggatgttgatgttgttctcggtctggctcggctggtttccgatcggtgggtatgggggtgtacggcactgggtgctgccctccgtgacgctcggcctgctgggggcggggtggtatgcccggatggtccgggctgccgcgttgaatgtggtcgccgctgattacatccgcacggcccgtgccaaaggggcgggagaaacccggatcatgatccatcatgtgctgcggaatgccgctttgccgatattggcgctggcggggaccgatatcgcagggttcctgtccggggcggtggtggtggaaagcgtgtttggctggccgggcatggggcaactggtgtggcaggcaatcccgttgctggatgttccggtgattctgggggtgacgatggtggcggcggccggagtggtgctgaccagcctgctggtcgatcttctggccccgctgatcgatccgcgcatagggctgccgcgatgatgctgacccgccgtgcctgcctgtcggtcaccggtctggccggtacggccgctctggtcgggccggaccggccctatgcggctgcttctccccgccatgggggaacgctgaccatcgcgtttcgcgatgatattgccacgctggatccggccatcggctatgatttccagaactgggccctgattcgtgccctgttctgcggcctgatggattacgagccgggcaccaccacactgcgtcctggtctggcagagactgtttccctgtcgccggatgcgcgggtctatcgttttaccctgcggcgggggttgcggtttcaccatggccgggaggtcacggcggcggatgtcgtctactcgcttcgccgcaccatccatccggcgacgcaaagcccgggtcagagtttctacgccgctatcgaaggtttcggccccttcgttgccggagaaacgcaggaactacccggtctctccgcacctgatccgcatacggtggtgatccggctctcccgaccttatgcgccgttcctgcatgcgttggcgctgaattttgcttcggtggtgccacgggacatggtggagcggtacggtgcggatttcggccgtcatcccgtgggctgcggcgcttttcgtttcgacacatggcgcattggccagagcgtcgtgctgcgccgttacgaggcgtattacgaaccgggtctgccctatctcgaccggatcatcgccgaaatagggcaggagcctctgacggccatgctgcggctggaacgcggcgagatcgacgtggtgggcgacggtattcccccggccaggctgaatgcgatccggcgtgatccgcgttttcaggggctgatcggcatccggccgagactggcgacgacctatctggccatgaatgtgaccaggccgcctttcgatacgctgcgggtccgccaggccgtggcccatgcgatcgacaagagccgcatcgtgcggctgatcaatggtcgtggcgcgccgaccgaccagattttcccgcgtggtctgcccggatatgatccctcattctccgggcctgcttacgatccggcgcgggcgcggagcctgttgcgggaagcgggctggaaggatggatttcagacggacctcatgaccgccgccaccgatcccaacccgcgtattgcgcaggccctgcaacaggatctggaggccattggtatccgggcttccctgcgcgtgctggcccgtcccgcgatgatcgaggccgcctgttccgggaccggtgcaccgctgatctggtcgggtgataccggatggagtgccgattttcctgatccatcggatttttatgggccgatcctgtcggtggcggcctttgcaccgggtggatggaactgggccagatatcgcaatgccggcattgacgctctcgcggcggaggcggatgccatggcggccccattgcaagctgcggcaaggctgaaaagatggcaggcgattcaggcggccattctggccgatcagccctgggtgccgctttataatccgctgtttttcgtgccgcatacggcccgtattcagggggcagaggccctgttcaccgatccggtggtgacgccggtgaacttcatgcatgtctatgtggttgagggctgacaggatgcctgaacggagaaaccggatgatacgtggtgcctatgttttcagcggattggtcgtggcggctgccacccttgtggcaagtgccgtttcggcccagacgcggatcgggtcgatcaatacgagctttcgctggctggggccggatgacaggatcattgtcgagcgtttcgatgatccgaaagtgcagggcgtttcctgctatctgtcacgtgcagcgactggcgggatgaaaggctgggtcgggttggccgaggatcccagccgtttttcggtcgcctgccagcgcaccggccatgtcacgctgccgccggatcttccgaagcaggagacggtggcgttcgtctcctcctccctgtttttcaaatcgttccagatcatcaggctggtcgatcctgaccggccggtgctggtttataccgtggtcagtacgaaactggtgaaaggatcgcccttcaatgcgatttccgtggtcgggctggacgggccgtaacgccctccctcagccgaccagcgcccggatggcatcgtggtaggcgggggcggcccagttcgttcccccctccagccgggcgcgctcccggccctgccggtcgatgatcagtgtggtggggattccgcgcagcttcagtgcggtctgggcttccccatcatgatccagccatgtgccgagatggacgatgccgtgcttgcggtagaaactatccaccgcctgcacgccgccctgatcggcggagagcggcagcacgacgatcccctcatctttcactgcggcggcaagctgatccagcgagggcatttccgcaacgcagggcgcacaccatgtggcccacaaattcagcactacgcccttgccgctgaaataggccatgctgcgtgtatcacccatggcgtcggtaaagcggaaggcgggcagcctggcaggcgggtcgaccggtttcagcccgtgcggcagttcccctattgttgcgccgctggcttgtgacagagccagtttgcgccccatgacgccgcccgctagggtgccgccaatggccgccagcatcgtgcggcgggtttttaaatgcttgctgacaggcatgacgacaggccttccttcatgacgaacgatcagacgaccaccaccggcgattcagggcagagatcagccaatatgcaatggggcggacgctttgctgccggtcctgccgcgatcatgcaagagatcaatgcgtcgatcggtttcgatcagaaattgtggcggcaggatattcgcggctccatggcgcatgcggcgatgctcgctcatgtgggtatcatatccggggaagacgcgcaggtcatccgctcaggtcttgagcgaatcgctgccgagatcgaggaaggacaattcactttttccgtcgcactggaagatattcacatgaatatcgaagcccggttgaccgagcggatcggtgaggccgggaagcgcctgcacaccgcacgcagccgtaatgatcaggttgcgaccgattttcgtctttggatcagggatgcgattgacgggctggatgcgcagctggccgatctgatgcgggcgctggtcgcacgcgccaccgaccatgcggcggacccgatgccgggcttcacccatcttcagaccgcacagccggtgacgttcggccatcacctgctggcctatgtcgaaatgctggcacgggatcgcggtcgtctggccgatgcacgtaaacgcctgaatgaatgtccgctcggctcggcggcgctggcgggaacgtccttcccgatcgaccgccgcatgactgccgcggcgctgggcttcgaccggccgacgcgcaattcgctggatgcggtgtcggatcgtgatttcgcgctggagtttttatcggcagcctccatttcctcgatgcatctgtcgcgtctggccgaggaaatcgtcatctggtgcagtgcgccctggcggttcgtctctctgtccgatgcgtatactacgggcagttccatcatgccgcaaaagcgcaatccggatgcggcggagctggtccgcgccaaggtcggccgtgtgatgggtgatctgatcggcctgatgacggtgatgaagggcctgccgttggcctatgccaaggacacgcaggaggataaggagccggtgttcgatgcggcggaagcctggacattatcccttgccgccatggccgggatggtgcgggacatgaccccgaatactgatcgcatgcgtttcttcgccggcagcggctttgccactgcgaccgatctggccgattacctcgtgcgggcgctgcatctgccgttccgtaccgcgcatcacgtcaccgggcgtctggtggcgaaagcggaggcaaagggaatcgaccttgccgagctgtcactggaagagatgcgggaagaagaaccagccatcggcgaggatgtgttttccgtgctgacggtcgatgcctccattgcttcgcgtcgaagcgaaggcggcaccgcaccggaaaatgtcgcgcagcaggccgcatggtggcgggatcagttgaaggagacggcttgatgacctgtttgcgggcattttccctgatggtactgctgctgggtctggggttcggcctgacggcctgcggcaagcgtggtgctccgtccccacccgggccgccggaccagattacatatccccatacctacccgagccgctgaccagggaattgctgtgatggacatgcatgtgacggatacggaccgaccggacccttcggtgatggaactcattgccgcacgcccgagcctttccatgcatgcgatggatggattgctgctggatgatgtgccgctgaatgccattgccgatgctcagggcacgccgtgctgggtctactcggcggggacgttccgccggcgttaccggctgttgcgtgatgcgctggcggaggcagggatcgcgccgcatatccatttcgccgtgaaggccaatgaccatcttgccgtgctgcgtctgctcggcaatgagggggcgggcgcggatgtggtcagtggcggcgaactcagccgtgcgcgggccgctggcattccgggggagcggatcgtgttctccggtgttggcaagaccgcggcagagctgacactggctctgtccgaagggatcgcccagatcaatgtggagagcgcggaggagctggagatgctctccgccattgcctgcggtatgggccgcacggcgcggatcgcgctgcgggtcaatccggatgtggatgccggtacgcaccccaagattacgacaggtctggccgataacaaattcggcattcaggccggggatgtgcctgccctgtatgcgcgggctgcgtccctgcctgggatcgaaccggtcggcctcgctatgcatatcggcagccagatcaatgtcatgacccccttcctggccgcattccgccgtatggcgattctggtgcaggcgctgcgggatcagggattgacagtcaggctggtggattgtgggggtggtctggggatcgattatcgcggcgatgtcacctccaccccggcggcgctggctggggcgatgaaggcagagctgggcggtctggacgtgcagctggtgctggagccggggcgctggctggccggtcctgccggtgtgctgctgtccagcgtcgtcctggtgaagcagtcccgtccgcgtcctttcgtggtgctggatgcggcgatgaacgatctgctgcggccctccctgtatgaggcatggcacggaatcgtgcccttatccgcggttgaggccgcgcatatgccgatcgactgcgatgtggtgggtccggtctgtgaaaccggtgatacctttgcgcggtcgcggtcgctgccgccgcttcagggcggcagccgggtcgcaattctggaggcgggggcttacggtgcggtgatgagctccacatataatgccagaccactggcggctcaggtgctggttgatgatgggcactgggcggtgatccgcccgcgtcagacggtcgatgcgttgtggcgtgatgaggtgattccaccgcatctcacccggcagggctgacagcaacccgcaacaggcaacggaggggcagccgtatggagtatcgggccggatgacggcggagaatccttccacgcttcctccaatacttgcgcagcggcggcggcaggcattgcgcgtgctgcgcctggagcggttctgccgtgccgcctggccgcttctgcctgccaccggcttatttatcagccttgttttgctggatgtctggacgtggctgccgccatggccgcatctgattctgctgatcgtattctgggccgggcttggcatctggattgtatggcggtggcgggttctgccgaagccgctccggaccgatgccgaccggcggctggagcaggatgccggactggtccatcgccctttagccacgctggatgaccggcctgcccggggcagttcccccatggcgcaggctttatggcaggcccatacacactttgtgctggatcaggtgcggacactccgcccggcggtgctacgtcccggcattgctggcagggattgtttcgccctgcgggccttgtcggtgattgtattggcggcattgggggtcagtgccgggggagatttttccactcggctggcgcatgcactctggccggttctgccccctgcgccatccgttccggggccagtggtgcaggcatggattacgccgcccgcctataccggactacctccgatcttcctgcatggcgaaaccgatgcggcgcatcatccttacgtggttccgatcagttcagtgctgtctctgaccgtctccggtctcgatacgccgccggggctggaactggatggtcacaggacccttctgccccgtctggccaagggcagttttcaggccagcattccgttggggcagcaggctgtccgccctgatgcacctctgacattgcgagcgggcggcggggctgtgcttgctacatggcgcatcagaatggtggccgatgcgcccccgcaagtcacttttaccgcgctgccggaaaaggcggtgcatggctatgcggtgcgtattccgtggcaggcacgggacgattacggcatcgccggagtgagcgcggttctgcgtctgactgaacggcctgatctgcctccggtgactgtgccgttgccggttccagccggacatccgcgtgtagcgggaggcgcgacggagagcgatctgactgccaatccatgggccgggctgccggtgaccctgactctgacggcaaatgatacggcgggacagaccggtcagtcggagcctgtgtcattgattttgccgcagaagccgttccgtcatccgctggcaagagcattgctgtcgatccgtcagtctctggcacgccggccggaagaccggcgtaacgccgttggtgcgctggcggagctgggggctcagcccgatattctggctgatgatccaggaggatacctcaatctgcgcgccattacgtcggagctggcccgcaacatttccgcctctgcgatcaacgatgcgcttaaccggttgtggctgctggccctgcatatcgaggaagggggcgccgagcgtacggcccgcgctctgtccgcggcccgccaggaactgcgggaggcgctgaatcagcaaaaaaacggcgcgcccccggatcagcgtgagatgcagcggctgatgagccagcttgaacgcgccctgtccgatcatctgaagcagatggcggagcaggcgagccgggaagcggcaacacccgtcccggaggaccggaacgcctccctgatggaccgtctgcgcaaactggacgagcagatgcggcaggctttgaaagagggccggatggaggatgcccgccgcgccatggcgtcgctggatcgcgctctggaccggttgcagcatgcaaagccgttaacggctgaacagaaggcgcgccgggcgaagcagcagcaggccagacggcaggcgcaggaacagatgaaagcgttgcaggatctgacccgccggcaggccggattactggataatgcacagaagcgtgctgaggcggctcagcaggatgccccgcgctttccggatttcggcccggagaatgatcctgatgacgggccgcccgatcagcaggggcagggaggcagtcaatctcaatcgggacaacctccctcaggacaaccgggccagcagggcggacgggctgatccggcagaggccttgcgaaaagcggatgagaccacccagcaggatgtgcgccacaaactggccgatctgatgcagcagctgagtgaaaaaggtgggcagattccacgcgggatggcgcaggctgatgctgcgatgcgcgaggcgatcgaagcaatgcgccgtggccgtgacgatcagacggtcgatgcggaacggcgggcgctccagaaactggcggagggccagcaggacatcaatcgccagcagcaggccaataaaggtggccgacccggtcaggatcagggcggagaggaacaggaggatggcgatgaggatggggtgacgctcggcgccccctctcaaggccagcgccgggagtcggatggcgggcaaacgcccggcgaacaggccggtgacaatgacagtgatggggcgggtgatcagcatgatcggcgcgatccattcggacgcagccgctccgtgggatcggctgcgggggatgagaatggcgacgatgtccgcctgcccgggcagatggagccgatgcgcagccgggatgtgcagcaggaattgcgccgccgcggtgccgagcgtaaccgcccgcaggaggaactggattatatcgaccggttgttgcagcagttttgatccacagttatcgatgcatttcagacttctccccatcatggcaaaatcgtttttcagtcggcaggatgcggtggaggcaagggtgctgacatgatccggtttgagcaggttggactgcgctatgaaccattgcgtggggcaacgggcagcacgattctgcgtgatactgatcagcccggtcttgctgagccgggggaagtgctgcgtgatgtttccctgacagtgcccgatggtagcttccgctggctgctcggtccttccggtgcggggaaaagcagtctgctgcggttgatgtacgcggcgatccgtccgacccgtggccgcattatgttgctgggggctgatctggctgtgacaccgcgggcggcattgcctgtcctgcgtcggcggatcggggtggtgtttcaggattttcgccttttgccgcatctgaacgcgttcgacaatgtcgccttgcccttgcggattgcgggccgcccggagggccagatcagggccgatgtggcggagttgctgcgctgggtcggtctggcccgcaagatgaacgcccgccctgctgagttatcgggtggcgagcagcagcgtgtagccattgcaagggctgtgattggacgtcccgccttgattctggcggatgagccgaccggcaatctggatgaagctcaggcggaacggctgatgcagcttctgaaggagttgaaccggttgggaacgacgatcgtggtggcgacgcataatgacgggctggtggcccgtcatcccgcacccgccttgcgtctggcccatggccatgtgttggctgaggataccggatggacgcagggtatgatcgggcgggaatccggcttttcctacggtctcgcagcaccggatgaggaagtagcctaccctcatgcttcggttgctccggccgggctgcatgggtctgcaccgctgcaaccggtaagaaacggcgcggctgtcgagcgctccttcagaaacaggccagccgggagccgttttctctgatgcgttatgatgcccgccgcccatgagcacccgtcaggaaagacaacgccgtcgggcagaggaacgccgcacccgccggctgcgcccgatgcgtttcgacgatctggggctgcgtcgtgccctgtcggaccggctgctgcctttgctggtggcagccatggcgtttctggcggctctggcattcgcaggctatgttgcggctgatgctttgggtcgccattggcaggaaggcgctgcggcctccatgaccgtgcaggtgccacggccgacagccagtgccgatgataaagctacgccggaggctggaaggaatcaggcggatacgcggcgtgatgccgtgctggccgtgctgcgtgccacgcggggtatcgcttcggccgagccgatgtcggatcaggaactgaccatgctcctgcgtccctggctcggctcggatgccgaaacattatccctgccgctcccggctgtaatccgtgtgcgtcagaatgcggccggaagtccggggggtggccaggggggtggtgcgacgctggatatgactgcgctggcggcggcgctggagcgggttgcccctggcaccgctgtggaaagccacggtgtctggctgggccgtctgaccgcgctggcacacagtcttcagctctgcgctggtctggtcttgatcgtcgtgacactggttgcggtctgtgtcattgcggtggcgacacgggcggggctgatggcccgacgggaggcaattgaaatcgtgcatgggctgggtgctacggatggttatatcgcacggcgttttgcggggcgtaccacagccctggccgctgccgggggattggcaggcggggtgctggctctgccggtgttgatcttcatggggcggctgacagcgccatttggcggactgaatgaggtggagcctgtgcagggtggtttggccgggattatctcctggttgcctccggcgctttggatgacgataccctctatgccgatgggggctgcctgtatcggctggctgaccacccagatgactgttcgccgttggttgaggcgcctgccgtagcgatgggatataccgcttcccccctgtcgagacggatgggccgggccatggtgagcgtgctgaacgggttcggcctgctcggtggttttgctctgctggtcctgtccggcggatttttatggtttgcatggcaaagccagcatgttctccgggcaccatcccatgcggatggtatcgtggttctgaccggcggggcggagcgtgttgcgaccggattgaagttgctcgcggctgggcgaggcagcgtattgttgatttcaggcgtggccaagggtgcctcgctgggcacgctcgcccgtgtggcgggaattgatccgacccctttggaggggcgcgtcatgctgggatatgaggccgccaccacacgcggtaatgcgctggaaacagccgactgggcgcatgagcgacacctgagaagcgtcatcgtcgtcacggcggggtatcatatgccccgcgcattggccgagctgcggcgcgccatgcccgatgtgatactatatccggagacagtgcacccggatcaggggggcagtctgctcaatattttgaaactgctgtcgtctgaatatttgaaatggttgggtgcagagctgcatctgtccagcctgacgccggtccgtgaaacgtgatgagctgacaggatctgcaagggaatgatttttcttcgttcactgctgtttaacgcagtgttttttgccgtcacgctggtgctgagtctgtatggatttgtgctgcgctttgtcgccccgcatcgtttgatcgacgatgcccgtctatggtcgcgtatcatgatcgcgtcggcccggttgatctgcggtattcatgtccgtgtgcgcggtctggagaacctgccgcccgggcagccggtgctgatcgcttcccagcatcaatccgcgttcgataccatggtatggttcgggcttgcctcctacccggtctatgttctgaaaaagcaactgctgaaaatccctgttttcgggccgttgctgccactgacggggatgattccggtggatcgggaggggggcgtgacctctttgcgtaatctggtcagtgcatcgatggaggcagcttccttgaaccggcagattgtgatcttcccggaaggcacccgcacggatccgggtgtggaggtgccgctgcatcccggtatttatgcggtggcctcgaaaacggggctgccgatcgtgccggttacgaccaattccggccttttctggggacgccgtgcatttcgtaaatatccgggcacgatcaatgtcgatattcatccgcccctctcccctggcagccgggccgtaaccatggaggctctccgcagcctgtatcatcgtgctggcaatgacatagcaacatttgtccacacctcggaaagggctgtggataagtctgtggtttagtctgaaggaatcgtcaggaaaaaatcgaactgaattatataagatattgatttaaaataaaaaattatgttgatagacaaggtctgactgattcgcggcatgatggggatgaatggtgacgcgacggcgatccggaatccccttagactgctttggatgaacgatttggtcacccgtccagcaaaacggagccttaccatgagacgtctctggttccgtcttgtccttcttgccgttgttctggcggcggctgattatgggatatggcagtggaccgtgaaccgtctggtggagcaatcgctgctctgggtacatcaacggcctgatggggtggtgctgaaatcccgggcggcggcgttacccggcggctggccgctggcggcgcggattaccctgccggagccggagctgtttgtcggcggatatcctgtctggcagggacaggcgctggaagtggaggtatcgccgtggcatcccctgcaactgctcatgaggccacggggaccgcaggctgcttttcccgaatcaccctggaagatcatgatgcaacccgccagtgccagtgtcaccttgccggtcaggcttgcctgggatgggtggtggccggttgcactggtgccggatacggacccgtccatacataccctcgatcttcatgtgaccgctcaggatgtgcgtctgcggcccaatggttccggctggacaagcgctgatcccgccccgcaccctgatacgggactgcctgcaggatacgatatcatcaccatcagcagggtggagatgcatctgcgattggatcaggctttggccgtgcagtgcagtcttgatgatgccgtgttgccatctgtccgccagtggccgttcggaaaaacggtacagcatgtaaatgtggctgccagaattgatccatttcctttttcgaacgttcagccccaggaaaaaatcagagcgtggcgcgctgcgtccggtgtgttcagaatattggatgccactctgacatggggcagcctgcgtgcgagtatggcaggacagggagggctggatgactttctgcagccggtcatgcagggcgtagtgacgatggcatcacccgaggagacaatcacatcattgcgtgatcagggctggatcgcgtccggattatatatggctgccaaaaccatgctgggcctgtttgtccaagcgacagatgctccggggcgtgcgacacaaaggaacagtgtcgatcatgccgatacggcccggagccatcctgcttatgtttccgtgcctgtccggctggccggcactgtcttgatgatcggacaggttccggttctgaaaatatcacctcccccttgggcggatagccaacggtagcggctttcgcccagcgttgaaggacaaacatgatgcccggtatggacgctattttcctggcgcggctccagttcgcttttacggtcggcttccatattgttttccccgctttctccatcgggttggccagttatctggcggtgctggaagggctgtggctgaaaacaggccggcctgtttatctggatctgttccgctactggtcgaaaatctttgccgtcggtttcggcatgggtgtcgtctccggtctggtgatgtcctatgaattcgggacgaactggggtgctttcgcggccaaggcgggtcccgtcattggtcccctgatgggctacgaagtgctcacggccttctttctggaagccggttttctgggcatcatgctgttcggcatggagaaagtggggcggaaactgcatttcctcgccacctgtctggtcgcccttggcacgctgatcagtgccacctggattctggcggtgaattcatggatgcagacccctgccggctatacgatcgacgcggcaacggggcgtttcctgcctgcggactggatggcggtcattttcaacccctcctttcctttccgttttgcccatatggtgctggcggcctttctcagcgtgtctttcgtggtcggtggtaccggggcctggcatctgctgcgcggacgtcgcaatgaggccgtgcggacgatgttttccatggcgatgtggatggctgcactggtcacgccgcttcaggtgctggtcggtgatgcacagggtgggaatacgttaaagcaccagccgataaaaatcgcggcgatggaaggatattggcgcaatggtgctccgggggccggtgtgccgatggtcctgtttgccctgccggatcagaaagcgcaggagaaccggttcgagatcgccattccgcatgtcgcctctctgtatctgaagcatgactggacgggtaccattccggccttgaccgatgtgccgcctgaaaaccagccgcctgtgatcgtggtgttctttgcgttccgcattatggtcgcgctgggtatgctgatgctcgctgtaggggtgtggagcctgtatgagcgctggcgcgggcggctgttcgacacagtctggctgcatcgcgcggtgctgacgctggggcctgccggatttgtggcgcttcttgcgggctgggtggtcacggaagtcgggcggcagccttacaccgtatacgggctgttgcgcacggcagagagttcctcccctatcggcctgcccggtatggcgatttcactgagcgcgttcgtgatcgtctatctgatcgtctatgctgccgggatcggcattctgctgcgtatgatgggcaggccgcctgaacacggggagacaccgcccgcgcccgagccgatccgggcggccggtatcgtgccggggcctgccggtgccgttgatgatctgcatcgtgataaccacaccatccgtccggggagtgtcgtatgatcaccgaaaaccttccctatatctggggcatgatcatagccgtagcggtgctggcctatgtgctgctggacgggttcgatctgggatgcggcatcctgtttctggcggagcgcgaggaggaggaccgggatgtgatggtgaattccattgcgccggtctgggatggcaacgaaacctggctggtcatggggggcgggggattgctggctgtgttccccgttgcctatgcaattctgttttccgctttctatcctaccattatcgctatgttgctggcgttggtgtttcgcggcgtcgcgttcgagttccgtttcaaggcccataccctgcgcgggcgcaggtggtgggaccgggctttctgcctcggctcactggtggcggcactgtgtcagggcatgacgctgggtggcatcctgcagggcgtgcaccataatggtttcgcttatacgggaggctggttcgactggctgacccctttcaccgtgttgtgcggggtggcggttgttgtgggatacacgctgctgggagcctgctggctgatcctgaaaaccgagaacgggctgcatgtgcgtgcccgccattatgcgaaaccgcttttcattcttcttctgttactgattgccgctgtgagcctttggactccgttgttgaacgaaacctatcggctacgctggttctcctggcccggcattgttctgacggcccctgttccattgctggtggcggcgatggcactgggattctggcggtccttgcaacataaacggcatgctgccccgttgctctatgcgatggggatgtttttgctgtgctatgtcgggctggggatcagcctgtttcccaatatcgttccaccagcccatggtacgacaccgctttcgctggttgatgctgcggcgcctgcggccagccagatgttcctgctggtcggggcggttgtgctgattccgatggtgctgggctataacgcctattcctactggattttccgagggaaagtccggcacggtgagggctaccactgatgcggagcagcctgcgccgactggcctggttcgccggcttgtgggtggctggcgtagtggccgtgggaggggtggcggagcttctgcactgggtgatccgccacaccatgacgggctagaatggcaaaaggggcacggccatggtgcccctttctgctgtcgtcaggcctgattgatttcgatcagattgcgccggatacggcggccacgttcgattttatcgacgatgtaatcctcatcgccccagcgcacagcacgtgccatggcctgagcatcttccgtaaagcgggccagcatctccagcagggcgtcccggttattgaggaaaatatcccgccacatggtcgggtccgaagccgcgatccgggtgaaatcccggaacccggaagccgcgaatttcaaaacctgctggcggctttcatcagccagatcgtcggcggtgccgcagatagtgaaggcgatcagatgcggcagatggctgacgatggccagcacgcggtcatgatgggctggctccatgatctcgacctgcgccccacagccacgccagagggcggagaccgcttcgatggcttcttcagcagtatcggggggaggggtcagcaaggtccagcgatcccggaacagggtggaaaaacctgattccgggccggaatattcggtgcccgccagcggatggccgggcacgaaatgcacatgggggggcagcagggggccgacatcccggatcacggattgcttggtggagccgacatcggtcaggatgcaacccggtgccagatgaggggcgattttttcagccatatcggcaaaggcgccgaccgggacgcagagaatcacggcatctgcattctgcacagcctgtgccggatcggcctcgcagtgatcggcaattcccagtcgggcaacacgttccaggatatcggcccggtcacaggcaacgatttcatcggccagccggttttcccgcaccgcccgggccagagaactgccgataaggcccagaccgatcagggtcagacggcgaaagaccggagcggcttccgtcatgatgcggcatcgctgtcggctggtgcctgcgccatgaaagcccgcagggcttcggctaccagatcgcattcctcgtttgtgccgatggtgatacgcagataggcgggcaagccgtaactggcgacgcggcgtacaatcagcccccgcgtgcgcagccagcgatcggcagcgcccgcgcgtgcttcgctgccgaaatccgccagcaggaaattggtgacgctcggcagggtgggaatgccgatatcgaacagggctgtggccagttttgcacgggcggcgctgttatgggcgcggctgcgttcgacccagcccggttcctccagcgccccgatcgcagcttcctgcacggcggcgttgacggtgaaaggcccgcgcaccctgttcaacacatccacgatggcaggcggtgcataggcccagccgaggcgcagcccacccagcccgaaaatcttgctgaaagtgcgggtcatgacggtattgtcgcccgcatcgaccagcttcacgcctgggtcataatcgggatcatcgacatattcggcataggccgcatccagcaccagcagcacatccgacggcaggctcgcccgcagacgtgcgatttcggcggtgggaagcatggtgccggtaggattgtttggattggcgatgcagaccactttggtccggggtgttatcgcatccagcagcgcatcgacatcggtggtcagggcctgctccggcactttcaccactttggccccggcataatggccatacatctcgtacacgctgaatccgtgcacgctcatgatcagctccgaatccggattgctgtaggccatgcagagatgcgcgatcatttcatctgatccgacaccgcagacgatgcgggccggatcgagaccgaaataacgcccgatggcttcccgtaacgcgtgggagccgccatcaggataacggtgcaggctggacacggccttcagataggcctgctgtgcggcaggaggcggcccgaatgcgccttcattcgaggagagtttgatcacctgctcgacgccgggcagctttgattcaccgccgatataggggtgaatggcctcgataccgggattgggacggggattgctcatgctgcgtttcctgcctgtgaggaacggacaggaaccgcatagcatcccagcacgacaggtggacgcagaaggggggtcagggctgccagccggggatcggaatcctcaacaaatccggcgacatccgccagcacatgggcgtcatccgcccccggtatgcgacgcaggatcgtattgccgactgaaaaaccggcattaatcagcatttgtgtcagccttgcccggctgatgtcggaagcgatttcaagacccagcaaagcgcggtcatcgccggacggatcgggtgcgatggctgccaccgccatggcatcggtacggggggcgccttcgggccgggtgctccagactggcaggcgggcgacgatatggatgcggggggcatcgtggtgcaacagggcggtccaccatgcggcgcggggcgattcgtcatcgaccggggccgggactaccgccaccatggtctgtccgctgctgacatcggcaatggcctgggccgggctgccatagatgcgcaatggtgtcagggctccgaaatgctcccgtgcgatctgggtcatggcggcggagccgtcatcgctgtcgcagaccgagatggtaaaattgcgctgcatgctgttcgatccggcgaatagctcccgccagatacggataatggtctgttccgggaactggccccgatggcgtccgagcagacggcgaatgatcgctgcttcccgtcccggtcggatcgagacaccgctctttgttgtggcaatggaacggactgtttccgcccgctggatcagcagatcgtgcagggcatcgtcgatcatatccagttttgcgcgcagcatgccgagcgctgcttcggccccgtcggtggaagcgggagacgatgcatccggtgcagacagaacaggcgaggcaagaccagacagaatggggcgcatgacgatatcgggccaatattcgggcgcctgctgtgcaggggccaaatccttatgaagatcgacctgatagccgaagcatgcctcgctgcaaagcatcgcagtatcagccatggtggttgagcatgggcagggtggttgcacgacgggcatgagagggcatagtcacccttttccgggatctgcccccggagtcatgaccggtgaagcgatctgtgaatacagcgccacaaaaagatgttttcgtctttcgggatggcctgccgctggataatggcggcagcctggacgggattcgcattgcctatcgtacctatggcgcgctgaatgcagaggccagcaacgcgattctggtgtgccatgcgttgacgggtgatcaatatgtggctgatcccaatcccgtcactggcaagcctggatggtggtacggtgtagtaggaccgggctgcccgattgataccaaccgttatttcgtcatctgctccaacgtgattggcggttgtatgggcagcaccgggccgcgcagcccccgtgatccggccttgccggatgatgcagccggtgtggagttgtggggtaccgatttccccagcctgaccatccgggacatggtgcgcgcccagaaaaaactgatcgagcatctcggcattgcgcgcctgtttgcggtgattggcggttctttcggtgggatgcaggcgctgcaatgggcggcgagctatccggatgcggtattcgcggcgatcccgattgccacggcgtctttccattcggcacagaacattgccttcaacgaggtcgggcggcaggcgattttcggtgacccgaactggaacggggggggctactggcgcaccggacacatgccggagcgcggtctggcggtggcccggatggtggcccatatcacctatctcagtgagcaggctctggcgcggaaattcggacggcgggtacgtcgtgacgggatggggggggagaccgccgccaatctgttcggggagatgttcgaggtcgaaagctatctgcgctatcagggtggtgcgttcgtaaagcggttcgatgccaattcctatctgaccattacccgggctgcggatcattttgatctggcggaagaatatggtggggatcttgcggcggcgtttgccggcacgaaaacacggttctgcgtgatctccttcagttccgactggctttatcccacggccgagagccgccatatcgcccgcgccctgaaccgggtggcggcgaatgtgagcttcgtggaagtgacctccgacaagggacatgatgcgtttctgctggatgaaccggatttccatcgggtgctgaatggttttcttgagggatgtgccgatcatgccgggctggcgttcaatggctttggcggtggctccgcattgctgcgggtggaggcatcatgaacaacctgtcctctccgcccgagccttcgcacgccatgcggcatagcgggcggaacatgcggcttgatctgcgtctgatcgcggagatgatcgagccgcgcagccgtgtgctggatattggctgtggtgacggtgccttgatcgagcatctgatgcgcacccgtggctgtgatgcacgcgggatcgagatcgacatggcggaggcaacgcgggcggtcgcccatggcctttcggtgatgcatggtgatgccgatgaggatctggcgcattacccggatgatgcgtttgattacgtcgtattgtcccgcacccttcaggccgtcgaacgcccccgtgaagtgttgcgtcagatgttgcgcatcggcagccgggcgctggtcagcttccccaatttcggacactggcaagtgcggcttcagctgctggcattgggcagaatgccgatgaccggggcatggaaccgcgtatggcatgagacccccaatatccatccctgcaccatccgcgatttcttcgagttgtgcgcgcaggaaggttatcaggtcgagcaatggctggcggcgggggaggccggtcagcgttctccgtggcggcgctcggcaaggcttgccaatctgttcggagaacagggcctgttcatgctgcgcaaggcatgaaaaaaccccggcctgacagaccggggcttgaaatgctggccggggcaggagcggtcacaccgtatttgatgaacgaccgacgatgaagcggtagattgccagaatgatgatggcgcctacgaccgagccgataaagcgggccccatcctcgggaccataccaatgcagggcgcggccgagccaggtggcaaccagagagccgccaatgcccagcagaatggtgacgatgataccacccggatcacgtcccggcatgatcagcttggccaccgccccgacgatcaggccgatgagaatagtccatagaagtgaaaacattgcggtgcgcctttgatgcaggtctccagaccgatcatgacgcatgaacactgaaaaggttcagccgggacgatgccagggctttatgatgtctgaacagggggggctgccctgtcagctttatggcccttgaggcggtagaagaacgatctgctcagcatccgatagaacctttggggtggccgcatgcaggatgagcacggcgcgcaggccggggttgttatcttcaaggcgcaggacaccaccatgcagttgagccactgcctgcaccagagcgagaccaagacctgatccgggcgtgctgcgcgctgtttcgccgcggaaaaaacgctctgtcgcccggttgcggtcggcttccggaataccggggccgttatctgcaaccagtgcaaaaatatctgctccattacgccagccgctcagatggagtgtgccgccggtgggaaggaatttgatggcattgtcgagcatattcgccaaagcctgttgcagcaggctgcgatcaccgaaaatcggcagcgggtcggggcagtcgaacacgaacagcaggtttttctcttcggccagcggttcgtacagctcacagagatcggccagaatgggttgaaggtccgtgctggcaaaggctgatcgtcgcgcgccgctttcaatttccgcgatccgcaacaggccctgaaaaattgcggtgacaccatccagatcggcaatggcgcgctcgaccgcggctgccagttgggtgtcttcctcgctatgggtcagcgcatcttccagacgggcgcgaacccgggcaatgggggtgcgcagatcgtgggcgatggcgttggagacctgcttcacaccctccataagacgaccgatccggtccagcatatcattgacggtttcggccagacgatcaaactcgtccccccgcccggagagtttgacacggcgggtcaagttcccggccccgatggcggcggcaacagaggagatatcggccagtgaccgccggaacagtcccctgaccaccaaagcccctgcaacgctcagggcgaccacgaccaccatggcccagaccagagacccggtcagcagatcccgcagccgtgcccgcgcctgtacatcgcgaccgaccagaagatgaaagccgctgggcaggtcgaagcggcggatgcgcgccagagatttggttccagcccgctggatcgataattcgaaccaggtattggtcgtgttcatctggcttggccaatgcgccagattacccgcgattcgcctctgctcgggatcggttagcagatagatcgcatcatcatccagattttcactgagacgttcctgaatcccctgcacaagggcaggcagtccaccatcgttccagcgttccgccagcccctgtgcatcggtgagaatggctgtctcggtctggcggttcagcagaccggctgtggtccaccagagaaaaaccgccagagccagggcgctgatggcgaacagccccgcatagagcatggcgaagcgcacgctggcggagggcaccagcgagagattgcgccggaaggcccgcagccacagactccagcggcgcagcagggaccgccggggaatggggggcaaatgccccctttcagccatccgcccggagcatatagccggcgttgcgcacggtatggatcaggctgacggtaaagggcttgtccactttctgccgcaggcgagagacatggacgtcgatcacgttggtctgtgggtcgaaatgataatcccatacgccttccagcagcatggtgcgggtcacgacctgatcggcatggcgcatcaggaattccagcagacgaaactcccgtggctgaaggtctattttctggccgccgcgcttcacgccacgggacagcagatccatttccagatcggcaaccaccagcttggtggtcggggcgtcggtcttgccgcgtcgggtcagtgcttccacgcgggccagcagctccgaaaaggcgaagggttttgaaaggtagtcatcgccacccgctttcaacccttttaccctctcatccacaccgctgagcgcggagagaaacagaaccggtgtattgacatcctggctgcgcagggtttccagcaggcgcagaccatcgatgccgcccggcagcatgcgatccagcacgatggcgtcgaaattctcgctggcggccatgaacagcccgtcccgtccgttatcccggtgctctaccgtatggcctgcctcgcgcagtcctttcacgatgaagccggctacgtccttatcgtcttcaacaagtaaaatgcgcattcttcagcctgcgtgttctgccggtcggcgaccgacggtgatctcgatgtcgacgtcacgtccctgacgctgtactgtcaggcgggcagtgctgccgggggggatggcggcaatggcgcggatcagactgcgggcgctctgcacggcagcaccgttgacagcctctaccagatcgccggcacgaagcccactccgcgccgccggtccatttttgtcgacactggcgatcagcacgcctgccatatcggtctggctggaatcctcaacggcgacccccagccagccgcggtcgatatggcctttgctgcgcaggatttccaccacatgggcggccaactcggcagggatggcgaagccgattccgaccgagccgccagtaggggagacgatggcggtgttcagcccgaccacctgcccggccatattgaaagtcgggccgccggaattgccgggattgatgggcgcatcaagctgcagaaaatcgtcgaacgggcctgccccgatgtcgcgcccgcgagcggatacgatccccgccgtgacggacccgcccagcccgaaaggattcccggcggcgagaatccagtccccgacctccaccacatggctgtcgccccatgtgacatagggcagcgggcggctggtattcaccttgatgacggcaatatcggtcagatcgtcaatccccagcacgcgggccggaagttccgaaccgtcggagagggaaacaatgatgcggtcggcatgtccgaccacatggttgttggtgatgatgatgcccgatggatcaaggatgaagcccgatcccgcccccatgacctgttccctccgtccacgcagtttgtcgcgaaactgcttttcgaacggggtgcctttcagctctggcggcatctgcgccagtgcttcctgtggcgagagcgattcggtaacggcgatattcaccacggccggcatgattttcttgaccagcggggcaaagctgtccggtgccgtgcgagcctgacaggcgctggtggacagcagcattgccgccagtatgacggtgcagaaagcacggcggcgatttgagcggccattgaggcggctatgagatagccgtgaccggtcaggcttggaaaacggcatgcaatcagaaaccttaagaatctgtcatcctaagcgtaacccacattcgatcccctggcgtcaagccttcagcgccaggacaaaatttttcctgaaatttttatgatcggttttgccgctccctctgcagcggagggggtgaaattcaaccttctgccggattttccggccagcgatgccggggatagcgcccgcgcatgtcgcggcggacatcggcccagcctccctgccagaaaccggccaggtcggcggtaatggccaccggcctgccggcgggtgagagcaatgccagtcgcagcggaatacgtccaccggccagttgcggcgtgtgctgcaacccgtagaaagcctgcgcccgggcggaggcaaccggtacaggctgcagataatccacgcctgcgcgggcattcccggccagggcaagatgggtgggcatctccttgtccagacgctgggccagttgccatggcatgacggcccgcagcatggcggctacatcgagggaggctggtttaacgccttgtcccagccatccgccgagccagtccggggcggtggcggtcagagcatcatcggaccagtccggccagtctttgtccggttccaatgtgcgcatcagctctacccgggcgcgtagctgccgggcggtatcgctccagaccagagcggcgaaggcggcctgtgccatagcgtcggaggcaccgggatgggcggcaggatcggctttctccagacgatcttccagcaccagcgcgcccagacgcagcttgcggcggatatagaccgtgccgctggtggaatcatgcatcgtttcggtcgtttcatgggcaaggtcgcgcagggtttcgacctcgaccggcacggccagccggatacgcggtgctgttttcacttccagcgaggcgacagcgagtaatcggcatcgggcaaggggatcattcacggctatttttgctccgcctccgccggagaaacggaagctgcctgcctctccccgtgcctgtgcgacccggtccgggaaagcggctacaatcagcctggccacggcatcaggccctgcctcgctggcttccgccggagcggggctggcgatagcggggctggcggttttcagacggcggcgatactgggccgccgtctggcggatacgggccagcgctccgcgatcggccgcaggatcctcatggcgcagggcctccagccgcagcatgaggtcggcgggggcatccgggttgcggaacgggtcccgttcctccagcaaggcggcaatatcggcggccagcaggcgctctggaagggtgcgggcagccagcatcatggcagccagcctgggatgagcgccgatccgggccatctgccgacccgcttccgtgatgcggccttcaggatcgagggcaccgagatcacccaacagcgaccgtgccgccgccaccgcgccatcagggggagcatccggaaacggcaggtcggagggtgatgcgccccagcccgcgcaatccagcaccagcccggacagttcggcctccagaatttcaggccggtcgaagggtgccatgccccgctccatagcctgactccagagccggatcgcgatacccggcgcttcacgaccggcgcgtcccgatcgctgggcggcggcggcacggctgatgcgcagggttgccagccgggtcagaccggtcgaagtgtcgagacgcggcgcacgacgccagccgctatccaccacgatccgtacacccggaacagtgagggaggtttcggcaatcgaggtcgccagcacaacgcgccgtcccccattttccagtggacgaagggcgcgatcctgctcggcaggtggcagatcgccatgcagcggcagcacggtggcgccacacccatccagcatggattgcacgcggcggatttctcccatcccgggcaggaaggccagcagatcaccctgatgatcggacagagccaccctgaccgcgcgcgccgtggcctcggggatgtcgcgcaaatgggtcaggtcgcgcgcgctatgggtgatgccgaccggatgggcctgtccggcgctttcgacgatgccggcctgcatcagggtcgaaaggcgtgcaccatccgcggtggccgacatagccagcagccgcaattcgggccgcaaggcgcgttgcaggtccagacagaaggcgagggcgatatccgcatccagactgcgttcgtggatttcgtcgaggatgaccagatccaccccctccagccccggatcggattgcagacggcggaccagcagcccttccgttatcacctcgatccttgtggcatcggagacggcgctgtcggtccgtgtgcggtagccgaccaactctcccggtttctgcccgatcagtgacgccatgcgtgcagcagcggcgcgggcggccagacgacgtggctccagcatcacgatgcgttggaaaggcccttcctcgccgagcagaaacagcggaacggtcgtggtcttgcccgcacccggcggtgcgaccagaaccgcgttgccccggatcagggtttcgcgcaacgcgggcaggacatgtttgaccggaagatcggagacgctcatggtccgccccatatcacggcgtgccgggaaacaaagccccggtcgcatcatgaaaacatgttatccgggcctgatcatgcgctttcttctgtctgtgctgggtgtctgtctgtcgctgctttatgggagttctccggcttatgcgctggaaagcgcgccggtcagcagtcctcatgcgacggtgacgctgatgagcgatgcggacagctacacgtccggtcatccatttcggctcgggctgcaattcaggatggctcccggctggcatatttatggcaaggatcccggcgattcgggactgccgccggaactgacctttaccctgccatccggcgtcacggccgggcctgtcgactggccgccgaccatgcagttgaaagaaggccctctcagggtcaatgcttatcagggaacggtcgtgctgccggtcacgattgatccgcacggagcgcgtggcccgatcgagattgatcttcaggccaactggctgatctgtcagaccatctgtgtgccggaagagggccattttcacctgactttactggaaggccagggaggggaaggttcttctgccagtcccctttccggacaggtatctcagccgcagcccagtgatacatcttccctgccgatggtgctgttgtttgcggtactgggtgggctgatcctcaatctgatgccctgtgtctttccggtgctggccatgaaagcgctggctctggcccgccttggcagcggtgagagagcggccgtacgcagccatgctgtggcttatacggcgggtgttctgctggcttttctggcgctggggatgatggcgatcggcctgcgccatgccggggcggcggtggggtgggggttccagttcgcctcaccggttttcgtgacagggatggcgtggctgctgatggcggtggggctgaatctgtccggggtttatcagattggcgcacggatggtcggcacaggtcatacactgagcagccgggatggcctgtccgggagcttcttcacgggcctgttggcggttgtggtggccacgccctgcacggctccgttcatggggttggctctggccgtggcattgaacgcgccggctgtgaccatgctgacgatcctgctggccatggggctggggctggccctgccttacctgctggtggcgatttttccgcagctggttgccgccatgccgaagcccggtcgctggatggaggttttgaagcaggcgctggcttttccggtctatgcctcggtctgctggctggtctgggtgatcgcgcaggaagctggggccaacggggtgctgattgtgggggaagggctgaccgccatcgcttttgccgcctgggtctggggagtcgcacaattcgggagtggcgtgcgcagcctggtcggacgtgggctggcgatattggcgattggaatcagcctgcttctgttacaacgcctgcatcaggcgtccggattggctgtagccgatgtggccggcaccacgatggcagagcggcagggggccgagcctttttcaagggcgcgtctggatgcattacgggcggaagggaggccggttttcgtcaacctgaccgccgcatggtgcgttacttgcctggtgaatgagcaggttgctctcagtaatcatacagtcaaggaagcgttccggaatggcggcgtcgcctatctgctgggtgactggacccgtcaggaccgtaaattgacggcgtttctgcgcgaccatggacgggatggtgtgccgctttatctgttctatccggcgggtggcggtgatcccgtaacccttccgcagcttctgacgccggaaatcgtcatcaacgccgtcagggcgcggtaacgttttccggcgctgagccgaagatcaggcttccacctgctccaccgccagaacttccggcacgtaatgccgcagcatattctcgatcccgtgcttgagagtcgcgcgggaggaagggcatccgctgcatgcaccctgcatatgcagcagcacaacgccgtcgcgatagccgcggaatacgatgtctccgccatctccggcgacggccgggcggacccgggtatccagcaattccttgatctgatcgacgatttcgcgatcttccgggcggatatcctcctccagcacgtcggagggggtatcattcagcaccggacggcctgtgacgaaatgatccatcagcgcggccaggacctgcggcttcagttccggccattcgacatcggaggatttggtcacggtgacgaaatccgcgccgagaaaaacgcgtgcaatgcccggcagttcgaacaacgccagcgcgagcgggctgcgctgggcggtggcagcagaggcaaaatccgccgttccacccggcatgacatcccggccgggcaggaatttcagggtggcgggattgggcgtgccctcggtttcgatgaacatgcagatctccggacgtcaggaatatggactttttcagtcctgttaccggagtagatcgtctgtttgccgtctgaacgcaagggccgtactggcccctgcgcatcaggcccgcgcaacgggaatgtgtgagcgggtctgttcctgctcagacggagaaatatttcgcatgtgggttgagcacgaccagcgcggaggtgctctgttcaggatgcagctgatattcatccgacagatcgacaccgatccgttcggcctgaagcagtttcaggatcggctcctgatcctccagcttcggacaggccggataaccgaaggaatagcgactgccgcgataaccctgcgccagcatcttttccatgtcccgctcatcttccgctgcgaaaccgcattcggcgcggatgcgcttgtgcacgtattccgccatggcttccgccatctctaccgagaggccgtggagatagaggtaatcctgataccggtcttcctcgaaccagatgcgtgccatgtcggaggctttctgcccgaccgtcaccacctgcaacccgatcacgtcgcgttccgcatcgtccacatcgcggaaaaaatcggcgatgcactccccatcttccttcggctgacggggcagggaaaagcggcacagttccgtgctgccatcctgttcgaacaggatcagctcattgccctgccccgctgctttccagtagccgtaggcggcctgcggtttcaggatgtcctgctcctcgcacagggcgagcatccgcttcatcaccgggcgcagttcctgcttggcccagcccagaaaatcgtccagcgagcggccctgtttccggaagccccactgaaactgatacaggctgcgttcattgaggaaggggatgatcgctttcggtgtggcttccaccacgcgcgccccccagaaaggcggttcgatggccggaacgttgtttgtcagacgatgacgccgcgcccgcgtggcattgatatccaccggctggaaagcgcgtgcatcggccttgcccagcgttcggctctggttgcgtgacttgcctttgcgtttctgctgaatggcggacaggtaatcgtcgaaggcattgcccgtcaccttgtccatcagatgcagcccgtcgaacgcatcacgcgcataggcaacgcggccggaggcataggccgccacgcaatcatcctcgacgtaattccgtgtcagggccgcaccgccgagcaggaccggcacatcgacgccctgacgggacatttcttccagattttcgcgcatgatgacggtggatttcaccagcaggccggacatgccgatagcatgggcgcgatgttccttcaccgctgccaccatatccgccagcggcaccttgatgccgagattgacgacgcgatagccgttattggtcaggatgatgtcgacgaggttcttgccgatgtcatgcacgtcgcccttgacggtcgccaggacgatggtgcccttctgctggccttccacgcgctccatcatcggttccagataggcgacggcggctttcatggtttccgccgactggagtacgaagggaagctgcatcttgccggcgccgaacagctctcccaccaccttcatgccgtccagcaggatggtgttgatgatgtccagcggcgcatgggttttcagcgcctcgtccagttcgtcggtcaggcccttgcggtcgccatcgacgatgcggtctttcagacggccttccactgtggcggcgcgggttttcttgacggcatcagcggctttacgatccgcaaacatttccagcagacgttgcaggggatcgtaatcctccgtgcggcggtcgaagatcaggtcttccatgaccttcgcttcctctgccggaatctggtgcagtggacggatcttgctgacatgcacgattgcgcccgtcatacccgcccggaccgcatgatcgagaaacaccgagttcagcactgcacgggccgccggattgaggccgaagctgatattggacaggccgagaataatctgaatctccgggaatttctcccggatcatgcggatgccttccagagtccattcgcccagcttccgatcatcttcattgccggtggcgatggtgaaggtcagcgggtcgatcagcagatcggattgcggcaggccgtgtttttcgcaggcgaaccgaaccagacgctcggcgatagcgagcttgcgttccggcgtcttggccatgccttcttcatcgatggtcagggcgatgacggcggcaccgaacttgcgtgccagaatcatgcgttcttcggcagcatgttccccgtcctcgaaattgatcgagttgatgatcggcttgccgccatgcagtttcagtgcggcctcgatcaccggcgtttcagtgctgtcgatcaccagaggcgcattcacgctgctggtgaagcgacggatcacctcattcatttccagcccttcattgcgaccaacgaaagcggtgcagatatccagcgcgttggagccttcgccgacctgctcccgccccatggagatgcaggtgtcccagtcatgctgttcctgcgcctcgcgccatttcttcgatccgttggcgttgcagcgttcgccgatagagaaataggaattttcctgccgcagagatgtctggccatacaggctggcgacggagggaacccagattgagtttcgtttgatcggctcgggccgcagacgcgcaccggcccggcggcgcagcatggcatccagcgcgcggatatgcggaacattggtgccgcagcagccgccgatgagattgacgccatcctcgctgatatagcgttcgacccagctcgccatttcctcgggcgagagcgggtagtgggtctggccatccaccagttccggcagcccggcattgggctgcatggagatcagaccggtccagtttgcggccagccatttgacatgctcggccatttcctgcggcccggtggcgcagttcagcccgatcagcggcacgtccatcgcgtggatcacggtcgcggcggcggcaatgtccggcccgaccagcagcgtaccggtggtttccaccgtgacctgcacgaagatcggcgtatcgacacccatctcagcccgcgcttttttggccccgttgacggcggccttgatctggagcgtgtcctgacaggtctcgatcagaaacgcatcgacaccgccatcaatcaggccccggcattgttccgccagcccggcttctagcggatcatagtcgatattgccgagcgagggcagcttggtgcccggcccgatgctgcccaccacatagcggtgccggccatcgctgaagctgtcggcagcttcgcgggccagttcggcggcgatccggttgatctcccgcgcgcgatcgcccagttcgaactcgccaagggtgacgggggagccgccgaagctgttcgtctccaccatatccgccccggcctcatagtagccgcgatggatttcacggaccagatcggggcgggagaggttcaggatctcggtacagttctctttgccgagatagtcccgctcgacatcgagatccagcgcctgcacgcggctgcccatgccgccgtcgcacagcagaacctgatcgcgcagggcatcgagcagatgggggcggctcatgagagtctccagctttggaatcgtgaggggagcagaccgggcagcggctcagtcatggatggaagccgctttcagggtgaatgcggccggtgtggtaccggcagggcggatggcgcgccagatggcaatgtcgatgggtccggatatcgtggcggcaggtatggcctgcaatccggcagaggtcagggcacggcgcatctcggcatcggaaaagccgggccagcggtgatgcagggcgcgggtcagatcctgtcgttcatgcgcggccagatcgacgatcagcaacgtgcctccgggcttcagcatgcgggcggcctcggtgatgactgcaccgggtgtttcgctgtgatggagcaccatatgcaggatcgtcaggtcgaaactggcatcgggcagtggcaggcgcatcatgtccgcctgacggacgctgcaatgacgcagccgggcgcgggacaggcgggaccgcgccagcgccagcatggtgcggctggcatcgataccaagtccggagccgatgaagggggcaagcaattccagaattcgtccggtgccggtgccgatatccagcagggtggcgccctcaggcagagacagcgtttccacatccgccaccagcgcggcttcgacggtttcagcgggcaggccgagcgcgcgcatttcatcccattccgcaccgtcccgacggaatcgctcggtcgcggcgcgggcacgctccgccagcacacgctcagcctgacggcggtcggcttgcagggttgcgtcgatagcgggcagcttggcgggcagatcgcggcccagcccggtctgggccaggctgaaccacgcattggagccttcccgcgtacgctccagcaatccggcctccaccagcaggcgcagatggcgtgacaggcgtggctgggactggccgagaatgtcggtcagctccaccacgcagaaatccccgagcgccatcagcgccagaagacgcaggcgggtcggttcggcgcaggcgcgcaactgggtgagcatcaactccatactggacaaatgacataaagatatctttatgtccactatggcctggtttctggatgcccgtattcccgtcgatattcgtaccgctgtcatgcaggcaccggtcgcggacggcatagccgtgctgatggaagcagggatcgcggcagaccatcgttccgctgacacccggatctttcaaccggcagcgccgcaggacaggcggcatggcaccgattgcgcctgttgcacgctgcgctcaccgctggcggaggcgttatccgtcctgtttctggatcgtgtgcgtggtcaggcggcttttaacagcgttgtcgtgatcgtgggtagtccggaagcggcagaacaggcgatagagacgctcaggaacgatccgttactggctgcccggttccgccctgcgcccccggaggagaagcaggacgggatcgaggtctagactgtttccggctcgttttcctcgacgatgaggctgaactggtcttcctcctcgtcatattcgaacagctctccgtaacggccccatgcaatcgcggtgcgaagggtggaacgggcgtaatcctcgctcatatggtcttccagctcgtcgcggaagcgcacggcggcggcgcgatggttggggcggctggccagaacctgacagatcgtcgccaccagcggcacatgagagcgcagagcgttcgcgaaaatttcttttctggtgtcggtttcggcttcgacataggcccgcccggcatccagcagccggatatcgccttcttccagctcggccagacgcagcatttgcagggtttcgcccagcggcagcaattcgtccacgtccagttgcagcgcggcggcaagcggcggaaggtcggcgcggccgttgtaaggctgtgcctccagcgtttccagcagaccggccatgaggttggtggaaacggggtgcagggcctgaccaatgccctgcggtgtgacggcggcatgcttggtcggcagcgggcggcgggtcatgatcgcatagatatcgtccaccatctggcggaaggcgatgtcgtgccgatcgcgtggatgagggaacggcacgcgcagttcctgcgccacccgcccgggattggaggagaaaacgaggatacggtcgcacatcagcaccgcttcctcgatgttgtgcgtgaccatcagcaccgatttcagcggcagcttgccatcgctccacaggtcgatcagatcggtgcgcagcgtttcggcggtcagcacgtccagcgcactgaacggctcatccatcagcagcagatcaggatggaccaccagggcgcgggccagccctacacgttgccgcatgccgccggacagttccttgggataggcgctttcatagccgccgagaccgatcagatcgatggcgatttcggcgcggcgttcccgctcggcccggttgacgccctgtgcttccagacccagctcgacattttcctgcacggtcagccagggaaacagtgcgaagctctggaacaccatggcgaccccgcgggcggggccattgaccgggcgccctttccacgtcacctgacctgatgtggggggcagcaggccggagacgatccgcagaagggtcgatttgccggagccggagcggcccagcaatccgacgatctcgccttcccgcagcgtcaggtcgacatcgtccagcaccacgaaatcggcgttgctgtccttgtgataagcctgccggacgttcttgacttccagaagggctggggcggcgagggctgtgtccatggccatgagatccgttccttcgatcagtaggtcaggcgacgtgtggcgaagttgaaaagcggtttccacagggcacggttgaagccgaccacgaaggccgacatcacggccacgcccagtatggtgcgcggccagtttccatcggccgaggcatcggcgatgaagcggcccagcccgtgcgcttgcagcgtattcggtccccaggtcacgacttcagagacgatggccgcgttccacgcaccgccggaggcggtgatcgcaccggtgatataataggggaaaatgccgggcaggatcacccgccgccaccacagaaagccacggatatgaaatccacgtgcggcttcctgcatgtcgccggggaaagcggcggcccccgcgatgacgttgaacatgatgtaccactgtgcaccgagaatcatcagcggcgtcagccagatatccgggttcaacgaaaaacgggcgatcaccaacacgaaaagcggaaagaacagattggccgggaaggctgccagaaactgcaccaacggctgtacaaaacgcgccacgtgcgggcgcagaccgatagccaccccgatcggcacccagatcaacgtggcaacgatcatcagcacgatgacgcgcagcatggtgatgcaccccatcagcacggcttgcagtacatccgaaggcgcgatgcgtcccgacaggaaagcgtagatatgccaggcgcaccagaccagcatggcgaagacgatcagaccccacagcatatcgacaatacgggaaggctggtttgaggcccggatcaggcgcggcagacggaagccgattcgcagattggtgaaagcgttgaaaccgctcgccagcagctcgcttccggcacgcagccaggcagtgcggcgcagcaggcgcagcagccacggttcctcggaggttgaaccctgcgttgtttcgaagcggaatttttccgaccacgccaccagcggacggaacagaagctgatcgtacagcaggatcaccaccgccatggcgagaatagcatagccgattgcggccatatcctgctgacgaagggccaatgcgacgtaggagccgattcccggcagcatccaggtattgtcgccgaccgagaccgcttccgacgccaccacgaaaaaccagccgccggacatggacatcatggcgttccagaccagccctggcatggcgaatggcacttccagcttccagaaacgctgccatggagacaggcggaacgcccgagtcgcttccaccagatcacccggcagggtggtcagggactgatagaagctgaacgccatattccaggcctggctggtgaagatcgcgaagatggaggcaagctccgcccccagcacctgtcctggaaacaggttcatgaagaacacgacggtaaaggtcagaaaccccaggatcggcaccgattgcaggatatcgagcatcgggatcagcagcatggccgcccggcggcttttggcggcccaggtcgcgtaggtgaaagtgaaaaacaacgcggcggcgagggccagcagcatgcgcaacgtggttcggaacgcataggcgggcaggttccatggatcgagcgaaacggcatgcgcgtagcgatcatccagcggcaccagcgtgccacgcgtcacatgcacgacggccaccagggcggcgaacaccacggcaatcgaaaccagatcgaacaggttcggaagacggcgtcgcgatgccagagcggggaaaacagtttcggacatcgtttcttcctcgcgcgaaagcggcctgaaagcggcaggatgcagtggaatatcctgcttcccgcctcctagagcatgatgccggagccgtcaccccgctgtttggttgcgttttggtgacggcagagaaataaacggaccgggatcagccggtgctgccgaagccacccgtgccgcgttccgtgtcatccagcgaatcaactgtctgaaacgtgccgcggataacaggggccagcaccccttgggcgattcgcatcccgcgttcgacgataaacggttccgtacccgtattgagcacgatgatgcctacttcgccgcgataatcctcgtcgatcgtgccgggggtattgggcagggtgatcccgtgtttcagggccagaccggaccgggggcggatctggagttcatgtcccggcggcagcgccatacgcagtccggtcgggatcagggcccggccgccgggcgggatggtgaccgattccgtgacggcggccagtaaatccatcccggcggcaccgggagtggcataggcgggaagggacagtccttccgcatgcggaaggacctgaatcaggatattcatgacggtctcgatcctcaggatgcgttcataaaggctgcgatgcgggcggcgagatggtctgcgacctccgttttggaggtgcggggccagtcttcttccccatcggcggtgatcaggcggatggcgttatcgactccgcccatgatgccggtgttgggtgagacgtcattggccagcagccagtcgcaccctttgcgcaggcgcttgtcgcgggcgtgctgatgcacggcttccgtttcggcggcaaagccgatcaccagagccgggcgtcttgggccgggcgcggacagggtcgccagaatatcggggttcggcagcagcgtgaggtgaggtgtgccgccggttttcttgagtttctgctcggcggcttcgacatgccagtcggcgacggcagcgacgcagaccgcgatatcggctggcagggcagattcgcaggcggccatcatctgccgtccggtttccacatggatcgtcgtgacaccttgcggatcgggaatggagaccggcccgctgaccagcgtgacccgtgctccccggcgcgccagagccgccgcgatcgcatgaccctgccgcccggagctgcgattggccagatagcgcaccgggtccagcggctcatgcgtcgggccggatgtcaccagcgcgtgatgcccacgcagatcctgcggtacggtgtcggcagatgaggggacattggaggagacagaggaggggaccagaagggagaggatcgcatcacggatcgtctccggctccgccatgcggccgggtccgtattcgtgacaggccatcggcccttcttccggcccgaccagcgtgaggccgcgtgcggtcagtgtgtcgatattggcctgtgtcgcctgatgttgccacatgcggacattcatcgccggggcggccagcacgggtttgtcggtggccagcaagacggtggcggccagatcatcagccatccccgcgctcatgcgcgccagcagatcggcagtggcaggcgcgatgaccagcagatcggcggcacgggagagctggatatgacccatcatgctttcctcggtcagggaaagcaggtccatgtgtacgggctgctcggtcagtgcctgaagggagagcggtgtgacgaaagcactccccgctttggtcagaatggtggagacgctgcatccttcggcgcgcagcaggcggatcaggggcagggttttataggcggcaatgccaccgcccacgatcagcaggacggtttttccggccaggcgctgaggcagggcggcgtccgtcacagccgccagccgctgtggatggcggcgattccgccagacaggttgcgcacggacacacgggagaatccggcctcccgcatcatatcggccagagtttcctgatcggggaacatgcggatgctttcggcgagatactgatagctgtcccgatccccggcaatggcctgacccagccggggcagcacctgaaatgaccaggcatcatagacaggttccagcgcggcgacggtcacgcgactgaattccagacaatggaaccggccgcctgttttcagcacgcggcgggcttctttcagcacggccagcttgtccgtgcagttgcgcaggccgaacgccatggagacccggtccacgctgcggtccggcagcggcagcgtttcggcatcggccaccagaaaacgcagactgcccagcaatccacggctggcggcgcggtctcgcccgacccccagcatggccgggttgatatccgacagaatcgcatcgccaccaccggaacgcagccagttgaagctgatatccccggtgccgcctgccagatccagcaatgtctggccggggcgcgggtccagcacggtgttgaacacgcgcttccacaggcgatggatgccgagggacatcacatcattcatcagatcgtatttgggggcgacgctggcgaagacctcgcgcaccagcgtttttttctgaccacgcgggacggcgcgaaagccgaaatcggtttcgccagctgtctgatcatttccagctgcctgatcattcatcggggggacggtgccgtgtgactctgtcatgcaggctgtataggaggtcacgcggcgaagtaaaacgattgcgtgatgcttgaaacaaggaatgcgcttcatgccggaactgccggaagttgaaacggtgatgcgtggcctgcgtgcgcgtctggaggggcgtcgtatcgtgcgggcggaggtcaggcggcctgatctgcgctttcctctgccacccggtctggcggcccggctgacgggtgcgtatgtgcgggatttccgtcggcgtggaaaatacatcctgatgcgtctggatggcggtgacagcctgttgattcacctgggcatgtccggtcgtttcgtgctgcgtgcacccgccgacacgaccttgccggaggggcatgaaccggagcggcatgaacacgtctccatgatggctgaggatggctggatcgcggcgctggtcgacccgaggcggttcggcatgatggatctggtgccgactgcggcggaggatgcgcatcgtctgctctcctccatggggcctgagccgctggaagatgcattttgtctctctggtctggaaaaggcatttgccggtcgccgcacggcggtgaaactggctctgctggatcaacggatcgtggccgggctgggcaatatctatgtttcggaggccctgttccgggccgggatcaatccgctgcgggccgcgggggacctctcccgggctgaactccggcggttgatccccgcgattcgcgagacgttgacggaagcgattgccgcaggtggctcctccctgcgtgactatgtgcagccggatggtgaactgggctatttccagcatgcatggaaagtctatggccgtgcggggcagccttgcgaacattgtcccggcctgtccgccggctgtcaggggatcgtccagatcgtgcagggcggtcgaagcacgtatttctgtccctgtacccagcaacaggcggggaaacaggcgggatgaagggggcagggttgccggcgccgaatggcggggtgtgcaagtttccttgactctctgcgggctgctgcgtagatatccgcccctcacaggcgggccactccgccggacccgtccttagcattaccgaatggtttgaagatcgatggctaataccgcttcagcgcgcaagcgcatccggcagatcaaggttcgcacggagcgtaacgctgcgcgcaagtcccgcatgcgtaccttcgtcaagaaggtcgaaaccgcgatcgcgtccggcaatcacactgccgcaaacgaagccctgcgtgaggctcagccggaaatgcagcgcgccgctggcaagggcgtgatccatcgcaacacggtggcccgtcgtctgtcccgcctgacggcacggatcaaggctctggccaccgcctgagcctgaccggattacagagccggtatatttttaatattggttgcgtaattctgttatcaaacagctggctttagtcagtgttttgattttcggcactctcaatctgcacgaatactgctgtccatttgacggatggcagtatttttgctgtctaaggccgttgtcctttctccgggactttggttctcagtgccgtgatcgttcaaatctttctgaccacagggcatgacttttggattgcttccggatcatccccgatgcaacctaagatatcgacttcctgtttgtggtgaggaaggcctgacaggacgtgcatggttcctgttcaggcagacgaagcaacatgtcgtttgaatatcggtcctctcttcaggaccgcttgatccgggtaggtgcgggcagtgtcagaacacggcggcagcgcggaacaggatatctccgttcacgctgcaaaaaaacgcgatgactttgccgatgttacgccagcaaccgggcggccggtttcggctggcctgctggccgagcaatggaatcgcgtacgtcagaggctgcgggctgaggtcggggaagttgaataccggacctggctgcggcaaatgacgctggccgggttggaggctgatgaggttgccattcacctgccgacccgttttctgcgtgactgggtgcgttcccattactccgatcgcctgaatacgctgtggcaggcggaaaatcctgcggtcaggcgggtggatatccgcctcggctccgtgacggagagtggccatggtctgaccgaaagcctgtacgaaagcggtatcgtccagaaagcatctgctccggcagagcgtgtagcgccggtctcatcggtcgcggatcaggccagtcttccggaagcagacactctggccccttcttctctggctggccctgcgttggatgaggccggacgcgccggcgatatgcatgcgctggatcggcgcttcagcttcgagaccttcgtggttggtaaacccaatgaattcgcctatgcctgcgcgcgccgcgtggcggaaagcccggccagcccgggcttcaatccgctctttctgtatggcggtgttggtctcggcaagacgcatctgatgcatgccatcgcgtgggagctgaaccgtccgggacggcccccggtttccgtcgcctatatgtcggcggagaagttcatgtatcgctttatcgccgccattcgcagccaatccaccatggagttcaaggaagagttgcgcagcgtcgatgtgctgatggtggatgaccttcagttcctgatcggcaaggacaatacgcaggaagaattcttccatacgttcaatgcgctggtggatgcgggcaagcagattgttgtgtcggctgacaaatcaccttccgatctgtcagggctggaagatcgtctgcggacccgtctcggctgcggcatggtggccgatctgcatgccactacctttgagctgcgtatctcgattctcgaagccaaggtgcagaaagccggcgtcgaggtctcgcccaaagtgctagaattccttgcgcacaagatcacctcgaacgtgcgggagctggaaggcgcgctgaaccggctgatcgcccatgccaatctgtttggccgggcgctgacgctggaaaccgcgcaggaagtgctgcacgatattctgaaggcgcatgaccgtcgcatcaccattgaggaaatccagcgccgcgtcgcggagcactggaatatccggctgacggacatgtcctctgcccgccgggcgcgggcagtggcccggccgcgccaggtggcgatgttcctcgccaagcagttgaccagccgctccctgccggaaatcggccgtaaattcggcaatcgcgaccataccaccgtgatgcatgccatcagccgtgtcaccgagctgatggagcgggatgcggcttttgccgaagatgtcgagctgttgcgccggatgctggaatcctgatttcgcttatcgccacgacgttccgtgttttctggccgccagcacgacgcagccgagccagatcaactgcggcaccagcagcagcgtcgggatcagcagttttccgctcggccctgcctgcatgaacagcaggcaggcacagcctcccagtactgtgaaaccccaatggatcagggtgacggcttcccggctgaaaccgctgcgggaggcgacctgatacaggtgtccacgatgggcggcagtgacgttttcgccattaaggccgcgccggaccagggtaaaagcgacatcgaacagcacgccggataacagcatcggcaccagcaggaacgacatgtccacattgtcgaaccggctggcggcaataccgagcatggcgagcacgaacccacagaactggctgccgacatcccccatgaaaatccgggctttgggaaagttgaaaggcagaaatcccgcaattcccgaggccagcagcagggcggcaaaataaatgaaatatccgccctgttcctgtgcaatccaggccagaaacaggcaggcgatcagggagacgccggaggccagcccgttcagcccgtcgatgaaattcatcgcattggtggcgaagatcagccacatcatgctggcaatcggtgcaatccatcccagcgaaaccgggccgatgaacggaaggttcggatcgcgcaggctcagcccgctggcgacgacggtcagggcggcgaggatctgggtgccgagcttgacggtaaaggagcggctgcgaatatcgtcgatcatcgacacggccgcgatggcgacggaggcgattatgaccccccggaaataaggatcggcaatccgggaaaaatcggcccagatatacagggccagcaatccggccagaaaagcggcgacgattcccactcccccccctttcggggtggcgatgctgtgggccttgcgcaaatcgggctgatccatgacccgcacggtgatcatgatccgcacgatcatggctgaaagccctgccagcgcggcacagaacagcagatggtgaagaaaggccgtgaacgtcatgcaaggctcccgcaacgggccggaaaaggcggcggaccatggccgatgccgcgtggaaccgcaacaccagcctgtatcaagcgtgcggggcacacggtaattcacccgtctcccccctcggcaagagggctggagctgtttataggtcgctcatggcgtccggacgcgtttattcccgtatcgtgctgaacatcctgctggatggttctctggcggctctggccgttccggtggcgcactggcttgcccggccggggactgatccggttccggcctcatggtggctgttactcagtgcgttgagcgtggtgctggggggcattccgttccgcctgcctacccaatactggcgctttgcaggaatcggcgatctggtcggtgtcgctgcatgcagtatcagcggagccgtcctgttcacgcttgctctggtcatggcgcacacgccgctgcccagcaaaagttttccggtcattttcgccatgaccttgctgctggtgctggggacgccacgggtggcctatcggttgacgcaaggcaatatccgtttcggggcgcgcacggaggcgtcggaagcagccccgccggtgcagaccgtgcttctggtcggtgcgggcgagggtgccgatctgtttctccgtgcgacggccaaggatcgccgtgcctcgctgcgtgtgatcggattgctggcgctgtcctcccgccagacagggcggcgtattcacgggcagccgattctcggcacggtcgatcaggccgatgaagtgctggagcgtctgcggacagaaggccagttgccggggcagatcgtcatcaccgcgtcggagttaggcggggagcggatgcgtatgctgatggatgtggcggaaaagcagggtatgcaactccgccgtgccgccgatcccacattgctgaccagtgccgcagccgatgcggattccgcgcgggccaccctgaagccggtggcgattgaggatctgctcaaccgcccgcaggcaagactggatcgggaaggcatggcccgactgattcagggccggcgtgttctggtgaccggtgccggtggcacgatcggcagtgagctcagtcgtcaggtggcggctttcggcccctcccgcctgctgctgctggataacggtgaatatgcgctgtggcagatcgatctggagctgggagaatctttccctgctgttccgcgtcagccgattgtggccgatattcgggatgccggccgactgcatgcgatcatgcaggtggagaaaccggagctggtgtttcatgccgcggcgctgaaacatgtccccatggtggaggccaatccgctggagggcctgctgaccaatgcagtcggcacaaggatcgtggcggatgcggcagcggctgccggagcgctgggcatggtgctgatttccaccgacaaggcggtcaatccgaccagcgtcatgggcgcctccaagcgtctggccgagatgtactgtcaggctctggatcgtctcgcccagcgccatggaaacggcatgcgctgcgtcacggtgcggttcggcaatgtgctgggcagcaccggatcggtggtgccgttgttccggaggcagttggaacgcggcggcccgctgaccgtgacccatccggatatgcgccgctatttcatgacggtgcgcgaagcggtgggactggtcttgcaggccacggttgtcggtgtcagtgccggggcggcctcctctgctgtgcccgaaggcggcattttcgtgctggatatgggggagccggtgaagatcgtcgatctggcgcgccaactgatccgtctggccgggctgaggccggatgaggatgtcgccatccggttcaccggtctgcgccccggcgaaaaattgtatgaagaactgttccacggcaaggaaccgccggaggctaccatctatcccggcctgctgatggcccgtccgcgtgtggtggaggcggagatggcggccgatgcgatcgacatcctggcggctgcctgtcgacgtggcgaccatgcggcggcgctggcggtgctggcacagatggtgccggaattcgtgcatcagcccaatcatgacaggacggctttgctacaaacggcttccagctgagtgagacccatgacagagacagcagccccgatcgctttccttgacctgaaagcgcagcagcgccgcatcgcggaggatctgcgcccccgtgtcgaggcggtgttcgcgcattgccagttcgtgctggggccggaggtgcgggcgctggaggaagagctggcagcgttctgcggggccacacattgcgtctcggtcagttccggtacggatgcgttgcagattgcactgatggcggagggaatcggtcgtggagacgccgtgttcctgcctgccttcacctatacggcgacggcggaagtacctctggtgctgggcgcggtgccggttttcgtggatattgatccggcgacgttccagattgatccggtggcgctggaacgccggattgaggacgtgaaacgtgcaggcgtattgcgtccgcgtgcggtgatcggcgtggatctgttcggccagcccgcgccatgggccgcgctccgcgccattgccgagcgccacggcctgttcacacttgatgattgtgcccagagtttcggggcgagcctgggtgagcgcagacttgggcaggaagccgttgcaacggccaccagctttttcccctccaaaccgctgggggcctatggcgatggtggtgctctgttcaccgaggatgcggagcgtgccgcgctgtatcgcagcctgcgcacccatggcgagggcacgacacgatacgaggttttgcgtaccggcatgaatggccgactcgacacgcttcaggcagcagtgctgctcagcaagttgacggtgttcggggaggaactggaagcgcgggaagcaatcgcgtcgctgtacgatgcaaggctggcgggggtcgctgggctgaccactccggcccgtgtgccggacagtcgctctgcctgggcgatctatgccatcctgctcaaggatgcggcccaacgcgacggcttgcaggccagtctgaaagatcggggcgtgccgacagccatctattacccgcgaccgctgcatgtgcagcctgcctacgctccctctcacgatggaacggcgctgcctgtttccgaggatctcgccacgcgtattctggcattgccgatccaccctgatctcagtgagacgcaggcccatcgcgtgtgtgatgcgattctggcttcattggcctgacctcaccgaggatgatcaggatgctgatcagcggcagttatcgggattgaaggttggctcccagctgcacaaaacgttatgtgccgcgacgctcttgttgaagtcgtaactctccgaggcgattttgccgctgcccagccaggccgtctgatcctggttgttcatcagccgggcatgggttgtgccggtttccgggacttggccggcacaggctgccatcagcaacggcaggcccagcgccagaatcaccgggatcgcgcgcccggatattcgctgccgacatggtccgtgtgtattgtgcatgatattcgctttcctcaatggcgaccggatctggttttgttttggtccggtttgcaactatgaggatgggaatgattttggcggggaacaacgccaaacacggcatgagagcaatgctttccacgcaccaaaaccgttttgtttcagggtgtgaaagaggtgttttgtccgattgccccggctgctgccacaccaaaccagcccagcatcagggttacacctccaataggtgccagcgggctgaggctgattccctgcagggccaggacatacagatcgccgcagaacagaactgtgcccacaaaaaaagcgcctccggcagccagagcgattttccggcctgccttcgtatgcagatgcgtggcaagcagcgccgagatgatcatcatgatggcgtgccagccctgcatctgcaccgccgtctgcaccagccggattgtatcgggatcgggcaaggcatgggcagcgatggcggccatggcaactgccatgcagccggataatccgccaagggtgagcagaacgcgggccatctatgcgatcctcctgaaagcacccctatttcatgcgcgggcttacatctgtaaaataccttcatgccccgtggcgatctctttccggatataggtccgaacgaaaccggctacctgccgttgtcaggtggtcatgtgatgtattgggagcaggtgggaaatccctacggcgtcccggtgctgttcctgcatggtggtccgggggcgggggcgggtacggtccatcgccgtttctttgatcctgtctactggcgggccgtcattttcgatcagcgcggagcgggccggtcccgcccgctgggtagtttggcacgcaataccacgcaggatctgatcgaagacatagaactgctgcgcgtgcatctcggcgtcgaacgctggctgctgttcggcggttcctggggatcgaccctggcgctggcctatgctcaggcacatccggacagggtgctgggctgtgtgctgcgcggcatttttctgggccgtgagcaggaggtcgcatggtttctctatggtcttcgccagatatttccggaggcccacgccgctttcgccaatttcctgcctcctgaagagcgacatgatctgctggccggctatataagccggttgaatgataccgatcctgcagttcatatgccggcggcacaggcatggtctttgtatgaagggtcgtgcagcacattgctgccgaatccggatacggtcggcttgtttgcgcgggatcggggcgcgttagggctggcgcggatcgaggcgcattattttgccaaccggctgtttctgccgccggagggtttgctgggtcatatggaccgtatcgccaccctccccgccgagatcgtgcagggccgctacgacatgatctgcccggcctattccgcctttgaccttgccgcatgctggccggccgcgaaattgaccgtgattcccgatgccggacattccgcgctggaacccgggatcaggcgtgcactggtggcagcggtggagcgtttccgccgccagatcggctgagcatgcctgatcgtttcaggcccgtttgcttcaatggcttttttaagtttttagggattgcagagcatgaccgctctttctgcttccacgcgcgcccgtttgttacttggcacccgccgctattcctcctggtcgttgaggggctggctggcggtgaagctggctgggatcgaggtggaggaagtggtctataaactggcgggagggcatacaccggaggtgaagcaggcttctcccagtggctttgtgccggtgctggaagtggaggggcagccaatctgggacagtctggcgatctgcgaatattgtgccgagatccagcctgcgttgtggccgtccgagttcatgatccgtgcccatgcgcgcagcgtggcggcagaaatgcatgcaggcttccgggaattgcgcatcgccatgccgatgaatgtctgccgccattttccggggctgatgttcaatgaggcggtgttggccgatcttgcgcgtatcgatcaggtctggagcgaaacgcgggcgcggttcggggcaggtggcccctatctttacggtgcggcattgacggtcgccgacatcatgtatgcgccggtggtggcacgctttctgacttataatgtgccactttccgaagcggctgcctcttaccgggacgcagtgcgggcgcatccgctgatgcagcaatggtatgcggcggcagaggccgaacctgaatcctggcatctgccgaaatatgagcagatcgtctgatccccgtgagcattgcttcccgtgcggcggtcagcgccggtattgaacgtgtctcggtggtggcgttgctgctgctgccgatttttctgacgcatgggcgcgggatcgcggaatgtctgatgtcaggcattgcagccctgttcctgatccgctcggcgctggtccatgaatggggatggttccgtaccggctggctgaagatcggtctcttgtggtggggatggctggtgctgtgttccctgccgatcggcagtctggggcaggggggattttcctccctgttgcaggcggtgctgacagtcagagttctgattttcgtggcggcgctggagcatctgctgctgcgtggggagcaggcgaggctgtggctgcggcggctgttggaaatcacgtttttctatatggccgcccagacggcttttcagttcgtaaccggccataacatgttcggctggccgcgtggccccgatggagagttgactggcccttatcagcatccacgagcggcccctccttactcccgtctgttgtttcccgtgctgttgccgatgctgatgcaggcgttgcgcgcaccgtggcagaaggctggtgttttgcgcattgtactggctgccggctcggtcggtttgctggtgttgatgggggagcggatgccgctgctgctggttctggggccggggcttggtgtggcattcatctatctgcggcgtttgcgtcttccgctggcggcgctggtggtgctggccggatgtctggtggcggcttctccggtgatttcacctcaggtgcaccatcggctggtagaaaagttcagtcagcagatgggagcgtttggcggcagtcattatgggcagattctcagccgctctctggtgatggcgggggataatccgctgactggaaggggttttgacggattccgcactggctgtgacgatccgcattatttcggcgtgcgctctgttgggcgggcattgggagatcgctcaaccgatggtggaggcgccgatatctgcgtgcagcatccgcacaatcattatctgcaggcgctgacggatgccggttatccggggctgctgctgttttcggcactggtgatcgcatgggtggtggcactggcgcgagggctttatcgccaccccacgccgctgcgggtcggtttgctggcagcggtggtgattcaggaatggccgctcgcctccgccagcagcgtgacatccatgcctctttccggctggttcttcctgctgcttggcttcggtctggcggaggcaaggctggctcttggatcagacaaggaacgcgttatctctgcttcatagaaaacggcaccggtgcaagccgcatgacaggaaagacaacgaccatgacagacacagctgcttccgctccgccacacattcccgtcactgtgctgaccggctttctgggggccggcaaaacgacattgctcaaccgcatcctcacggagccgcatggcaagaaatttgccgtggtgatcaatgaattcggtgagctgggcgtggataacgacctcgtcgtcgatgcggacgaggaagtgttcgaaatgaacaatggctgtgtctgctgcacagtgcgtggtgatctgattcgcatcatctccgggctgatgaagcggcgtgggcgtttcgatggcattattgtcgagaccaccggcctcgctaatcccgccccggtcgcacagactttcttcatggatgaagatgtgcggcgcaatgcccggctggatgcgatcgtgacggtggtggattcccggcatttgccgcgtcagctggaagaaagcaccgaagccatgacccagatcgcgttcgcggatgtcatcatcctcaacaagaccgatctggccacgccggaagaactggatgcgctggaggcaagaataaaggccatcaacccgcataccgtgatccgtcgtgcccatcgcgccgatgtgccggtcacggaattactggggctggacgcattcagtctggatcgcattctggcaaacgaccctgatttcctcgatcatgactcgcatgatcattcggagggggtgacaagcatcagcctggaagtgaatggtccgcttgatccacaaaagttcaatgcgtggattgccgagctgcttcagaccaaagggcaggatctgctgcgtaccaaaggaattttacactatgctggtgaagacaagcgctttgcgtttcaagccgtgcatatgctggcggatggcgattacattggcccggcagagccggggcagcgcagccggatcgtgtttatcgggcgtgatctgaaccgcccgcaattgcgacgcggttttgaggcatgccgtgcggcggtatcatgagcggggagatggatgaggacttcctgctgacgtcccgcgggcggcaggtacagcttggagcctacgcaatcggtgtggcattcagccagtcgcatgtggcctttgcggcagcggatggctgtgtccacgtgctgtctttgtccgatccgactgaaacaaatcagatcaggacgcatgaggacggactactttctttctgtgcttctcctgcggcggatggttttctgtctggcggcgatgacggccatttgcgtctgatccggtctgacgggacggtggagacagtggccggtttcaagggcaaatgggtagagaccatcgccgtgcatccggaccgtaaactcggagtgattgcctgtacggcaggccgggcggtgcatgttttcaatgcacagggtaaattgctgaaaactcttgagcatgcgtccacggtcaccgggcttgcttttgatgcgaagggcaagcgtttgtttgcctcccactataatggcgtcagcatctggtatgtggcgtccaaaaccgataaccctcgtgttctcgcatggaaagggagccataccggtgtggccgtgcatccggcagcggaagcggtggtgacatccatgcaggaaaactctctgcatggctggcggctgagtgacgggcatcacatgcgtatgagcggctatcccgccaaaacacgctcgctgtctttttccagaagcggtaaatggctggcgagttccggggccgaagccattgtgctgtggccgtttttcggtggagggccgatgggcaaacagcccatggaactggctccgatcccggatggtttgtgcacggccgtagcctgccacccgcgtcatgaggcggtcgcggcaggatattccgatgggctggctgtcatggccgatattgagtccggtcgtattctgccgatctgtgcaccgggtcgtggagagatcacggtgctgcgatggagcccggatgggcgtcatcttgcattcggcactacaaccggctttgccgcctggattgatttttcacggcaggaataggcgctttttattgtctgaatatcgcagccccaaaaaaatagcgcccggtttatgaccgggcgctatttttatatcggtttcgccaagggctgttgattaccaacggtatccgagagaggcgaacacggcacggccctgaccatacccgcaagcactgaggctgctgcatgcggcgacaaatgttttatcggtcagattggtggcattcacctgcaggcgccactgtttgtaatccgcgtgtgctaccagatcgaacagcaggaaactcggtaccgtgaaggtgttgggtacggcaccggctgtttcaccggtatagcgggtaccggcgccaagccctacgctgagatcctcgctgatcggataagtataatccagaaacacggatgccatatggctcgcctgtgcgacgggccgcgatccggttgcaccggccacattgctctttgtaatcagcggctcctgataggtgaaggcactgatcagggaaaggttccgggtgattttgccggttgcttccagttcgatgccgcggctgcggatttcgcccgtctgtacgctgaatgtgggtgcaatcgggttcggagtcagcacgttctgttggtgcagatcataggccgccgccgtgaacagaacgttggtcgagggcggctgatacttgatgccgacttcgacctgatctccggtcagaggctggaagccattgccctgcatatctgtgccagcctgtggcaggaacgatgtggaataggctgcgtagggtgagacaccgctcgggaatgcataaagcagggcggcacgaccggtgaaagcctgattatcctgggaagctgtagattttttcagattgttcaccgtggaggtggaggcaaaatcctgccgtccggtcagtgtcaggtgccagttctggtaggagagctgatcctgcagatagacaccggtctgtgtctgtgtctggttggtgctggtgagtgtgacaccgcgcgggcctgcgaaagtcggccatgtgaagctgcgatagacaggtgcaaaaacgtccagcgtaggaccgttgaggctcgcgttacgttgctggttggcattgctacggaaatcgacacccaacagaatgtcatgaccgatcgggcctgtggcggccttgtattccgtatttgtatccagcgtcaccgtgttcatgatgggctgttgccacatcgcgacgcgattcagcgtacgcaggctttggccggcatatccatttccgtagatggaacgataattcaggtcgatatgggcaaagcgcatgttctggcgtaccacccagttcgacagaatatgatgttccgctgcatatccgacagcgatctggcgcttggaataaacgtcgaactgttcatcgccattcaggaagtcacgcggaatccggccattgggattgggcaggactgtgcctttggcgggcaggaactgggcggatgatcctgcatcatcctgcatgtagctggccagcagggtcacactggtatcggcatccggtttccacgcgatggacggggcaacataaatgcgattgtttttgatatttttgtaaccagtgcctgaatcgcgcaacaaggcattgaaacgccacagcaatgttccgctcttgttgagttttccccctacatccaccgcaccctgaatacgaccgaaggagccaccctgaatctgcatctggttttgctggttcagcctgggtgttttgctgacggcattgatcagaccgccgagattacctgaaccatacaggggagagaccgctccacgcagcacctcgatgcgttccataccccatggctcgatctggaatgcctgagaggtggtggtaatgggtgtgcgcgtaccgtccagatagacatccggggtaaaggcacgaatggagccatagaagccccgcacgtcggcgccatatgaatccgcattgacgcctgccgtatagcgaagcgcttcactgatactgcgtgtattgaggacctgcatgcggtcctgggtaatgaccgtcacggcttgcggggtttccagaataggcgtgtcggttttcgtggcgctggtatcgcgggttgccagaaatccctgtaccggtgtgctggcggtcgttttctgcccctgtacggacagggtgggtaaggccgatgtttcggcctgcgaaattttctgtgccgcgctgtcggcctgtgcctgcggcatgacagccagcatgcccgccgtcatggcggcattggcaagaagaagggctttgaatgtcatctgaagtctccggctcacgtggcaagggcgcttaccggaaacgcttccccttttggaagaggtaatgattataataatcgttctcatttaaagttcatcgtaaagcgttgctaaatggcaacgctttacggagattatgatgatggccgattattcagttgtggttaaccggcctgccactcacgggcggcctcggtgatcatggcgatggcgtactcggcatagctgcggggtatggcaagatggaaaccgttttcccggtcgggatgccatatctgcacggtgacgtgggccatggtggtgatggccgtatcctccggaccgaaactgcgtggatgcagatcaatcgggatcagtttcgccagcacatccctgacagcagtaccgcagagatggaggatcacccgtccatccccctgttccgtgaccgaggcattgctaccggcggcagcccgtatgtccgatgcaaggccaggatcatgaccgatgaccagatactgtccgttgccgttccatagtacctccataccgggtacggcgctgcgctttccggtctccggcagggggatgccgtacccgatgaggaagacatcccgcagggcggaatggccattccgtctggtgttgaccagcgcgatggcccggctctgttccgtcatcacaaaaggtgtttcagacattggagcggtctccggcaggatcgacgaaggcggaggaaacgatttcggccagataatcttctccgcgcacgggatcgtagacgcggatgatttcacccgccctttcaggcccccgacacagcagtgccagcgcaatccaatggccaagagtgggagaatagacggcagaggtgatggatccctgatcatgggcggaactggcttcggcgccgcggggcagcagatgggcgcctgcccgcatcctgatgccggggtcgatctggaagccggcatcgaccgggcgcaggccgatcaggcgtggacggccaggatccgtcaaggccgggcgcagagccatagcacgaccgaggcattccttgtcggccatcaatcctccggcgttcagatcatgcagcgtgacctgcccgtttaactcgctgccagccggataggctttttccacccgcatgatccccatggcttcggtgccgtagggggtgatgccgaactcggccccggcctccatcagccggtcggcaatttcggctgcgcgacgggcggggacggccagttcataagccagctcaccggagaaggagaggccgaacaaccgtacaggcgttccatccgtgagcatggtttcggccacgctcatgcgcgggaatgcctcgcgggacagatcgaacgcagggtcgatcagacggtgcagaacatcgcgtgatcgtggacctgcaatagcgatctgcgcccattgctcggtgacggaggcaatctgcacgtccagctccggccacagacattgatggcagtagaggaggtgctggaacacctgcccggcatgggcggtggaagcgctcagcagataatgatcttctccgagccgtgcggcggtgccgtcatccagcacgaacccgtcctcgcgcagcatcaccagatatccggcgcgaccgctgcgaatgcgtgagaggcgattgacgcagacccggtcgagaaattcggctacatccgcgccctgtatatcaatcttgcccagcgtggagacatcgcagaaccctaccccgttccgcactgcattgacctcacgggtggcggtggccagccagtcggattctcccggacgcgggaaatactgggcgcgcatccattgtccgacctcggtgaacacgccgccgcgtgcttcagcccagcgatgcagcggggtgaggcggcgcggacgataatgcggcccgcgatgcgctccccccagcgcaccgatcgaaaccggtgtataggggggacggaagccggtggtgccggtggcggggatgcccgcgccggtgatccccgccatcagggccagcccgttgatattggccgttttgccctgatcagtggccatgcccagcgtggtgtagcgcttcagatgctcgaccgaaacaaagccttcctgatgcgcgagcgccacatccttcgcggtcacatcgttctggaagtcgataaaagccttacccttgacgctgcggatctgacccagcggctgggccggatcggcatcgagatcatccgtggtcggaagtgccggggctgaagggaccgaaaaaccacaggattcggccgcttccagccctgcatgcattccttcggcaatccccgcaccgaggccgaaacagcccgaagcagcccccaccacgctcataccgggcggtaatctgtcggtatcgggcaggaatgtgctggccgtatcgtcccagcgcggcttgccgccgagatgggtggtcagatgcagggccggtgtccagccgcccgacatggccagcagatcggcgcggagtgtggcgactccgccatcggtacccgcgatgctgacgctgcgtatgccactcgcaccgccatgtgcttttttgatgtgggcaccggcaaacagccttgcaccggtgcggtgggcgatgtcgcgtacggcctgcgaggtttccgtccgctggtcgatcagggcggcgacggagagtccggctgccgccagatcggccgcggtgcgggcggcatcatcattattcagggcgatcacggcgcgctgaccgggccgcacggcaaagcggttgacatagcttctgacgctgcctgccagcatcacgccggggcggtcattgccgtcgaaaaccagcgggcgttcgatgctgccggtggccagaatgcagcgacgggccatgaagcgccacaggcgctggcgcggcagatgatccggagtcactggcagatgatcggccacgcgttccagcgcgccgtacgtgccgccatcatacactccgaacacggtggtgcggcggaagatgcgggcttccgcacaggcggcaagctcggcttccatcattgcggcccattgcgcggcgggctggccgtcgatgtcgcggcgctcggtcagggtgcggccgcccaaacgactatcctgttcggccaaaatgacacgcgcccccgtccgtgccgccgcgaccgccgccgccagcccggcagggccggagccgatcaccagaacgtcacaaaaagccgtcgctttttcatagcgatcaggatcggcctcgcccgacagggcaccgagaccggcggcgcggcgaatggccggttcgtacagcttttcccagaacgcggcaggccacatgaaggtcttgtagtagaaccccgccgtcagaaacggtgagatcaactgattgaccgacagcagatcgaaacgcagcgaggggaagcggttctggctggtggcggtcagcccgtcgaacaactcgattgtcgtcgcacgggtattcggttcctgccttgcgccgctgcgcagatgcaccagcgcgttcggctcttcctcgcccgctgaaagaataccgcgcggacgatgatatttgaacgaacgcccgaccagcttcactccgttggccagaagggcggaggccagcgtatcacccgcatgaccggtataggcgcgcccgtcgaaatggaaatgcagcgggctggtgcgatcgatcatgccgccggagggtagacggcagctttgggtaaggggggcactcatcatgcctctcctgttgcagaggaggatggatcgcgggccagcatgacgctgacgatgccgtggtcgcgcgtatcgcgcctgacacgcagccagttctgacaaccggcggtatggaaccagtattcctcatgcacccctgccggattgtcgcgcagataggtgtaatcggcccatgcctccgtgctggccgaggccgccggaagagtgcgggtggcatcgccacgatacaggaattcctccaggccgcgcgggccgcaacagggacaggcgatgcgcatatcctggtccttttcagtgtcgttgatcgtcgttcaaatcaggccggttctgaaaccgcgtcagtgcaggttgggctgtgcgcccatgcctttttcatcaatcacatgaccggtggcgaaacggtccaggcgataggctgtggcaacctcatgcggcgcgccggtggcgaccagatgggccagacacagccctgccgcgggaaccgccttgaagccgccgtaacaccagcctgcattcagatacagcccctcaacaggggtacggtcgatgatcgggctgccatccatcgacatgtccatcagcccggcccagtgccgcagtaatctggcccggccaatggcgggcatcagcgcgacgccgccttcacatacatcctcgatggtcggcagattgccgcgctgggcataggagttgtagccgtcaatatcgccgccaaacacaaggccgcctttatccgactggctgatatagaaatgccccgcgccgaaggtgatgacgccgggaatgaccggtttcaaaccttcactgacgaaagcctgcaacacatggctttcgatcggtaaccgcatacccgccatggccgcgactttgctggaagagccggccactgacagcgccaccgttttcgcaccgataaagccccgttttgtgtcgaccccgagaatccggccatgttcgattttcagcccggtgacttcacagttttgaatgatgtctacccccagacggtcggcggcgcgggcatagccccatgccaccgcatcatgccggaccgtgccgccgcgtctgtgcagaagaccgcccttgatgggaaagcgtgcatgatcgaaattcaggaatggatacatcgcacgcactgcctcgcggtccagcagctccgcatccaccccgtgcagtcgcatggcgtttccgcgccgtgcataggcgtcgcgctggccatcggaatggatcaggttcagcacaccgcgctggctgaccatggcgttgtagttgatgtcctgttccagactctcccacaatttcatggacagttcgtagaacgggatgttacccggcagcccgtaattggagcggataatggtggtgttacggccgacattcccgccgccgatccagcctttttccaacacagcgacgttgcggataccgtaacggctggcaagataataggctgtggccaatccatgtccgccgcctcccacgatcacgacatcataggatggggcgggtgcggcatcacgccaggcgggtttccaacccttatgtccacgcaatgcctgtgagatcacggacagaatggaatagcggtctgacaacacggcaatgcttctccggcaggcgcatggggcgcatgagggaaaacgtagcggtggaggcgatgggacagggtataattttttcttatactcctgcctctgaggagatcgcgcatgctgcatagccccggactgccatttgatctgagagtgctggagatttttctggcggtctgtgatgctggcggtatggctggtgcggcgcgcaggctgggtttgtcgcagccggctgtctcgcaggccattgccgagatcgagaaacgcagcggtgtcgcgttgctggatcgtggcgtcagaccgctttcacccacgccggcaggggtgctgttgcggcagcgcggcgctgcattgttggatgaggcgcggcagattgccccgctgctgcgtcaggttcgccagcggcgtctggcgctgctgcggatcgggatggtcgattccctgtcccgcgccgtgctggggcctctggcgcaacagttggagacgatggctgatcaggtcatgtttttgtccggcctgaccgccagccatgccagtgcattgctgacgcggcatctggatatctgcctcggcacggatgcgttgcaggatctggacgggctggaacgctggaatctgttcgacgagccttatattctggcgcttccagccgggattgatctgccggaaggattgtccgctgctgcctctctgaccgcgttgtctgaacggctgccattggcccggtatagtgcccgttcccgcacggggatcgacatagagcggcatctgcgccgtctgcaactggatctgccacgtcatcaggaattcgatacgccttatggcgttatggcgatggtggagcaggggattgcctgggggattaccacgccgctctgtctctatgaggcacgtacggatttgagccgcatacgctgcctgcctttgccgggaccatccctgcggcgtcagctgaccctggtcgcgcggcggagggagcttggaacagtgccgcgttccctggcacagggggtgcgcaaggcgctggaggctgaggccatgccgtggctgcgccgttctatgggctgggtttgtgaaggaaaaacggagctgctgccacccttatcatccatgaccggccccaatgccgatcacgggatgggtgattgagacatatcaatgccaggatgtcgttccgttttatgaagatcctgtctgctgcatttctgatgagtgctccggcagctgcgtttgcagccccttggaccaccgcgcctgtgtccgtagggcaggggttccaggaccagcctcttctgattgcgacccagtatccgctcccgatcattcccggttataaacgatgatcgacaggaattgggctggcagttctgtcagctcctccggtccatgcagcgctgccgaatcaaaagacagcatatcaccgggattcaaggcataaagcccatccccgtggcggtagcgaatgctgcccgacaacatataaatcagctctgttcccttgtgctgaaactgcgtgtagggggcggcatccttgctgagggtgatcagatatggctccactgccaggccggagcctagagaatgcccgagcagctcgtatttatgtcctgctttggtgccgcgccgttcaatgctcaggcccatgccggctggcacataactgcaatcgcgtcgttcatcgaaatcgctgaagaagcttgagatcggcgtattcaaagcgcgggacaatgcctgaagcgtggcgagtgacggagacgtagagccgttttcgattttcgagagcatcccggccgataaatccgcttccaccgcaagatcggccgccgtaatgccaagacgctggcgcaggcggcgcactttcgcgccaatagcggcctccagcgaagcaggcggcgcctccgttctgacagggggggcattggagccggtaatcaaaggcacatcgacagatgcaggaggctgcctgtcagatgtctgggaggtaatttttttgttcatgctacagagaaaatccttttaagcagaatatagaaccatattctgatgagtcgtaaagaaatttgatattgtactaaaatataatgtacaaaaaacgatcatcagaaaaatagcaaataaaaaataatctaatttttctattgttgtaatacctttttttaataaatattttttatataaaacctctataatttgatattttttcaagaaatgttttttattgcaactaacaaatttctcttgatgaagattttttataatgcactatactgagtttgatttaaaaacagggatcagcgatgtcttgtaaaaattttgtagcccgtgttctgccgatggttgccattctgtttgctgctacaggatgcggccagaacgtgacccagaaggaaaacaagctggcagcggccggtttcgttcctcatctgcctgatacccctgccaggcttgcatccatgaaaaccttgccgccccataaatttgtccggcaggtacggaatggccagatgttgtatgtctattccgatccgaccctatgcggttgtgtctatgtcggggaccagaaggcttacagcaactatcggcatgaagtgtttgagcagcacctggcggatgagcagcaggcaacagcatccatggatcaggattacgccatggaatggtctgcatgggggccttgggcacccttttattattactgaaaacccgtatcaaaaaatttcgtcctgatgaacagttatctccggatgggccgtcccgatccggagaagctgcataacaacatttctttttcaaaaaaggcttttctttcggtgcctatgagattcctataccggcagtaggtttctccctctctcattcctatcccggtcgcgcgataaacctgatgtgcagaggagtatgaaatgctcgacggattttatgtcggccttggactggtaggctttatcgtctgtatcggcttcgtgacggcatgcacgaggatatgagccatgagcttcgatttcgttctggcgggtggtgtgaccatttttttgctggtctatattgccgccgtcctgatccggccggaaaggttctgaaccatgtccatggcaggatggatcacaatcggcattttctttctttgcgttctggcactcaccaggccgctgggcggatttctggtctctgtactggagggcaggcggacctttctgtcgcccattctggggccggtggagcgggcattgtaccggttttcaggggtgagaccggaggaggagcagtcctggtcgcactatgcgctggcgctgctcagctttaaaatcgtctgcttcgtggccgtctatgctattcttcgtttgcaggcttacctgccgttgaatccggcgggacaggggagcgtagcgcccgatctggcctacaataccgctgtcagtttcgttaccaatacaaactggcagagctatggcggtgagacgaccatgagttatctcagccagatgctcggcctgacagtacagaattttgtatccgcagctgcgggtattgctgtggctgccgctatcatcagggggtttgcccggcgggaatcaaaagccattggcaatttctgggtcgatatggtgcgggcaacattatatgtgttgctgccgatttctgtcgtgctcagtctgttttatgttttcgaaggtattcctcagacattttcgggcagtgtggttgctactacctatgaaggcatccaccagaccattgcgctgggaccggtggcatcgcaggaagccatcaagatgctggggaccaatggcggtggtttcttcaatgtgaattccgcccatccattcgaaaatcctgatgcgctgacgaatttcgtcgaaatgatcagcatttttgccattggtgccggtctgaccaacgtgttcggtcgtatggtcggcaatgaacgccagggctgggcggtgttctcggctatgtccgttctgttctttgtgggtgtgaccgctgtctactgggcggaagcgcacggaaacccggctttttccgctttcgggatcgaccagtcgctgggcaatatggagggtaaggaaacccgctttggcgttgcggcttcagcgttgtttgccgccgtcacaaccgatgcatcctgcggggccgtcaatgcgatgcatgaaagttttctgccgctgggtggcatggtgcccttgatcaacatgatgctgggtgaagtgatcatcggtggtgtcggtgccgggttgtatggcttcatcctgttcgccatcattgcagtgttcatggcgggcctcatggtcgggcgtacgccggaatatctcggcaagaaaatagaagcgcgtgagatcaagatgacgatgctggcagtgttgtgtctgccgcttgtgatgcttggatttacggctgtggcagtggtggtcaaaccgggtctggcggcgttgtctgccactggtccgcatggatttaccgaagcgctttatgcctacacctcggcggctgcgaataacggaagtgcctttgcaggtctgacggccaatccatactggaacatcacactcgggatcggcatgatgatcgggcggttttttgtgatcgtgcctgctctcgccattgccggatccatggccgccaagaaaatcgttcccccttcatccggaacattcccgaccgataccggtctgttcatcggtttggtggctggcgtgatcatcatcgtcggcggactgactttcctgcccgctctcgctctggggccgatcgtcgagcatctgtcgatgctccgcggcaccctgtattgaaaggcgtttttgtccatgacctttctatcatcccatgcgcccgccgcatcggagcgggtccatccgcgtggcagccagcttctgcggggtgacctgatactgccggcgattggcgacagttttcgtaagcttgacccgcgtgtgatgtggcataaccccgtcatgtttgtggttgagagtgtcaccctgctgaccacagttcttttgatcagggatatcttctctggcgaaagccatgtcggttttgcggttcagatcaatctctggctctggtttacgctgctctttgccaattttgctgaagccattgccgagggacgcggcaaggcacaggcagacagtttgcgccgtactaaaacggatacgatggcgaaacgcctgattgccgacagtgatggccgttattcggcgaccggtatgtatcagggtgctgctgcgcctgaactgaaagtcggcgatgtcgtgctggtcgaggcaggggatttcatccccagtgatggtgaagtgatcgaaggcattgcctccgtcgatgagtccgccatcactggtgaatcggctcctgtgattcgtgaaagcggtggtgaccgttcggcggtgacgggtggcacgcgggtattgtctgactggatcattgtccgcattacttctgcgcagggggagacgtttctggatcgcatgatctctctggtggaaggggcgcaacgtcagaaaacgccgaatgaaattgcgttgaccattctgctggcaggcatgacgctgattttcattctggccgttgctacgattcccagctttgccgcttatgcgggcggtcatatttcggtgttcattctggtggcactgttcgtcacgttgattccgaccacgatcggtggattgctatcctcgatcggcattgccggtatggatcggctgatccgtttcaatgtgctggccatgtctggccgtgctgtagaggctgccggagatgtcgatacgctgctgctggacaagaccggtacaatcaccatcggggatcgtcaggcggcggcgttcattcctgttcccggggtgacggaagaagagctggccgatgcggcacagctggcttctctggccgatgaaacgccggagggtcgctccatcgtcgttctggccaaggaaaaattcgcgctgcgcggacgggagatgcaaacactggaggcccgttttgtgcccttcacggcgcagacacggatgagcggggtcgacattggcagccgcagcatacgcaagggagcagtcgacagtgtgttggaggcggcgtcctccgattcatcccgtcaggctgttcggaacagtgcggatgagattgcccgttccggtgggacgcccctggcggtgattgatagtggccgtctgttaggtgtgattcatctgaaggatgtggtgaaaggcggtatccgggaacgttttgcggaactgcgcagcatgggtatccgcacggtgatgatcaccggcgacaatcccctgaccgctgctgccattgcggcggagagtggggtggatgattttctggcgcaggcaaccccggaagccaagcttgccttgatccgcaaggaacaggcggcgggcaagttggtggccatgtgcggtgacggcaccaatgatgcccctgcactggcccaggcggatgtcggtgtcgccatgaacacgggcactgtggcggcgcgtgaggccggcaatatggttgatctggacagcgatccaaccaaattgatcgaaatcgtcgggatcggcaaacagcttctgatgacacgcggcgctttgacgacgttttccatcgccaatgacgtcgccaagtattttgccattatacccgccatgttcatcggcttttatccgcagctcggcgcattgaacgtgatgcatctcggcaccccggagagtgcggttctgtcggcagtgatctttaacgctctaattatcgttgcgctgataccgctggccctgaagggcgttcggtatcgtcctgtcggggcggcctccttgctgcggcgcaatctgctggtctacgggctgggcggaatggtcgttcctttcatcggcatcaagctgatcgacatgatcgtcgtcagcctcggcctcgcttgagagcgcacgttatgatcatcatgcgtcaccttcgtcccgcgatcatggtttttctgtttctgtccctgatcacgggtattctctatccgcttgccatcaccggagtatccgcgctggtgatgcccggaaaagcagggggcagtctggtgtacgaccatggaaaactggtcggctcccgtctgatcggccagaatttcatacagcccggctattttcatccacgcctgtcggcaacgatggggcctgatccagccaatgcagctgtgacaatatccgcgccttataacgcagcggcctcggcggcctccaatctcggcccgacctccaaagcgttgattgatcgtgtggcggcttctgcggcggcactgaaagctgaaaatccagaggcattggcggcaggtttaccgattcctgtggatctggtgacaggctccggcagtggattggatcccgatatttctccgcaggcggcgatgtttcaggtgaagcgcattgcacgtgtgcgcaaattgccggaaaatcttattgttacgcttgtgaatcagatgacggaacagccttttctgggctggctgggggagccgagggtcaatgtcctgcaactcaacatggctctggatacgctgaaataaatgcaggacatccgcccggaacggcctgatcccgatgccttgcttcgtcaggcggaaaaagaagggcaggaaggtcgtcgcgggcggctgaagattttcctcggtgcggcgccgggggttggtaaaacatgcgagatgctgaccaccgcgcatcatcttctgcgcgatggtgttgatctcgtcatcggcgttgtggaaacgcatggccgtgccggtactgcggccttggttgaggggttggaaatcattccccttcgctctgttccgtatcgtgatcgcacgatgacggagatggatctggatgcaatcctgaatcgtgcgccgcagatggtgctggtggatgagctggctcatggaaacgtgcctggctcacggcatccgaaacgctggatggatgtggaggaactgatctccgccgggatcgacgttatgaccaccgtcaatatccagcatctggaaagtctcaacgatatcgttgccagcattactcgcatccgtgtgcgggaaacggtgccggatcgcgtgctgagtgaagcggatgagatcgaactggtcgatctgaccccgaatgatctgttgcagcggatgcgcgatggtaaaatctacgccccacaagcggcgggtcgggcgatgctgcattatttctcgcccggcaatctgaccgcgttacgggagctggccctgcgtcagacggcgcagcaggtggatgcccagctgctcgatcacatgaaggccaatgccatttccggcccatgggcggcgggggagcgcatcatggtctggctgacattgcaggatcgggatgtcagtcttctgcgctatggcaggcggttggccgatcatctgcatgcgccatggattgtcctgcatgtcgagacggggcgcgatatcacggaagatgcaagggcacgtatggcaggccagatgcatctggcccagtcgctgggggcggagaccgtcaccattcccggacaggatgaggcgttggatgcgctggcctatgcccgggcccataatgtgacgcagattgtggcggcccatccggatggtcatgcagggcggatgcactggtatcaacgtgtggcgcgctggttcagccgttcgatgacgaaccggctgatcagggcgggcggcagttttccaatccatatcgtggcgcgatcccgcgatgatgatcaggacgtggtgacaccgttcgccccggaaccgcgtcaggccatgccctatgtcagcagcacgctgatcatcggcgtggcaaccggggctgccatgcttctgcggcagattctggaagtcggtaatgtatcgctgacatttttgaccgccattctgtgggtggcggtggcgtacggtttatggccttccctgtgggcatccgtgctggggatgctgtgtttcaatttctttttcctgcccccgctttacactttcaccattgccgccccggagaacgtggtggcgatgttcttttttctgaccaccgccctgatcgccagccatctgggggcgagggtccgcaatcaggcggtggtggcgcgtcacagggcggatatcacgcaatcgctttatcagttcagtcgtcgtctgtcgggaattgtcacgctggacgatctgctgtggacggcgtgccatcagattgccaccgcgctggaacgcaatgccgtgatcctgatgccggagggtgatcggctgattctgcgcgcatcctacactccggatgagcagattgatgccgatgacctggcggcggcaagctgggcctggaaaaatgatcgtatggccggtcgcggctccgataccttgccgggcgtgggctggctgttcatcccgctgcgcacgggtcgcgggccggtcgcggtgatcggtctggatgcccatgccgaggaccatctgttatatcccgagcagcaacagcttctggatgcgctgggcgatcaggcagcgctggcgatcgagcggatcggtctggcgaaagatctggatgaggcacggcttacggctgagacggagaaactgcgtggtgcgttgctgacctcgctctcgcatgatctgcgtacgccgcttgcctctattctcggggctgcctccagcctgcatgagtatgatgcgctgctgacggagcaggaccggcgggaattgctgctgaccatccgtgaggaggccgagcggctgaatcgtttcgttgccaacctgctcgacatgatccggctggaggccggggcattgcaaccacgacgggagcgggtggaccttgcggaggtggcggccagcgcattgtcccgtgcggcccgcattttgtcggatcatccggtgcggctggaggtcgcgcccgacctgcccatgcccttgctggatgatgtcctgctggagcaggttctgttcaatctgctcgataacgcggccaaatacacgccgccgggcacgccgatcagcattgtgatcgggcaaggcccgggtgttctgacgattcgcgtgctggatgagggggccggcctcgccacgcaggacacggagagcgtgtttgagaaattcacgcgcttccgtgcggctgaccgttcccgcccgggtaccgggttggggcttgccattgcgcggggtttcatcgaagccatggggggagggatcgcggcccgtaaccggagtgatcgttccggtgctgaattcacgatcactcttccagtggaggcggaaaaccgatgagcgatccctgcgtgctgatcgtggatgacgagccggccattcgtcgtttgctgcgcaccacgttgggaacacagtcatggcggatcacggaagcggccagcggtgccggggcaatgcaggctttggccgagcaaaagcccgatctcgtgctgctcgatctcggtctgccggatatggatgggctggaggtgctgcagcacatcaggaaaacggctcccactctgccggtggtgatcctctcggcgcgggataatgaacgcggcaaggtggcggcgttcgaaatgggggcggatgattacgtcaccaagccgttcggcatggcggagctggtggcccgtctgcgcacggcgctgcgccattccctgcaaacggaaggcactctgccggtgttcgtctccggcgatttatcggtcgatcttgtgcggcgtcatgtcttcaagggtggggacgagatcaaactctctccgcgggaatgggatattctgaggatgctggtgcagcatgccggaaaagtgctgacccatcagcatatcatgtctaaactatggggcgcgcagggcgatgtgcagcaactgcgcgtctatatccggcagatcaggcagaaactggaatccaatccggaacagccccgctatatcgtcaccgagactggtattggctatcgcttggtagaagcggatgatatgggcaggtaaaggcatccctcttctctggtttttgcagcaattgttctgacccgtgacaaagtatacggccccttctgtttctcctgacaatgctttgccgtctgcggggccgccagggacggttattcgaggatcccggactggtcctttgctggctgtcacggcctgcgtgctgttgtggagcctgatcggaactgtctcgaagctcacccaggcgcagatcgatttttaccagatgatgagctggtccaacctgctgtctttgctggccgtgctggtggtgcatcgtctgagtggtcgggcctggcgcaatctgctgccgaaacgcgcagatatcagccgggtcaggctgctgatgctgcctgcgttacttggtatgctcgattgtttcttctatctggcggtttattacggctacggtcatgccaatggtgtggcggtgctggtcacacaatcgagctggccgctgatgatcgtattgctcggcatggcagtgttcagcgagcgaatgagtctccgacgctgggttggaatggcgctgggttttgcggctctgctggtcacagcgtctgccgcggggcatgccgtgctgccagcggggtcagagacggatgcgagcacggcaggagccggtttcgcgacactgtgcgtcgtgctgctgggagcgttcagctttacgcttttttcagtcttgtcccgttttctgcggttggatgcgtttgccggcacggtctgggtttttctgttctcgcttttatgctcgctggtgccgctgcttctgttcagccgattgaccctgccaccccgctcggcatggccagccttgttgctgaacggagtgttgatcaacggggtctcttacatcctgtggatctacgcgatgtcatcggtccatgccgcccgtctgacagcgctggcctttgcagcgcccgctttatcgacgatatggctggtggtatttctgcatgagccgctgatcccggcctatctgctggggctgggcatggcactggccggaggcatgctatgcctgtccggctcggatgcggggcatgcctgacgataaaaattcgatcttatcgggcggaaaatggtgccgacactcggaattgaaccgaggacctactgattacgaatcagttgctctacccctgagctatgtcggcataaggcatacgaggctgcgaccctgtgacgggtcgtgtgtatccttgagcggcgccgatatacagaaagccggcgcaggcggcaagagaagaagcggccttatatcccgcatcctgagccggaaagatcagtttttgctctctgcggccggtgcgggcggcagaatggtcatgaccgtttctgcagggcggcagagtttgacacccagtggcgtatcgacgatgggccggttgagcagggcgggttccgccagaatggcggtcagaatatcctcctccgtcaggtcgggacggtcgaggccggattgttcatagaccggccctttgcggcgcagcagatcatgtgcggtgccattcatccggtgcagtaatccgctaagctggggacgggtcagcggcgttttcatatattcgatgaccaccggcttatgccctgcttcctcgatcatggcgagaacggcccgggacgtcccgcagccaggattgtggtagatcgtcactgtcatcgcctgtcactccccatcgtggcggcccggatgattgcaatggcatggtcgtcagccttggcaaccatacatgtccggaactcttatagaacacctgaccggaacacgctaaagaccggtaaagggcattcagtgaaaggggtctgcgaccagtatggttcatgccgagcagcaagactcgcagactgatggggcggtcgatggtggccgttcccggaccgcctcttccatcgtggtgcaccgtcatgcgctggaatgccccggctgtggtgcgttttaccgtcaaccaccgcgatcccagctggaagtgcactgcacgcgttgccacaccgtgctgcgccgcacgacacgctctcctgaacgcgatacggtggcgctggccggaaccgggctggcgctgttcattctggtcggcctgatgccgtatatcaccttcgatatgcggggccgggaaaatgtcggcaccatgctggggggagcactggccttttgggaatatggtctgtgggtgctggggctgatcgtgatgttcacgaccctgattgcgccgtttctccgtcttgtcgggctgttggcggccgttacggcacctcgaatgcgcaagcccccccgggagttgtatattctgctgcgtgtcgcccaatgggttcggccatggtccatgatcgaagttttcatgctcggcatgctggtcgcctattcccgtcttgaggcactggcgcatgtgcggttcggggtggcgctgtacgctctgggtggcctgatgctggtgatggcggcgatggattgggcgcttgatccccgtgatgcctggaacaagctggaggcgcgtggtctggtcgccgatccggtgatgatgggggaggcccgccgaaatgcggccacaacgcgtttcgatgaacggcacgctatcagctgccatggctgcgggctggtcgtggagggggcggatcatgatgcctcctgcccacgctgcggcagtttcctccatcgccggaagccggacagcgtgaccagaacgatcgcgctggtggtggcagcggtgcttttatacatcccggccaatatctatccggtcatgatcatcacttcattaggcgatacctctccccacacgattgtcggcggggtgaaggaattgatcgaagccgatatgtggccgctggcggcgctggtgttttttgccagcgtgatggtgccggtgctgaaagtcatcgggctggtctggatgatcctgcgggtgcgcagacccagcgtggagggtttgaaaacgcgtaccaggatttttcatgtcatcgaaatgattggccgctggtcgatgattgatgttttcgtggtgacgattctgatagcactggtgcatatggggttcattgcgactattcagcctggtccgggggctttggcctttgccggcgtggtcattataacaatgctggcggcggagactttcgacccgcgcctgatgtgggatgcggcgattgaccagcaaaggagcacgcggcgttcccgtgatcaggctgctgaggagggtcctgacagagtcaggctggtgtcatcctctggtgtttccgtgcaaggcggtctgtcccgatgagcaataatgaacgcccgcctttgccgcccgaggatgatgacgggctggattatccgcagggcttgccgcgccgtcgattttccctgatctggctggtgccgattctggcggcgatctgcgtgatctggatcggttaccgcaccatcagtcaggaaggtccgaccatcaccctgacttttcagaccggtgaagggctggtcgcgggccagaccaaggtgcggcacaaggcggtcgatcttggcacggtccagtcgatcaatctgagcaatgatatgtctcatgtcgtggtcacgatcgccatgcggcaggaggcggagaacgttctgaccgatcacgcccgtttctgggtggtgcgcccgcgtctgtcggcaggggatatctcgggactggagaccattgtttcgggggcctttatcgaactcgatccgggccggcccggcgggaattatcgttatcagttcacggggcttgaggcgccgccggcagtgcggtcggatgagccggggaagaccttcacgttgaaggcgttcagggtcgggcagatcggcaccggcgccccggtttttttccgtgaccggcccgtgggagaagttctgagtctggatgtaggaaaacccggtgaatcggggaccatgaccatcttcatccgcgctccgtttgataaatatgtgcatgaaggctcctttttctggagtgcttcaggcatgagcgtttccacctccgggggggatttccgggtggaaatcgaaagccttcaggcccttctgtccggcgcggttgcgtttgatacgcctaatgaggcgctggaaaccccggaagccaccgacaaaaccaatttcttcctgttccgtgatcgggataccgcctcctcctcccattaccatgagcagctgcaattcgtgacctatctcaagggcgatctcagcggcctggacaaatatgctccggtgctgatttacggcatccgtgtcggctttgtgaccgatgttcatctcggattcgacagcaaatcgaatacggtcattgtcccggttcattttgtcgtccagcccgagcggctgaaaataaaggggccgcctgtttccaaggaggaaagcgaggcgcggctggcggcactggtcaggcgcggcctgcgtgccaggctggcgacgaccagctatatcacaggcgcgcaggcgatcgagctggtgatggatgaaaacggccaggatagcgtcctgacgcgcgaaggcgatgccgtcgtgctgcaacaggccaccggcacggatttcgccgggctgacagcctctgtcggggcgattgctgccaagttgaacgccattcctttcgcagagatcggcgccaatctgaaccagactctggaaggggtggccgcaatcgccaaaggggagcagcttcgtaacacgctgcgcgatgtctcgaaaacgatggccagcgtgcgggaactggcggacaatgccaataaaggggcaacccctttgctgcgtcgcctgcctcaaatcagtcaggatctgcaggcgacattgagccgggccaatacgctggtcggctcgctggataacgggtacggggccaattctcatttcaacagggagctggaccgcctgatggcccagctgaacgatacggcccgttccatccggattctggccgatctgctggatcgtcacccggaggccctgattctcggtcgtgccaaagcaggagagcgctgatccatggtattcaagcaaccggccatgctcagctccgggcatgcctgtgcaggaattgtgaaacgccgcgccgtgctgggcggtctggccgcaggactggcagggttgagtggctgtgcatcccccgatccgcagcttttcacgctggcgaccgtgccaccggcccgtgtctatcagggtgactggctggtggagctgcgccgggttggtctgccggcctatctggatcggcctgaaatcgtgcgatcaagcgatgggtacagggtgtttctggcctccaaccagcgttgggcagagcctctgaccgatatggtggaccgggttttacgccaggatttgtcgctgcgtctgccgggatcgacggtcttttcggaatcgggggctatttctgccgatccgaccgtcattgttgaagccgatctccagcgttttgaatctcccggcgatggctctgtgctgctgttggcgcaatttgcgatccgttcctcccgctctcataccgccttgatggcccagccagtgcggatcagtcattcgacagcaggcggaggatcagcgactgagacggcgtctctggtcgcggccctgagtgcgactctggcagagatggccgatgccatggccgccgcagtggcccgcaccgctcctgacgtgccccggctggatggatgatgaagaagcagaggcgggatgatgatgggtcagagcgactggatactctcccgtcctgatcctgtatcgagatcggtcagggcgcgctgcatcagcacgacatccagtgtgcgctccagctttaccccgacttcccgcaggcgtccgacggatttgaagcccagcgtggcatggacgccgatcgagccaatattctccgcatccccgatcagcgcgaccatctgtctgaaaccggcccgggcgctttcatgcagcagaagggtcaggagtgccttgccaacgccctgtcctcgtacatcctcacgcacgtaaacactgtcctcggcgcagtaacggtaggcggagcggtcccggaactgtgctgcataggcatagccgatgataccggtgcggtcttcggcgacgataaatggccaggcctcgctcttgatggtgtggaccaggcgctccatctgctcaacggtagggggtgtttcctcaaaagtgcctgttccgtggagcacgtgatgggcgtaaatgctttggatgaaggcactgtcctcacgctgtgccgggcggaaatcgggaaggcggtatgtcatgatgagcgatcttgatgttatcggggtctattactgaaatttcagagtagtggtcatggtgtcattgtaaaccatgagttgttttgaggtgacttttatgatcacggcatgttatggatcagtcacgatattgtaacagccagtatggtatttttattttagctctgcgccaagctggcacaggcatctgatctggataatatatacctcatcgtgccaggtgatggggctgatttcgcttaaaggatacgcttttgcagaataacagcgatgctttgccctcctcagcgcagggaccgcaacaggaagcggctcttgtcgatgtcgagaacgaggccctgcctccggcggtcgaagcccgtctggctgcggttgaggaagctggccgtttccatggcataaccctggaccggggcatgctgcgtatcgtcagcggagaaacgccttcggcggcgatgctcgggcaatgggccaaggattgcggcctggcggcgcgcgggttgcggctgagctgggggcagctcatgaaaatgaagggcacaagccccttggtcatgctgttcaaggatggcggtgccgggctgatggtgggggtcgatccccagcgcaagatcgtcttcatgaaagacccgctggccccccgcagcgatgatccgattgccattgatgaactgcgtctgtcgcaagcatgggatggcgatacgttgctgatccgctcccagcgtggcgtggcagaggaagatgcaccattcaatttcagctggctgctggggatggttctcaaggaaaagcgcaatctggtggatatcggagtggcatcaatcactctgagtgtgctgaccattattccacccatgctggtgatgaccgttatcgacaaggtcattgctcatcagagcatgtccaccctgctgctggtgtccctgatcctgctggtctgtgtcgtgttcgagaccgtgctgggctatacgaggcgtgagatcacccaaatcgtggcggcacggctggatgccaagctggctttgcatattttcaaccgtctgctggctctgcccctggaatatttcgagcagcaccctgcgggtgagaccacgcagcgcctctatcaggtgttccgcatccgggacttcatgacaggcaagctgcttcagacatttcttgactttttcacgctgattgtcctgctgccttttctgttttacctcagcgccactctgacctggatggtgatcggcatctcggtgctgattactctgacgattgtcactttcctcaatccgatgcggcgcgctgtcggtaaggttgtggtggcggaaattgccaagaataccgtcatggtggaaaccgtccacggaatccggacggtcaagtcgatgggactggagccgcagcagaaagaggcctgggatgtgcgggctgcggtttcggcacgggcgaggcttgcagccgggcggctgtccaactggccgaataccattgtcacaccgctggagcggttcattgaccggggtgtactgctgattggtgcctatcttgcgctgacccaccctgacagtggcgtagctgttggttcgctggtggctttcatgatgctgggtggacgtgtggctgctccgttggtgggcatggcgcgtctgctggaagatttcgaggaagtgcggacatccgttggcgaggtgggcgccgtgcttaataatccgaatgaaagcaatgcccttcagaatggcctgcgccccaaatttgccggtgccatcagcttcgacaatgtgcagtttacgtatcccggttccaaaacccctgctctatgtggagtcacattcagcgttccggccggcaccatgcttgggctggtggggcgtagtggctcgggcaagtccacgatcacccgattattgcaggggatcaaccgggactatgaaggctacgtgaaaattgacggttctgatctgcgggaaatcaatctgcatcatctgcgtcgcagtttcggtgtggtattgcaggataatttcctgttccgcggcacaattcgcgaaaatatcatcgccgggcggcccggcctgacactggaagacgtggtgcgggccgcgcggctggcaggggccgaggaatttattgaacggatgccgcaaggctatgaaaccttcattcaggaaggctccgccaacctgtccggtggccagcgtcagcgtctggccattgcccgcgccctgatttccgatccgcgtctgatgattctggatgaagccaccagcgcgcttgatccggaaagtgaggcgctggtcaatgccaatctggtgcgtatcggcaaggggcgcaccatggtgatcgtgtcccaccgtctggcatccctgacagagtgcgatctgatcgtggtgatggatcaggggcgggtcgaggatatggcaccacataaggtgctgctggaacggtgcaccatttatcgccagctgtggaaccagcagaaccgtcatatggaagcagcgcagaagcagggtccggttgcgtccatgctcgcgcagggcgactgaaacgacagaaattcaggcaggattctgtgatcctgcctgttacaggctgccttcactgcgggaaggcatctcagtctcagggcggcattcactgcgaaaaacaaggcagtggcaccgcttgaatgcgttaagggagcaggccaatggccagcaaacagcttaaattggcgcaggccaaggatacggcggagcttctggagtttgaatctcccagctctgccgtcattgccaccccggttctgccgacagcccgtcataacaccctcatcgtgttcgggctggtcacgacactcctgctggcagcgggtctggtgccggtcgacaaggtggtgaccgcccgtggcaaggtgatttcaagggttccgatccaggttgtgcaacctcttgatacggccatcgtccgttcgatcaatgtgacggaaggccaggtggttcataaaggggagcttctggctcaactcgatccgacctttgccagcgcagatatggggcagctgcgtgatcaggtgcgcagtctggaggcggaactggcgcggctgcatgcagaggctgatggcaagccctatattacccaggcggataatccggacagcaggctgcaggcggcgatctacgctcagcgtcaggccgagtggaaattcaaggtcgagaattacaatcagaaaatcagcggcttgcagaatacggtcgccaaaagcctggccgaggcgaattactatcgtcagcgtctggccattgcaacgaacgtagagagcatgcgccatgagctggagcgattgcaggtcggcagcaagctgaactcactggcggcggttgataaccgccttgagatgtcccgcgatctggcaactgcgacctccaccgcggaaacggctcgccgtgacatgcaggcactggtggcggagagggatggtttcatcaaggaatgggctgccaagatcggtcaggatattcaggatgaaggccgcaaatatagcgagcaaagcgaaaatctgaaaaaagcccagctgcgccacaaactggttgaattgcaggccagcggtgacgcggtgatccagagcattgccaaggtatccgtggggtcggttcttcagtcgggtgcccagttcatcaccattgtcccgctggatgctcctctggaagttgaggccgatgtgccgggcgaggatgccggtttcgtgcatgttggcgatacggtgacggtcaagttcgatacgtttccgtttacgcaatatggcggagcacagggaatagtccgggtgacgagcccggacagctacagccagaatgattcgcgggatgggcagctgaaagatacccagcaatcctccatggcagccgagaagaccttctacaaagcgcgggtgacgattgataaggtcacgttgcacgacacgccggaaggatttcacattgttccgggcatgcctgtcaccgctgacatcaaggttgggcagcgtacaatcctgaaatatcttctgggcaaggtcttgccggcgttttcagaaggcatgcgggagccttgatccgtgattgatcaataacggggatcatgatcagaggggtatgacgcagccgtggcacgtctgataaaccgggtaaccggcctgttttctcctgctgccagaatgcaggaggccacagcacttgcggaagcgggggaatggcccaaagcgtttccgctttttgccaaagtggccgaaaaaggcgtggccgaagcgcaatatcgggttgggcgttgctatctggaggctgcaggtgttcctttcagtccccgggaaggggaacgctggttggaaagggctgccagtcagggcttcgtggaagcgcagacattgttggcaaccctgtatctgcgtggcgtcggggagcagggggaaccagccactgccgatcccgcaaaggctgcatcggaagatgtgctgggtggggtggaagcctctctggaggcgcgatccgggggagccggaacagctgcctcccgtgtcggatcaggcttgtttacctctgcttccacgattcaggccgatccgctcaaggcactgggctgggcgagcaaggcggcggaagctggttcctctgacgggcaggcgctggtcggatatatcctgacgaccgggccggactctgtgcgtgatctggaacaggcgctggtatggtatcagaaagcagccgcttccggctgtccgcagggggcgctgggagtggggttggccctgctcaaggatgcagtgacgccggaagccactcaggcagcagccgagcagttgcaggtggcagccaatggtggcctgccgacggcgctctatctgctgggcgtgatgcatgagcgtgccgccggtgtgccccatgatctggcagcggccgccggttactacaagacagccgcagagaaagggctggtttccgcccaggcacgctggggtctggcgctgctcgaaggacgaggcgtcaaacgtaatctgctggagggtgaatcatggctgcgtcgtgcagcccttcagggcgatgccgaggcggcggcactggtgggtgacctttacgcacggggtggggatgtccctcctaattatgccgaggccgccctgtggtttcgccgtgcttccgatgcagggcacagcaaggcggcccgtacgctgggtctgatgtgtctgacgggggccgggatgagccgcgacccggaagaagcggctcgctggttccgtatttcggccgagcgtggtgatcaggaagccgtgtccgaccttgccagtctggtgcaggctggtctggctgcggaagaagagagcatcagaacccgcaagatttttgaacaggccgctgcgaatggggatctggtcgcggctttcaatttcggcgtttgccttgccgaaggggtgggaatcgagaaagacgagcgcagcgccgcgcaatggctgcgcaaggctgcggatggggtggtgaatgcccagtactggtatgggcgtatgctgctggaagggcgcggtctcgatgtggacgccgaagccgggcgctcctggatcgaacgggctgcttctaccggcatggtggaggccgaggttgcctttgcagaactgctggtgaccgggcgcggtggcgcgaaggaccatccggaggcgctggtctatttcgaacgtgctgccgggcggggccatatcggtgccatgttcgcgattggtgcgatgatgggcggtggtcacgaagtgccgacggatcgggagaaggcgatcatctggtatcgtgcggcagcagagcgtggtcatgctcatgcacagctgatgttgggccggtttctggcgcggggattggccggagaaaaggacgagcttcaggggcgcttctggttggaaaaggccctgtcgcagggtctgacagaagcacagggcgatcttcaggctctgcccccggagattctgacgatgccatatccttatgaggcagtcagagtggacaatctccccgaagagcctgtcccacatttggcagagcatgaaccgtcttcagtccagaatccggctttgacggatcattcctgacgtgccggatatgttgcagggtgcgagatggcagcattaggcagcgctgccgttgcggctgagcgacagagactgcgggaatattggcgtcagctggctgaagatgcctacaagcttggcgaacgggccatggagcagtcgcagtggcacgaagctgcgttctggctggcccgggccacgcgtctgtctccgcgtcaggacacgatccggctgctatcggcacttctgaagctgcggcggggtgatccgactgcaagggccgattttgaatcccttgcacgccagtatgaaacgaccgagatcctgtccggtttggcgactttgcaggtgctgggcggtgatctgacgcatgcgaccgttaccgttcaacgacttctctcacgtatccggcatgatgtctggccgatagcgcatgaattgttgatgacggtgagcagggcagcaggattgccgggctggtgccgcctgtcagccgatggacatgttcacgcctatgaagtcgggacgggtgatgtaaaccccgccagtctcagtttcacccttgatgggataacgctggaaacggcgccttccgcacaggagctggttgcgggtcgttttctggatgtgtgcagcgggaaccggcctttgctggggtcgccgtttgatctggtggcgatgtatcgtgtgcagggctggattgactggaatgaagacggggatgtgcagggctgggcctggcatccgggctgccctgacgctgatccgctgctgtcggtcatttctgctgacggacacttgtatggtccgttcaaggcgcatgaaccggcggagaaagtgggtctcgatacaccctttgcccgtccccggcgtattcatgttccggcgggggaatgggatggcaccgggctgatttcggttcgcgatgtgcgaggcaatgatcttttgggtagtccgcttgatccccgtctgagccctctgttgaaactgaagcggcaggatgcgaccggtggcgagggttttgcccgcgcgatcagatcggtgcgtgctctggcccgtgcattaccggtttctgaaccggccattccctgtcctgcggatatcctgccggcgatgaagcctctggtcccgttgcgctgcttgcctgtagcggagagcctgtcgaccgcctcccctgttgagacagggcagcccgtttccatcgtgatgccggtttatggtggcggagacgttgtccgagcctgtctggagtctgtgctggccacggtccctgaatcgaccgagatcatcatcgtggacgatgccggttacgaccccgtacttctggtgcatttgcaggctcttgccgggcaggggcgtatcaatttgctgcaccaggcccgcaatcgcggatttccatcctcggtcaatcttggcatgcgggcggctggggccgggcgggacgtggtgttgctgaacagtgatacgctggtgccggaaggctggctggagcgattacagaaagccgcctgcgcggcgacgaatatcgggacggccacgcctttttcgaatgatgcctcaatcctgagctatccgcaggaggatggacgctggcctctgccggatcgtgctgaaacagagcagttcgcccggtttgctcgtcaggccaacaagaaccgggtggttgatattcccgttgcggtcgggttctgcatgtatatccgccgggattgcctcgatgaggttggtgttttccgggatgatgtctttgcgcagggctatggcgaggagaatgatttctgcctgcgtgcccgtgcgttgggctggcgccatgtggttgcaacgggtgctttcgtcgcacatgtggggggcggcagcttcggagaaggccggtcgcgtctggcagcccggaatgaatcgatcctctctgcgctgcatccgggctatcacggcatggtggcggcctggcgtgcccgcaacccgctgcatgccagccgccgggcgatggatggtctgcgtttccgggctgccctgcctgacaggccttccatcctgatgattacccatgatcgggggggaggggtgcagcgacagattgagacccggatggccctttttcatcaggcaggccgcaatgtcgttatcctgcgtccggtcatgatggaggagacagcctcttatgagggctggaccgtcctcgacaccgggtttgccgatcagtatccccatttgcggcaccgtatgcctagggacagggtcgccttgctgcgattgttgcgccagatcaaggtggagcgggtggaactgcatcatctgcttggccataaccacgccgtggccggtctggctgcagcgctgggtgtgccgcaggatatacacgtgcatgattatgccgcgttctgcccccgtatcgccctgatgagtcccgccaggcgctattgcggggagccggagatcgaccaatgtgaacgctgcatcgctgagggaggcagtcatctggaggagccaatcagtgttgcagccttgcgccaccgttcgcagcgcgatctgatggaggctgcgcaggtcgttactccctcacaggatgtggcacggcggatgcaacgccatttcccggcccttcgccccatcattgtcccatgggaagagggtgccgatgtcgtctccatgccccccggaatggagagtgatatggcggcatgggggcctttggcggatcatatttgcgtgatctgtgttatcggcgcgatcggcgctgaaaaaggtttcgactgtctgctggaggctgcaagggatgcggcagcgcgttccctcccgcttcgtttcgtgctggtcggtcatagtgttgatgatccagccttgctggagacaggttatgtccgaatcaccggccgttacagcgatgatgatttacccgctcttattgtggcccagaaggcgaaaatggcatggattccctcaatctggcctgaaacatggtgtttcacgctcagcgaggcatggcgggcggggcttcccgtggttgcctttgacctcggtacggtggcagagcgtattaaaaaagctcaggtgcatcagagccatgccggctttgtgatgccgcttggcatgcctgttgaaattataaacgatacatttctgtcacgtaatatggatagaacaggctttgcaccctctgcaaatcgggtaaacaggattcagttttgctgaatacggtgaaatcggttctgacagccaaaagaagcagccgaataaaaaccagtttcttttgcatcatggagagcgagattacgcatgtctgaaggcttgtttgccgggcaaaatccggcccagtcacgactggggcaaggtgctcccggaaatgtggccgcaccatcgggtgcggatcagcaggctgctgcacagaacacagcctcccgtatcatgagcgaaattcaggtttccgcgcatgtcatgaagctggatcccgggctgttctgctttgtccagacgccaagcccaaatcgtccgttggacaatagcggactgccagcgatccgggtttccctgccgccgggacatgaacatcggccccatgccatttcggtgacatctttccgggaagatggctggttgtacggccccgccgatgccgcgctggtgcgggtcatgcagccgcaggctcaggtgctggtcacaatttaccaacagcccggccagcaggattccgcaccccggttacaggtgctgcgtctggctgatggggtgccttttggcggtgttccctcagcccctcctcttcagcccggtttcatgcagccgggagcagtgccgccgccgggtgtgatgccgcaggtgggggttcctccgatgccaccaccacagggcgttcctcaaggcattccgcaaggtatgcaacagggtgcatcccatgggccggctcagtcatttgaaccggtcagaacgcaatccggtgctattcccgatattattgctcatatccgtatgcagggggatgtcggcgaccagctgggtgaatggattggcgagcgaggcagtacccgctggatcgagggctttatgatcatgccgcaaagcctgatcgatccgaaagatatcgaatatcagggtgttcttggccgcggctggttgtcgccgtggatggaaggcggccagctttgcggcagccggggcatggcattgccgttgctgggactgaaggcgcggttgcggaacagggccgccgaagctttcgatctgagctacgagggcagtttcgtggatgggacggctattggaccgttggccggcggggagacgctggaagcgaccaatatggctcctctggaagcattccggatcattctgcgcccaaaagcaaaagccactgtccccaaatctgctcccaaggcatcaacccgtaaagcagcctcttcggcccggacaggggcacgccgcaacgtatgacgccggtatacgttatttgaaatagaaaggggcagcaccatctcaaaagggtactgcccttttcgggcgattacctgatatggatttgatgtgaaattcctgtttgtccatcagaattttccgggacaatttttgcatatcgtccgctcactggcggaagaaaaccggcatgaaattatctttttgacggaagaaaaccctaattttttggggggtgtccggaaaatggtctaccggatgctacgtcagcccgagcccaatgttcatctccatgccagagatatggaactggcagcggtccgggccgaggcggtggcatcggcagcacgtaatctgctgctgcttggattcaggcccgatattattatcggccaccatggctggggggagttgctgaaccttcaggatatctggccgggtgtccccttgcttgggtatttcgaatttttttatcgcacctatggtacggatgtgaatttcgatccggaattcccgagcgggcctgatttcctgcccaatgtgcgcaacaagaatgtcgtcaactttctggcgttgcagctggagggcatggggcagaccccgacacgattccagttggagacatatccggaatgggccagggagcggattcgggttattcctgaaggcgctgatctggaagcctgtacgcctgatccggcgatccgtaagcaaccttatcagctaggtgatttccatgttgcgccggatgagaagctgatcaccttcgtatcccgtgatctggagccttatcgcggctatcacgtcatggtacgcgccttgccgaagattttggaagctcgccccgatgtgaaagcgattctcgtcggcagggacggggtcagctatggcgcacggcccgtcaacactacatggaaagagcatttcctgaacgaacaggccgggcggctggatatgagtcgggtctgtttgccggggcgtatcgactatgaggaatttttaaaattgctccaacggtcgaacgcacatgtctatctgacctatcccttcgtgctgtcctggtcgctcagggaggctctggcgacgggctgcgccattatcggcagcgataccgcgccggtgctggaatttctgacgcatgaggaaaatgcgttgatcacaccatgcctcgatcctgacaagctggcggattccgtcctgcgtctgctgtcagatgaaaagctcgagaaaaaactgcgccggaatgcccggcgctatgcggagaagcatctccgtatggaggaccatctggccaatttccgcgcgctgatctccgagatgacggggcagaaactgtaacccgtcaggccctgtcaggcatgatataaacaggcgtgatataaaaaggggcggcaggcgtttttcctgtccgccccgtttttttatttcgctgcgcgctggatggaggcggtgatggcagcctcggccgcagccttgtcgccccagccggtgaccttcacccatttattgggttccagatccttgtagcgcgtgaagaaatgctcgatcgccttgcgggtgatttccggcagatcctcgattttttccaccgtgctgaattgcggatgcaccttgtcatgcgggacgcagatgatcttttcgtcgatcccgctttcgtcttccatgttcagcacgccgatcgggcgggcgcgaatcacggcacccggcaccacgggggcaggggtcaggaccagcgcatccgccggatcgccatcatcggccagcgtgccgggaataaaaccgtatgaagccgggtaggccatgggtgtgaacaggaaacggtccacgatcacggcgccggagtccttgtccacttcgtatttcaccgcagaaccttgcggaatttcgatcacgacattgatgtcactggggggctgcttgccaatggccagcttgctgacgtccatgagaggatactcgtctcgttaaagaaaaaggtcggcgcaccgtaacggccagagttgtccttgccaacatggcgtagttgtggttcccctcccttcgcaccgtgtcgtaccgggtggggggcgttattctccgactggcggcggcggcgcgctactctcatgcgcctgtagctcaatggttagagcggaccgctcataacggtttggttgcgggttcgagtcctgccgggcgcatatttcgatctccgtcggccgcggctttgtcagacgcggccgaccggtcaaccgccgggagccagatatggccagctaccagtatgtttatgtgatgaaggatgtgacgaaggcttatccgggcggccgggaagtcttcaagggcattaccctgtccttcctgccgggcgtgaagatcggcgtactgggtgtcaacggggccggtaaatcgaccctgatgaaaatcatggccggcattgagaaagaatatggcggcgaggcctgggccgcggaaggtgcccgggtcggttatctgtctcaggagccacagctcgaccccaccaaaacggtggcggaaaacgtcggcgaggcgtttgcggagctgaaagcggcgatcgaccgcttcaatgaaatttccatggcgttcgccgaacccatggatgacgacaagatgaacgaattgctggccgagcaggccatgttgcaggaaaagatcgacgccgaggatggttgggatctggaccgccgcgttgaaatcgcactggacgcgttgcgctgcccgccaccggaggcgttggtggagcggttgtcgggcggtgagcgccgccgcgtcgcactgtgccggctgctgctggaaaagcccgatctgctgctgctggacgaaccgaccaaccatctggatgcggaaagcgtgtcctggctggaacgcacgctgcgcgattatgcgggcacggtgatggtcgtcacccatgaccgttacttcctggacaacgtgaccaactggattctggagatcgagcggggccgtggctatccgttcgagggcaactactcctcctggctggagcagaagcgcaagcgtctggcccaggaagaaaaggaagagagcaaccgtcagcgcgccctggcggcggagcaggaatggattcagtccagccctcgtgcccgtcaggccaagagcaaggcccgtatccagcgttatgaggaattgctgaacaagtcgcaggaacaggccggtggcgtagcggatatcgtgattccgcccggcccccgtctgggcggtacggtgatcgaggcggaagatctgcgtaaatccttcggcaatcgtctgctgatcgacgggcttaacttcaagctgccgccgggtggtatcgtcggcgtcattggtcccaacggcgcaggcaagacgacactgttccgtatgattaccggggtggagcagcccgattccggttccctgaccgtgggtgacaccgtgaagctgggttatgtggatcagaaccgcgacagtctggacgacaacaagaccgtctgggaagaaatcagcggcggcacggatgtgattcatctgggcaagcgcacagtggccagccgggcctatgtcggggccttcaatttcaaagggcccgatcagcagaaaagagtcggcgtgctgtcaggcggcgaacgtaaccgcgtgcatctcgctaaaatgctcaagagcgaggccaatgtgatcctgctcgacgagccgaccaatgatctggatgtcgatacattgcgggccctggaagacgctctggcggatttcgcaggctgtgccgtgatcatcagccatgaccgatggttcctcgatcgtcttgcaacgcatatcctcgctttcgaaggcgatagccatgtcgagtggttcgaaggtaacttccaggcctatgaagaggataagcgacgccgacttggcgccgaggccaccgagccacatcgtattaagtaccgcccgctggagcgttgaggacggggcggggcgctcccccgcccttgccacggctgctcttctggcggatctgatcccggccgggcgcattctgcgcacggggcgtctgctgctgtaccctgtcacctatgccgatctgcccgacctatgccggatcaaggctgatcccggggtcttcgcgatcatgctgggcggggttcgtaattccttgcaggcagcggaggaactggccgctgatattgccttctggggtcagcataatgtcgggatgtgggtggtgcgggatgcccataccggccatttcgaggggctgactggtttgatgggccgcccggatgggcgtggcatgtcgattcgtttcgcattttggccggaggcgcggggccgtggttatgcccgcgaagcggcgggagccgccttgcgctatgcccatgatgttgcaggggtggaacgtgtcatcggcgttgcgcgggaggaaaactggggttcccgcatggtgctgggcagtatcggtatgcggcatgccgacagttttatgcgggatggataccggatgctggtttacgaaagctggcggatgggccgtccgccagcataggtcagcgcaggaacgtgccgaaggagcgcgggctgttccccgctttcaccagcgccttctgatggccgttttcggcatccagaatagacagcgtatcgtccatccagttgacgacgtacagggtcttgccgtccgcactggtctggatgccttcagggtaggagccgacaccgaaactggtgatcggcttgaggctcaccgtatcgaatacggtgacggaatcagacatctcgttggtcacatagccgcgctgcccatgcacggtgacgacgtaggggcgatgcccggtcggaatccgggccagcagggtgcgtgatggcaggtcgatgacggcgacatcattggattcgacatcggcggcataggcgcgtctaccatccgaggaaaccatgacgccaaacggatgctgcccggtcttgatggaggccagatgtttgaaatgcacaggatcaaggatggaaatctgattatcttcccggtccgcacaaatcaggtttttgccatcgggtgtgaaagccagcccggagggagatttcccggtttcaatgacagctttgacagcaccgcttacgctgtccagagcggtgacatgattggcaaaccagtccgccacaaacacagtgccgccgtcgggtgaaacagcgacacccagcggtgcgccgccaactgtaatgcgcttgatcaccctgcgctgcacagcatcgagaatggtgaggctgtgatcttcaggggcagtaacataggcacggctgccatcccggcttatggcaattccggcgacatcccccgtcattggaatggaggcgaccggttttgtgctctccagatcaatgatggtgaccatgtgaccctgctgatcggtcacgaaagcttcctccgcccggcctgtcagcggggtaaggaaaaggaaagcggctgataacgcgctcagcagggtctttatcatgggttaaccgccgaatttggccttcaaggcggcgaggccggctttcatgtagtcggcgaccgcctttttggacgcttcatcgttcaggttcggcggcggatcattgttcatgtagccgcgatagaaagccgcgttccattcgacggtggatttgccaccagccgccggagagacggacagctccgtagacaggtcgttcgcgggcagggcatccggattgggcttggtgaggaaggttttgtacagatgctcggtggcatcgtatttatccagagactcggtgatcggcttcccggatgctttcagcgtcagggtacgcagggaggtaaccttgttaccgccatcaccggtggcgcttgccacggcgggattccagctcatgtcgtggaaattgccgatgacggcccagactttgtccggggttgcgttgaccgtcacggattcctcgaccttctgacgggtcgggccatgggcggaggcctgtgaagcggcaaaggaggatacaagaaccggaacagccagcatggctgcgcgggcaggggtaagccagtgaagaagcatgacaatctcccgttggggcggcaaatattgcccgctcttttccgcagaacaagcgcatgaagaagaaaaagtcttaaattcgaggttcagtttgatcggttttttcagcgccagtgatggcactgaaaaaacgctctgtttattccccggcctgccggctgatggcggagatcagggtatcgagatcctggttatgatgttgcaggaagctggcataatcctgccgttgggtcagccgcaggctggtgccttccgccagcacatccacaatacgggggggaccgccctgtgtcgccacaacccactggacgttggccggggcatttccggggcgatgaatgatggtttgaaccagcgtattttcgccttgtggcgtcacgcggccaagcgtgtagctcatgccttttgcttcgccgatcttgcttgtgacgttacggacgagaaccttgtgaaacaggttcagatattgctgccgctgttgctgtgaggcactcgtccagtaacggccaaggcagaaacgtcccacattatcgacatcgatatagctgtcgacgatacgggtcagttcggcttttttcctggcttcgttgggagaattattgaccgcagccaccagttcattcccggcacgacggatgaagtcggccgctacgttgctctgggcatgggtgggcagaggcagaaatgtggcaccggcaagggcggcggccagaaacagtcgtcgattcaacacaatggcatccatgaggttcagttttaccattcacgcgggagcggccggtgtgaaaaccaggtccggatcagggttgtcccggtccggaagcggggaacaggtcttcgtcctttaccgtccctttgttgcgggcatcttcgatcacgctggcgcggtgctgacggaacaggctgcggaacgtggcgtaagggtctaacgacgtttcctggatcgagttcagaacatcattggcctgatcgcgcatgtcggcagcggagacgctgtactgtgcccagagcagcttgttgactgtggctccctgcccaaaccatgtggtgggggacatggcaacatcgacgccatagccggaggcatcgcgcggattgctgggccccagaatcggcaggaacaggaacgggccttccggtacgccccacagcgccatggtaacgccgaaatcggtatcgtggcgtttgatgcccatattgccggccacatcgaacaggccgccaatgccaagcgtgctgttgatagcgaagcgggacagtgtgtcgccggcgcgctttccgttccactgcagaacgtcattggccaggatcaccggggtctggatattggtaatcgcgttgcggaacccggtgcggaccggggaggggacaacataatgataggcaagggccaccggtttcagcaccaccgcatcgatggcatcgttcacctggtacatgacccggttggtgggttccagcggatcgttggcctgctggtattccgcgacagcttccttgtcgctggcaggtggtttggtcgcacatgcggctatcaggccgggcagcagcagggcagccgcaagccggcgtaacgaaagcccgaacggacgcatggttggaactgtgtcagaacaatcagcgcgcatgggcggcaggtccttgaagaattaagccccgccgcgatggtcgggggtgtatggccagacagcctgtctctgcgaactgttgtagcatgcagttacggggctgcaacgcatccggatgtatgaggttgtgcatcatggcgctatcaggcaagagctagccatcactgtggccgtcaggtgacaacaccgaccggcttttcccttccggcgcgaggggatggatggagacagagggatatgaatcgtctggcgggtcaggaacagcagggtgaaagcgcgacattgcggcgctggctgaccggcccgcgcgtgaccgggctgccggccatggatgcggaacatcctgtgccgctgctgtcgtttgaattcttcccgccgaaaacggaagccctggaacgtcagctctgggcctgcatcagacgtctggagccgctggggccgcgtttcgtgtccgtgacttacggcgcaggcggctcgactcaggcccgtacgcatgagaccgttgcccgtattgtccgtgaaaccagcctgacccccgctgcgcatctgacctgtgtgggtgccacacgcgatgaggtcgatgaggtcgcccgccattactgggaggctggggtgaggcatatcgtcgccttgcggggggatatgccggggggtgccccgtatcagccccatccgggcggatacgcctatgcttccgatctggtggccggactgaaacggatcggagatttcgagatttcagtggcggcctatcccgagactcacccggctgcaccggatgccgggtttgatctggacaatctgaaacgcaagctcgatgccggggcgacacgggcgatcacccagtattttttcgacacggataccttcctgcgttttctggatcgctgccttgtcgcgggtattaccgcgccgatcgtgcccggtatcatgcccgtctccaactatgcgcaggcggttcgcttcagcacggcgatcggtaccagcgtgccggactggctgggccgcctgttcgacgggctggaagacgatgtggaaacccgccgtatggtcgcggcggtggtcgcggcagagcaggtcaggctgttgcaggccaacgggattgacgaatttcacttctatacgttgaaccgtcctgatctggtctatgcgattgcccgtattctgggtgttcatccccctgccgcaccaatcgcctgagtaggtgtgagcttccaccctcggactgcccctgcacggatctggccctgcacggatgtagtctgacaacatatatcggatttcgtgaccgatcatccttcatcgccgtttcctcctgctgctgcgtctgtcccgtctgaggggggggaggcatatctggcgcgcctgaaccccgaacagcgggcggcggtggagacgattgatgggccgctgctggtgctggccggggcgggcacgggcaagacacgggtgctgaccacccgctttgcccatattctgaaaagcgggcgtgcttttcccaatcaggttctggccgtcaccttcaccaacaaggctgcccgggaaatgcgggagagggtcggggcgatcctcggcgagaaggtggaggggctgtggctcggcacattccatgcgctctgcgcccgtatgctgcggcggcatgcggagtatgtcggcctctcctcgaatttctcgattctcgacagtgatgaccagatgcgcctgcttaagcaggtggcggagacgtttcgggtcgataccaaacgatggccgctgcccggcctgatggccgccatccagcgctggaaagatcgtggcctgacgcccgagcgtgtgaccccggctgaggatacggattatgcctccggccatgctgtcgcgatctatcgggcctatcaggagcgactgcgggcactcaatgcggctgatttcggtgatctgctgcttttcatgacggaaattctccgctcccggccggaagtgctgagccagtatcatcgggctttccgttacattctggtcgatgagtatcaggatacgaatctggtccagtatctctggctgcgtctgctggcgcagggaaggcagaacggggaccagaacatctgctgcgtcggggatgacgatcagagcatctattcctggcgcggggcggaggtggaaaacatcctacgcttcgaaaaggatttccccggcgcgcatgtggtgcggctggagagtaattatcgctcgaccgcccccattcttggcgctgcggccgggctgattgcgcataatgaagggcggctcggcaaaacgctgcgtcctggccgggccaatgcggaaggtgagaaggtcgatgtcatctctctgtgggattccgatgaggaagcccgcatggtgggggatcgcatcgaaacggcgcgtcgtaaccgtcacccgttatcggagatcgcggtgctggtcagggccggctttcagacccgctccttcgaggaaaggctgattaccctgggcgtgccctatcgtgtcattggtgggttgaggttctatgagcgggccgaaattcgcgatgcgatcgcttatgcgcggttattggcccaaccttccgatgatctggcgttcgagcggatcgtgaatgtgccgcgtcgtggcgtgggagaggtcgcgttgcgtggcctgcatgaacgggccagggctgattctgtcccgctgctggaagccgcttcacggcaactggccgatggtaaattgcgcgggaaagtgaaagagggcatcgctgccttcctgcagggtctggagagttggcggcgcatgctgggcagcgaaggccatgtcgccaccatggccaccatgctggatgagagcggctacacggagatgtggaagcaggataaatcacccgaggcgccgggccggctggaaaatctcaaggaattgctgcgggccatggccgagttcgatgctctgcccggttttctcgatcacgtctcgctggtgatggagaatgaacaggatgcgggcgacgacaaggtcagtctgatgagcctgcacgccgccaagggactggaattcgacatggttttcctgccgggttgggaggaaggcctgtttccccatcaacgggcgctggatgaaggcggcctgaaaagcctggaggaggagcggcggctggcctatgtgggcctcacgcgcgcgcgacaaaaagccgtgatcagccatgccgccaaccggcgcatttacgccaactggcagagcgccattcccagccgctttatcgaggaactgccgccggactgcatccagtcgcaggggtcggcagtgatggagcgggagcagcggttgcggggtggattcggcgctggcgttcagttcccgatgctggcgacccgtcatgcaccccgggcggcagcaccacgggtgcgggaagcatgggaacagccgggccgggcatctcaggcagggcggttttcggtcggcagccgggtttttcatgacaaattcggctatggaaccgtgacggcggtgattgatgaccgtctggacgtgacattcgacaaggcaggcacgaaacgcattctcgacagtttcgtggaaccgcgatgaggaagacagatcaatgagccgccatgccaccgctctggagacggtgcgcgtcatcgttcccgatgaagccgtctacgcttatgaagcggcgtttcagaccgtgtgcggcaatgtcggtctctggctggatgaggataccggcctctggcatatcgagggggtcagggagcgtggcacaccgggcctcgatcaggctctggcgctggcccgccttgccagcggtacggatgcggagatcatccgcaccgaaacgcctgccgatggctggcttgcccgcacctatgaatcattccccgaacagctcgtaggtcgccgttttgcggtgcgcggcacacatctgaatggccccgatacgccgggccggatcacgttgcgtctggatgcgggggttgcgttcggctctggcgagcatggctcgacccgtggctgtctgctggcgttggagcaactggctgcaaaagcctcgccaaagcggcgggtgattgatctgggaacaggctccggcattcttgccatggcggcggcacggctgatcaagccgcatccggtgcgggtgatggcggcggatatcgaaccatggtcggtacgtaccgcacagcagaatgcagtgctgaaccgggtatcaaggcagctcgactgtcttgtctcggatggatggaagcgacgtccgatccgggccagggcaccttatgatctgatttttgccaatattctggcgcgcccgctctgtggtatggcctatcctctggcgcagtctctggaaccgggtgggcatgtgattctggccggattgctggcaacccagatgcggatggtgttggcagcctatcgccgccaggggctggtgctgtggaaagcgattccgcagggacactggatgacgctgatcctgcacaagcgtccggtggcctctttggaaaaagcggtctctgcggcataattcaagacgcctatcatcatcaaagaagagacgtgctgaatgcttcttcctcttccgactgacagaaaacgtgctgcggtcgttgatctggggtccaattcggtccgcctcgtggtgtttgaggggcagtcacggaatccgttaccgattttcaacgaaaaagcggtgctccggctcgggcgcggattgcagaccacaggacgtctgaacgatgaaggggtcgggcaggcgctggttgtcatggcgcggtattacgcgctggcccgcgcgatgcatgccgatccgttcgaagtattggcgactgccgcggtaagggatgccgaaaacggtcctgattttgtagcggcactggaacggatcatgccgggcgtgccgattctggtgctgtcagggcatgaagaagccgcgctgtcggcacagggtgtgctgtgcggtatgccgcaggcaagaggtattctggccgatattggtggtggctcgctggaagtcgtacggctggatggggggcaggcccaagatgccgctaccctgcggcttggggtcatccggctggcggatcgtgccgggggcgatccggccaaggcgcggacactggtcgatactgaccttgcttccgtaccgtggctggggcaggagccgggccaggatctgctgctggtgggcggggcatggcgcgcaatggcgcgtatccatatggctcaaaccggttatccgctgaatatggtgcaccattacacgatcagccgggatgaggcgcgggatctgaccggtgtcatcgcttccgccagtccgaaagggctggagcggcttcctgccgttccgcgccgccgcatggaagatctgccctatgcggctctggtactgcgtcggttgctgcgcgctaccggctgccgtcgtgttgtattctctgccaatggactgcgcgagggctggtatatgcgcatgatcccgccggagatcgccgcacgtgatccattgcgggcggtcgccgaggaagatgcgcggctttatagccgtgatcctgctctgcctggccgtctgtgcgcctggacggatggattattccccgatgagaccgaggaacaaaggcgcctgcgcgaagcctgctgtctgatgtccgatatcgggcatcacgatcacccggaattcagggcagagcaggcgtttcattatctgctgcgtcagccgggcagcggcctcgatcatcatggccgggcttttctgggtttgacgattgccatgcgatatgaggccgatccggcttccccctggctgctgccggcgcgtttgctgctggatagtgctgccgcacttcgggcagacattttggggcatgcccttcggctggcctatacattatccggtggcacgccggcgctgctggcactggcgggtctggacgcccgggatggagcactggaactgcggctgcatcgcggtgggggtgtttttgccggtgaaagcgtggtgcgcaggctggagcaactggcccagatcatgggcctgcgacctatgattacggaggggtaagcgactgggctgtctggtcagcctgtggtgatcagtttgatctgtttcccatccaccccaagacagatctccccatttttcagggcgagagcatcctgaccgaagacatcccgcctccatccggtcaaagcgggcacgtctggttccgcctcggtcgccagccggtccagatcctccgaggaagccagcagtttcggagcgacgttatgctgttcgcttttggccgccagcagcactttcagcaatgaaacgagagcgggagaagggcgcgccccactctcccggctgcgtggaatcgcgggaagatcagcgtcgggcaggcccctggcctcggcaatggccgccagcagggtggcgcctgaccggccttccgcaaagccgcgcccgactccacgggcctgcgccagagactctgcatcggcaggggaggtcgcggcgatttccagcaggctttcatccttgatcagacgctgccgtggaatgttcaggcgctgtgcctcaacctcacgccatgcacagatagcccgcagcaaccccagatagcgccggttattggtgcgggggcgcagcctttcccacatcgtgaccggatcggtgcgataggttgcgggatcgttcagcaccgccatttcctcggacacccaggccagacggccttctttttccagccggtcacggagggtctcatacacgccacgcagatgggtgacgtcggcggcggcatagtcgatctgggcctgagacaggggacggcgggaccagtcactgaaccggtgtgccttgtcgatatgtcctccggtcagggaggaaacgagcgtgtcatagccgacctgatcgccaaaccccgccaccatggcggcgacctgtgtgtcgaacatcggttgcgggatggagccgaagcgcagcaggaaaatttcaatatcctgccggcaggcatgaaacactttgatcaccgccggatcagccagcaattctcccaccggggcgaggtccagttccggtgccagcgtatcgatcacggcgacgcaatccgccccgccaagctgcacgacgcaaagttccggccagtatgtgcgttctcgcatgaactcggtatcaatggtgacgtatggctccctgcgcagcgtcgtgcataacgctgcgaggtcttcgctttttgtaatcaaggtggggctgggaaatctggagcgggactggcgggacatagggctgcttttatacccgtgtgtgcgggggcggaaggaccaatggcgtgattgatgagccggaatacgatggaactgagaggctggaaggcatgctgccatgttgagggtattcccggcggcccatgaggcggaagaccaggcgggacatattgcccctgactgtttggcgcaggctggctggattgatctgcataatccgacggaagaggaaatccgtctggtgtctcaggaaaccgggcagtctattccttcacgtcaggcgctggaggagattgaaaattccagccgtctgcgcctgcatgaggaaaccctgtatctcagcatgccgctggtcagccggtcgagtgaggaaccggtcataggaccgttgggtatggtggtgaaccgggagcgcctgatcacgatccggtttcaggaagcgcaggtttttgatcgactgcatgaagcgctcgcggccagacaggcgggcggcagttccggtttccgcttgatggtcgccctgatcgaggcgctggttgatcggctggccgatgtgctggaaatgacggcgaccgatattgatcgtgtctccggcacaattttcagggaaagccgtcagacgtcccgcaggccggcccgtgcggatcgtatgttgcaggcatctctgcgcaggatcggccagctgggcgacaggctgggcaagattcgcgacactttgcttggggtagggcggattgtgccctatgtgatcacgaacgcgcaggactggttgtcggacacgctcacggcacgtttggagtcgctgaaagccgatatcgcatctctgaacgactatgagaatcatctgaacatgaagctcaatttcctgctcgatgcgacactcgggtttattaatatcgagcagagcgggatcgtgaaggtgctgacgatcgtgtcggtcgctggtatcccgccagtgctgattgccggcatttatgggatgaatttcaagctgatgccggagctggactggcattacggctatccgatgagtctcgggctgatggtgctgagtatcctgctgacgatagcgtggttccggatacggggatggttctgaagcggtttttcgcggcattatgggctttgcctgatggcggccatcggctactcagtcgcgccccggctttttcggggattgcctgaaaagatgtgccgcttccgcctggccggcggaggtggacgccgcgaggattgacccgatgcacgcctatcgcagccatgattgtggcgccctgcgcgccgccgataccggaacggaagcccgtctgtccggctggattcacagcaagcgcgatcatggcggtctgctgttcattgatctgcgtgatcattacggcttgacgcagtgtgtgttcgcctccggcactgacatattcgcgacggttgaaaagttgcgccccgaaagcgtcatcaccgtgaccgggcaggttgttgcacgtgaaacagggacggtgaacccgaaactgccgaccggtgagatcgaactccgggtaactgcgctggatgttcagtcctcggccgaggtgctgcctctgcaggtggcgggcactgaatcctatcccgatgaattgcggctgaaataccgctatatcgacctgcggcgggagcgcgtgcatcggaacatgatgctgcgtgcccaggtcatcgccagcctgcgtcgccgtatgattgagcagggctttaccgaatttcagaccccgatcctgacggcatcctcccctgaaggtgcgcgcgactttctggtgccggcccgtctgcatccgggcaagttctacgcgttgccgcaggcgccgcaacaattcaagcagctggcgatggtagcgggctttgatcgctattttcagatcgccccctgtttccgtgatgaggccagccgcgctgaccgttcccccggtgaattctatcagctcgatttcgagatgagcttcgccacgcaggaagacgtgtttgctgcactggaaccggtgatggcgcaggtgttcgaggagttctccaacggtcgtgaggtgaccaagccgcctttcccgcgcattccctatgaaaccgcgatgctggaatacggctccgacaagccggacctgcgcaatccgctgcggatcaccgatgtgacggctcagttcgacggttccggtttcgggctgtttgccaagatcgcggcttcgggcgggatcgtccgtgctattccggcaccgggcgctgctggaaacccgcgcagcttcttcgacaagctgaatgattgggcgcgtgcggaaggggccggtggcctcggctacatcattttcgatgcggagggtccgaaaggccccattgcccgcaatctggagccggagcgtgcggaagccatccgtcaggcttgcggattgcaggcgggagatgcggtgttctttgcggcaggacaaaagctggaagcggccaaattcgcgggcgccgtccggacacggctgggtcaggagctgaacctgatcgctcagaacgagttccgcttctgctggatcatcgacttcccgatgtatgagttgaacgaggaaaccggccagatcgatttcagtcataacccgttcagcatgccgcagggtgggctggatgcgctcgacaatcaggatccgctgacgatcaaggcgtatcagtacgacatcgtgtgcaacgggattgagctttcatcgggggctattcgtaaccatcgtcccgatctgatgatccgtgcgtttgagatcgcgggctatccggccagcgaggtggaggcacggttcggcggcatgctgaatgcgtttcgctacggcgcacccccacacggtggtgccgcgccgggcattgaccgcatggtgatgttactggcggatgagccgaatatccgcgaggtgatcctgttcccgctcaatcagcaaggcgaggatctgatgatgggtgccccggccgaggtcgagcctgcccgtttgaaagaactgtccttacggatcgagaaaccgcctgtggttaaaaaggggtaatatcggccttcccctctgcctgagcagcattttccgctctggcgggggttggcgagcatggggggaggctcttatccttcccgcatggcacgtatccgcgattttcttgttccttctcgtatccatgtagatcaagggaccgggtctatccgggaagcgccctcaatcacgcgcttttctctggcgctggccgggttgatgctcggcggggtcagcagcgtctcactctccgtcctccctgccttggcagccggcggagagcatgcaacagaaaaacctgcttctcacgatatcgtgcaggtggcccagtccgcctcctccatgacgtcaacagcccgcccggatcaggcgcagattctcaagattgcctccgggatggcggcgcatcgcatccattacgatctgacgctggatggtacgccgaccggggatgtaattggcgctcgcggtggtatggattacgaggtcattgatgcctgtgacggctgggccacacggcagcgtctggagatgaccatttccaatcgggatggtcaggatatccagatggtttcggattacaccacctgggaatccaaagacggcacccgcatgcgctttcacatgcgacagacgactgataccgccgtgtcgcaggaaacggcgggtgaagcctctatggatggtttcggccacagcgggacgatccgttacgatctgccgcgtccgatgaccaagccgatccaggccggtacgttcttcccgatgatgcatacggcggcattgttggccgcagcggaggacgggatcaaattttcggccctgcccctgtttgatggaacatcggcggatggcgtgcaggatacatttgtcgtagcgctcgactggaaaaaatcggttccggtcaagattgacctgctgaaggacatgccgagcgccaaagtgctggtgtcgttcttcgacaccgacaaggcgaggatagagcctgcttatcaggccggtatgcgatactggctgaatggcgtggcggatgatctcaccatgaatttcggcgatttcaagctgaagggcggcatcgcatccttcaagtcactcccgcataaatgctgatttgtccatcgcttatggcggtggtgcggtagtgacgctcagcttctgcttgtgaaagaactgcatgatcccgaccggaatccagttccgcgtttgccccattacgtaatcgcctgctggcagatagccattatggacgatcatgccatccggctgttgatagaaagtcatcgcttcagcgtgggctgtgccggatgcccatgtcgctgctttcgccgcagtgacttgatcaatgagggcatgatcatgctggagcgctggcaggcgaacaggcagagcgagcagaagcgctaatgcgaatggcaatgctgacacggcccgtaaatatcgtgtgtcgatcaggggccagcgggctgacgcaaatccgagggccatgaccgccagcagaatatagctctcacggatcgtgccatgccgggcgcagcagacgtaatcaaattgataataggccgcaagaatggagatataagcggctgataaaagggcaagtgcaaaccctgtcagaagcccggctcgaatccgggttccatcgcggtgaatactgcgccagcaccagcgtgctcccagaaaaaacagcagatgaatccagccaagcggcatttggttctgtgttgaaaagccaagctcatccatcattacgcctgtagctgcctgtgcgctgggaagaacatggtgaatatagtgacctgtctggataggaagttcgggagtaccaacccttcccagcaatagtagaaagaggatcactcctgatcccagcagaggcagactccagcgaaaaaatgcgggcagcagcggttgctcggaaaaggcggatggaacgttcaggagggtgaagaggaagacgaaaaacgcgccggtttcactgctccatgcggcaatgatcaacagaacgatggatcgggtggaggtaacaggtgtgttgctggcgatctcccagaatagcaaggtgatggctgccagtgtcgtgacataagcaacggctgattgaggccagaaaaatacctcggtcggatcggtatcgagcagatagaaggcgggcagtgccagacacaaacaaagttggagcagctttttgttgctgcggtgtctcaggatggatagcccgctgatgatcagaaccgcccataagctgccgatgatcgcggtgatcagggggcgatgcaaagcagttgatgcaagataatacagccagagaatcgactcggagaccggcctgggactccagtggaaaaaacgatccagaataaacggcagacctgtatcccgattatgagcaaatgtaatgaattcatcagcctgccatcggctgagcgggatcaggcggacataaatggcaatggagacagtcaaaaaaagcgatatcaacgctgcaattgacaactccagaaaatctgtaagcgatttttggatgatacgtgccttcatcgttctattatacggtgaagttttttcttaattccagttcttcattcaagatcaaggaaaatatccttataaaatatcataatcttataaggatatccctgatattttatggagagaaaattttttattatctttctgaaacggtcaccgcttccagtccaaacccgatctgactgtcaaaaggccaggatttgcgttccgtgggcgagatcgggtgggcaatccggaaggtcaggcggcgcaggccggtgacgggtggcaactctgcctgataggttttgatctgcatatcggtcagatcccattccgcgacagacgcaccgttttgtaaaacggtgacatgctggctgcctccactgacgggggcaaagccctgagcctgaacaaccagatgcagggcgccatcaccgatggcgggaagaaggagatcggcttgcgggccgacgctccatgttccccatccggccggttcaagccagccctggaccagcagagtggatagcatatgcccggcgctggcaggcaggcgctctccactggtggcatgaggcaactcgatggcaggcagcccctctatccttgctgtatcggcagtgcagaccccgagtgtacccagggccctgcattgctccgccgcgtgatcgaccagaaacgcagccgcctgatgatggggcaggaacagcttgacctcaccccgtgccagcgtgcttcccccggcagcgtccagtgaacatccggcggcagtgttggtgcgggccgtatacatcgtgttcacggcaatgggggtttgggcggcaacccacagaacctgcatcagatcactgatgtcgttgttccagcaacgggcaggcatatagatattgagcctgctctgcccggccagaatggtgcgcagtttcgtactgtcaaacggtgaggccacttgctggtgcgattcggcacgcacacctgctcgcaactgggtggtatccagaaactgaagtccggccgccagtacgatcagagccatgccgaacataggccgacaggtgcctttccatgctgcaatggctgcgatgctgaccggcagcaaggtgtagctcaccggccagaacaggcgtccgctggccctgatctgttgaaggactgcgggcggatggggcagcaatatggcgatccgatggtgcccaacataccattcatgggatagggcgaggatcgtcagggcaaggcaggcagcgatcaggccaccatgccggcgccacccaccccgtacaaggcgccgcaggcaggatggagcgagccgtggaaggattgtgaaaaacagcagcagcaacagacctgcgcccagatactgaaagccttcatattgaccacctgttccatcaatggtggccatctcatggttgggaaaaagggcggagcctgtggggtagaaaggtgccagccagttcatggagtataacccgtatcccccgtctgacttggctccccacagactggccccatatccggtcaaaacaacaagtccacctgtcagcgcgacggcagcggcgcattggcgccagcctttgtctccacgcagcttgagtgtgacgggaaccgccagaaacaggcttgccaccatgaccatcagataaggatggatcagcaggctcagcacggtcagcacacagcctgcgaccaggagcgacaggcgcggtccggtacagagtctgaaatacagtccgaccatcagcaggatcagaaaatgcccgcacagggcggcatgtccgatgcggaagatgaaggtcggcatggaaaccgccatcaccgcgatggcaagcgcaggcagcagccgcttttcccccagaccgcgcagggcatatatggcggcaaccggttgcaggatccagcacagcgtcagccagattgtgacggtctcaaatcctttcggcagccatggttgaaacagtttggccagtaaaatggtcagaggaatactgtcggtcaggctgacagccgtatcggccattctgtgagagaccagaggaggccagttccagggctcagccagaaaataccactggccgacaatatgctgggctacatcggccgatgtcggtgcgggcgactgatagtgtcccagaaaagcggagagcgggaacagggtgctggtcagcaggatgccgatcagaagtccccatagataactgaggcggtttctggcagccgtctcggatgaaaaaggtatcaggatcgtctccctggaactggcgggggtaatatcattccacgtccgtgctgaataacacggtctccgaatttatcacgcagctgatccagcgctttccgggcggcggcgcgtctggtgctggtctggtccattaaatcaccgggatcggccaatgcagcactgaccagcggtgcagcccccagcccgatcaggcgaaaacaggtgccgtcggtttctttttccaacaggttgcgtgcggattcgaacaaagtttccggcaggccggtcggcctgtgcagccgacgactgcgggtgcgctgggtgaaaccggcggttttcagcttcagcacgatcccggatgcagccagatcctgctcccgcaggcggcgtgccagtttttcagccatgcgccagagatgccgttccaatgtctcccggtcgctgatatcggcttcaaaggtggtttcggcactgatggatttcgtgtcgtgctcaggggagatgcgacgggaatcttctccgcgtgcccttcgtaccaaggctggcccgtcatcgccgaggcgtcgtcgtgcttcccggtcatccagtgcctgcaactgccccagcagcacgatgccctgagcagccagacgactggcctgtgcggccccgatcccgggcagcaggcggacgggttccgatgccagaatctgcgcggcgtctgccccaatgacgctgaagccgcgtggcttgtcccgaccggcagcgatcttggccatcaaccggttggcggccagtccgatggagactgttacgcccaaagccgcttccacctgttgagcgaaccgtgcgagcacacgggccggagacatgccgtgaagcgcctctgtgcctgacaggtcgagggcggcttcatcaatggataaaggctgcaccagcggtgtcagggccagcatcatctcccggatacgatgcgcggcggcacgatatttcggaaaatcaggtggcagaacaaccgcgtccgggcaggctttcagggcctgaaacatcggcatggcgctgcgcaccccctgcatccgggcgatatagcaggcggctgcaacgacgcctcgtttgcctccgccgaccagaacgggcttcgctgccagttccgggcggtcatgtttctcgacactggcataaaaagcatcgcaatcgacatgggctacggtcagttgatgaagttgcggatgacggacgatcctgcgggagccacaggcgcagcgcgacccttccggcgcagccagacagtcccggcacaacgaggtctctgctgccgtcatcccggcagaggttctggcgcaggccataaccatgccgcaccgcgcacgccggagctgtcgccgtggcgatttttcagcacgggcgtatcgcaaccgtcattgaacacatggcgggccatcaggccgggcagagcgctatagaggtggtccatggccgataatcccccgcccagcacgatggcatccgggtccagcacattgacgatcgccgccagcccgcgggccagccgatcggcatgtttatccagtgcctgttgcgcagcgaaatcgcccgtctgcgcacgctcgggcagggcatgagcatcatgggagccgggaccatcgcaggaggcggccagagccggtccgctgagataggtttccaggcaaccatgttgcccgcaccagcaggcaggcatgggcaaatcctctgcatcgggccatggcagcggattatgcccccattctccggcaatacggtggcgtccggtcagggcgtggccattgaccacaattccgccaccacaacccgtgcccagaatcacgccgaacacgacgctcattccggcagccgccccatctgaggcctcgctgagtgcaaagcagttggcatcattttccaccctgatcgggcgatggagaagctctgccagatcacgatccagagcatgaccgatcagataggtagagttggcgttcttcaccagtccggtccgggcgtcgatcgtgccgggaatgcccatgccgacactgccatgcccgcccaacgcctgttctgccgcctcgaccatggaggcaatctgttgcagtgaagagccataaaatgatggggttgtggcgcgaagacggtacaggatatcgccatcccgtcccagagcgacgatctccgtcttggtgccgccgagatcaatgccgatgcggaaatcaggaatgccatgcgccatgatcacgtgatgccgcagctatcggccatgctcaagcgccaatcctgtttgcgggcttgtcctgttggacagaagagcggagaattgggtcatggccgaaactgttctggatgtcaggggcctcagttgcccgctgcccgtgctccgtgccaaccgtgccctacgcggcatggcggcgggggaacgtctgcgcgtgcaggcgaccgatcgtgcctctgtggcggatttccatgctttctgtcgagagaccggccatgctctggtagcctggagcgaggaaggcggcgtgttcagttttgtgatcagacgccgcggcgatccttctcctcccggatcatccacggatcgggccgaggggcaggacatcgtttccggctgatcagagacgcatgcggcgggggctgaaggctctatccaaaacgccgtacagccgctacgagactggcccttcaatgcccgcggcaggatagaggcaggaattggcatgagcgacgcgaaaagcggaccgtcatctgtgtcttccgctcccatcgagtccttgtctttcgaggatgcgctggccgagctggagcagattgtgcgtgcccttgaaggcggccagcagaaactggaacacgctattgccgcgtatgagcggggcaatgcactacgtcgccactgcgagacgaagcttgcagatgtcgaggcgcgggtggcggcgattgtggaatcagcggatggcgtcaccggtacccgtcctctgagcgattgagagttcgaccggaaacagccggaaacggattgtgatgaccattatccatatgggaatgaagcggatatgattgtggcgacgcctgagcttgcccatacgctgccggcctcagccttaaaggaggccctgacccgtcgcgcccatgaggtcgaagcggcgctggatcgcctgctgcctgttccccccggtccggagtcgcgggtggtggaggcgatgcgctacgcggttctgaatggcggcaagcgtctgcgcgcgtttctggtgctggaaagtgcggccctgttcgatggcgcagccgctgaatccggtgtgcgtgccgcggcctcggtcgaaatgttgcatgcgtattctctggtgcatgacgatcttccggcgatggatgatgacgatctgcgtcggggtaaaccctctgcccatcgtgcctttgatgaggcaaccgcgattctggccggtgatgcccttcagaccagcgcgttcgaattgctggcggatgcggccacgcatcccgatcctgccgcacgctgtgcgctggtgctggctctggcccgggctgtgggcgcagatggcatggtcggtggccagatgatcgatatggcatcggaagggcgggcactgacggcggagcaggtggggcgtctgcacgccctgaaaaccggacggctgattcagtacagtgccgaggccgggggtattctcggcgcggctacgccggcccagcaggaagctttggcctcttacgggcgtgatcttggggctgctttccagattgtcgacgatattctggataccgaaggtacggcggaagagctcggtaagaccgccggtaaggatgcagccgcgggcaaggcgacgttcgttgccgtgcttggcatcgagggtgcaaagcgcgaggcgcaggctctggccgaccgtgcgaaggcggctttgtccgtgttcgggggccgggcggcgattctgaccgctctggtcgattatgttctggcgcgccgtagctgaagcgctttttgatgaggcgccgttccggcctgccggaatagacgcgtcggtgtgagtgagactgactttatgactgaaacaacccctgtccgttgccatgagactccgacactggaccgagtacgttacccgtctgacttacggaacatgtcatcggagcaactgcgcgcggttgcggatgagcttcgagcggagacggtggacgctgtttcggtaacgggcgggcatcttggcgcggcgcttggggtgatcgagctgacggttgcgatccatgcggtgttcgacacgccgtccgaccgtctgatctgggatgtcggtcatcaggcttatcctcacaagatcctgacgggccgtcgtgatcgtatccggaccttgcggatgggaggcggtctgtccggcttcacgaagcgttcggagagtgaatacgacccgttcggcgcgggccatagctcgacctcgatctcggctggtctcgggatggcggtggcgcgcgatctgcgtcgtgcggcgggcgaggtcggtgcgggaccggagcatgtgatcgcggtgatcggcgacggtgcgatgagcgccgggatggtgtatgaggcgatgaacaatgccggcagcctgaagtcgcgcctggtggtgatcctgaacgacaatgacatgtcaatcgcgcctcctgttggggcgatgtcggcgtatctgtctcgtctgctgtcctcgcggagcttcctgaacctgcgggatctggcggggaagatggcgcgccatttcccgcgcgggatcgagcggacggcccgtcgagcggaggaatatgcccgcggcatcctgacgggcgggacgctgtttgaggagcttggcttctattacgtgggtccgattgacggtcataatctggatcatcttctgccggttctgcgcaatgtgcgggatgcggaggagacgggtccgattctggtgcatgcgatcacgcggaagggtcatggctatgcgccggcggaggcatctgcggacaaatatcacgcggtgagccgtttcaacgtggtgacgggcgagcagatcaagcctgcgcctgttccgggggcgaagcccgccccgccgacctacacgaaagtgtttgcggaggcgctgattgccgcggcggaggagaatcctcgtgttgtggcgatcaatgcggcgatgccgtccggcacgggtctggacgcgttcgagaagcgcttcccggatcgttgctttgatgtagggatcgcggagcagcatgcggtgacgtttgcggctggtctggcggtggagggaatggttccgttctgcgcgctgtattcgaccttcctgcagcgcggttatgaccagctggtgcatgacgttgcgatccagcaccttccggtgcgctttgcgattgaccgtgcggggctggtgggggccgatggcgcaacgcatgccggcagcttcgacatggcgtatctgggctgtctgcccgggatgatgatcatgtctccgtccgatgaggcggagcttgtgcatgctgtggcgacggttgcggcctatgattctgggccgagtgcggtgcgctatccgcgtggtgaaggcgtaggcgttgcgctgccgcgtgatgagaaaggccgtctgcgcggggatgttctgccgatcggccggggccgcatcgtgcgggagggccggagcgggatcgcgatcctgagcattggaacccggttgcaggatgctctgctggctgcggatgatcttgccgcgcatgggctgacggtgacggttgcggatggccgcttcgtgaagccgctggacacggcgctggtggagcgtctggcgcgggagaacgacgttcttgtggttgttgaggaaggctcgatcggcggctatgccagccacgtgatgcagcatctggcgcaagccggcctgctggatgcgcgcgatggccatgcgctgaaactccgttccatgatcctgcctgatcgctatatcgaccatgatacccagccaaaccagatcagacaggccggacttgaccaccaggccattcgagataccgtcctgaaactggttgatgtcggtgtcacggcggcgcagcccgcctgatggcgaagaagcgtgccgaccagcttctggtagagcgcggtctgacggaaagccggtccagggcgcaggccgtgatcatggccgggctggttttctctcaggagcgtcggatcgccaaggctggcgatatgctgccggaagaggcgccgctggaactgcgtgggcaggatcatccctgggtctcacgcggggggctgaaactggcccatggtcttgagcatttcggcctgtcaccgcagggacgtatttgtcttgatgtcggggcttctacaggtggttttaccgatgtgttgctgacccatggcgcgctcaaagtccatgctgtggatgtgggccatggtcagttggcctggaaattgcggtctgatgaccgtgttgtcgtgctcgaaaaaaccaacgcccgtcatctgacaccggatagtctcggcagcgaccggattgaagtggttgtgtgcgatgccagcttcatcggcctgcggacggttctgcccgcctcgctggagatggttgctcccggtggatgggctgttgctctgatcaagcctcagtttgaagccggcagagaggcgatcggtgccaagggagtggtgcgcgatcctgccgtgcatgaggccgtctgcggcatgatccaggattggtggcaggctttgcccgactggcgcgtgctcgggatcgagccaagcccgatcaccggcccggaaggcaatcgtgaatttctgattgcggccgtcaaggaataaaaaaagccgggatgctgctgcaccccggctttttttggtgatccagcccggatgtcagctttgccgccgtgctggagaaccggaccagactgtgccggccgggatggattctcccttcatgaccagcgaaagcggcccgatccgggcatcctcattcaccgtgctgccatacagcgcgatggacatggtaccgagcgaggtgcgcgcacccagccggaccagaccgattttcatgacccggtcctcgaacagatgggtctgcgggccgcaattcgtatccagtgcggcatcgtcaccgatttccaccatatcgaattcggtcaggtcggtggtgtcggcgcagatacggcgtccgaccttcgcgcccagtagtttccatgaccatggcaggaaaggcgtgccgcggaatggatcaagcaggaacggtaccgccagcccttcataggtggcggtaatcgcctcgctgagccacacgaacggcgtccacatcggcacttccgccgattgatagcgcccgatcagcacccatttcatcagcgcaacactcagcagggatgggatacccatcaccgcgaagtagataaacggcaccgctgcgtaggaagccagcaatccgtaatggtcataggtccagtcgaaacaggtcatcgcatgacccagcatggcgatgaacagtgcaggcggcagcagcacccgaataccttcgattaacaggcgcatgccgatgcggatcgggccgggacggaaggtcagggtctcggcatggcaggtgaagctctgccgtgtaggaagaataaaggaggggctgccgaggcaggtctgaccgtccttgaggggtgccttgtcggttgcgggaggcacggacagacacccgaccagacattcatcggggatggaggtgccatccggcaacagagccgagttaccgacaaagctgcgacggccgatgacggtcttgcgcaggtatagcctgccatggcggatatccgcgtcccccagcatcacgccatcggcgatgaaagcttccggcccgatatccagcaaatcatgcgtgacagaggtcgctgtagaaatctcggtatattcgccgattttggcgcccagtgcccgcatccagggtacaacatacagtgttgcgtaaatggcatggacggcccccagcgccaactccatcaaatgatcgacgaaccatttgcgcaggaagaaagccgagcgcacatcatacacgccttccttgacccgcccgagcagcagccagcggaggatcacgatctcggccagcatgaagctgatatacatgaccgacagcagcgggatcagggcatagagcggcaccgtgccaatgctccagcgaccatcatggagctgatcatagatcaccatgccgggcagcaatggcacgaaggcgataaccgggaatacggccatcaccagtgacagcgcggtatcgaataccacgcgacgcagtggggtgatgtgttccggctgtgtttccggtgcggctttcgcagtgaagctggcgggggagccgttccatatctcgccggccgggatcgtatggtctgcggacagggcagacagattgcccaattcggcccggtcttccatcactgcatcgcgttcgaccacagcgcgggagccgacatagcaatccgtgccgatccggatgtggccgatatgaagcataccgccttcgatcgacacattgttgaggaacacctcgttgccgatgctggtatcggcgccgatttcgatcagatcggcggccccgaatccgactgagccgagatgggcatccttgccgactttcatcccgagcagacggcaataaatactgtaggcaggtgtatcggccatgaaagctgccggcacgacctgaagcatccgcgatacgaaccaccagcggaaataataacttccccatagcggatagctgccgggcttatagcgcccgatcaccagccatttcgcggcaatggcgatggcggtaatgaccagcggagtcagcacgaaggtcaataatgtgcctagaatcgcctgacggagagtccagtcgaattccatcagggcggagaagaccaggtacggcacgatgtcccgaatggcctgaagtccgaaaatcgggatcagggcgacggactgggctgccccgcacaggcgatgacgccatggcggtacggtctggaaaggaggcagtacggcttctgtatccccggttgccgtgtcggcaaatttggctgccagccggtccagtgtgcggcactcgtacagatcctgaatggagacagagcggaatcgctcatcctgtcgcagccgcgagaccagcccggctgccgagagtgaatggccaccgagatcctgaaagaaatcgtcgatggtgctgacctgaatatgtggaaacacggcttgcgccgcctccaccaatgctgcctcagccgggttgcgcggtgctacgatatcgcgtttttccggtgcaatggtctcgatgacggcggggagtgccttgcggttgatcttgccgctgggcaggcggggaatttcatccagtgccagaaacacggtcggcagcatgtaggcgggcaatctggccgcgagtgcggtgcggatcgtcccggcatcgggtgtcgcgccctcggcataggaaatgaaggccaccagatgctgtgtgccggcgctgtcctcacgcagcacgaccgctgccgcccgcaccgcgtccagcttgccgagttcggcctctatttccccggtttcgatgcggtagccacggaatttgatctgatcgtcaatacggccatgaaaaacgatgcggccttcggtatcaaagcttgccttgtcgccggtgcgatacaggacggggtcgggaatatcggatgcatccgcagccaccagaggattgcggatgaatttttcagcggtcagctcagggcggccgatatagccgagggacacaccggggccaccgatcagtaactccccgccctcaccggcaggaacaggagccagcgtcgtttcgtccagaatataagcggtatagccgggcagcggatagccgatggtgatcggatcgcccggctccagctctgccgcggtagcggtgacagtggtttcagtcgggccataggtgttgagcagacgacgccccggcttccaccagcgatccaccagtgcggccggacaggcctcaccccccatattgatcagacgcagggagggaacatcgcggtccagcatggccagcagggtcggcacacagtgcaggaccgtcacgttctcctcggtcagcacatccggcagtgcgtcggaggcgcggaccagctccggcggtgcgacgatcagtgtcgcgccggcgagataggagatgaacacttcctccagcgacatgtcgaaagcaggggagaaaccctgatagacgatatcatcctcgcggatgcccagaacggcgttttcggagtgcaggagatggcggatattgctctggcagacggcaatgcctttcggcttgccggtcgaaccggatgtgtagatggcgtaagccggatcgtttgaagcaggcggttgaaatgcatcggcaccgggcgcgatggcgggtgcggtttcatccagcgtatcggtcgttattgcgggaacgctcagcccatcggccagtgtcagatgggcggcatcgaccagcacggcggcggcctggcagtcctcgacgctgatatccacgcgttcacgcggcgcttcgggatcaaaaggcagataggccgcaccggttttcagaaccgcgagaatggcggcatgcagggcaatggagcgtgtgatccagatgccgacaaaacgacccggcccgatgccgcgtgctgccagaacggctgcccagcggctgctgagtgcgtcaagctctgcatagctgatggcttgcccgcgaaagcggatggcgattttttcaggcaaacgagcggcggtaacacggaaaacatctgccagagagccatggtccggtgtgaccggagcaaggatatcacgcatgtcgttcaaaccgactctccattacacggggacaggcggtggactttgtcattccgccgcgcaggctccgggtgcttaataatgtacctgccgggcatcatgaccggtgcgggctgggtatgatgaaatggcaagcgataacctgtcgcagaaagctgagatcatttcacggtatctgatgacaggaagcaatgttgttttgaagcaataatattaaatctgaatcaagagtgcaggtgcttatcgggatatggcttgcccgtgtcgtgcccggtcaaggtgatttcagttcatcgcggaccgttctgtgcccgatcacgcagcagatgatcagccagcacacaggcgaccatggcttcaccaaccggcactgcgcggatgccgacgcagggatcgtggcggcccttggtgatgacctcgaccggctgtccatccctcccgaccgaacggcgggggatcaggatggagctggtcggtttaaccgcgaaccgcgcgacgaccggctgtccgctggaaatgccacccagaatgccgcctgcatggttggagccgaaaatatggggtcctccggcttcattgggggcggcgaggatttcatcggcattgtcttcacccgtcagggtggcggcgtcgaatccatccccgatttccacgcctttgacggcattgatgctcatcagggctgcggccagatcgctgtccagcttcccgtaaagcggcgcgccgagaccggccggcaccccttcggcaatgacttccactaccgctccgaccgaggagccgcgtttgcggatctcatccagatagaccgcccattgctcagcggcgaccggatcgggacaaaaaaacggattggcctcaatctgggaccagtcccagcgtgagcggtcgatcccgtggggccctatcctgaccagagccgcccgaatagtgattcctgcaccaaggattttacgagcgacttcgccggcggcgacccggcaggcggtttcacgggccgaactgcgaccaccaccgcgatagtcccggatgccgtatttcagatcataggtcaggtcggcatggccggggcggtatcgctgcgcgatgtctccgtaatccttcgatcgttgatcagtgttctggatttccagtgcgatcggggtgccggttgtaacgccctcgaacgtaccggaaagaatgcgtacctgatcggcttcccggcgctgggtcgtgaagcgtgactggccgggccggcggcggtccagcgcgggctggatatcggcttcagtcagtggaatgcctggggggcagccatctacgacacagccaatggcggggccgtggctttccccccaggtggtgacgcggaacagatggccgaaactgttatgggacatgaggctgaccgtgaggctttcagtctgaaaccaccgcaatgtcgggggcgagaggatttttcatgccgacaatgtgataaccgcaatcgacatggtggttttcccctgtcacgccgctgctgagatcagataccagatacagaccggcactgccgacttcggccagagtaacattgcgggccatcggcgcgttcagttcgttccagcgcaggatatagcggaaatcgccgattccactggcggccagtgttttgatcggcccggcagacaggctgttcacccggatgccattcccgcccagatcggcggccatgtaacgcacgctggcttccagtgctgccttggccacgcccatgacgttataatgcggcatccagcgctccgcccccagatagctcagcgtcagcatggagccaccatcgcccatcagctctgccgcacggcgacagacagcggtgaagctgtagcatgagatgtccagcgcctgcagaaatgcatcgcgcggaatatccaggtaccggccgcgcagaaaattcttgtccgcccagccaatagcatggaccaggaaatccagtttgccgccgaaatgatcggaaacctggtcaaacgcctgatccatcgaggcatcatcaccaacatcacatggaacgatcagagagctgccaacactttccgcaagcggaatgacccgcttggccaaagcatccccctgataggtgaaggcgagttgcgccccctgtgcggcacaggcttgcgcgatggcccaggcaatggagcggtcattggcgacacccatgataagaccgcgtttcccctgcatcaaagttccagtccggggtccgctctgtgtcatggtgtcaggttcctcatcatgggacggtcaattctggcaaaagaagccatggttagtaaaaacaggcggatcttgataccgtctggcataggggcagggcggttggacttgacgaaactgcagggcaaggcggaaggacagtgtggtacgatcctgcgccgtatggtggtggcacagggccgctgctttcggcaagggcatgggcggggaggaaagatctcatgagcatggatagtgacgcaaaatccccatttcagacagctgagttggcttttgacgatccttttgctgctttttcccaatggatggaggacgccagaggggccgagccgaatgatcccaatgccatgaccctggcgacggcgtcgccatctggtgttccttccgcccgtatcgtacttctgcggagtgttgatgcggcggagcatccagagcgcggcttcgtgttttttaccaatacggaaagccggaaaggagtggagattgccgccaatccgcaggtcgccctgctgtttcactggaaatctctggggcggcagatccgtatcgagggcaaggccatcccggttgcagtggaggaagcagagtcctatttccatacgcgccctcgcatctcacgtctgggtgcacgtgcatcggatcagtcacgtccccttcctgatcgcaagacattgcagaagcgtgtggaggaggaagaggcgcgctatccgggagacgatattccccgtccggcctattggtctggctatcgggtcactcctacagtgatagagttctggcagcagatgccgttccggctgcatgaccggctggtgttcaggcgtcaggggaaaaactgggggcaggagaagctgtatccctaatcgttctttaatcctcagagttaatataaatgctttaatgatactcttgagcatgatagtccggagatattcacgcatttttttaaagaatgtgtttttaatacaagtaatattaataaaatttacacttgaagggattttttgatgatcactggcagtttatatgatggagaaggtatccggcttgaaggggatggtccggatctgtcacccgcttgggttgatgatatgccgttcaagatactgctgcagaattctgatgagcagaacccggaaatgcttaaggaagaccgttactggtatttggcaaaagagggggatgcccctgtcgtggttcccaaacactatgtggaaatgttggccggtcatctgaaatcaggaaaaaagcttgccgtaatctctgacgatccagaatcagcgtccggtatctgcaatatgattctgctgatttgtcgcagcccggggggcactgcctgagtctgggtcaggtgggaaggatagcaagatgatcggccatgtcgactcagtgacccgaaggaaggtcaagggctgggcctttaatccggatgatccccatgtgccgccaaaattacggtgtctctgcaatggagagttcatttccattattgttgccaacagttatcgccctgatcttgagcaggccggtatcgggactggctatcatgggtttgagctggaatgggacatcgcccttgatccggtcaaaagacatgtcatcagcctgattgatgaagccagcgggcaggagcttaaaaactcgccccatatgctggaggctgaaaactgtttcgacgaggaattcaaaaacggcctgtccggtcttctccgcagtattgaaagcagggagggacaggaacaggccgccggttttctgctggatcaggcagagcagcttgcccagcgtatggttgaaacggattctctttgccgggaagatgattttctggatcgcttacctgtggagaaaattcatcctttcaccggatgccgggtgcttgttttggatgaagtggttccagcaaaaaatcgtgatgccggctccaacgcgatcgtatcgcatattgaatctctccagcgtctggggatggaagtcagttttgcagctgtacaatacgaggctgcgcctgatctcctgacgggtataggggttcacttctatgcaccgccactttttcgcagtattgaggatgtattgcgtagaaatgttggccagttcgatgcggtttacatccatcgcacttcaatggcgatacgatatattccgttgatacggtactggaatccgcatgccgtcattgtttatctggtcgctgatcttcacgctgtacgcatgatgcggcaggctgagatgacacaggatgaaccgttatggcaggatgcttttcgtacgcagaaagctgaattggcagcagcctggcaggttgacaccgttatcacgcattcttcttacgaacgcgatcttcttcgcactcatatgccagccgccaatgttcatgttattccgtgggcggttgatgtagacccggtatccgctaccttttaccagcgccagggcattgctttcattggcaactacaagcatgcgcccaatcgtgatgccgcagagtatcttatcaatgaggtgatgccacagatatgggcgatcgatccgactattgattgtcggatatatggtacgggccttcccaaacatctggttggtgtacgccatggccgggttcattttatcggacctgtccctgatcttcgggatgtttttatgactgcgcggctgacagtcgcacccttacgctatggggctggcctgaaaggaaaggttctcgatagttttgccgctggcattccctgcgtctgcactccgattgctgcggaagggatggacctgccattatccatgaatgccctgttggcaggggatacgcaaagcctcgtcaaggtgatactcgatctgcacaatgatcccgaactttacactaaaatttcagagcgctgtctttcttacattcagaaaaactgctcgcgtgatcgaatcgatgctttaataaaagcggcttttgtgtctgccggtttgcaagagaatgatctgtaaatagattgctggtagaataaaaattctgttcatttatatcaatccgcccgaccttatggccgggcggattttattgttcagtgtgtatttgctgaaggcatataaggcgccgtcaggttttcaaatttttctggatttgcttccaccggaatgccgccaatatccttgggatgacgcagcccgtcatattggaaaacatcgaaggactggagctggtctttaggcggaatctggctcgtgctccagccaccgccgacagatctgatcagttccaccactgatttttcatacttcacatgcacctgcactttggacatcagcgcatcaagctttgcttcctgggcgatgatcgcatccagataattggatagaccacccgtatacagtgtcatggtgatcgcctgcatctgtgaagctgtcttgacagcttcttccagtttgacgacttcctgtttgtagagggtggttttggaaagaccgtcttccacttccttgaacgcagacagcaccttggaacgataatcatcccgtgtttcgcgatagacggaccatgagttttgcagctcggcccgccgcaggccaccttcgaaaatcgggatgttcacggctgcaccataggaccacaggctgttttgcagcgtcccaagattgaaaccgctggcatcaaagccaccattggccgccagggatacatccgggtagaaggcagccctcgccacaccgatcatgcgattggcttcagccattttgcgttccgaggaagcaatatccgggcgacgctgtaacagcacagacggtacgctgaccggcacattcacattcggaaagtcaaaatgatctttggcaggaatgtggaacgtgctgggtgaggcattggtcagaattgcgatcgcatgttccaccacttgccgctctgcacgaatatcaagttcctgagcctgcgtgacatagagacgatttttggcacggatcagatccagcggtggcgctgcctgattgctgacctgggcacctgtaacttcaatcgctttattataataggcgattgcctgattcagaatttcttcctgcgcgtccagtccgcgcagcataatgtattctgacgccagttcggcttccatgctcagtcttgccccggcatagtccgcggcacgctgctgcacgaagtcttctgtggcacgaatacggttgcggattctggaccagaagtcaggttcccatgatgccaccgctccatagaacgtgtcgctctggttgagtgcgctgcctggtgcatagaacaggctgtcagccgattgtctgttattagaggcaccggcctgaatcccgacatgcggcagaagctctgaccgcactttcatgatcatcgagcgcgcctgcaggaatcgttcggctgccgcctgaagatcggcattgttgacgacggcgcgctcctccagatcattcaaggttggatcctggaacagaacccaccatttctgtggaatttgcgtatcggctggtgtggcttccctgaacggcccttgaccgtgccaggaagccggaacgatgaaattcggcactttataatccggtgcgagattacagcccgcgacgatcccggaacaaataaaggcgctacttgccttcagaagggaccgaagtcccttctgcaatgtctggagagagggcatcattcttcggaaacctcttcatccgccggggagttattgccctcatatccgttcataggcttggtaatccgaactgtctgtccttccagcagatcggagggaggatttttgaccagcacatcgtcttctttcacgccttcggtcacggttgtcgatgtatccgccatcgtgccgactttgatgtctttgaaatgaacatgattgttcttgtcgatcaccgcaatttgtagccctggctcctggaagaccagggttgccgtaggaatctcgaagcttttgtaaggcacgggagctgtaaaattcacagaggcgaaagtacccggccatagcgcatgatcaggattatccagtacgaattccgtaatcgccgttctggtgtcggaattgaagctgcgggcgattgtcaggaagtcagccttatataccttgcccggatcctgaggcagggtgatgttcgctgtcatgccaggttgaagaatggcggcgaagttctgtggcacggacacgaacagacgcatcttgtgcatgtctgagacagtgaacatctgtgtcgcttcgtcttcttcaccatgttcaccggtgccggagcggacgtagtcgccgacattgatgttacgggaggtcacaatgccatcaaacggtgccacgatggtcttgaaccgttccagtgcttcatacttggcaacagtatgtgcggatgcctgcatttccgcgtaaccggattgcagattggcatcagcaaccgagacggactggccggagacggcattggccttcttcatattgtgccagcgctctgcgctgatcttggccagattgtatttggccaccttggcttcgtaatcagcctttgcctgattatattcggcatccagcatgggggtattgatctcggccagcacatcgcccgctttgacgacggcgccataatccttgtaccacattttcacatagccggtggcctgcggatagatcttggcctgataccatgcgtccagagtgccgggcagcgtcagttttttctggtttgatgccagtttcggcttgaccactgtgacatcgggaactgcgttataatcggtctcatccttcagggatgagaccttggtcagttgttccttgaacagggtgaacgcatagacaccaagcgcacagccgccaagcaggacaatgacgtagggaagtctgattttcattatgccgctcctttggaagcagaacgccggctataaacaatcgcgtaaatgcaggggacaaacacaagggtggagatcgtggccatgatcaggccgccaatcacggctttacccaacggagcattttcggagttgctggttgccattgggatcatacccacgatcatggcgctggctgtcatgatcaccggacgaatacgcccgtaacctgcttccagcgctgccgtcagggccttgccgtgtatttccatgcgttcgcgggcataggacactaccagaatagagttggcggtggctgtgcccatgcacatgatcgctcctgtcagggcaggcaccgagatattggttttagtcaggaacaggctccatgcaatcccggccagtgcacccggcaaagctgtgatgatgatgaacgggtccatccaggactggaaattgaccacgatcagcagatagatcacggcaaccgagacgaacaggccaccgatcagctgagcataggcttcccgcattgtgggggcctgaccctgtatctgcacaatggccccacggggcagtgtgctggcattttcctgaacgattttgtcaacatttttcagaaccgtgcccagatcgatcccttctgtagaaacatagatgtcgaagctgggcatcgagttgtagcgggtcacttctccgggcgtgccgattggctcgacatggctgacgccacccagcagctggatctgggaatgcgggtcttttgccgatccgccaactggaacagtcagcagattgttgaagtgagtcagctgcggctgtggaacataggtgttgagggtgaaggtgacaccccaatgtggatcgaaccagtattgaggatcgaccgtcgagctgccggacagtgtcatcagttcactgtcggcaagatcgccagcggtaatatcggtctcgctaccgaaggttcggtcattccgaacgaagagcgtaggattccgcatggtctgctgcaaaaccacatctgatgcgcctggaatgcgacggagtttgttcacgagcattcgggcgtactcatagctctttgccagttccggtccctgcactttcaggtcgatcggagaaggagaaccaaagttcaggatttttgctgtcagttcggcaggttggaaggtaaagaccgtgccggggaaactggcggacagttccttgcgcaggagtctgcgataatcccagaccggagattcaggattgttcagcatgactgtgaagtcacaatcctgagtgccgatggtgggggtcggaataaaggcctggttatgcggtgcttcagccataccacagttggcgacggcatctgcaacctggccgggcagcagttcatgcatccggtcgatgaccagtgcggcgatgcgtccggcgacctcgatacgtgtgccaagcggtgcacgcatatgcatctgcaactgaccggcttttacttccggaaagaagtctcggcccataattccgaacagcccgagcgaggcgacagaaaacgccagcatagagagaacgactgttccccgccgccggatagcgacttccagaaatcgtccatatccttcccggaaagagctgaaccctttctcgaagcctttctggaagcgggtaaagaaacccggtggtttgggcggatgggcatgaccatggccttcttcatggccatgacttccctgatgtccatgcccggccagcagatactttgccatggttggcaccagtgttcgggacaggatgaacgaggccgccatagccagaatgatggcttcagccatcggcatgaacagccagcctgccacgccgctgagggcaaacaggggtagccagacgatgcagatacaggttgtagagacgaaggtagggattacgatctggttggcagcatcgacaatagctgtttccagatctttccccatttcaagatgggtatcgatattttcgatcatcacggtggcgtcgtccaccaggatgccgaccgccagcgccaaaccaccaagcgtcatcacgttgatggtttgaccgagccagccaagtccgatcagggagcagagaatggctagcggaatagaggtcgcgatgatgaccgtaggacgccatgagccaaggaacatgatgaccacgaaaccggtcagtgccgctgcggtagtcatttcccgcaacacgtccgtgatggcgcctttcacgaaaccggcggcatcactgaacacgctgatatggctgctggcggggatgactttttccagacgcggtagaagaccacggacaccgttgatcacgtccagggttgaggcttcaccgcttttcatgacgaccagcagaacggcttgtcttccatgcaccaggacgagattggtctgtggatggccgccacgataaacttcgccgagatcgtgaatataaacgaccgcgttgccgacacgtttaaccgggatattggcgatttcctcgaccgttctgggggttgcgttggtctgcaccatccagtctgtcgggcctattttctggtcacccgccggacgcacgacgttttgggtatccagaaccttttgcacgtccatggccgagatatggtgcgcctgtaactgctcctgattcaggctgatcatgacgaagctgtccataccaccgtaagggtgggggacgattgcgcctggaacggtcaccagcatggggcggatacggatctgcgccagtttgaacagatccgagggcgtcatattgtcggatgtcagtttcagcgtgatcaccggaaccgaggaggcttccagtttcatgatcatcggcgctggtgtatgttccggcagctgtatcagcacggtttgggaaatagcgaccacgtctgcttcagcagagccgatttcggttccgggctggaagaaaatattaacaaccgcgcgaccgtagtaggaatcggactgcatatgctcgattccctcgacggtcgaggtaacgccctgctcgaaattatagataattcggcctgcaacttcatcagggagcaggcccccatacgtccatacgacggcgataaccgggatacggatggtcggaaatacgtcggtgggtgttttgaggatggacagaataccaaagaaaacaatggcaatcgacaaaacaacgaaagtatatggtcgtttaagagcaacaagaacgagtgcgttcattcgtctaatcccggcggtcgttcatagtgggaagctttcctcacgtagagtcggtcggttgcctttatgccggaatacgtccggctgtatctgttttgctctcgtgaaattttctatcctgagagccaaaggggcgatgattccgcagagaagtcaaggcaggcagatgacaagacattaatagttgcaggcagtgcatgttatttttccttagctcgcatggagttctgcataaaagtaatcaaatgagtaactaaaatcgtgtttaagattgccttcgcaagcaatgaacaaaagttatttttactgtcattataattgaggatgatttgttttttgataagaataaatacctaagaaagggcaaattgtttacttgaatgtacgatacgctattggtgagcttctatagaatcatcgacgcgatatcagaacgattatcgtcttaatgcaagtcttttgcagatcgaatggtcggaggggcgccttgatcggggggaaggtggttacgctggagcaaggcgcgtcggccttcagcccattgccatagcagcagggcgggaataccgatggccagatcacgcccgcgtttgatcagcgatatggcaagggcggcttctccgccgaggccgaaaaggccgcccaaaaagatcaggccaccctcctgcacgccaattgcgttcgggatcatgaaggcaacgcttcgtatgccatagagcagactgtcgatggcaatggcgctggtaacgggcagattaatgccgagcaggcggatggtcagccatgtttccagcccgctgatgatccagcacaaaagatgcagtgctccggccagaaacaggctggaaggtgtggcataaatccggcgtatatcatcctgcaccatggcggagcgggccagtgcctgccccagcagatggcgggagagggatgccccgagccgatcggtgccctttaatcctctggcttgcagaataatgaacagggataccagtacgcccatgcccgatacggcgtagagcaagggcgtaaccagcccgctatcggggcggttccatgacagcagggtgaggccgatcagggtgtagaccagctgtgcgaccagttctgtcgtgacatcgacgacggtggatgccgcggcaaaagccccgggaataccggccagtgttgcggcccgtccgcccagcacgtagccgcccagctgtgacaggggcagggtttcggcggctgaatcgcggatcaggcgcccccatgtgaaccaccatggccgtcctttgttccgccccagcatccaccatgcaaggcccatcagaccgatcaggttcagatgataaaggacgatgatgctgaagccttcccagccgatggcagtcaggctgtgccagaccgcgcctgcattctgctccagtaccagcagggtaacgatggcaagccctgccagcaggccgagaaggacggggatgttcatggcggtccggctaagccgctgctttctgctttggtttgcgtatgaagcggcaggccagccgggtcagggttggcatggtggtggggcggcgcaggcgctggtcataaccggcaaagcggcggtcattttcggacaggcacagctccatcagctcccgcacgctgacatcgacgtcgctgacggctttggtgccggtgacggtgaaattattatcctgtgctttgctggctttcccgtcaccatccatgccgcgcgccagtccgatccgctcccagcccaggaacacccacacggcagccacctgcatttcaaaccatatccggcgccagatgggcaggttacggcgatgtgccgccaaccagttggcgaacagcaggatatgtctgcattcctcctgcatgaccggctcgaacgtatcgaccagctcgggcgggaagaagccggatcgctgggcgaccgcgaacagaccgaacgcgaagaagctgtcgatgcattcactgaaaccggtgaccagataggcccattccgtatgtttcggcggggggtagggcggctccggctccagcacgataccgtatgcctgcaccaggttggacagcacgaccttgtgccggccttcctcccagccgttcagggcgatggcttcccgccaggccggatcatggaggctctcggcataggatatcatgcggatgcgcgccttgccctccgtctgaacggcgatgtcccagatcggcaggctggtcagcctgtcccgttcctcatcgctcagcttcggccagtcgatgatggttggtttgtaggggttgaaggtctccagaaacatgcgcagcgttgcctgtttatgggcttcagaaccgggggtgagctttcccttgaaggggctgacccaatgccgggcagcctgatcggcagcagcgatgatcccggcatcgtctacgccccctttggcaagcttgagaccgctgggcggaggagaaagatcggaaagggacatgcgggcgagagactcctgacgccggacgttatccgcggatgggggcgggaaaggcaggcgcccgttacgggcgcatcatgcacatgatgtcctgactattaacaggagtacggccgggaggccaaatccatagcaccgattctgaaacggccccgctatcgaagcagatggtatggccagatggtatcgagagtgaacattcccgggttttcaggggcatctgctcctccaccttctgcgtccggatacttggtggctggtgtacgtcaaacctgttttggtgcatgtgacaggcttatgtcatatgcgcagaatgcattgacccgagactgtcatctgaaagggacacagcttattacctgtctgctgaccgctcggtcagagcaatggagcgccaacgcattgctcggcgaacagggcatgttgtgctgatggccattctgtcggccggatgtgggcaggcagggattgaagggggacggatcggtgggatggggcaggctgtggggcgggcgaagctatgatctgggcaaaatgaccttgcctgaattatgggtcgcctatttaacctatcctgcgatacagctttacttcgccctgatggcaggctgtgccctgctggcggccatcttttatcaaggcgctggcggcatattgctgagcgtgatggcggcgatcctgatctatccttttgtctggtatggcattcatcgctttatcctgcatggccgttggctctatcgcatgcgttggacagcccggctctggaagcgggtgcatttcgatcatcaccaggatccgcatcggctggaagtgctgttcggtgatcctctgaataccattccgaccatggccgtgatcacggtaccggtcggcgcatggttgggcggtatcgcaggcggcgcctcggctttgggcggggcgatgatgatgacatgtgtctacgagttctttcactgcatccagcatctgaactacaagccaaagtcacgtattctccagtacatgaagcgtgtacatctgctgcatcatttccacgatgaaagcggcaattacggcatcatcaactttctgccggatattctggcgggcacttattaccgggatacccgggcccggccacgcagcccgcatgtgttcaatctgggttatgatatgcaggaggcacaccgctatccatgggtgatgcaagccacgggcgctcccccgcgtgaccggcctccgcctccatcggcgatggcgaaacgggtatgacctctcctttcatcaatccgggttcagagattgaggttatccctgtacgcagcaaggcggacagggagcgtttcatcgcgtttcccgaccggctggcggctgctgatccccattatattgcgccactccggattgatcagaaaacgctgctgtcgcagtcccggaatccgtatttccgccatgcggaggctgcgttctggctggccagccgtcatgggcgcgatgtgggccgtatcagtgcgcaacatgactcgctggagccaaacgggattgggcatttcggcatggtggctgccgaagatgatacagctatttttgcagctttgctcagaacggtggaagcatggcaccggcaacgcggtgtccgggagatacagggaccgttcaatctgtcgatcaatgaaaccgcgggtgttctggtcgatggttttgagacgccgcccatgctgatgatgggccatgaccagccttatgtgggatcaaggctggaagaacagggctatgaaaaggcccgggatctgctggcttatctctatgacacggcagcccctttgccgccttttgccggcaggatgctgaaccggcctttgccacagggtctgtcgatcaggcatctcgactggtcgcgttacagggaggaagtggcctcgatcacggcgatcttcaatgatgcatggtcggataactgggggttcgtgcccctgaccgaggatgagaccgatgccatggcgcagcaactcaaactgctgctgcatgccaaaatgatatggtttgcagagtatgaaggcaaacccattgcttttatcgtggctctgccgaatctgaacgaggcaatccgcgatcttcgcggaaaattatggccttttggccttgtcagattgctgtggcgtctgaaaatacgcggtgtcaaaactgcccgtgtgcccttgatggggatcaggcgcagcttcagtcatgggttgctgggcagtctgatcccttttctgctggttgatgcggtgcgccgggaaaccgcgaaattgggaatgtgttcggttgagctttcatgggttctggaaaataatgatcccatgcggcgtatgaacgaagcactgggcggcaggatctacaagacctatcgtgtctatcgaaaatcgcttatggaggagtaagcggacaatgtcgcatgccagcaggtgggttttgaaaattctgcggcaggccacttaaagaatatttttaggccacgatgctttccagcatgataaatccggtcataggatggaagtattgttgccgtcttggttgcctaaaattctgcaagccgggtggacatatcaatttctcctacacttgcagccgtgaacagggaatttacgattatgtccgaaaaatccatccgcattgcggtcgcagggataggcaattgtgccagtgcgctgattcaggggctgtattattacacgcctgagcgttgtgagcagggtgttgccggcctgatgcataccgagatcggcgggtttcgtccctgtgatatccacgtcgttgcggcgttcgacattgatgcgcgcaaggttggacaggatgtcagccgggcgatttttgccaagccgaactgtaccaccattttccaggcagacattccggatagcggcgtgatcgtgcagatgggacaggtgctggatggaatctccgaccacatggcccattatgcggatgacaggacgttcctgcgcgccgatgtccctgaactgagcaaggctgagattatcgcggaactgcgtcgcagcggggcggaggtgctgctcaactacatgccggtggggtcggagcaggcggcacggttctatgccgaatgcgcgctggaggccgggatcggcttcatcaacaacatgccggtttttatcgcctctgacccggttttcgcggcgcgtttcaaggctgcaaacctcccgatcatcggcgatgacatcaaatcccagctgggagccacgatttcccatcgtgtgttgaccgatctgtttgccaagcgtggggtcaagctgctgaggacgtatcagctcaataccggcggcaatactgacttcctgaacatgaaaaatcaggatcgtctggtctcgaagaagaaatcgaaaaccgaagccgtgcaggccgtggccaagaagcgtatggaggataccgacatccatgttggcccgagcgattatgtgccctggcagaatgacaacaaggtctgcttcatccgtatggaaggccatctgttcggggatgtgccgatgaatctggaaatgcgtttgtcggtcgaggattctcccaattcggccggtgtggtgatcgatatgatccgctgctgcaagctggcgctggacgccggggttggcggcgttctggaagggccgagcgcctatttctgcaaacatccgcccgtgcagttgaccgatgacgaagccttccaggcgaccgagcagttcattctggattacgcaggggcgaaggcaaaggtgaaggtctctgtcgtcgcatgaaatgcctgattgttgcggctggtcaaggcgttagactgcgtgcgaagggggcattgaaaccgctcatcccgcttcgcggagttccgctgattgaatctgtgatgactcgcgccatgcaggcgggcgttgatgaattttttgttgtcagcggctatcgtggggatgagctgagagcattccttaacagctatgcagcacgggaaaccgttcgcatcacgcatgtgatcaatcgtcagtgggatcgggccaatggttattccgtaaccatggcccggcagtttctggatgagccgtttctgttggtgatgtgcgatcatttggtagatccggctctgatccgtgccctgatcgcgcatggcacgccggaggatacggtgacgctggcggtcgattacaatctggacagcccgctcaacgatcccgacgatgtgacgagggttcaggtcgaggatggccgcatcatccatatcggcaaggtgatccgcacgtataatgcctacgatacaggcgttttcctgtgtacaccggtcatgttcgctgcgctggaagaaagtcaggccgcgggggatgacagtatttcgggggcgatgaacgttctggccggctggggccgggcgcatgtctttgatataggcgaccgggtctgggttgatgtcgatgacccgctggctttcggaaaggcggaacagttactggcggaggggcggctctgaacgccataccacccccctcgatttatgcgcacacacaggctgagccagtgcgccggacgaccgagatcgaggaagccaccaatcgttggatcgtgcatcctctttccgcaagactggtgccgatttgtgcgcgccttggcatccatccgaatgttgtttcgctcagtggcatgatctgcggtgtgactgccggttttgcgtatgcgcagtatccgcgcctgcctttcatcatctgtggttttttgctgatgggggcatggcatatcctggacggagtagacgggcagcttgctcgcctgacctcgaaacagtccgcacttggaaaattactggatggaatctgcgattatatcacgtttatcgcagtttatgtcgggatcggttacgtgctggcaccgctttatggcggctggatatgggggctgattgcgctggctggcattgcccatgccgtgcaggcggcatcgtatgaggcacagcggcaggattatgatgcgtggggcaaaggtttgctccataaacgcttcacgatgtcttcgtcagaggctggttggttatatgcagcctatctgcgtctgcaattaatggtggcgggggatatcgtggcactggatcgggttatggcagatgccataagttgcgatcccgcgcaggcttcacttttgcagtcccgctatcaggagatttttgcagcccctgtacgccgctggggtgtaatgtcggccaactggcggacaatcagcctgtttatattctgtctgattggcctgccagcaggctattttttgatggagatcatcggcttcagcatggtctgtgcaatgatgctgcgtgcccagcgtcgtcgtcgcgccgcgttcgtggagatgatccgttcttccagcctgtcagcctgacaggcctcgcgaaccctcagagcggaaaaccgatatcggaagccgctactttgaaacgagcgatagcgtcgttgatcattccttctgtatggctggccgtcacgctggaacgcagcagaggatgatcatccggcgttgcgggcggtaaggacagattgacatacactccatgctccagcagcgcattccagaaagcgatggcggtgggaatatccggcatcgtgaccgccacgatggggctgacctgtggtcccactgtgaaaccggcctgtttcagcccgccatgaagtgcttcggcattgtgtcgcagcgttgcctgcaagtccggcctttgctgcatctgccgtagagcggattgcacggaggcaatcacggaggctggcagtgaagcggtaaacatataagggcggcaggcaacgcgcagaatgtcgaagccgtctatgtcggtcacgcagaaaccgccgacactgccgagacttttcgaaaatgtgccgacgatgaaatcggtatcggcctctacgttttgagcttccgcaagcccacgcccacgggcaccgagcaccccgagcgaatgggcttcatccaccagcagccatgcacccgcttcgcgtttgacagcggcaatctcggcaaggggacagctgtcgccgagcatggagtaaataccttcgaccaccaccagctttgcgcccggtgtgccatccagacggcgcaggcggcgggccagatcttccggatcgttgtgacggaaacggatcacctgcgcctgaccaaggcggctgccatcatagatgctggcatggctgtcagcatccagcagcagatagtcatccttgccggccagtgtagagagaatgccgagattggcctgatagccggtgctgaacaccatggcatgtttgcgaccatagaacgcagccagctcgtgttccagggcggtgtgcagtgctgtggtgccattggcgatacgggagccggtggtgccggttccatgctcccgcacggcctcggcggaagcgcttatcccggccgggtccagattgagacccagatagttgttggttccgaacagcagggtcggctgtccattgatcatgccttcactggccgaggggcctggctcgatcaccacgctgaacggatcatgaccggcggaggtcagggcgcgccgcgcttcggcgaggggagcaaatttggcgagaatggaacagctcataagaaatccgggaacgctggagataaggaagaggggagtgtcttcaaggcgcggcagtcaactcggccagacaggcggccagatcgttgatggtgcggatccctgccagccggtcgagcggcacggagacatcgaggcgatcttcgatgtccatgacgaaattcatgacagcgagcgagtccagcccgagatcatcgacgatcaccgtttctccattcaccggctttgccgtcttggagcgggcagtcagcgtatcaatgatcagagctttgatggagggcagatcggtgctcatgagaggctccgtgggcgatcagtggggtggattgatatctggatcatgtctctagcggggagcgtgcgccggggccagccaacccgcggcacgataccatgcgaccgcgccggaaaatccatgatcaagggtgatacggggtcgggcaatggcatcgggcaataattcagccggggagaccgaccagtcgggatgcagcatctcccgcgccttgcctgcattgaaaatggcaggtcgccgggaaagcagactgtaaaggctgcccgccagcccggccccccatatggagactgccggcagccggacatagcggggatggtggccgagcgcctgcgcggcggtctgcatgatttcctgcggcgtataaccttgtgggttgccatcagcgagcgtgcagagagagggtggcgttttgtgaacggccagagccgcgatcgcatcggcggcatcggcaacatggatcatggcgattctggagcgggaatgacccgcgacgggcacgatccttgccgcggcgcttctgaaaatggacagggtggcggtatcccacggaccataaatgaccggaggacgcacaatgcacagtttgcccccgaacccgtccctcaaagcctgttctccggcggatttgctggcggcataggcggatagatggggtgcccgtgcggcaagggaggagatgccgatcaaccgtgccgccggtgcgcagcgttgcagcatggaggctagcctgaaagcgccatcccggttgacggccagaaatgccttgggtgagcgcgcccgcaccagcccggccagatgcaggaccacatcagcgcccgtcagcagccgttgcagcgcggtttcatccgccagatcgcccggaacagtttcgatccctctgtcctgccacagcggatgtggttcaggtctgcggatcagggcgcggacgtgaaatccgcgctctgccagggcagccacggtatggcagcccaaaaacccggtggcccctgttaccgccgcaatgggttttcgggccatcattcagctcgttcaggcgacggaggagacaggatcgctctcgaaagcgccagtcagcagcatctgccttgcccgtgcgcggctgagcttgccggatgaagtctgcggcaggctgcgcggcggtaccagaatgacggagacctctacaccatgttggcgcaggaacagggaagctgcttcctgctgaagggcctcccgggcagccggatcgctgagcctgcattgcagcagcgccacaactttctcctgcgtgtcattctcgatcgagaaaacgaccacatcacggctgcgcagggcaggaatatggctctcggcggaccattccagatcctgcggccagatattgcgaccgttgacgatgatcagatccttggcgcgtccggtgacgacaatctgcccgttaagcagatagccgagatcaccggtattgagccatccatcagcggagagtaccgcggaggttgcttccggctgggcgaagtagccggtcatgatgctcggcccccgtgcatagatcacgcccacgcggcgttccggcagcacagttccatcctcgccacgcacctcaatggcgtagcccggcagaaccggtccacacaggacgaagtcacggctctgaccggtctgctcctccggcacgctggcaagggcgagaccctgatgttccagcggtccgcgcgccacgacatcggtatgcaaccctccaccatggggggagaaactgagggccagtgtgacttcggccatgccatagctggggacaaaagcccgatcactgaaaccgcgggttgcgaagcgcgcggcaaaatcgcgcagaacctgcggtcgaatcatgtccccgccaatcccggcaatgcgccagctggagaggtcaagcgtttccggagcgctttcggcccggcgggcgcacagctcatagccgaaggaagggctgtaggagagtgtgccgcgattgcggctgatcagatccagccagaccagcggacggcgtgcgaattcccgcgttggcagaaaatcgactgaaatctgacaggtcagcggggtcagcaaaaagccgaccagccccatatcgtgatagagcggcagccaggaaacaccccgatccccatccctgaatgccaggccgtgctggctgatggcggcggcattggccatggcggcgcgctgtgtgacggccacaccaagcggaaaccgggtgctgccggaggaaaattgcagataggacagcgcatccggatcaattacgggcaggtccatagctgggaccggcatggtatgcagcatggtggcggtgccggtgaagacgaggttcagaccctcagtcgcttcctgcaaccattcgttcagcagatcgggtgcaaaggccgcgctggcctgtgcgctttcgatcatgcggcggatattggcgatatacccttcccgtccggcaaaggcagccggcagcggcaggggggctggcaccagtccggcatactggcaggcccagaagaggcggacgaaatcgccatcattctcggcaatcagcgcgatgcgctcacccggattgagacccagcgccagcagacgacgggcattatcctgtgcctgacgacgcagttcccgatagggcagggcttcctgcaacaccccgcgcccggagtagaaattcagcccggcctgaccggtggcggcataatccagcgcatcgggcagggtaggaaaatcagcaagccgacggggagtgccagcgtctgacggcgtgggggtgacggaatgatgcacgggtggtccacatccttgagtgctgacgcgccactcccggtggcggtaggtgcaggttggtcgggcggcggggtgacaggatcagccccatgaaaggcaggactatcagggggtttgaaggcaatccgtcaagtccgaagcgcggtttagtagtatttcattctgatatcgaccacgttatcgccggggtgggttgcaaatctgacagccgacaggtcgggtggccccagcagaagaaccgggttgcgggagaaaccaaacccttcggcaggcaggcccagcatgctcgtgtcgaaatgaccgttccggttggcgtcatgaaacagggcgacggcataaaatcctgatgcgggcaatgcgatgcaggcatgtgtcacaggaagggaaaccggcaggctgacacgggcaagtttgtatttcccatccagaaaatgcgtggcctcatccggatagacggtgatggtgatcacgcctgatgctgaattcatgccatggacagagatcaacaggcgggtctggtgcggatcagccggctgacacggagcggtccctgcgtgaccgtggcaaggccagactgccagactcagcaggattataatactaaaaagccgtttcagtatgggtggtctgttccgatccatgacggctgcttcctgtcagtcttgtgatgaagtgcgacttccggttaggtctgccggatcgccatctcccatcatgccgggtattcctgcgtgagcaggctgtacgggcatggaacggtcaagtccagccgactgtaggccagccgatcgtaggagagagtcgcggaagaagagaaacgtcctccggcatgaaatgcgtcagatcctgattttccgccataacctgttccgtgtttcggagccgttcgtcaccgaaccggctgaagcgctggcgcgctatcgcccgctttacatgggctggctgcgctatggggaggctccgtcgggggcggagtccattgtgctggggcgttgtgccgggacgcgtccttctgctgcggtaggctggcagatgctgtcccgcgatcccggcccctatctgcggcggttgggtaagcgcaggccggcgctgatccatgcccatttcggggttgatggcagctatgccctgccgctggccaggcggctcggtgtgaagctggtcacgacatttcatggcttcgatgcgaccctgtctctggccgggctgatgacctctcccccctgggcctggtacgcgctgatgcggcacaggctggcgcgggagggcgcgttgtttctctgtgcctccgcgtttattcgccggaaagtgctggcgctgggtttccctgccgagcgcacgcgggttcactatatcggcgtggattgtgccggaatcacgcctcgtgcgccggaggaggaaaccagaaccattctgcatgtcgcccggctggtggaagtcaagggcaccgcttctctgatccgcgcttttgcccgcctgaatggccggcatgagaatgtcaggctggacattatcgggaaggggccgttgctgcccgggttgcgtgatctggcgcgtgcgctgggcgtagaagcgcgggtgcggtttctcggtgcatggccgcatgaggctgtcctgcaccatatgcgacaggcggcgatgctggtgcagccgagcgtgcgcacccgcagcggcagggaggaagggttgggcatggtcctgctggaagctgcggcgagcggtgtgcccgcgatcggatcgctcagcggcgggataccggaagccgtccgggacggggaaaccggtttcctgacgccggagcgggatgtggaagcgctggcccgccggatgaatgatctgctggatgacgacgcgcttcgccggcgtatgggccatgctgcccggcgcatggccgagcgggaattcgaccgccagcgtcagacggctggtctggaaacactgtatgattcggtgctcgaccatgcgggctgaagcgggtttggttccagaaggagcgaccatcgtcgtcgcgcacccggatgatgaatgtctctggctgagttccgtactgccgacggcccgccatgtggtgttcgtattcggcgattcctttacacgtccacagcgtgcagcagcccggcggcgggccgtggcggccttgcatccccctgggcatccccctgggcatccccctgggcatcccccggggcatctgccggggctggtcaatctggcgatccccgaaagcggagccggatttaaggttgattgggcggatgagcatctcgacaccgcactgacccggttcggcattgcgatcaacgagccagcggcgcgggcgcgctacgaggccaattttgaccgcgtgctcaccgcgttgaggccgcatctgaccggtgcgttgcatgtctgcacccataatccatggggcgaatacggccatgccgagcattttcaggttcaccgtgccgtgatgcagttgcaggcggagctgggctttacggtctggtacagcaattacgtggatgcacgcagcctgaccctcgcagcccggatcggggcatctccctgttatgcacagcgaagaactgtccctacggcaccgggggttgcgcgtgggctgatgcgggtttatcgccgccacggagcctggacctggacacgctggcatgtctggccggagcgggagacgctgttttcggttcctccggaaggatgtctctcgacgctggcgggcgaggcattgctggatgtcgcgggattacgcctgtggccgccaccctggcgccgtgctctgcgtgttctgccggttcagccgcctttatcgtccctgtttcgcccgccggtggcggggcaggcataaccagtccgggaattccatggcgaagcttcctctgtcgaagaaactcaaaggtctccggtcgggcctgcgctttctcggtcttgttgccagttcccgttataatcctctgctggcacaggtggtggtaacgcggcgctgcaacctggcctgcggatactgtaacgaatacgatacgttttctccgcctgtgccgttgccggaattgctggcgcggattgatcatctggcgaaactccgcacagcctccatcacgtttaccggaggcgagccgctgctgcatccgcaattggatgaggcgatccgggcggcccggcgtcacggcatgatcgtgaccatgatcaccaacgggttccgtctgaccaaagcctggatcgaccgtctgaatgcggccggattacagggtatgcagatcagcatcgacaatctggaaccggatgaggtgtcgatgaaaagcctgcattcggtggaaaagaaactcggattgctggcagagcatgcgcagttcaaggtcaacgtcaattcggtgcttgggatcagtgatgaacgcaccccggatgtgattgaggtcgcgcgcaccgccgccaaatatgggcttcagcattctgtcggcgtgctgcacgaccataccggaacgctgaagccgctcagtgcgctgcagatggcggcctatgcgacggtcacgaaaatctcgccgtctctggtgcatggtctcaattaccggctgtttcagcggaacctgatgcaggggcaacccaatcaatggaaatgccgcgccggcgcgcgttacctgtatgtgaccgaggacggacgggtacactggtgttcacagcagcggggctatccggccattccgttgctggaatacacgcgggaggatctgcggcgcgaatatcatacgcccaaatcctgcgcgccgacctgcactttatcctgcgtgcatcagatgagcatgttcgacggcttccgtggggcgcagaccttgccggagcctgtccctgcggtagctgagtagatttatccggtagaggaaggcgcctttttgcgctgcgagagcggtagcagggagccaatcgtgatgatggcggcaatcatccccagccgaagcatgggaggtaccgttcccgcgagtgtttccagaccgatcacgatcagcaccagaatggtcgcccgctccacagacccccgtatggtgtgcagccatatccatggtgaccagccccagcgccggtgcacatatcgggacgcccagagcagggcgaagggatagatcgcaagccatgatgcggcggcggcgatcacaccctgttccggcggcagaaccagcccggcccacagaataccaaggctgagcagcgtcagggttgttgccgagagttttgccgccataccgggctgcccggtggccagcatcagcggaaacatcagttccagcatcacacgcagcagggcggcaccggccagaagctgaaggggcagagcggcggcggcatagcttccgccatgaccgtctttcagcagcgccagcagcggatgggctgcaaggatcagtccgatcgtgacgggtgtgaccagcatcaacaggcggcggagggcccaggtgaccccttcctgaagcgcttgtggcgtatgcgccatgcgggaaaaaaccggcagggtcgcacgcttgatcaactggctgacggccatggccggttccatcgccacatcgaaggcgacccggtaaagggccagcgatgccgggccatataatccgcccaccagcaggaaatcgatattgcggaacacctgatcgagcaggctggccgaggccgagcggagaccgaaacgcagcagaaaacggatggtgatgaaccggaagcgcagacgcggccggaaggggtgcgcaatcagggaggccgtcagaatgcatgcgccgctgatcgtataggccgccaccagcgcccagcttcccgccccgcagaccgccagcccggcgcgggtgagggcaccgccgaatgtgcctgccagtccgacaacggcaatgcgttcatactgcaaggcacggttcatctgtgccagtggaatgaccgctccggccaccagaggctgtttcagcgcgaccgccacgaaatatcccgctatgccgccaatcccgtacagcgcactaccagtcatggccagcagccatgtcagcaggccgatcaccgcagcggcggtcatgatgaaccagaacaggctatcatactgggtgcggctgatacggggggcctgtaccagcgcctcggcagtgccgattccgtccagcgcttcgatcaccatgccggtggcgattaccatggcggcgatgccgacctgctccttggtcagaaacatcagggcgatcagcgtgctggcaatatccatgattctggtggcgatggcggctccgcccagccagttgaagccacgggccagatgctgccggtggttatccatgcggtggcgtttccggggcaggaaagggtgcggatgggcgtggcggcagcacccatgaacgggtcttgagcaggtgcgtaagccactgccgggactgaccgagccattgacgccagtgcctggctgtccagcgggatgcgtgtggaggaggagcctgcatccttgtttgcaggatggcggcgatgcggctggcgcgggcctcccaggtcaggctctgactatcggcctgagcggtctgtgccagcctgtgcgcccgtgccggatcggtgatcagggtcgtgaggccctctaccagcgcctcgatatcgtctgcccggcagagccatgcattgcggtcatgctccagcaattcccggacatccggggtatcgcccgccagaatgggccgcccggaggccagatacagaaacagcttcagcggcagtaccgtggagccgaactgcatcagcgggctggaggagggaggaatcaccagcacatccgcggcaaacagatagcgggagagggtcgcttcggtctgccacgggatgaatgtcacattggcaagaccagccgccatggtctcgatcgggccatggcccgtagagccgaccagcaggaaacggatctgcggcagaaggcgtgcggcctcgatcagcagcggcaatcccttcttgtgattgatgcggccggtatagatcgcggtgatctgcgtcggatcgaggccgagcgcgcgtttcgcatcttcgaccggcacggggtggcgcagccgctcaggctcgaacccgttatgcacgcagagcagcttgtcggggggtatccccagcgccagatatttttgccgtgtatactcggaatgacagatatggatcaggacatggcggtgggagaacaggcgaaacaaccatctctgcaaaggcgggatctggtccggccaagggcggtaatgatcgaaggcaacgcgctttccgcacagcacggccatccaggtgacgaacagattgcgcgaatagaccagatccgcttcccggaaagcccggcgcagcacgatcgtcaggccacaggccagatgccggaccagtcccggtccacgcggtgcccatgcacggataacgtccatgcctgcgagggtttcgctggcctttaaaccctccggcgtagagacgggaacatgcaaccagcattggtcgaggtgccgggacagatagcgggcggtggtggtaaagacttcggcgtcggcttcccggctgggcaggggattttcgaacgcaaaaaggattttcatcggctacggcgctttcatcctggctgctggtcgaccgttggccgtgtgatgacgatccagcggcatagccgccgggcggcctgccctgcaatgcggcgtttgcgcagcagatgtttcggattatagctggcgcgatcatggccggtcgatcaacgatgatccgcgtgacgctggcccgctgctttcgcccttttggctgccttctggatcaggcttttgtaccgttgattatccagacctacctgatccgtgagatcatgcgccctttcgtgccggtgctggcggtgctggcaggcttgttcggcagtttcagcgcggctggtttcctgtctgatgcggtgaatggtctgttgccgactggctcgatcatccagatggtcagcctgaaagttttgatcgcgctggaagtgctgatccccatttcgctctatctgtccgtacttctggcgttcgggcggctgaacagtgatcaggaaataaccgccatggctgcgctgcgcgtccagccggagcgcatatggcgtatcgtgctgagcctgtgtctggctatggcggtggtggtgggggccttgtccctgtttgccagaccatgggcctatgcgcggctgcatgccctgtcggatcaggcccatgtgtcgctcaataccgatgcgatggaggcagggactttttatatcggtcccaaaggcaatcgggtgattttcttcacccatcgccaagggcctgaagaaccggccagcggtgttttcgtgcagctctggtcgcctgatcggatggagatcatctccgcacggcaggctatgaccctgcggccggcctcaccggatgcgaaatcgcaaatcctgttgagtgatgctcatatttatcgtttcaaccgctccggtgagggaaacgatgaggtgctggatgcggctgagaccgttctcgatatccagccgaacaaggctgatgccgccgcttacagcgctgtcgcgactgcgagccgtctgttgcttggatcgcccagtccggcagatattgcagagcttcagtggcgtttttcgacccctgtttccaccttgctgcttgggctgctgggaatcccgatgagccgttcaaagccgcgccaaagccgctatgcacgttttggagccgcgattctggcgtatttcagctattatctattgtgcacttcggcgcggacatgggtgcaacatggggttgtgcccgccatccccggtatctggtgggtaccggcgctgctgggtgtggttctgttgatcctgctgtatgggccacgctggcgacttgcactttcccgccgcggtgcccgggtcaggagatgaagaaagaacgctacgcggcgatggcggctttgaaagcggtcggtctttccgccatcgcactgacggccttgttcagcctgctggaatttgtgcagcaactggcctctgtcggacaggggcgttacggtatgctcgatgccgcgatttacgttgccctgaccatcccttaccgattgttgcaggtctttcctgtctccatgctgatcggaacgttgctggggctgggcggccttgcccgaaatggggagctgacggcgttgcgcggcctcggcatgtcagagcgacggatcatcctgtcggtgatcgctttttccataccgctgatggttattctgtttctgatggcccagtttgtgattccaccagcgcagagagaagcccagacatggcgcagcaacgcgctgccggataccacggctcttcgcagccaggacagtttctgggcttacggggacaggcattttctcaatattcagcatttcgaacatcatgatgaaccttataatatcgacatattctcctttgcgccggatggagaactgcatcgttatctgcatgcgcaaagcgccgatattctgccgaatgatcgctgggttctgcatgatgtactgagcagaactcttgtggatgggcaactccgcaaggctcatctggaccgtctggactggaccccttttctgactccgcagcagactcagttcctgcgcttgcggccggatgcaatgccgccgctggcattatggcgctatgtacacagtctgaagcagcggggcttgcaggctatacgctatgagcaggagttgtgggctaaaatcagtattccgttgacgatgatggcgatggtgattgcggcgacaccttttgtttttggcggtggccgtgtgcagaatacaggagccttcattgcgctgggggcggcgatcggtgtcgtgttcacacttgttcagcagatttcaggccatctggatgtgctgctgaatctcaatccggcggtgacggcattaacgccgcctgtgttattgatgtggctgggaattgacctgttttaccggcggcagagataggaccctgagcgaacggttcatatcgtaaggcccataaaacaaaacggcgaccacgctggtcaccgttccaacagcaagacaatattttaaaaaactggagcgggcgaagggattcgaaccctcgaccccaaccttggcaaggttgtgctctacccctgagctacgcccgcatccgtgaccgtgccgaagcagcggtgggcgggcttctatagggggatgaaaagcttggcaagccccttttttgtcatgatttcgacaatcgcgaaaaacaccccgcgccgggttgtttcctaaccggtcgcaaacatctatcaatccggtcttgttgtgctgctgagggatgtgaatcatgagcctgatcattggcgctggaggaaattctgccggaggggcaggcgcatcccgaagaggcccttccgctcaggggagtggtctggtcggcgcagccggtcaggacgtgtccagtcagaatcccgcgaccctctcggcgcaggagatgatcatcgatggctctcaggacacgttcatggaagacgtgattgaggcatcgcgcaccacccctgtgctggtggatttctgggccacctggtgcggcccatgcaaacaattaaccccggttctggaaaaagccgttcgtgcggcacaggggcgtatcaagctggtgaagatcgatatcgatcagaaccgctctcttgtgcagcagctggcccagctcggtctgccggtgcagtcggtcccgaccgtggcggcattctggcaggggcagattgccgacctgtttcagggggctgtgccggaatcggaaatcaaacgcttcgttgaacctctgctcaagatgacgggtggagagctgcccggtgcggatcttctggccgaagccaaacgtgcgaccgaggcaggcgagcatgagatggcggcccagctctattccgccttgatccagcaggatgcggaaaagccggaaggctgggccggtctggcccgcagcctgctggcgctggatcagccggaagaagccgccgctgtgctggatcaggctccccccgcgattgcggcgcatgcagacatcgaaggtgcgcgctccgctgttgcagtggctgaggaaggccggcaggcccgcgccagactggccgagctgcaggccgctcatgaggccaaccccgatgatcggcaggccgcctatgatctctctgcggcgttgtccgcggctggagagcgggagcaggcggcgggcctgctgctggacatcatccggcatgatcgcgcctggaacgaggatgcagcgcgtctgcaattgttgcgctttttcgatgcatggggacagggcgatccggccaccctcgcggcgagacgaaaactctccgcattgctgttcagctgatccggctgtccctgactggagcgatcatcatgactgacaatactcttccttcgctgtctgatcccgcggcgactccggagcgcgggtctgccgccgagactgttgatccacggctgctggaaattctggtctgtccggtgacgagggacacgctggtctatgatgccgccgccggagagctgatcagccggaaggccggtctggcctatccgatcagggatggtattccgattatgctgccggaagaggcaaggcggttgccggaatgaccggcataccgcctttggggcaggcatcggatggggcggcagtgacgccgaccgaaatcaggctggatcgtggtgaggcactgctgcacgtcacattcgaggatggcgccgcctacagcctgcctgccgagtatctccgtgtcgaaagtcccagtgctgaggtgcaaggccatacgccggcagagcgccgtactgtctccggcaagcgtcatgtcggaatgcgggggctggagccggtcgggcattacgccgtccggatcatcttcgatgacgggcatgataccggtatttacacgtgggactatctgcgccgactcggtcgggaacagaccgagcgctgggcggcttatctgcatcggttggcggacaagaagctgacacgctgaccctcggttgcaacgcatccagggccacccatatggggcaaggcgggttttgcccgccctatctatgttgctgaggggagcaagccatgagccagcccagtgctgccggatccgggattttcaggattggtggggatctgccagttcatcgactgggtttcggtgcgatgcgtatcaccggcaagggaatctggggtgagcctgccaatcccgatgccgcccgtgcaacgctgagccgcctgcgtgatgttggtgtcgacctgatcgacaccgctgatagttacggaccttttgtcagcgaagacctgattgcggaggttttgcatccctataccggcctggtaattgcgaccaagggcgggctgacgcgccatggaccggatatatggcgcccggtggggcggcccgaatatctgcgtcaatgcgtgctgatgagtttacgccgcctgcgggtagaacggattgatctgtggcagctgcacaggattgatcccaaagttgaccgtgccgagcagttcgaggccattgccggcttcgtcagggagggtctgatccggcatgtgggcctcagtgaggtctcggtggcggatattcaggcggcacagaattactttcccgtggcgacagtgcagaatcgctacaatctggtggatcgcaccagtgaggatgtgctgcgccattgcgaggctcatggcatcggtttcatcccctgggcaccgctctctgcgggaagtctggcgcagagcggttctttgctggatcggttggcgcagggaatgggtaagacgcccgggcagattgcgctggcatggctgttgcagcggtcgcccgtgatgctgcccattccaggaaccggcagcccctcccatctggacgataatgtcatggccgccgatattcacctggatgaaggcgatttcagagctttggatgagcaagggaaggctgcctgggcggctgccggataagaagcctatcagtcttgatcaagcaggcggggcaggtagatggaaatcgttgtgcctgcgccgggcctgctgtcgatactgatatggccgcctgtctgcttgacgaagccataaaccatagacaggcctaacccggtaccaaccagccgtttggtggtaaaaaacggttcgaaggcacgttccatgacatccggaggcatacccgttccgctatccttgacggtcacgcagatataatcgccggttggcaggatggacatataattgtccggctgatcgggatcattccggaaattacctgttgtaatctgtaaagatcctccgtctggcatggcatcccgtgcattgatcgccagattcaaaatggcattgtccaactgatgggggtcgcacagtgtcagccacagatcagactgcaattcggtcaccacatgaatggaggcgccaagtgtacgactgagaagatcatccaacccgacgatcaggctgttgatattgacggaggaagaattaagaggctggcggcgggaaaaagaaagtaatcgatcgatcagggaagatgccttgtcggcagcgttcagtgcggactggatatatctctcaatttctgaattttcggttttctgtgttttgatctgcaacagctcaagattgccgataatgcaggccaggatattattgaaatcgtgagcaatcccgcctgtcagctgccccacagcttccattttctgggcctgccgcagctgttcctgggtctcagtattttcacgcagtgctttctgtaaagccaatgtccgctgctgcaccagagtttcaagggctgatgcatctcgctttaaaatctctcttgcctgaacagagtgttcgatgtccgtgcagcttccataccagcgcgtaacagcaccggtctcttcattgctgatggcatgagcctgcgttaaaatccaccgccactgtccatcgacacgtttcatgcggtgttcgatttcataggattgaccgcttgcaatgctattattcatatgggcaagcgtatgatcgcggtcatcgggatgcagcaatgttgtccagccatgcccgatcagttgattggtcggcagaccggaaaactgaatccatctttgattgaaaaaatcatggtatccgtcagcctgggccgaccagatcatctggggcattgtgtccatgatcgtgcgcagctcatgatcggctttgatgcggtcatgaatgtctgttccaatgccgatccatagttttggcgtccgatcagaattcagggaaatgctgcgaatcaaaaaccagcgatattccccatccacccgacgcatcggcacttcaatgtcataatgcatgccgtcgttgaaagcagtttcccgatgatgcacgactttcgtcacgtaatcgggatgaaaagccatttcccataatggccgaagatcaatatctttcttatcatgactggaggtaacggagatgccggtaaaatcctgccagaatctgttcagatagatgatgcgcttgctgccatcactgatccagacaggctgggtcgtaatttccatcatatgctgttgcagaagcgatttataataatcctgctgtggaaaaatctccggtgaaaattctttttcaacaatcagcaggacaaggctgagggtattattttcatcatgcagaattttgatcagcacaaagaaagcaatcggatttccagaatgtgattgatgctccacccactgtcgtgtgcatccgacgccgtgtaaaatggctctttgaacaaggcttctgaatacggttggcgcgtctggcaagaaatgtctgctacccaattcgaagagcttatcagccgcttggttggctctcagcagccgtcctgatcctctttccagaatcaccagtcccgatggattattgttaaaagcaatctgtatgtcagacgggatatgatgcgctgtattctggttgagcgtagcttgttcttgtggaagctgggattgtacagccaaggcacggcgcagtagccggacggtcaggtgcaaaacattctgctctgtaacggagagcatgtcgggacgaagcgtgctgctgaacccgatgatagcccctgtgggggaacctcctgaatcgtccagcgccatgacacagcacatgctgaaacgggccatgaaaggacgaccagcatggcttcgaaaaatattttcctgatcaagcgggtgccatgaaggctctgatcccgccagtgatatcagccgcgccagaatcgggtggttggcaggtggccgggatggaaaaaagaccattttttcctccgcagcgcatgcgtgaccaagtaaagaaaaatgatgattttcctgcagaacgataaaaacagccgccaatccacatgtttcagcgacaagctgagcataatcatcataaagcgtgctgtttttatggatggccatcccgctattttgctgggatggcttttaaagacaagtttctattttatagtatcgcttcatatcaccaaaaaagggaaaagccagtttggcttttccctttttaaaatacgggccgttgcaaatcgtttcagctggcggagacacgatgggtgggggctgtgacattggcgatgacctcgccgaagggtccggcattgcgggctgtaccaagagtacgattgcccgttgtttcccgcaacggcagcagaggaaaaaccagttcggcaaagcgatagcattcttccagatgcgggtagccggagaggataaagcggtcgatgcccagcgccatatattctttcatccggtccgccacctgttgtggactgccgaccagcgccgtgccggctccgccgcgaaccagccccacaccggcccacagattagggctgatttccagtttttcccggcggccactatgaagccgggccatacgttgctgcccgacgctgtcgaaatgggcaaaggctttttgtgccgtctcaatggcttcgtcggtgacatactggatcaaatgatcggctgccgcccaggcttcctcagccgtttcccgcacgatgacatgcaggcggataccgaagctcagctttcgaccgcgttttgcagcccgtgcccgcatgtcggcgattttttcagcgacatccccgggtggctcaccccaggtcagatagacatcgcactgctcggccgcgacctcctgaccggcttcggaagacccgccgaaataaagcggcggataaggcgtctggaccggcggatacagcagctttccctgttttgagcgtacatgtttgccttcgaaatccactgtcttcccttctagcagggcacgccagacctgaagatattcagcagttgcttcatagcgttcgctgtgatccaggaagaccccgtccccctgcaattccttcggatctcccccggcaacgacgttgatcagtagacggccgccagacagacggtccagtgttgctgccatgcgtgctgtcatggaaggttcggacaatccgggccttaccgccaccagaaaccgtgtccgctgtgtcaggggaaccatggcagaggcaatgatccacgaatcctcacaggatttcccggtcggcagcagcaatccataatagccgagttcatcagccgcacgggcaatctggctgagataattcagggtgacatgacgcgcaccgacctgggaagccagataccgcccatcaccatgtgtgggcaggaaccacaaaacatccgcagcctcggcagcatggctggagtgagacattggtcaggaaactccattcagaaaacgtatttctgatcaaaaaaacgctaaaaacgtgttgatggtttatattcacatatataacgtgcaatcaagcggttgtaccgaaaattacattattgaaagactatatatgccgaataatcggactattgcacagaaattaacattgggaaggcgtggttttatcgcttccgctctggcggcatccgcgatgggtagtctggctgggggggcgtctgcttctgcggcggatggcccaaccaccatcaggattggttttcagaaatacggcacgttggttctgttgcgtcagaaaggatggctggagaaagcgctcgaaagctccggccatcaggtggtgtggagcgaatttccggcaggcccgcagctgctggaagctatggccgggggggcgatcgacttcggtagcacgggtgagacaccgcccatttttgcgcaggctgccaatgacagcattctgtatgtgggggtggagcctcccgcaccgcatggcgaggccatactggttccaggtaacagcccgataaagtcagttgcggatttacgaggccgtacagtggggctgaacaaaggcgccaatgtgcattggctgctgctcaaagcattgcagaatgcggggctgatgatgaaggacattcacgtctcctatcttgccccggcggatggtgcggcggcgtttgacagcggtcgattggacgcatgggcgatctgggatccgtatctttcctctgcgcgggagcgtacggatgcacgtgttctggtcgatggggccgggctggtggaaaatcgggaattttttctggctggtcgctcttttgcacagaaagcgcccgggctggtgcgggcggtacttgaccaactcgccctcctggatcgctgggcggagacgcataaggaagaggttgccctgacgctttcagcaggcacccgtctgccgttgccggtggtgcaacgtgcggtcaaactcctgcctttcgggttgtccccgatcaccccggacgtcatcgcctcacagcaggccattgccgatgcttttgcggatcagcatcttctgccgggccgtatccgggttgccgacgcggtctggcatgaaggccagtctggctaagccttgtcagtcctgttcgtccggcagaacgcatggaacgggcagcagctccatccggcccagaatggcgacggtttcggttttggcggggatcaccagtatcgtctccgccataccggtccgtagcgcacagatcgcctttttcgggcagacgccgaaacagcctgtttcggctacgcggatcgtccgccgcaggcccagttgtcgtaaaccatttttcagcgctgtgctgaggctgtcccgcgcattttttccaaaaccacgtttcttgagctttttattgcacttggcacagatcagcagaacatcatgccatggtgtcgatacggatttgatcggcgtgtcagccatggtgcatgagccttactgatcgtggataaaaagcagggatcatgcagaccgccttgcccgcatagcggcagcaagggtaccgtcatccagaacatccagcgcgccgccaatgggaatcccctgtgccagccgggtgacggaaacccccattggtcgcagttgctcggccagccaatgtgcggttgtggccccatcaacggtggcacccagggcaagaatgacttctgtgaccggggttgcggatgggcgggaagactcgatacgccgcatgagcgcgggccagttgagggcatccggaccggtcccggccagagcggacagcaccccgcccagcacatggtacagcccgcgatagatccccgcccgatccatggcccacagatcgccgacgctttcgacgacgcagatcagtccattttcccggcttgggtcagtgcagacagagcatggatcggcgctgtccagattgccgcagacccggcaggttttgacggcgcgggcagcgttctgcatggcggcggcaaggggcaacagccgggtctccggctgctgcaacaggcgcagggcggcacggcgggcgctgcgcggacccagtccgggcagtcgggccagtaaggcgatcagttgctccagttccggtccgcccatgaaactcccttaccggtgctgccggatgacaatctcatgcggatgagaacggttcagcacgaaaaaccgtttcagaatggcagcttcatccccgcgggaagattcagcccgcctgtgactttctgcatttcttcggcagccatcgtctcgatttttttcttggcatcgttatgcgcagcgacgatcaggtcttccagcatctcggtttccgccggatcggccagtttcggatcaatatgcaggcggcgcaggtcgccctttccattcagggtcacggtgaccatgcctgccccggctgaaccttccgcctcgacggtttccagcttggcctgcatttctcccattttcgcctgcatctgtgatgcctgtttcatcaggcctgccagatttttcattctcggtgctccagaagtggttaagactgttccgattgtgtcggccgattaagccccggaaaggcatctccggaaggatcatcggccggttccgcatccagcggggcaaagccgggtccgtcatcgggatcacccggtatttcatccagagaatcgaaccggtcgccatgtccgccacccagcatgggggaggcggtcatcatacccggatcggcatgggtttcgcgtgtcagcccgtagacatcaacagtgctgtcgatcaccgttcccaacctcgccccgggaaaagcgttcagaatggcacggacgacaggatggttgctggcctgtgccagccgggattcgcctgcggcccggccttgttctgccagagtcggttctccgggggccgaggacagggcaatggtccagcgctgaccattggcttcccccagcagggctgcaagctgggcagggagagtgtgtggtacattgctctcaagccgtaattcgatcaccggcggggcgaaacggaccagatgaacattatgcagcagatgggcgtgcagcattgcttcgcggcgtgactctacgaactgtgcgacctcccggaaactgtgaaagaccgggacgggaacatcgggtacggagtcagccatggcgtgcggctggcgcgctgtggcggcgccgctccccccggacatgatgcctccggcaatggcacgaaagcctgtggatgaggcggtcggggatgatgaaggtgtggacggtgcgacgccgccccctccttgatgccccggctgttgagtgcccggtgcgccggtcaggcgccgtaccagttctgcgggtggcggcaggtcggcaacataacacaggcgaatcagcaccatttccgccgcagcccgtcggtccggagcggcctcgacctcggcaatgcctttcagcagcatctgccaggcacggccgagcaccggcatggcaagacgatctgccagagcactgccacgcagccgttcggcttctgccatgcccggtgcggtgcgcagatggggaatggttttcaggcgggtcagcgtatggatcagctccagcagatcctgaagcaccatgcccagatcggccccccgtgcatgagctgtgtcggtgaccgccagagcactggctgtgtcgcctgccatcagtgcttccagcaggtcgagcaccatgccgcgatcggccaggcccagcatgtctgcgacctgtgcctcgctgatagggatgccgggatcgttctgggcgatggcctgatcgagcagggacaggccatcgcgcaccgatccatcggcggcacgggcgatcagagcgagggcctgcgggctggcgctgacgccttcctgttccagaatccggctgaaatgcgcgctgagcacctccgcatcaatacgccgcaggtcgaaacgctggcagcgggacaggaccgtgaccgggactttcctcagctctgtcgtggcgaagatgaaggtgacgtgcggcggtggttcttcgagcgttttgagcagcgcgttgaaggcattgcgtgacagcatatgcacttcgtcgatgatgaaaaccttggtgcgggcttgtaatggccggaaccgggtggcctcgatgatctcgcgcacgtcatccacgccggtgcggctcgcggcgtccatctccacgacatcgggatggcggtcggccagaatggcggtgcagttggggcatacgccgcaaggatcggcggtggggccaccctgaccatcggctccggtgcagttcagggcgcgggcgatgatgcgggcggtggtggttttgccgactccgcgcacgccggtcagcatgaaggcatgggcgacgcggttcagcgcaaaagcattgcgcagggtccggaccagcgcatcctgaccgatcaggtcgtcgaaatggcggggacggtactgacgtgccagcacgcgataaggctgggtgccagccgccgtccttgctggcggtgtggcaggggcatcgccgaacaggcccgggccggagggctgttccggttcaggcagggtatcccggcagggatcggtatcgggtgatgatggatcgacaggggtcacacggagatccagggaagcgggccgccatcctctggcgtaacgttatccggggtgggagaccggacaaacgacccgggcggaaactcgttgcggctgctgccttccggccctgaccgggttggcgaggcgcccgtccgccgccgatctcccacccccttcttaccctgatccgcgccggatggccagagatgacaatgccggtgccgggaatggtcttgacgatacggttccgaaccattgttttcctggtctgcatccatgctatgccgcttttacaaaggcagacagaggctgcaacgctgacggaagggggcagatttcatgtcgcaattgcaggccatggccgatgttgtgctgcatttgctgcggcaattgatcggttttgccatgcaggtgacgggggcgttggttggttggctggaaaacggcatgcgggcgctggggctgggggcggagctgcgtctgctcgcgctggtcctgatcgccgggctgctgctggcggcttcgctgcatctgcggcggggcgtggtgcgggttctgcttgtggtggcggctgctctctttgcgctgcgggtggcgctggtgctgctacccgtgcatcactgatgcatgatgcaggcagatgcatgagcgccccccttgcctccgggggcaatgagaagctaacccccggataaccggtgaccagggatattcagaccatggctgtcaaggatgtgaagaaggtcgttctcgcctattccggcgggttggacaccagcgtgatcctgcgctggctgcaaacgacgtataactgcgaggttgtgacctttaccgccgatctcggccagggagaggagctggagccggcccgccgcaaggccgagatgttcggcgtgaaggaaatcttcgtcgacgatctacgcgagaccttcgtgaaggatttcgtgttcccgatgttccgcgccaatgcggtgtatgaggggcagtacctgctcggcacctccatcgcccgcccgctgatcgcccagcgccagatcgagatcgccgaactgaccggtgccgatgcggtggcgcatggtgcgaccggcaagggtaatgatcaggttcgtttcgaactcagctattacgcgctgaagccggatgtgaaggtgatcgccccctggcgtgaatgggatctgaccagccgcaccaagctgctcgaattcgccgaggcaaaccagattcccattgccaaggacaagcgtggcgaggccccgttcagcgtcgatgccaatctgttgcactcctcatccgagggcaagctgctggaagacccggcggaggagccggatgagatcgtctatcagcgcacgatcagtccggaagccgcccccgacaaggccaccatcatcaccatcgatttcgagcatggtgacccggtggcgatcgacggcatccgcctgtcccccgccactctgctggcgaagctcaatgagctgggcaaggctaacgggatcggccgtctcgatctggtggaaaaccgttttgtcggcatgaaatctcgtggcgtctatgaaacgccgggtggcaccatcctgctggtggcgcatcgcgggatcgagagcatcacgctcgaccgtgaagcggcccatctcaaggacagcctgatgccgcgctatgctgagctgatctataacggcttctggttcagcccggagcgccggatgctgcaggccgcgattgatgaaagccagaagagcgtgaccggtcgcgtccggttgaagctttacaagggcaacaccatcgtgatcggccgtgaaagccccaacagcctgtattccctgaagcatgttactttcgaggacgatcagggcgcctatgatcaggtcgatgcgcagggctttatcaagttgcagtcgctgcgtctgcggctggcggcgatagcgggccgtcgcggcggcagcctgtaagacttcaaagccgggcgggagaaagcggtcatgatcaaccagatgatcgccggcttcctgctcgctttccccgctctgttctcgattatcaacccgctggggtcggccctgatctatcaggaggttacggccgaccgctcggcagcggaacggagatggctggccgggcggatcgggctttattccctggtcatgctgctggtttcgctgtggctcggctcctatgtgctggcctttttcggcgtgtcgctcgcagccctgcggatcgcgggtggtttggtggtggcggtgcgggcatgggagatgctttccgcccccgaagcccatgaggaaagaaagcaggaacaggcggcccccgcctccccccaatcggcccgcccgcgtgatgccggggtcgcgtttttcccgctgaccatgccttttaccgtcgggccgggtacgatttcggtagcggtggcactgaccgccgcacatcctccgggatcacgggatcagtttgcttttaccattggcagcagcctggcgggagccgttatggctgtcctcatctggctctgttaccgttctgctgaacggttcgtgcgtctgctcggcacgtccggggctcggatcgtagcgcggattgccgctttcctgctgctttgcatcggcacgcagatcattattgccggggttgtcgatacgttgcggatcgtatttcccgggtaaaaaaagcggatgccgcggcacccgctttcttccttcccatacgtcgccagatcgtcaggccgggcgattggcaatcagatcttccaccaccgagggatcggccagggttgagatatcccccagcccatcggtttcattgcaggcgatcttacgcagaatccggcgcatgatcttgccgctgcgggttttcggcagtccgggtgcccactggatcacatccggcgtggcgatcggcccgatctgccgccggacccagttgatcagctcgctgcgcagtgtgtcgctgggttcgtacccgtccttcagggtgacgaacgcatagattccctgacccttgatgtcgtgcggaacaccgaccacggcggcttcggcaacatcgccatgcgcaaccagtgcgctttccacctcggccgtgccgagacggtggccggagacgttcagcacatcgtcgatacgcccggtgatccagaaatagccatctgcatcgcgacgggcgccgtcgccggtgaaatacaggcctttgtaggtggagaaataggtctgcacgaaccgttcatgatcgccatacagcgtcctcatctggcccggccagctatcggcgatgcagagactgccttcggcttcgccctccagcacattgccttcgttatcgaccagaaccgccttgacgccggggagtggcagggtggcactgccgggtttctgggcgatcgcgccgggcagcggcgtgatcagatgaccgccggtttccgtctgccaccatgtgtcgatcaccgggcagcgttcttcgccgacgacctcgtaataccagcgccatgcttccggattgatcggctcgcccaccgtgccgagaatgcgcagggatttgcgggaggtctttttgaccggtgcatcgccttcccgcatcagcgcacggattgcggtcggcgcggtgtagaagatcgaaacgttgtatttgtcgaccacctgccagaaacggctgctgtccgggtagttcggcacgccctcgaacatcagcgtggtcgcgccattcgccagcggtccgtacacgatataggtatggccggtgatccagcccacatccgcggtgcaccagtatacttcgggggcgtggtagtcgaacaccagctcatgcgtgaagctggcccagaccatatagccgccggtggtatgcaggacgcctttcggcgtgccggtgctgccggaggtatagagaatgaacagaggatcttcggcgttcatttcctctggcggacagtcgggggaggctgcctcgatcagggtttcgtatcgttgatcgcgccctgcctgcatgttgacatcgccgccggtgacggtgacgacaatcacgttccggatgcagtcaaccctggacagggcctcatcggcattgcgcttcagcggcactttccgtccgccccggcgaccttcatcggcggtgatgagcaggctggattcgctgtcacggatacggtcggcaaggctgtcgggggaaaagccgccgaacaccacagcatgcaccgcgccgatacgggcgcaggccagcatcgcaatggcggcttctatcaccatcggcaggtagatcgtaacgcgatcacctcgcccgatgcccatggatttcatgacattcgccagacggcagacgcggtcatgcaactggcgataggtcaggctgccctgtgttccgggttcatcgccttcccacagaatcgcgctctgatcgccgcgcgtttccagatgctgatccagacaggcgacagaagcgttcaggcggccatcctcgaaccagcggatcgagacatcaccctcgaaggacgtgcttttgatcagggtcggttcccggaaccacgggatgcgcctggcttcttcggcccagaaagcatcgggatccgttccggcctgatgagtcatcaggctgtgacggcgggcattcacatgggccgaatccgcaagagacggcttcacatgaatcagggtcggctcggacattcgtttcctccggggcggctcgcgttatccacgcgctcgattggctgtatatatcgtgtgataggaaactttcgagtggtttttgcacgtcttcacgcaacagacgaaaataaatattcctttccctgtcgaatgtgttgcgccgcctttattccatgccggattgaagccgttttttgaccagggcaatccacggcgcattggcaggcgcctctttcagggcgcgctcgaacatggtgcgggcttccggtgtgacctttccggcgatttcagagtctgcttcggcgatccgggcggcaaggcccggttcgtaccggacagcaagcgccttgcgccacgcggcgacggcttgcggcatgtggcccatcctgccttccacggtgcccagcagcaggaagccctgacgcgcttcctcgctatgcgggtcaagcgaatcgattcgttcccgcagctttgccaccagatcattgatattccgagcctgtctctgggcctctgccatgcgctgtgcatagggggcggagggaacccggggctgcccggatcgccagtagagcgccagcgccgccaacgggatcagtatcatacagcccagtatcggcaggcgtgcggcagaacgtggagcagtatcaatgctggcatcgctggccagcaaacggcgctgcacttccaccatggcggtggcgtgttccggtgcgccaatgcgcccctcggccaggtcgcggtccaattccagcaactgcgcgcggtgcagggccatggctgcttcccgctgaccgcgcagcatcacggtattttcccgcagtgaccagccaagtggcgccacacacaccaacgccagagtagcgataaaaagccagatcatggacggagcaacctgttcagccggtctttttcatcatcattcagcgggggaatggccgtggtgcgctttctgcgcgctgccagcacgatggcggccccgattcccagcgcaaaaacgggtgacagccataacagccatgtcagcggggaaaatggtgggcgcagccgcacgaattcgccgtaacgcgcttccatccaggcaatgacctgggcatcactgtccccggcggccacccgttgccggaccttggcgcgcagatcccgggccagatcggcttccgaatcctcgatggattgattctggcagaccagacagcgcagttgggaaccgatcgcttcggcgcgatgttcctgtgccggatcgggcagcatctccgacgggctgctgaccgcccatccatgccggaccggcagaagcagaaacaggatggtgctcagagccagccagcgcatggccagccggggcatggccagccggggcatggccagccggggcatggccagccggggcatggccagccggggcatggaacgagaccgaatcatggataggctttcagcaaaggctcaatctggtccttgataacctgctccgtcagggggccggcccatttccagcgcacgatccctttaggatcgacgaagtaggtttccggcacgccatagacaccccaatcgatggcggtaccgcccgctgcatccctggcaatccgttggtagggattgccatccgccttcagcatggcagcggctgcttcaggcttgtctttgtaggcaatgccccataacgcgatgccgcgctgtttcagcgccatcaacgcaggttgctcgattttgcagggaacgcaccaggacgcgaagaaattcaccagcaccggatggccatgctgcgtgagggcagccgaggtaaacccttccggagagggagtttgcgctggcagatcaaagaccggaacgggtttgccgatcagcgggctggggacgccgcgcggatcgaaatgcccgtcctccataccatgcagcatgccgagaaacgcggcaccggcagcaacggccagcaccagcggcacggagagcagcaaccggcgtgtccagacaggccgtgaaggtggtggggaggggatcatggaatttgactcttccggcgctatcaggcgtgaacggcacggctgcgggcaggggcacccacacgtaaccggcggtcggtcagggacaggcatccaccaatcgccatgaccagcgcacccagccatatccacggcgccagcggattgacatgcaggcgcagtacggcagtgccatcccgttcctcacccagcacggcatacaggtcacgcaggccgttggtctggatagaggtatcggtggtgttctgccgctgcaccggataggcacggcgggacggggtcagcacggtgacgaggtgcccctgactggtcacggtgatggtggccacccgggcgacgtaattcgggccgggcgcatcggtgatgctgtccagtgtccagcgatagccaccgagttcggtggattggcccggtttcaccgcaacaatggtctgttgggccatcgacatcgcggcaataccgcagatggtgatccccagcccggcatgggcgatggcggctccccatgcggatcgcggcaccccaccgagacgggcgaaactggtacggggcggcacacgaaacagcttgatccgctcgatgatgtcggcgaaggagccagtaatcagccagcctgcacagccgaaagccagcgccggcaggaactggcgtcccatagccccccatagaccggccgcgagggcaaccagcgccgcccaccacagccgggacagggcaggccagagccgggcgcgtttccatggcagcattggcccgaccgccatggcgatgaaaacgggaatggccagcggcatcacggtagcgttgaagaagggcgcccccacgctgatctgcgctccgaacagtaactgtgcgaacagcggataggtcgtgccggtgaataccacggctgcaatggagcagagcagcacgttgttcagcaccagcgagccttcacgcgaaatcggtgcaaagacgccggacacggacagaaccggggcgcggaacacgaacagaagcagcgcagagccgatcaccagtgccagcaggcccagaatgaacacgccgcgggccggatcattggcgaaggaatggacggaattcaggatacccgaccgcacgaggaacgtgcctgacagggaaagcgaaaacgtcgcgatggccagcagaacggtccagattttcagcgcctcgcgcttttccacgacgatggctgaatgcaccagcgcggttccggtcagccatggcagcagggaggcgttctcgaccggatcccagaaccagaagccgccccagccgagttcataatacgcccaccatgatcccagtgcgatgccgcaggtcaggaacgcccaagaaaccagcgcccatggacgcacccagcgcccccaggaggcatcgatccgcccttccagcagggccgccaccgcgaaagcgaacgggatcgcgaagccgacatagccggtgtagagaataggcggatgaatcgcgaggccgggatcttccagcagcgggttcatgccgctgccttccatcggtgcaggccatatccgtacgaacggattgctttcgatcaggctgaacagcagaaacccgaccgaggacgcccccagcacaccgataacccgtgcccgcagggcggaaggcaggttgcgcccgaacgctgccaccgcgccgccgcaaagcgcgaggatcaggcaccatagcaggatggagccttcatgatttccccatgtgccgctgatccggtacagcagcggcttggcggactggctgttctgggccacgttcagcacggtgaaatcattgaccacgctggcccacatcagggccccgaacgaggtgatcagggccatcatctgcccgagcgcgagggccggtgccgctgccatcagccttgcatcacggcgctgtgcaccccagagcgcgagaatggcctgcgcggcggcaaaggcgcaggccagtgccagcgcgaaatggcccagttcaggaatcatggatcagccgcctgtcctgtttttctgaagatcggcggtcgaggccgggttcatcctgtaccatgtgctggcggctggcggcggaccggaagccgggttccagcggccgctttttttcagggcctcggccacgtctttcggcatataggtttcgtcgtgcttggccagcacttcggaggcatggaagctgccatccggctcgacggttcccagcgcgaccacgccttgtccttcgcggaacaggtcggggagaatccctgtaaaggttaccggaaccgaggccttgccatccgtcaccacgaatttggcggcgggctggccgttttcgacctcacgatgcacgctgcctgcctgcacgagaccgccgagacgaatggtccgtcccgccgcgacatggttgtttgcgaaatccgacggggccatgaagaacaccagattatcgctgaacgcgaacagggtcagcgcggtggcggagccgaggccgatgccgcaggccagcaggatatacagacggcggcgtttgcgggtcatgatcaaaatttcctgaagcctgttccgcatgcagggggaaactcatgcgggagacggatgcgtgtcactggatgcaggccactacgtattctggcccctgcgtcggcctgcacgtagccccgtttcgagcgctgccagtttttttcgggcagaggcaagccgtgtcgccgtcatcaatcccatgatcagtggcaggcccagcgcaattgtataggccgcgatgatgaaagacgcatgggtcatggaatgttcccttgctcggcccgggcggcattggccagcagcagggcgcggatgcgccgttccatgaccgccgccctgatacgggtaagcaccagagcaatgaagatcagggtaaagccgatggcggaccagagcagcggccatagcatctcggtggacatggtgggggcaccggtcaggctgatgctggcggtctgatgcagcgtgttccaccaatcaacgctgaatttgatgatcggcaggttgaccaccccgaccagcgccagaatggcgcctgcgcggtagccgcgttgcggatcgtcgaaagcccgtaccagcgcgatatggcccagatagagaaaaaacagcaccagaaccgatgtcaggcgtgcatcccatacccaccatgccccccacatcggcttgccccataaacttccggtggcaaggcagatagcggtgaacatggctcctaccgggctgatctccgttgcagcaagatcagccagaggatgccgccagatcagagaggcggcggaggcggcggccagcgatgcatagcccatggagccgagccaggcggcaggcacatggatatacatgatgcgcacggtatcaccctgctgccagtcggcgggggcatagaacagtccccagaccagtgcgaaggcggtgataaggattcctgccactgccactggcgggacgatttttccggcgatgcgcaggaaccggcccggattggcaaaacgatgcaggttgggtttcgcacgcatctccccacccgatccgggcatggcgcggcctgaaggatttttccccgccgcgccttccggcagcgcgttctggtgagtatcctgatctgataaagctgacgtttccacggctccatcataccctgccatgcgttccgtttgaagcgcctgcttgttaccttaattttaagtgcctgctggctttgaaaacgaaagtggaaagtcatgttgttcgcagtcatctgcacggatcgtgaaggcggtcttgagcttcgcaagcaaacccgcccggcccatctggaatatctgcgggatcacgaatcgcgtctggtgcaggtcggaccggttctgaatgcggcaggggagccggaaggcagtctgttgatcatcgatgccaccagtcttgaggaagcccaggctttcgcggcgggtgatccttatgcgcaggccgggttgtttgcctctgtcacggtccgtgcctatcgtcaggtgttcaaggacggtcagttcgtcggatgaccgcatactggctggtgaaatcggagccggatgccttcagctgggatcagcaggtggcgcatggtgtggagccatggaccggggtgcgcaaccatgccgccaagcgcaatctggcgacgatgcgggtgggcgatctggcgtttttctaccattccaatattggccgggagatcgtgggcgtggtgcaagtggtccgggaagcctatccggatcccactgtcgaggcggatgagctgagccgggatggcagcaatccctggctctgtgtcgatatgcgtgccgtcgggaaaatgccctctccggtgacgctcgccatgatcaaggcggagccgggcctggccgatctggcactggtgcggcaatcccgtctgtccgtatcgtccgtttcaccgcaacactgggcgatcctgtgccggatggggggccagatggatggctggaaaggtgcggaaggctgacgatgacagtcagttgcgcacttcgttttctgtgccatgtgcaggatctgtccgatcccggagccaaagggtttcctcctgcgccgggtggattttttggtctgttcgccatccgtcggggggataatgtccgggtttacgtcaatgcctgcccgcatatcggtgtcccgctggaatgggcgccggatcgcttcctgtcttcggacgggcagcatattgtctgcggcacgcatggcgctctgttcgatctgctgagcggagcgtgtcaggctggcccatgtaagggtgatcatctgaccatggtgccggtcacgatcgagaatggcgcggtctatgtggctgcggatgccgggctgtagagtccggctgctatgatgaaggaacaagggagccacgttatggccggaaccgaccaaaaacccgtaccggacagggacggtcacaaggaaacagtgactcccattgatccggcaaccatcgctgatacggctcagccggtggagcatggcggcccgaaaggaccggaaccaacccgtttcggtgactgggaacgtaacgggcgctgcattgatttctgacgggaatggctgatggacgatgcggcgaaggtttagtttttgggacgatttgccgcgctgcgcgcattcagaccgataatggcgatcgccgccagcagtgaggtcagcgcaagacgcaacccccattgcccggccatgaagccgataatcggcggcccgcacagcccgcccgcataaccgagtgttgccacagtggcgacaccggcattgccgccccgtcgtcccgatgcggcgaacaggatcggcaccacattcgccatccctatccccagcaatgcgaatccggccatggaaaccagtggctgacgggtggcaagcgcggtcgccagcccgatggcggcgatcagtgcagacagcgcacaggtccgtaccgggcctaaccgggtgatgatcccgtctcccaccagccgcatcattgccatcatcagcgagaaagaggcaaatccgccgccgctcagtgccatgccttctttcgacagggtgctcatataaacggctgaccagtccatcatgccgccttccaccataaaggccagaaagcagaggcatcccagatagatcagcggtggcgtccatcctttttcggcgggtgcttccctgtgttgcgaaggagtgccctccaccggacggttgatcagcaacgcggccagaaacaccagcatcagcatggctgcggacagacccatggctaattccgcgctccatccccatgcaaacaggaggctggtaaaggcggaaccagccataccgcccaaactccatcctgcatggaaggaggacatcatggcgcgacctccttcccgttccagccgggccgcttcaccattcatggcgatatcggtggctccatgcgtgccgccgatcagaaacagcgctccggcaagggcgggcatggcccagtctccgcaaaggcgggagaagggtggcaaaagcacggagagggcaaaagccggcccgctccaactggacaggcatgcggttccgtaacgggcggcgagacgtcccgccagcggcatagagaccaatgcgccaacggccatggccagcagggcaaagcccagcgccctgtcactgagaccggcatcacgctgtacatgagcgacgctggcagaccatgtgccgatcccggcgccgcatccgacgaaaagcagggccgtgccgatccgtgcacgatggaatgatctgatcaggagtctgtccccccgctggccagcgtttcgactgtgctccccagcgtttcggggtctccctcgacccgcaccagcttgtcgcgtgcggtcagaccctgaagcagggtgatgcgggaggcaggcacgcgcagggctttggccagcatgtcccgcaccgcttcgttcgcctgtcctttatcggcaggggcactgacggagattttcagccgcggtttgccatcagccccgggaacagtgcctcccagcccgattttgcgggctttcggtacgacacgcagggcaagggtgatgccgttttcgacactgcgccagatgctcatcgccagatgcccgtggatggcattattgcagcaatgcgttccactgtccgaatgcgatagcaatatacagcttgcccagcatcggccggaccagcagttgcagcaccagcagcacgatcagcgggctgaggtcgatcgcacccatattgggcagaatactgcgcaccgggcgcagaaccggttcggtcacgcgatacaggaaatcggcgatcgaccagaccagtcggttgcggctgtccagcacgccgaacgacatcagcgtcgagatgatcgccgatagaatcagcgcatagatataaagctggatcaacgtatccagcagattgaaagcgatcgtgagcacgcgaagcgtctccgtcaaacatcaggtgacagtaggtctggtcgtttggtctagccgtgccggcttgggaaccgcaagcatgttgccccttctgccttgcaaatcaggggggagggtgcgatgcagattcctctccactatcagcttgacttcggcgcgcgcgcgcggcattacgcgccgcctacgctgtaacgcagtgcaggagacgacgcggagcggggctgtagctcagttgggagagcgcctcgttcgcaatgaggaggtcaggggttcgattcccctcagctccaccacgcttcgcgggtcgttctgaaaatactcttccccattcttatctgctttcttgaagccgcaggctgctcaggggtggagcgatctcttcaagggatttgttttcggcctccacacccagccggaattctaccaccccggccgccatcatcagagcgcctccggcagcgtaaccccacatcacagcgtttcgtcccgcatcgatcagatgaccgaacagcgctggtcctgcaatgccgccaatcccggtgcccagcgcgtagaaaatcgcaattgcgacggcgcggacttccagcggaaaattctcgccgacggtaagataggctgaactggcagcggcagaggcgaagaaaaatacgatcgtccaggcgactgtctgtgcagttgcatccagcatccccgcgccgaacagcagaccaaccaaggtcattagcaagccggagagaagataggttccggtgatcatggttttacgccccagcgtatcgaaccatcgccccagcagcagcgggccgagaaaattcccgagcgcaaaaggaaagatataaaatccaacctgcgcattgccgacgccttcgaatttattcagcaccagcgcatacgtgaacagcagcgcattataacagaatgcctgagcgcccatcagaacggctgcgagaatggttctgtcccgatactgcgtgaacagactatgcaggctgggcagaaaccagcttttgacatcggtgcgcagacgtaaccgggtgggaggaatgggcggaagcgcattatccggtctgtccttggcgaccatcgtttcgatctggtgcatggcttcatcagcctcgccgggtctgccatgcgtcatcagccagcgcggactttccggaatccagcgccgtaacagcagcactatgaagccgatcaggcccccgatcacgaagctcgcccgccagcctgtttcctgatcaatccactcgggatggcccagcgccagcactgatcccagcgctccgatcgccgcgccgagccagaacgaaccattgatcgtcagatcgacaaaaccgcggctgcgtgccgggatcagttcctgaatcgtggcgttgacggcggcatattccccgccaatgcccgcaccggtcaggaaccggaacagcacgaaggaccagaaactccacgataatcccgacaaaatcgtagcggtcagatagagcagtacggtcagggtaaacagtttcttccgcccaagccggtcggtcagccagccgaaaaacaaagcccctccgacggcacccgcaagataggcgctggctgtgagaccggcctgtccgccggtaagcgtcagggctggactgctggcgattgcacccgccagagacccggcgagagtaacctccagcccgtccagaatccaggtaatcccgagggctatgatcaccagcgtgtgaaaccggctccagggcagccgatccagccgagccggaatatcgcttgtgactgaaggtggggattgcaccctggaatgtgggcaatcggaatgtatgcaatcagcctggcgcgcttccatgaaacgcaaaacggtcgggcagggaggccggttgcatgccctcctgtccggccggaatggtcagaccttactgtgcgctggcgctcgcctcgctgcgatgtgcaccgacgcgggcggccagggcggcagccatgaactcgtccagatcgccatccagaacggcacccggattgcctttttcaacgttggtgcgcagatctttcaccagctgataaggggccagaacatagctgcggatctggtggccccagccgatttcgcttttggcgttttcctgttcctgtgccgcggcttcacgcttttgcagctccgcctcatacaggcgggctttcagcatgttcatcgccgtggcgcggttgcgatgctgggagcggtcggtctgacaggcgacgatgatacccgatggcacatgggtgatgcgaatcgcgctttccgtcttgttcacgtgctgaccacccgcaccggaggcgcggaacgtatcgaccttcagatcagcttcgttgatctcgatctcgatattgtcgtcgaccaccggatagacccagatactggcgaaactggtctgccgccttgcggcgctgtcgaatgggctgatgcggaccagacgatgcaccccagcctcggtcttgagccaaccataggcggaggggccggcgacctgaagggtcgcggatttgatccccgcctgctccccatcactctgttcgatcagcgtgactttgtaaccatgggcttcggcccagcgcgtgtacatgcgcaacagcatttcggcccaatcctgagcctctgttccgcctgcgccggaattgatttccagataggcgtcgttgccgtcagcctcgccggacagcaggctttcgatttccagccgcttggcttcggcggcaatggtttccagcatgcggcgggcatcggtggccatggcttcgtcgccatcggcttcagccatttcggccagctcggtagcgtcgctgacttccgattccatgcgcagcacgccttccacctggctggccagacgggtgcgttcacgcatcaccgcctgcgcggcggcggagtcgttccatagatcagggtcttcggcgcgggcattcagctccgcaaggcggtgttgagcggcatcccagtcaaagatgcctcctcagcagtgcaacggactgcttgatctgctggttgagggcgtcgatttcggcggacatggtcctgttccggtcatactgaagtcaaagaaaacgagaggcgctcaatacagcccacccattccggtgtcgagaccgccgctgcttcccccactgccggaggaatcgccgggctgtgccgtcccggatgcgctgccgccatcaatcatggcacccccatcgggctgaccgggcttcagggcatcccaaccggccgggcttttcaccagtgtcatgccttccggcatcgggaattgcagcatgggatgatctttcagcgcggcactcatatattcgcgccagacaggggctgccagcgctccgccggtttcgtgttcgcccagagaggtggggttgtcgaaaccgatccagacgatagtgaccagcgtcggtgtaaagccgccaaaccaggcatcaacgaaatcctgagtcgtgccggttttgccggcaatggggcgtccgcccataccgatcgaggcctgatagccggtgccgtgtgccaccacattttccatcatggtgacaatctggaaggtgctcatcgcatccgccaccggattgcgcttgtcatccagcaccggcccggcatcggtggagatggccgggggagcagaggaggaaggagacgttgcgggcggggtcgcaggcgttgtgcagttctcgcaggtaatgtcttccggcttccagatgacatgcccgtcacggtcctgcacactgtcgatcagatggggtgtaaccagcctgccgccctgcgccagcgacgcataggcgccggcttcacgcagtacggtggtatccaccgcaccgagcgcggcgggcaggactttcggcatggactcgaccagatggaaatccatcgctgtcttggccaccgcctccataccgactttctgcgcgacccgcagcgtcaccagattgagcgatttttgcagtgcgacgctcagcggcaccggaccggagaaggtcatctcatagttattgggccgccacacacctgctgcccccatattcatcacgaagggcgcatccagaaaggtctggcccggtgcaatgccctgttccagcgccgttagataaacgaatggcttgaatgagcttccgggctgacggttggcctgtgtcgcccgattgaactggctggtttcgaaactccagccgccgctcattgccagaatacggcccgagcggggatcgagagaaacgagcgccccctgcacattgggaatctggcgcagccggacatgcagggccgggccagggacttccctgatctgggtggcgggtgttttgcgggtcgatgaggcggcgggttgaacaaccgggctgccgagcgctgcttcgtctacctcgaccatcacgacatcgccgacggagacgacatcattcatccggcgggggacgccacccagcttcccgtctttcacgggacgtgcccatttcgtatccgccagttgcatcatgccatgatgcaccggagcgggggttgcggtgggcagcgggctggcgggcggatcggtccaggccagggaggcatcggcaggctgaattttcatcactacagccagtcgccagttgcgtagcataccggccggacgtggcagcttcgccagttcggattcccattgcgggctggaaaggctgttttcttccagatgggcaacgggacctcgccagccgccatgggactgatcataagccagcagcccccgatgcagcgcctgatcggcggcattctgcagggctggatcaaggctggtgcgcaccgacaggccaccctgtgtcgtggtgtcggccccgaagcgctcgaccagtttgcgccggacttcctctacgaagtaaccggcgcccgggatgccttcgggccggtggaacgcggtgggtagcacaggttgttgtttcgcttcggcggcctgctcacgggtgatggcatggtcttccgccatgcgatccagcacccagtcccgtctgccccgcgcgacatcgggatagcggaacgggttgtaattgttcggtgctttgggcagggcagccagaaaagcggcttccggtattgtgatttcgtccagcggcttgttgaaataggcctgtgccgcggcggcaacgccataggcgccctgaccgagataaatctcgttcagatacagctccagaatgcgctgtttgctaaggctttcctcgatccgcagggccagaatggcttccttgatcttgcgggcgatcgagacctcattggtcagcaccatgttcttggcgacctgctgagtgatcgtcgatgcaccgatgggccgctttccatcatgtaaatggttcagatcggtgacggcagcccggaacatggcaacggggtcaacgccgggatgggtccagaaatgctggtcctcggcagagacgaaagcttttttcacaatgtcgggaatggctgaaaatggcacgaagacgcgccgttcggtggccagttcactgacgatctggccgtcagcagcatagacgcggctcatgacacggggttgatagacgcgcagcccctccagatcaggcagatcggatgcgtaatggcgataggcggcatagatcgcgaccacccctgtcagaccgcccagtacgatcaggccggccagcgcgccgatcagacggccgatccagcgaaaacgcccgccagcccgtctttttccggcttcacgcgccgcatgccgcgaggactgattatccttgcgttgtttgcggggaggctcccgccctggttccggagaaggaggcgccagccgttcccgcgcggtcagcaccgggcgcggcggaacggcaatggaacggtcggggggcggcaaatcggatgacgtcatgcgcggctctgtatcagatttcgtgatcccgtgcatggggaaggtgactgatccgccatgcgatggtgccgtgggctggaagcgtgtggaaaagaagtcaaggcagggcgtttatgtccgtcaatccatgatcgggcacatggtgcctgatggacggagcatgtcgggtcatccccgcatggcatagccggcgctggtggcgaaataggcttccaccgcgcgggtcatggcggtggcgatccgtatgcgatggtcggggcggcgtaacaatgcctcgtcctgacgattggacatgaagcccatctcgaccagcacactgggaatatcagcggctttcagaacgacaaagccggcatggcgggcaggatgggtcagcatcggcacggtgctgtcgaggctgctgaccatactgtgtgacaatcgggctgatccaattttggtctctctccgcaccagactggtgagaatacgggcgatatcgggcggctgattgctgaaggccgggccgccaaaccggtccacgctgttttcccgtttcgccagagacgctgtctgcgcgtcggaggctgatgttgccagcgtatagacgctggccccgcgtaccccggcattgtgcagcgcatccgcgtgcatggagatgaacagggaagctcccttgctctgggcgcgatccacccttccgtcgaggggaatgaaggtgtcgttggtccgggtcatttccacccggtagcgcccggtccgttccagctggcgcttcagttcctgtgcggcagcaagggcgacatgtttttcatacgtgccggtgatgccaatggcacccggatctttgccgccatggccgggatcgagcatgataagacggggcgcgctgtttttacgggcagcagattggccggctggcggagcatgcaatgtttttatggcatgaggatggccgtgtttctgcggcccggcagcctcggcctctgccatgctgtccagcaatgcggggggcatcatccagctggcaagcaggcccgccctggcaaggagccgcccggaggtcatcgcgccgaggaagctgcggcggtgcagtgacagaagatcagccatagtgcgtgtttttaacaccgtacggtcggttttgactattaagctttgaaatatggcgcattttgggcggcctgtctcctttggatcacaggatcgcgtcttgcagtgggccggcatttgttccatgctgggtgtgccagagagattgccagcggcgtctccatgcccgccgacagatcgttcggatcgtcagccggatgcatggggccaaccgccgggctggtttcatactggacagcgagcgcacccgcgccgcggccacgcatcatgtggcgttgggaaaaccgccgggtctggcgcctgaaacggctgccgcacccagttttttagaccgaaggatcgagacgccaggctgtgtggctatattcggaactgactgagattgtcatgccatgcgcctcaggcgctggcccggatacggttgcggctgtgcgtgcccttcgcgacgatacaccgacacaacgtcatgcccggtggagcgcgccgttcgcgcatatcccgggtgtgtaccggagctcattattcaatgaccaaaaaaatgctcatcgacgccagccatgcggaagaaacccgcgtggtggtgatggatggaaaccggcttgaagatttcgacgttgaggcagcgtcccgtaaacagatcaaagggaatatttatctcgccaaagtcgtccgggtagagccgagccttcaggccgctttcgtcgaatatggcggtaaccggcatggctttctggctttcagtgaaatccatcccgactactatcagatccctgttgccgaccgtcagcgcctgctcgccatgcaggaagaggaagcacgtgaggaggaggaggctgaggaagccgaattttccgccgctgaggcgcgtcgttccgcctcccgaccgttgaacaacgctcgggaggtcatccaggcggattcagaacagcccgaagcatccgatccgcaagaggacggggccgatcatggggtgcaggatgaatccgccgccgatttttctggagaggccggggatgaggggagcgttcctgcctccgccggggaaggcgatgatcaggaggagagccgtcaggcctcgcgcccggcccgccagaaagaagatcgtgagcgccgctctccccgttttctgcgcaattataaaattcaggaagtcatcaagcgccgccagatcctgctgattcaggtggtgaaggaagagcggggcaataaaggggccgcgctgagcacttatatttctcttgctggccgctattgcgtgttgatgccgaactcgccgcgtggtggtggcgtgtcacgcaagattacctccgccacggatcgccgccgtctgaaagacattatcggcgcgctggagatcccgcgcggcatgggcatcatcgtccgcacggctggcgggaaccgcccgaaggcggagatcatgcgggactgcgaatacctgttgcgcctgtgggatgatatccgcgacatcaccctgcgttcatccgcgcccgcgctgattcacgaggaagccagcctgatcaagcgggcgatccgtgatgtctataccagtacgattgaggaagtgctggtcgatggggaagaaggttggcgggctgcgcgcgatatcatgcgcatgctgatgccgtcccatgcccgcaaggtgatctgctggaacgctgacaaggaacgtgccggacagcccctgttcgctcattatcaggtcgaatcgcaacttgatgccattctggcgccgaatgtttcgctgaaatccgggggctatctggtaatcaaccaggccgaggctctggtggcgatcgacgtcaattccggtcgttccacgaaggagcgggggattgaggaaacagccctccgcaccaatctggaagcggcggatgaggtcgcccgtcagctgcgtctgcgtgatcttgccggtctgatcgtgatcgatttcatcgacatggaaagccgcaagcataacggcatggtcgagcggcggctgaaggaagcgttgaagaacgaccgtgcccgcattcaggtcggccagatcagcagctttggcctgctggaaatgagccgccagcgtctgcgcccgtccctgaccgaaaccagcatgatcacctgcccgcattgcaatgggcttggtctggtccgcaccactgagggtgcttccgtccatgtgctgcgggcgatcgaggaagagggcgcacgccgtcgctatgccgagatcatggtgcacgccgctgccgatgtggcgttctacattctgaacaatcgccgggattttctggccacgctggaatcccgcttcggcatgaaggtgcttttctccgctgatacgcagttcagtggttcccagttgcggattgagaaaatccgtgcccgtgcgatggaagacgtggtccggactccgctgatcggcgttgctgatccgcagccgagcgttgcgggtgatctgtatgatttcgctgatgcctctgacggttttgcgacgttcgaggcggccccggtggcggcattgcccgtggctgtgcaggcagaaccggttggaaccgccgaggaaggtaacaacggtggcaggctgccttccgcggaaggcgattctgaacccgggccggatgatggagagcgccgccgtcgccgtcgtcgtcgtcgtcgtggcaatcgccgtaatgacggggccgagaatgggatggatgcccggtcggagcaggatgagaacggcaatccggtcgaagagggtgagggtgtcaggcacggggatgccaatacctctgcgctgcccgtggaaaccacagagctgacagtggccggagttgcttccaaagaaaccagtgcggaaacacagggcgacgccatcgatggtacgcaggctgtctccggtgaatttggtgatgagtttgcggaggattcccgtccgcgccgccgtggccgccgtggcgggcgtgggcggcgtcagcctgctcaggcgaatggccatgatgcgggggaagtggcctataccggtcccaccccggctgatccgttcggtcagcagccgctggatgtattcgacgtgatggatggtattgagcaaccgatgatccgtgacgggaaagtggatcagggctcccgctccgaacgccatcctgacctggtgcctgagccggttgtcgtgtctgaggagcaggctgagccctatattgcgccccccatccagccagtggtgattgaggataccgctccacgggccagacgaggctggtggaaacgctgaggcaacccctgttgcggaagcctgaatgaaaaaaggccgggtcgcgcgtcttggaacgctcgcccggcctcttttgtccgcgcatgataaaaatcatgtcgatgggctttacaggtcagccccggaacggtattacgcgcgcctcggcaggttgggcgcatagctcagttggtagagcagctgactcttaatcagcgggtccaaggttcgagtccttgtgcgcccaccaacttgccgaaaatcccttctattttgtcgtatacgcccgaatattctggcaatatacttcttgcatgcgatgcgatcactgccgtcgttcagggatgtggacatccttcatcctttaatacagtcagacattttctagtcaccaaaaccgagaaaatttccgtgaaggcagtggtaccggtttttctggtcatgactgtggtattggcgggtgcatcggacactgctgctaaggctgataaagccgctcctgatccatctgttatggtgcaggcaccctggtctgttcccgatatcaataccctgccgcaggatgaatggggccgtacggtcagatatggccgcgatttgattgtcaggacagcgtccctgatcggtccggaagtgtctgatccggcacggcgttttgccggcaacaatctgaattgtcagagctgtcatctgcagggcggcaccaaaaaatttggcctgccactgatcggtgtattcgcggattttccgaattatcgcgcccgttccggcactgtcgggacaattgaggatcgtgtccagggatgcatgcaacggagcatgaacggtaagcctctgccttgggatgggaaggagatgaaggcgatcgtctcctatctgcaatttctgtccactggtcgtcctgtcggtgcgcctactttgggacgagggtccggccgcatgccggagctgatgcgggctgctgatcccgtgcgtggtcagaccctgtacaagcaggtttgtgccgcatgccatggtcaggatgggcagggacagcgtgtcggcagagtgggtgatgcacaaggatacgcggtaccaccgctatggggggctgacagcttcaataatggtgccgggatggatcgtctgatcaatacagcgaattttatccacaacaacatgcctgatggtacgaactggacacagccggtgctctccatcgaggattcatgggatgtggcggcgtttatcgatatacagccaagacctgccaaagcagatcttcagcgggacttcccgaacaggatggaaaaacccgttgatacaccctatggcccttatgcggacgggttcagccagaaacagcatgttctcgggccgtttcagcctattcgcgatgctctcaagcgtctgcgcaatgcagacagataaatatgcttttgaggaatatgatgtgtggctgcatcaccatgatgatgggattccgggatggaatcttttttgtcagccagggcactcaagatagcgcgtgatacgtctgaaggcctgttgcgcatgacggatgcactgctcggcttccacagccgtatgatccagcagagatctgaaacgcagccatccccccgatactccatcgcgccctagatggagatgttgcagaccataagtgtcatgcagaccatgtctttcaagttgtctcgcaatatgcgcagcgccaagcttcgatccttcggcgacataaagccagccgagagcagaggaggtatcttttgcaccggttggaatggctgactgcatggatggcagtgtcagtccaagggcagcggcatcggcctcaatggccggcagccggttgcgctccgccaggtcggggatcagttgaagcagtgctttcttctgatagagcggaacgatatccctgtgaaaacaatactgtgctgtcagaaaatgcctgtatccatcaagggtaatcagaagttttctgacaatccggtccagcctgtcgtgataggaatatgtctgttgtttcagtgtgattgataaattgtcttgcattgcgaaaactgaaagaaaatatttttatcaataacgatctaccaacaacatggtttctgacggcctttccctgcattcctgttgcaattcgtcacgtttgtgatgccggcctgttacgcaaccggtgtttccttcggttgttgccaccggtcaggtggtgatggccagaattcaggaggataattcacaatgcgcaggatcatgttaacaggtgcgggcttgctggcttttagcgtggctggtgctgtctatgctcagggcgtccctccggttccggagggtccagcgcatgggcctgctgcccctatgctgccgccggatcaccatcatccgttcgggcctcctcctccgcccccgtcaaaggctgcatttttcaggctccaccgcggtgatctgagtgtcgccgtcaaatgtgcggaaggagagaatacgaaaacatgtgtcgatgaggcgagccggctgatggatcatttcgcctcggtcgcgaacacgcactgagtctctatgcacgggtcggcatccgccacgcgctgccggtttcaggcgtgtggcagcgatgtcagcaaggtttcggccagatgggacagggggccgttttttctggcaccgttcatgcgatcattgcggcgcagcgtcagcagacgctcgtgcagggcgctgcgtccgtcatcagccagatgccggtcgagcaggatcaccagctcccgcagcatgtccgtggcagcattcagctcattgctcagggccagaatgcgtgcgtcgggcgtatgatggctgaatggcatggcagctccggtatgattctcatggtctgttcaggaacaagactgttttcataaacctgaatgatcttcgggagatacggagaactgttcgctgcttttttcaacttttgagcacatgtccggctgttgctgctgccggaaacatagctgaccatggagatggccgttacttcatgcgataatggtgggatgtcccatgtcgagcagcgtccgtttgcccctttctcctccctttacagccatggtctggtgagggtggcggcatgtgtgccgcctgttcatatcgccaatccggcccggaatgcggacgagattgcggctttggcaatgcgtgccgatgcgcagggcgtggcggttgtggtattccctgaactctgcctgagcggatatgcgattgacgatctggtgcagcaggatgtgctgctggatgcggtggatgcggcgataggcgcgttgctacgccgtagcgcgggctggatgagtgtgatcgtcatcggtgcaccggttcggcagggcgggcgcctgtttaatgctgccattgtgctgcatcgcgggcgcgtgctgggggtggtaccgaaatcctatttgccgaattaccgcgaattttacgagcgtcgtcatttcacgcccgggctttcggtgcaggggcagagcattcgcatcggtgatgaggatgcgcctttcggcacagaccttctgtttgcagccgaggatgtggagggattgatcctgcatgtcgagatctgcgaagacatgtggatgccggtgtcaccggccagtctgggcgcgttgaacggggcgacggtgctggccaatctttccggcagcccgatcacgatagggcgtgccgacagtcgtgcattgctgagccgctctgcctccatgcgctgtgtcgcggccacggtctatgccgcggcgggttggggggagagcacgaccgatctcgcctgggacgggcaggcgacgatttatgagaacggaaccctgctggccgaaacccctcgcttcgcgcaggaagccacgatggcggtggccgatatcgatccgggcctgctgatgcaggagcggatgcgggtgcatgggttcgaggaaaaccggcatgcaatggcgggcgcggccatgcgccggattggtttccggctggatccgccctcccgtgatctggggctgcgccgtcgggtagagcgttttcccttcgtgcctgccgatcccgcccgtctggctcaggattgctatgaggcctacaatattcaggtgcgcggtctggcgcagcgcctgtctgcggccaagatcggcaagctggtcatcggggtgtcgggcgggctggattcaacccatgccctgatcgtggcagcgcgggcgatggatgtactgcagcggccccgctccgacattctggcctacaccatgcccggtttcgcgaccggggatgaaacacgcaacaacgcgctggcgctgatgcgggtgctcggcgtgtccgcgcatgagctggatatccggccggccgcccggcagatgctggccgatctggagcacccttttgccggaggggaacaggtctatgacattacgttcgagaacgtgcaggccgggctgcgcaccgattacctgttccggctcgccaatcagcataacgggattgtgcttggcaccggtgacctgtccgaactggcgctgggctggtgcacctatggcgtcggcgaccagatgtcgcactataacgtcaatgccggagtgcccaagaccctgatccagcatctgatccgctgggccgggggcagcggcgatttctccgatgaggcacgcgtgattttcgaggcgattctgaacacggaaatctcgccggagctgatcccggttgcgaagggagagaagccgcagagcacggaaggtaccattggtccctatgccttgcatgatttcaccttgttccatgtcctgcgctacggattccgtccatccaagatcgcttttctcgcctggcacgcctggcatgacgcacagcagggcgtatggccgcccaactatccgttagatcagcggcgctcctacgatctggccgatataagacagtggatgcaggtattcctgaagcgtttcttcggcttcagccagttcaaacgatccgcccttccgaacggtccgaaaatctctgccgggggagcattgtccccgcgtggtgactggcgggcaccgtccgatggcagtgcggagatatggctgcaagagctggctgctcatgtaccggatgatttttcctgaccaactgcgctttgtcggcacagcttcggcttgattagcggcccgttttcacgtcatctgtcacgatgcgattcaccatcgaccgccttgatcatctcgttatgaacgtccgcgatgtggaaatatccgcatcctggtaccagcgtgtgctggggatggaacgggaggaattcggaacagagcgccgtaccgcgctgcgtttcggcggccagaaaatcaatctgcgcccgttcgataatgaaacccgtagctggtctaccgccgctcatcctcagatcggcagcgacgatctgtgtttcatcacggcggtcgggccggatcaggtggtcgaacatctgcacgattgcggcgtcacggtcgaggaagggccggtgcgcaaacatggtgcgctggggcagattcattccatctactgccgcgaccctgatggtaatctggtggagatcgcctcctatctcgctgaataatctgccctgcctgtgcgcaggcagagcttgaagcgcggaggcaggcccggcagatagagggccatgagtacagcccctctcgatattgccgatttcactttcgatctgccgccggagcgaatcgcccatgaaccggcgcgtccgcgcgaatccgcccgtctgctgcatgtgccggcaggggaggagggggtccatgatcatcatatccgcgatctgcccgacctgctgaggccgggcgatgtgctggtggccaatgatacgcgggtgatcccggcgcaactcacggcatggcgcggacaggcgcggatcggcctgacgctcaaccggcctctgccggatggaagctggcatgtgctggcccgcaatgcgcgtcgcctgcgggccggggacaggctgcgctttaccgagcatgacacgcagtccacccacacgcagcccaccggcatgctggcggccgaggtggtggcccgtgacgaagacgggggcgccatcctgcgttttgtcgcggaggatttcgatgcggcactggcgcagtacggggcgctggccttgccgccttatatcgatcgtccgcaagggccgaccgctcaggatgcaaaagattaccagactgtctttgcccgtcatcgcggcgcggtggcggcgccgacggcggggctgcattttactccggccttgctggacaggctggcggcaaaggggatcgaacgtgtcacgatcaccctgcatgtcggcgccggtactttcctgccgatgcgtgatgatacgatcgaggcccatcgtctgcatgcagagcgcggcgttatcacgccggaggctgcctcacggatcaatgcggccaaacgggtcattgcggtcggcaccaccagcttgcgcctgctggaaagtgcggctgatgctgcggggggcgtacgtccttttgatgccgagaccgatattttcatcaagccgggccaccggttccgcaccgcgcatgcattgctgacgaattttcatctgccgcgttcgaccctgttcatgctggtctgtgcctttgccggaacagcgcggatgcgggcggcctatgcgtatgccatcgctgaggcttaccgtttctactcctacggtgatgcctgtctgatcgagcgggacttgcgcgacaggcattaaggcggcacagcgttgctcatgtcccttaccctgtctcttcaggccgaggatggccgggcgcgagccgccacgctgcataccgcgcatggtgacgtgccgaccccgaccttcatgccggtcggtacggcggccaccgtcaaggccatgatgatggattccgtccgcgccaccggtgccgggatcgtgcttggcaatacctaccatctgatgctgcgcccaggcgctgaccgcgtggcggcgctgggcgggctgcaccgtttcatggactggcccggccctatcctgaccgatagcggcgggtttcaggtcatgtccctgtcctccctgcgcaagctggacaaggatggcgtgacgttccagtcccatattgatggctcccgccatcgtctgacgccagaaagctcgatcgggatccagcacaagctggatgcgacgatcaccatggcattcgatgaatgcaccaaattccccgccacgcatgaggaggcggcgtcttccatggagctgtcgatgcgctgggcggcgcgctgccgggatgcgtttgtgccgcgtgacgggtacgggttgttcgggatcgtgcagggcagtgtctataacgatctgcgcacgcaatccgtgacggcgctgggcgatgatttccacggctatgcagtgggtggtctggcggtaggagaggggcaggaagcgatgtttgccacgctcgaccataccctgccgctgctgccgcgtggcaagccgcgttatctgatgggggtcggcacaccggatgatattctgggtgcggtcatgcggggcgtggatatgtttgactgcgtgatgcccacacgcgccggacgaacggcccgcgcctacacctcgcagggggtgatgaacatgcgcaatgcccgttatgcggatgatggccgcccgattgatccggcctgcgactgtcctgcctgcacacgtcacagccgggcctatctgcatcatctgttccgggccggcgagatgctgggaccgatgctgctgacatggcataatctcaattactaccagtccttgatgcgtggcctgcgcagcgcgatcatggagggacggctggagcagcatgccgtcacgctgcgcgctgcctgggcggcgggagatcgggagaaacaggatggctgaaaattatgcgggcctgacccagctcggccagaccgtttcccagcccgccagccctgatcaggcggtgctggagaaagtgcctaatccgacaccgggcaaggcgtatatgatccgttttaccgcgccggaattcacctctctctgcccgctgaccggccagccggatttcgcgcatatcgtgctggattacgtgccgcgtgactggatcgtcgagagcaaatccctgaagctgtttctgaccagtttccgcaatgtcggcagttttcatgaagcctgctcgatgaaaatcgcggagcgtgtggtcagcctgcttgatcctgtctggctgaggatcggtgcttactggtacccgcgcggcggtattcccatcgacgtgttctggcagaccggctcaccaccggatggcgtatggattccggcgcaggatgtgccgggttatcggggaagaggttaaatcacatggctctgtgggtccgttttgcgcgggatggggaaaccggtttcggaacgttggcggatggggtgatcacggcccataccggcacgatgttcggcgacaatgcaccctctggcgaggtcgttccgctggagacggtgcgtctgctggcacccgttatgccgcgtaaattcatcgggctgtggaacaattttcatgagctggcggccaagctcggcacctctgttcccgaccagccgctctggttcctgaaatcgccggacagcgtggttggcccggatgcggagatcgtgccgcctgaatcctatcaggggaaagtgctctacgaaggcgagctgggtattgtgatcgggcaggacatccataacggcgatgaagcagccgccgaggccgcgattttcggctatacagcggtgaatgatgtgacggcgctggatattctcaatgccgatccgtcttttccgcaatgggcgagggccaaaagctgcgacacgttcggaccgatcggtcccgccatcgccaccggcttcaactggcaggaagcgcgtatccgcgtggccctgaacgggcgggaacgccagaactacccggccagcgacatgattttgtctcccgcccggatcgtcagcttgctgtcgcgggaaatgacgctccgtgccggagatgtcattgcctgcggcacctcggtgggtgtgctgccgatgcggcccggtatggtggtggaggtcacgatcgacgggatcggcacgctgcgtaatacggtcgcgcaaaaggccgatgcggttgcggcctgaccatgacgcaaccggatcctgctccctcggtctgctctcccgatgaatttcatgcgtggatcgaggatgcggttcgttttggggatacggatgcgcagggtcacgtcaacaacgtgaccttcgcccgttacgccgagacaggctatgtgccgttcatgcgggcggccgggttgctgagcgatccgggccgcatggcggttgcggcccggatcgagatagatttccgctccgagattttctacccggctgtcgtccggatcggcaccgcactggaacggatcgggcgcagcagtatcacgctgcggcaggggctgtttgtcgagacgctctgcgtggcaactgtgcggctggttctggtgctgatcgaccggaacacacgccgcccggtcgtggtggatgatgccctcattgcgcggctgagggcattgtccgaaggtctatccgatcaggaggcgagtttggccgccagccgggcgacgtgatcgccgaggaagcgcgcaccatccagctcattggtgctcggctgacgtgacccatcgccgccggcgagggtggaggccccgtaaggcgtaccgccggagacttcatccagtctgatctgtccctgaaaagaatagggcaggccggtaatcaccatgccgtgatgaagcagattggtcagcagggagaattgcgtggtctcctgcccgccatgctggctggcggtggaggtgaacgaagcaccgagcttgccgatcagggcgcctttggcccacagaccgccggtctggtcccagaactgagccatctgggatggcaagcggccaaaccttgtccctgcaccgacgatgatggcgtcataattcggcagttcctccgttctggcgatcggggcagcctgatcgagcttgaaatgattggcgcgggcgacctcttccggtaccagctcggcaacacggcggatatcgacctcggccccggcggcgcgggcaccttcggcgacggcttccgccatggtttcgatatgtccgtaggtggagtaatagagaaccagaactttggccattcgtacgttcctttgctgtcagatcggctttccggctttaatgatcgggcaggccgtagagttcagaaagagaaacaatggaaatgcatcttttccggatctgtgatgccgtttcttcctgatcttgaaggctgggcggtctttgcccgtgtggccgatagcggttctttcgccggtgcggcggaggagctgggcctgtccagagccaccatctccaagatcatcgcccggctggaggggcggatcggcgcggcgctgttcaaccgtacctcccgccgcttatccctgaccgaagtcggccgcgcctctcttgagcgtgctctgagcatgctggagcaggcacaggggctggaggaaaacgcacgttcttcttctgctgcgccgcgtgggctggtcaggatctcggccccggtcagttttgggctgatgcatgtgagaccactgctgccccagcttctggccgagcatccggggattgatattgatttacggttggatgatgcggtcgttgatctggtcgcagggggctatgacatggcgatccgtattgcgcagatgccggattccggtctgcgggtgcgccggattgcccggatgcagatgaagatcgtggccgcgccatccttgctggaacgtgtacgtccagagcatcctcgtgatctggatatggccctgtgtcttggctacggtcacggcacgatggccgggcgttggcgtttgcgccgtgaaagtacgggcgaagaagcctctctgctgcctgcgggccgtttgcgcaccaataacggcgaaatcatgctggaggcggcacggagtggtcagggatttgcgctggcacctgattttctgatttgggatgatctgacggcaggcactctggttccggttctgacggactggtcactgccattgctggagctgaatatcgttttaccaccttcgcttttgcgcccggcccgtattgcggctgtcgccagtttcctgaccgggcaattatcgaaatgctgctggattgttcgtgacaaagcagcctgaccctctgcagtcagcgttgacgttgaagatgcagaaaaaagcgaaacaggatatcgctgcctatgcgcaggaactgggctttgcctcggtcgggttttcgcctgccaccctgacgcagacggcgcaggatggactggcggcatttctggaggctggtggccacggcaccatgggctggatggcggagcgcagtgatcagcgtgctgatcccaagatattatggcctgaaaccggaacggttatcgcgttggggatgtcgtatgcgccggtggaaaacccgcttggcaaccttgatcagcctcagatcggcaatatctcggtttatgcaagaaacagggattatcatgatattatcaagggaaaattaaaacagatcgcgcagaggatcgtttcccggcatggcggtatggtgaaggttttcgtcgatacagcaccggtgatggaaaagccgctggcgcggcaggccggattgggctggcaaggcaagcacagcaatcttgtctcccgtcagcatggatcatggttattgctgggcgagatttttaccacgctggttctgccgcacgatgatccacacccggatcgctgcggcacctgccgccgttgtctggatgcctgtccaaccggtgcttttccagcgccatatcgtctggatgcgacgcgatgtgtgtcgtactacacgatcgaatttcatggcccggtgccggagccattccggcatgccatgggaaaccgtatttatggctgtgacgattgtctggctgtatgcccatggaaccgcttcgctgtacaggcttcagaggcaaagttgaaagcccgtccggaactggtggcacctcgactggatcagctggtgcaactggatgatacaagttttcgtctgctgttttcgggatcgcccatcaagcgtatcgggcgggatcgttttatccgcaatgtattatatgcgatcggcaatagcggtgattcgtccctgttgccaaaggcgcaggcactgaccgacgatgcatcagacatcgttgctgacgccgcgcgttgggctgttgccagactggcagaggcacagagtccatcatgagtctgatcaaacgcagcttttccttatccggtcatcgcaccagcgtcgcgctggaaccggaattctggacgatgctgacgaatattgcttccggtcagtcgcagacattggcgcagttgattgccatggtcgatgcttcccgtaatccggatcgtcctttggcttctgcattgcgggtgctggctttggaagcagcgctgaggatggcaggcatcaaacaggcagagcagagctgaattgtctggtgcgtagattaaatatcaagccatcatcgtgatgatgatgcgatatgttgctgtttgatgaacaggatgagtgaccgaagtgcagaatgatgcttttattccctcttctatccgaagcgtcattcaggaacgccttgatcggatcgtggcggaaaatcatgtgcgtattctgctggccgttgagtccggctcccgcgcatgggggtttccttcccctgacagcgattatgatgtgcgtttcgtttatgtcaggaacagggatgagtatctgcgtctgcacgcgcctcgtgatgtgattgaaacacctctgctcgacgaaattgacctgaatggctgggatattcgcaaggcgttgggattgttgctgaaatcgaatgctgtgattggtgagtggatggtgtctccaattcagtattgcaccgcgcatccggtgatcgaacggttgaacgatctggccggcaaggttctgaaccggcatcatctggcctggcactatcacagcatgggccgcaaatcagcggaacgctggttgacgggggatgagccggtaccggtcaagcgatatttttacgctctgagacctgcccttgctctgcgctatctgcggctgcatgcgggaaagcgcctgccgatgcatgtcagtgccctgatggaagcctccgacttatcgcggtctctgctggaacagattaacactctgatcgcggcgaaacggcttaccaacgaacagacgaacggcgcacgctatcctgaacttgatgcgctgatcaggcaggaactcgcaatcctaccggaatcggagcagacacgtccgcctatgctggataggcaccgcagagaggcagatcagctttttctggatctgatcaatgcgtcataagggagacttatgactgagtctggcgtgccctgaaaacggaaggattttccccggcaacagcggcaaaggcttttgcaaaggcgctgagcgaggcatagccgcattcggcagccaccatggtaacttgttggccttccatcagcagactcatggcgtgcagcatacgtgcctgtgtcagccaagcttgccagcttatgcctgtttcccgctgaaaactgcgccggaagctgcgttccgacaaagctgcggcggctatcgctccggcctgtgtggcttgtccgggtgcggccagtgcgtaatccatggcgcgggtcatgcgtgtactgcgggcaccgggcagaaacagaggcaattcgtcctccagccattccccgcagagcattgccagagactggaaaaaacagcgtgccagaggatcctgttctgatgcgccgaccggccagcgcgtggcgtaaaggatcatttcacgcatcagcggatttgcatggagaatacgaacccgccctgctccaatcatcacacagtccggtgaaaaatagagcgatacactgtccatatccatgatcgtggtgcgatgacggatgttggccggtatccacaccgcctgcccaagcggcaggatatgctgcccggcttcggtttcaatccgcatggccccggaggcagcgtaaatcagttgatgatacggatgggcgtgccagtcataggtggtgttgcgtgtatggtcccggaacgcaaaacccgttccgtatggtttgtcgataccgtaacggtggagaatatcggctgtttcgtcccgggtcaggagcttcatggcggccctttcatggtcgtgaggtatggccgttgctcattgatatttggcctgcaagcgttagccggtcaatgatgtctttgcctatctttcccgccccagcaggagagagagagccatgatcccctcagacaccaaacccgacgaaacgcggcagaatcatgatcatgcggtgatcgcacaatttacgcgatgggccgggacttttgcggcattacccgtgcatgcggaacactctgccatggtccgtacgctggccgcctgtgccctgaccccggcttcgcgtgtgctggatgtggcctgcggcccaggcattctggcatgcgccatggcagagcaggcgcagcatgtatccgggattgatctgaccgaggcgatgatcggacaggcaaggcggcggcagaatgcagccggtctgcacaatctggaatggcatgtcgggcatgccggatcactgccgtttgaggatgggtctttcgactgtgtgaccacgcgctacagcctgcatcacatgaccgatccggggcgcattctggcggaaatgaagcgggtctgttgtgaaggtggcagggtggtggtgatcgatgcgacccctgcaccagaaagtcagactgcttatgacaggatggaacggatacgcgatccgtcacatacctctgctctcactttgatgcagttgcgggaggtcgggcggcaatgcggcctgattgaacaattgattgacggctaccgtctggaagcgaaactggaggagttggccgatccggaggctatgcccgccctgacggagatgttcgaggcagatatccgctccggtgacgatcgcctgggtgtgcaggcttaccgtgccgtcgatggtctgcggctgtttttccccatctcgattatcgcatggcaggtctaaaggccacgagatagggagtgatcagggcagaacccagcgtgcggcatcacgcagaatggcactgtccagtgcatacaacgcatccagaaattccacctgcaacgatccggggccatcggcgcggatagcggccagttctccggccagaccggtggcgcataatccggcacaggcggcaaccagcgggtctggctccaccgccgcaaaagcgccgatcagcgcagtggcggtgcagccgagaccggtgacgcgggtcatcatcgggtgcccgttggcgatgccgatcaggcgcgtgccatcggtcacgtaatctgtggcccccgtcacggccaccgctccgccggtgcgacgggcgagtatagaagctgcctccagcgccgctgtggaggagacgaggctgtctacgccgcgcccaccgccgccatctccggccagggcaatgatctccgaggcattgccgcgcacaatatgcggctttgcctccagcagatcacgggccagttcggtgcgataacgcagggcaccgaccgccaccggatcaagcaccaccggctttccggcctggcgtgcagccgccatggccagcctcatggcagcggcacggggggaggacatggttccgagattgataaccagactgtcggccatgcgcgcaaaggagtccacttcctccaccccctcaaccatggcgggcgaggctcccagtgccagcaatgcgttggcggtggtattggtcaccaccagattggtgatgttgtgcaccagcggccgtttttctctcagaagagtgagcagataaatggtccgctctgtcagccaggcggcagataaaggctcttccgtcatcgcatgcgctccctccggggcaacatatcccccggcagaagaagggaaacccgatcccggctgggacgtaaagaccagagacggtaccgccatcggtatgacggtccgagatacgaaaagcgcgccagtccgcgcgcctcgcaggtcaaggaggatatcgtatgggcaatcatgatatagacgctgcagtcaccgatctgaagggtaaggtgaaggatgctgctggaggcttgaccggtgataccgggctgcaggcagaaggcaagctggatcagggtatcagcaaggcaaagcagtttgcgcacgatgctacggatgcggttcaggacggtgtcgagcatctgcgggataaagcgaacagcgctgaagagcatgcacgccggcatgcagaaaccgtgactgcccggttgcgtgatcttgccgagacagcgtgggaaaaagctgccgatgcgggtggcaaggtttatgaaaccggtgtgcgtggcgggcagaaactcggggaaagtcttgagcagaagccggttctctctgtcgcactggcgggtgtggtcgggtatcttgcggctttcatgatccattctccctcaagcccgctggctccggagcctccgccgaaacgtcgttggctgttttgatgatccaggcttgatggtggggatctgttcatttccttccgtcagccatctgtggacggcaggcggcggtacagtatagtcgcggacccaccagagaaagcggaaacagggctttgagccagtcaacacactctgccggggatggaatatccccggcttttatgcatgatgtttcttattctgatcgtgaatcgaccctgaaaatttccggatccgccacggataccaatcatggagcagggatacggcaggctcgggctctggagcgtatcgcccgtattctggcctgggtggccggtactatcctcgctattgccgtgctcagcttgctctctgacgtgctgctgctgctgttcgcggccattctggcggcctgtctgttgcgtggtgcagccaatgctgccgccaacaggctgggggggacgccggggttgtggctgtccttgatcttgttgttgttcgtcgggatcattgccggtgccatctggctccgcggaccaacgctgatcacggaaatcgaggcactgggtggcaggctgaatgatcagttcagtgcagtctgggaccggctcggctcgctcgattatgcccagcaggtggtgcacaaggcgcgtgcctacctgtcttccgcaggggagaaaatcgccggcctggcggcgggggcggcaaccagtacgcttggtggcatcggcagtctgacggtgatcctgatcgtcgcaatatatctggccgcttcgcccggcatctacgtgcgtggcacattgcggtgtctgccaaaatcatggcggccgcgtggggctgaggtgatgcatgaaacggcccatgcgctgcaatggtggtttgtcggccaggtggtcgatatggtgatgatcggcgttctgacctggatcgggctgtccctcttgggagtaaaactggcgggtacgctcgccctgatcgcggcgctgtgcaatttcgtaccgtatgtcggtgctattgcaggggctgttcctgctgtgctggttgcgttcggtgagggaccgcagacggcgctttatgtgggagtgatgttcgcaggcgtgcaggcgctggaggggaatgtgatcgcgccgatcgtgcagaaaagcacggtcgatctgccgccggtgttgacgatcctgtcccagaccgtgctgggcacgattttcgggccagtgggtctgattttggcgacgcctattttcgcggttggcatggtcgcggtcagaatgatctatgtcgagagcattctcggtgatcacgatggtgccctgctgcctccgcttgagcagaccccggacggtcagtaatacggtcagtaatagcgtggcgcaggaatggtgcggaggatctggcacgcctgcatctgctcaggcggcagagtgtccgtcgtgtcacagattgcctctgcgccggcccggcatgatcgttccgcgatcagccggttgccttccatgatatcgaccgacacagggtcggccttgctgacggtctggttattgatcacgagatcagccgacgcattgaaatccttcatagccttgagacagtcgctgctggcctggcccttatgagcctgcaacaggttaagctccgctgtcagccgtgcggttgccggatccttggggggcggggcatcacacccagacagaacggcgggaaggatcaatgaggctgctgccagcccgatcagtctgatatccatcgtactctcaggaattcgtattgcgggtaggggcgatcgtgcaatgctggctgcgattgacggtcagggaaccggttctggtgctgtctaccggatcgggataggtcagaataatagttccgttttttggctcggcggccatctcaacgcgcgtggctcccaccagcacgacattgctgtcgcaggtgatcgagaccgtgtcggcggcctttggcgtgtcacttccacaggcactcaaggataccagcaacggggcagcaatcatcagggcgccatagagtgttctggccttcatcaattttctccgttgattgcgaatcggtctgtgccaacacagacaggaaaagtgcaatgcttcgtgctggcaagagtggacaggggctcgtgccgaatgtttccgcttttcgaccgatcttcggattcgggccgtggggagcagagcggggctgtttttggtatggctgccaaggaggaagcggcggtggtgtatctcggcagcgggttctatacgggcgcaccatgcctattccggcctgcaatgtggatactgctaagagaaagcgagaatgagcgcgtttaaattcaacgcctttaacgatcgacgtgaggccgccgcgaaagcaaaggcagccatgctggaccgcttcaaaagtgcacccagccttgatgatcccgacatcaagcagaagctggaggagcagcgcatcgcctatgaagcgcgggaggcccgtctggccgagcgcaagcgcctgaaagcggaagaagccgcacggattgccgcggaaaaagccgctgccgaaaaggcccgtattgaggaagagcgtgcgcatgaagccgccaaggctgcggcggctgtcgaggaaaaagcccgtgccctggctttgctggcagaacagaaggccgagcgggatcgccgctatgctgcgcgtaaggcccgcaccggtcgtaaataaccgggggttgccacaataataggcgggactattcccgcaccaggaagcggcgcgagggggcatcccttcgcgccgctttttgcacttcagcgtttggcagccgaatcggcatgtgccttcagcagtgcctccagcggtagatcaagtgctgggcaaagggcctcgatatgcgatgtatgaagggggatgtccttgcgcaggatggcgctcagctcttcttccggcagccgggtaatagcggataaaaggcgcggcggaatggagcgttcagccatggcattgcggatcagggcaatcggatcggtgcttttgggatcggcctgggaagcgaggtagtgtccggtcaggatggcccagacgcccagcatctcatgttcacggctgccgggttccggattgttgttcatcaggcgatgcatttccacacgcgccgcttgcagatcggcttcatcgcggatcggtttgaaatccatgcccgacaggctccccaaagatgatgacaatgtcttgggggcgttcttaaagcagatgggatagtgaagaaaagcggcccggcctgttatgatgaggtaagggcgaggcttgagtgaaagaaagggcgggatcagttatcgtcgctgtgcaggggaaccttgaccagcatggtcggggtcggctggaggttacgctccatcaccacttgcgacgagtctttccaggtatagccatcccccctgaactggtccctcggctggtaaagagtggccgaaacatacggttttgcgggttggaccgggctggtgggttcaccgacatcaagattaggcatcggggccgcggtatagtcttcctggcggggggcactgatggttgtctgttcggagggagaagcggcaaaagcccctgtgaaggacgggatacaaagcaccaccgccaccagtcctgccgtgaataccggcttcatgactttattctgcctcccagcgccaaagcgcgtctcccgtcctcatctgtctgccggacggttatccgatatgccttgtaactatgtcagaattcgcccgtcttgccggacaatcaagtaaaacctgcaaccatactgatgaaaaaacgttatgttgcccgttcgccgcattccgaccccgtcatggaacggaagggtagaatagtgtagccctttttatgggctgcactattcccctgattatctgatcagccgccggcaccggtccaggcaggctggggacgatagagtctgctcttgcattcattgggcggcaggacgatctggagcgcctctaccagccggtcgatcatctcatccgtatgcttcggtgtcgcggtcagacgcagccgttcagcccctttgggtacagtcggatagttgatcggggtcgcatagatcccgaattcatccagcaggcgtgcgctgatgtcacggcacaatgcggcatcgcctacgaaaaccggaacgatatggctttcggactgcatacggggtagctgagcctcatccagcttgcgcttgagcatatcggcccgctcgaacagctggatacgccttgtgggatcgctgcgcagatggcggatgctggccagcgcggctgccacgaccatgggcggcagagcggtggtgaagataaatccggccgcagtcgagcgcaggaaatcaacgatttctgtgttgccggtgatatagccgccatgcacgccgaagcccttggccagcgtgccctcgatgatgtcgacgcgatgggcgacattatcccgttctgacacaccgccaccggtcgggccgtacatccccacggcatgcacttcgtccagataggtcatggcaccgtatttttgggccagatcgcagatcgcgctgatcggggcgatgtcgccatccattgaatagacgctttcaaaggcgatcagcttgggcgttccggtgggggcggcggccagcaattcttccagatgctccatgtcgttatggcggaagatctgccgcttcgcattggcagcggcccgcatgccgacgatcatggagttgtggttcttctcgtcggagaagacatgccagtcgggcagactgttcagaatagtacccagcgctgcctgattggagacatagccggaggtgaacaacagcgcaccctgcttgccatgcagggcggccagttcggcttccagcgcatcatgcaggggattggtgccgctgatattccgtgtgccacccgcgcctgcgcccatctcatgcgcggcggcaatggcagcctgaatggtgatctcggacgtgcccatcgccagataatcgttggacgaccagacagtgacttcctgcacgcgtccttcgtgttcccgatggtagacggggaatttgtcggcctgctttaccagaggggtgaacgtgcgataccggccctgtgccttgatgtcgtcgagcgaccggcgacagagatcattgaaagcgtgcatgatgtggtcgtctacttcctgctggctcacgccatggcgtgccggtttcaacctggtcctgaataagcgacgccccgctgtggatgcgccaacccctggatcgccccttgcgtgatcttaccggatatccgacggagcgggaacacacaattgttctttggggatggaggcgtcaagttttagtaatcgtcacaaatggagagggtgcatggcggaattatcatgaccatgccggatttagtcctgtccccgtttgacgaagattctgatttccgaggcctgaatggcggggtctgtcatagctgccaggctgatctggtcagagtcgactcccatcagcatcatgtcttcggcaacggtgacggctttcatgcgggcggctttggcgcgcccgatctgtcgcgtggggttgcctgtcgcgggtacgacggtcgtcacgacatagaaaatcccgggatgggagatattggcctgctgcacagccgttctcaatgcatccgtataactgcgatccgcttcgtcataaccatcatagcggatggtcaacagcggaatgcgcccttcggagttcagggcggacatcagcgcggagggcggcggtttggcaggggccgccccgaaagtggtgcgatccaccagcttgcacccgccaaggccggaggccgcggcaagcatcagaaccagcagggatcccggcgtcacccatggatgacgcgaggaaggtaatactctgtgcaggaaaggcattgtgctccggctccgcgatgcccgcaggcttgcagggtttggcaggcagggcaagatcatcatcgcacaggacgcgcagcagacaggaacagggcagcatgagcggcagtaatcggcggatcaacggtgagcgtctgtgggacagcctgatgcagatggcgcagatcggggcaacgccgaaagggggcgtgcggcggctggccctgagcgcagaggaccggatggggcgagaccgcctggcggcgcttggccgtgcggcgggctatgccgtcaggaccgatgcgatcggcaacatgttcctgcggagagaggggcagactccggaccggaaaccggttctgttcggcagccatctggacagccagccgagcggcggaaaatttgacggcgcgctgggggtcatggccgggctggaagtgctgcgcgcactggatgagcatggaatcgtcacggaggccccggtcgagctggtcaactggaccgatgaggaaggcagccgcttcggccggggattgctggggtccggagtctgggcgggtgtgaacgggctggaggagactctggccctgcgcgatcatgccggtatcagcgtggccgaggctctggatggcattgccggagacgccccggcagaggctttcccggcggacagctattttgaactgcatatcgagcaagggccgattctggaggcagagaatgccgatatcggaatcgtcaccggcgcacaggcccagatctggtgggatgtcaccgtcaccggtcaggatgcgcatgctggcacgactccgccttctgtgcgcaaggatgcgctgctttgcgcggcccggatcattgatctggtagatcggatgatgcgcgcaaggggggaggccgggcgtggtacggtgggggagctgcatgtgctgcctaacagccgcaatgtgattccgggtgaggtgcgctttaccgtggagttccgccatcccgatgatgctgaaattgcccgcattgccgcccagttcccgcgagaggccgggtttatcgcccgtgactgcgatgtctcgctggccttggaggcggtgctgaggctggcatcccggcccttcgacccgtcctgtgtagcattggtggcggaagccgcggcacgtcatggctatgcagcgcgggaaattgtttccggggccggccatgatgccatttacgtggcacgcaagatgccggtagcgatgattttcgtgccctgcctgaatggcctgtcgcataatgaggccgaaagcatcaccaaggcccaggcagaggccggaacgcaggttctgttcgatgcggtgctggcgcgggccgggatcgcaggatgagcgtggcgtgcatggctgaacccagactgtcgattcttccctgtttctgtcgggttcgcggcttccgcacttcgtaggggcctgtataacgaatgatcgcgagaaccggcgcggaaggcgcgctggagaaaaaatgttacgccagatcgcctgttgcgcgaggtattcttgcgtctcggtaggctggtggagcgcttgaggaaaaggaagaacgccatggcggtcaaagtcgcgatcaatggtttcgggcgcatcggacggctggtcctgcgcgctatcgtggaaagtggacgcgaggatgtcgtccctgtcgtcatcaacgatctgggcagtgtcgaggcgaacgcccacctgttccgctatgacagcgtccatggccgtttccccggcgaggtgcaggtggacggtgacagcatcatcatccgccataacggccgtaccttcggcccgatccgcgtgacggccgagcgcgaccctgcgaaggtgccgttgcagggcgtggatgtagcgatggaatgcaccggcctgttcacgaagaaggatacggcagggcaactgatcactgccggtgcccgcaaggtgctgatttccgcgccgggcgacggggtggatgccaccatcgtctatggcgtgaaccacaacacgatcaccccggatatgacggtgatctccaacgcgtcctgcaccaccaactgcctcgcgccgatggccaaggtgctgcatgaccgcttccgcattctgcgcggctatatggtgacgatccatgcttataccggcgatcagcgcaccgtggacacgctgcacaaggatctgcatcgcgcccgtgctgccgccatgtccaccattccgaccagcaccggtgccgccaaggccgtcggccttgtgctgccggagctgaagggcaagctggatggcactgcgatccgcgtaccggtgccgaatgtctcgctggtgtcgctggacgtcaatctcgaaaagaccgcgaccgtcgaagaggtgaatgccgcgatgaaagccgccgccgagggcgatctgaagggcattctggtctacaacacggaaaagctggtcagcatcgatttcaaccatgccccggcatcttgctccttcgacgcgactcagacggcggtggtggacggccagatggtgcgggtgatgggctggtacgacaacgaatggggcttctccaaccgtatgtccgataccgccgcgctgttcggcagcctgtaagagacggtcgtacactatgtcgtttcgtacattggacgggcttgatgtccgtggacgccgggtgctggtccggctcgatctgaacgtgccgatgcgtgacgggcgggtgagtgatctcacccgcatcgagcgtcaggctccgaccgtgcgggagctggccgaaggcggtgcccgtgtcatcgtcatgagccatttcgaccgtcccaaggggaagcgggtgcaggaaatgtccctgcgcccgatcgccgaggcgctgggggcggcattgggtcaaccggtcgctttcgtggatgactgcatcggcggcacggtggaagaagctgtggccgggatgaaggatggtgacgttctggtgctggaaaacacccgcttccacgccgcggaagaaaagaacgatcctgaattttcccgtctgctggcctctctggccgaagtgtatgtcaacgatgcgttctccgccgcgcatcgtgcccatgccagcacgcatggcgtgaccgcgcatctgcccgcctatgccggacggctgatgcagcgggaggtcgaggcactggaactggcgctcggctcgcccacccgcccggtggcggcgattgtcggcggtgcgaaagtatccaccaagctcgatctgctgggcaatttgtccaccaaagtggatgtgctggtgatcggcggtgcgatggccaacactttcctggctgcgcagggcatcaaggttggcaagtcgcttcaggaagcggagatgcatgatactgcacgcgccattctggaaacggcgaaaaaggccggctgcgagatcctgctgccggtcgatgcggtgacggccaccgaattccgggctgatccgccgacccgcaccgtcagcatcaacgaaattccggatgatgcgatgatgctggatgtcgggccggaaacggtgcgtctgctgacggaacgcctgtccggtgtcaaaacactggtctggaatggcccgcttggcgcgtttgagatcagcccgttcgacaaggcgaccgttgcgctggcccagtccgttgccgggctgacggaaacggccggtctggttagcgtggcgggcggtggagacaccgtcgcggcgctgaaacatgccggtgtggttgagcgtctgacctatgtctctgccgcgggcggtgccttcctggaatggatggaaggcaaggaactgccgggtgtcgcggtgttgcgggcctgataaatgccgctctcctgcctgttccaatcgggacaggcaggagagcgggaagacaaaagagccagcaaggcgaggggcacgcgctttttgcgctcatatcagtcgtttggtgtgccttcgtgctgccccagccagagcagcattgccatcagtatgatggtgaaacggaatgcgctttcaatgccattccattggctggacatccacatgccgaaccattcgccgccaatcaccaaaaacccacccagccaaagcgttatgccgctgacgaggcccagtatggcgatgggtttggcgctctggaacgtcgctgccgtatgacgtgcatgccataagcgccatacgcccagccagcacagcgtagcagccagtccttcgactgcaatgatgagagcataggctgcatgttggagcagcggtgactgaatggcgcgatagtggatgtgtgcatccggaaaaatcgtatccatcgccagcacgtgctgtacaaatggccagttggtgccgtaatcagtcagattgccgaaggcggtcagggtgatccataatgcaatcaatgccagcacgatgatcttgcacaggcgtatgatcattgcgtcatgatccaactgctatgtcgggcttcggggatcaaacgcaaaagacctgaacgttcaggtcttttttgtcggcatgatttcaacaggatggaagcgaatttttacggctcacccggctcggtggagaacagttcggctttgcccggtttgtctttccattcctcggcatccgccggaggctcacccttgcgggtgatgttcggccagacgctggcataggtgcggtttttttccgcccaggcggtggcacggtcgtcgctgtcggggaaaatcgcttccgccgggcattccggctcacacacgccgcaatcgatgcactcatccggatggatgacgagcatgttttcaccgacatagaagcagtccacgggacagacttccacgcagtccatgaatttgcagcggatgcagttctcggtgaccacgtaggccataaagtcactcccgatcgcccaaagcggcatcgtcttctgatgtcgcgctgaatatgtggcgggcatatgccgggctttccaccccgatgcaaggattgccgctcagttttcgtccgtttcgggcgggatgccgctttccgctgtcggcatggccggcaaggacggtggggaggcagccgtgtttcccccgtcaggaatatcctcatacaacctgcgtgcctcgctggccggaccccggcgggtcgccagtgaaagtacccgcagcactcgcacagtctgccgctccggctgatcgccgagcgggatgaccagaacatctcctatccggagtctggcatgtggcttgtcggtggcctgcccgttcaaccggatcaatccgtgctcgatcaaccttgcgcacagggaacggcttttcagaaagcgggcgcaccacagccagctgtccagtcgctgccaattctgggcgctaccggaggggctaccggaattgtgcggggatatctcggggaaggcaggcttgccgctcatcggtcctgtgatcgtatcaaagctagcgccgcagggcggccagcgcggagaaaggatggtccggtgcgaccggcgtcggcctttttgggggcggcggtcgccggcttgtctcgcgactggtttcccggtgtgaatcgcgccgtggcagtggcaccagcataggcggggcgggtggtccgtagaaggacggttccagtcctttgttggcaatccgcaggcccagcgctttcagaaccatgggcaggatggcggttggaacggacaggcgccccgccaggccggcaggcagcggcaccgggccgcgtcttgcggcgaattgaagctcggcggcgatgcgttcggcaatgtccaggcgcagatagaccgggcctgtccggacccatcccattgcttccgcaaaatccggtggccatccaaggcggctggcctcggccagcggcatcgataccagcgccggatggggcagggagggaacggcattcagcccacgggcaatgctcagtaatctggcgcgtaccatgacggaggcagcgtggcgcaaagcgggaatactcaggccgaatcgtccggcccggaccccgatctgcttcagggcgctgcgttccgccgggggaatggcatcctcggtcgcgccgggcaccagaccgccgttttccatcagacggtgcagatgcccgcgcaacatcgcatgggggcgggcggcttcctgcgcctgaaacagcggtgccatggcggtggcaattgttctgtccagccaggcttgcagccgcagccggatacgttcacgcaggctgccgtcgagaaactcgctgtccgccaccgcgatcatggggttcagaagggtcgggccggcccgcaaccgtgcgatcgggtggccttcccacaggatttccagccgctcggagatcgacagggcctgatccggtgtggcttccagactgatgacccgccgcggcatggattcgcgcaaggcccgccttgcggcgcgcataaccagttttctttcttccccgacaataccggcttccggttcaaacccgaagcccgtgatgtgaccgaccgcatggccctccacgatcacctgtcccgcttgcgtgacggcagaaagcagcggggcgtcattctgatcttccagccgtcgcagcaaatgcgtggcgcggcgatccacgaagcgggcagtgagtttttcatgcaacgcgtcggagagcaggtcttccacctctctggtccggccctgccagaacggagcatcattcacccagtcctgatgcgcggcgatatagctccagacccggatgccggacaggcgctgcatcagcgtgtcgatatccccatcggcgcgggccagatggtcgatctgactggccagccagtcagcttgcagggttcggcgctgcaagacctgcaaaaagacccggccgcagagcttggtatgggtgtcgtccgccaatttgcggaaatcggggatctggcaggtctcccatagcaatctcacccggctgcgtctggtgctgtggccgcagaccagtgtgcggatctcctgatcccgtaacagcgcatcgagggtttcgacatcgctggcatcatgcccgcgcaccagccccgtgcggggtggtggcgcgttgaggctggccaacagagcatcgccatcgctgaaatcgagatcggcattgcgccaggccaattggccgatcgcctcgaaacgatgggtctccaccgcttcgaccagctcttccggcagtggcggacagtcggcggtggtgccgaaggtgccgtcccgcatgccgcgaccggcgcgaccggcaatctgggcgatctccggcgcggccagacggcgggcgcggtggccgtcgaatttcgacaggcgggcaaaggcgacatggtcgacatccatgttcagccccatgccgatcgcgtcggtggcgaccagaaaatcgacctctttgtcctgatacagcgccacctgagcattgcgggtgcggggggaaaggcgtcccatcaccacggcacagccgcctttacggcggcggatcagctcggcgatggcatagacgtcgccagcgctgaacgcgacgatggcactgcggggcggcaggcggccgagcttggctgcccctgcatggcgcagttcggacaggcggggacgggtctcgatctcggcctgcggcaccaggcttttcagcagcggccggattgtctccgcgcccagaaacatggtctcgaccatcccacgcgcatgcagcagccggtcggtaaagacatgcccgcgatccgggtcggcgcagagctgaatttcatccaccccgatccattcgaccgcccggtccagtggcatggcctctacggtgcaggcaaaccaccgggctccgggcggaatgattttttcctcccctgtaatcagggcgacgcgatcggcgcctttggtggccaccatacggtcgtaattctcgcgggcgagcagacgcaggggaaaaccgatgatgccgcttgcatgcgccagcatcctgtccatcgccaaatgcgtcttcccggtattggtggggccgagcacggccttcacccgggggagtaactgcgtcatggatatatagtctgtgtgcagggagacggattgcaagcgggcatcatgtgcgccatctccatgactgaaacggaggggaatgcaagaggaggtccgtccgccgtcaggggccggttcctgttcccgccgtgtttgagcatttcaacgatggagcgtactcagatcatgagcgaccagacaacaaccggacaggccaccgccggagaaaccggggccagcggttcggagcagcatcgtttcggggccgaagtggaccggctgctgcacctcgtcattcattccctgtacaccgagcgcgagattttcctgcgcgaactggtcgccaacgcggccgacgccattgagcgccgcagattcgaggctttgtccgacaccaccctgctggctggcgcggatgaggcgaagatccgtctttccgccgacaaggccgcccgcaccctgaccattgccgatggtggtatcggcatgacgcgggacgatctgatcacccatctcggcaccatcgccaaatcaggcacccgcgcctttggtgaggccctgaaagcccgcgaggagcagaaggaaggcgctgaaaagcccaccacgatcggccagttcggtgtcggtttctatgccgctttcatggtggccgaccgggtggaggtgacctcccgccgcgctggcacggaggatgcctggacatggtcgtcggagggaaacggcacgttcgccatcgcgcccggcagccgggatacggcgggcacgaccattgtgatgcatatcaaggcggatgctgatgaattcctcgattcctggcgtcttgaaaacattatccgcaaatgggccgatttcattgccgtcccggtgctggtggcccaggaagatggtgaggacagggccgccaatgatggggccgcgctgtggcgcaagagcaagtcggaggtgacggaggaggactatgaagccttctaccgtcatgtcggcagctttttcgataagccgtgggcgaccctgcactggcgggcagaaggggcgattgatttctccgccctgctgttcatccccggcagtcccggctttacgccgatggatgaggaacgtgaaagccgcgtccgcctgcatgtgaagcggatgttcatcactgatcgtgccgagatcctgcctgcctggctgcgtttcgtgcatggcgtggtcgatacggatgatctgccgctgaatgtcagccgcgagatgttgcaggccaccccggtgctggcgcgtattcgcaaggcggtgacgaaccgtgtgctgaccgaactgaaaacccgtgccaaggacgaggaaagctaccggaccttctggcagcatttcggccgcgtgctgaaggaaggcgtgtgggatgattccgagcatcgcaaggatctgctgcctttgctgcgtttcgcatcctctgccattccggcggatcaggatggcggcctgacctcgctcgacgcttatgtctcgcgcatgaaggaagggcagaaggcgatttactacctcgccggagaccgggtggagacgctgcgcaactcaccccagctggaaggcttccgggcacagggctatgaagtgctgctgctggaagatccgatcgacgcattctggccggagcgtgccgagtcattcgcggataagccgatccgttcggtggcccgctcggcggaggatctggcggcgccggaaggcgacgtgccggatgtgtcggccctgacctccgccctcaaagccgcgctgggcgagcgcgtgtcggaggtgcgtgccagcactcgtctggtctccagcgcggttattctctcctctgccggcgtggggcctgaccttcagatgcagcgtctgctggcgcgtgccggacgtggcttgccacccgctccgccggtgctggaaatcaacccgcgccacaagctgattgcctccctcgtcagcgctgccgcgcagggtgagggtgaggcacgcggtatggaaagtgtcgcggaaaccttgctcgatctggcgcggattcaggaaggtgaggccccggccgatccgaccgcttttgccgggcgggtcatgagctggatcgagcagggcctgcccggtcatcaggctgctgaaaaggcttccgcgtgagcggcgctccggagggccgctcacgggtggttgctgccccggatgaaattatctgggggcggcctctggagtgtttcgtggagggggagagtaattctctccccattttcccgttgcggccggagggtctggaggcttttctcgccggagaaggggcgcatgctgccgggttcctgcggggggccgggctgacggcgaaagcggggcagcttgtgctatatccggcaggagacgggactggtccgggtggtgcagtgctgggtcttggcgccagccgtgatccgtggggtttcggtgatttgtccagtcgcctgccagccgggacggtgtggcatctggagccgggggattatgctcccgatcaggcggcgctcggtttcgcgctgggcgcttatcggttcgacctgttcaaggggcggcaggatgctccggcgccggcccgtctggttgtgccggcggaaagcgcagacgcggtggaagaagcccgtgccgtgtggctggcgcgtgatctcatcaacacgcctcccaaccggctgggaccgcaggaactggcggacgccgtgcgccggatcggccatgaggcaggcgcggcagtggaaatcgtgaccggtccggcgctggagtcagcctatccggccattgccgcggtgggggcaggatcagaccggcctcccgctgttgccattctgcgttggcagggtagccgtgcggatgagacttctccgctgatcgcgctgtgcggcaagggggtggtgttcgacacgggcgggtatgatctgaagccatccgccgccatgctgcggatgaagaaagacatgggcggtgctgcggtgatgctggcagcggcccggctgatcatgcagcgcgatctgccgatccggctggtgctgcggattggatgcgtcgaaaatagcgtctccggtcgcgctatgcgcccatccgatgttctgcgcacccgcagcgggctgacggtcgaggtcggcaatacggatgctgaaggccgcttggtactatgtgaccttctggcggaagctgctgaggaaacgccttccctgttggtcgatgccgcgaccctgaccggggcggctcgtgtcgcagccggtcctgatctgccagtgctgttttccaacgatccgctctgggcggagcgattggaacgggcgggcggtaacgtctctgatccggtctgccggctccctctgtgggacgggtatgattcatggttgtccagcgatgtggcggatctgaatagcgtgtccagccgtccgtttgccggtgcgatgattgcagccctgtttctgcgccgtttcgttccgcctgagactgcatgggttcattacgacctctatgcatggaacgatgagaacaggccgggtcgtccgcgcggtggtgaaggccagatattgcgcggcttggtaggttcattgtctcattattacaaataattcattacgagaagttttaagaacgcgaacgtaaatttgatagtattttccttattaacacagaccatgctgcatcgcatatgcagggtcggctgccatatagtcagataatatatggttgttggctggataaaacattttgtaactcggctgttgaaacgatttctgcaattgtcgcgttacaggcagggaaaggatcattattatggctagtgttagcaatacggatcaaatggtcggcattctgcgcgacacggttgttgcgatggtgcgtcgtgacggtcccgatctctccgcccgtcagcttggcgtttttctgacatgctacatgcaggacggcgctcatacggtgcgtggactggcgcaggagctgaatgtttccaagcccgccattacccgcgcgcttgatcggctgggtgagctggatttggcccgtcgcaaagtggaccccatggatcgccgtagcgtactggtgcagcgaaccatgaaaggcaatgctttcctgcgcgatctgcgttcgattatggccgaggccgctgccccgcagcgtcgcggcagcaacgaaggacgacgcgttgcgaatggctgatttcttcccgcttcccgttcccgaccgctgccatcaattgtgacccgatggtacgcgggacgggttcgtgcccgctcataaagatatgaaagcggactgatatagggcgatcatggcaaggcggccttttccattgggaaaagcgttgctagtctcgtcgcccccgcagccgcgcgctcatgcatggtgctgtgggcgctggcaggattgaagcaatgaagttcaaggccgaacgcgctgtgctcctcaaggcgctggcgcatgttcaaagcgtggtcgagaagcggaacaccattccgattctggccaatgtgcttcttgaggtgaaagacggttcccttcgtttcactgcaaccgatatggaaattgccattgtcgaggatgttcctgccgagggccttcgtgatggtgctgtaacggctccggctggtacgctctacgaaattgtccgcaagctgcctgacggggcggatgtggagcttgatcatcaggctggtgatcagcaattgatgctgaaatctggccgctatgccacaaagttggtggtactgccgacggatgatttccccagcatgaccacgggtgcgctgccgcatcaattcaggctggcaggcaatgtgctgagggggttgatagaccgcacacgctttgccatcagcactgaagaaacccgttattatctaaacggtatttattttcatgcggcccagggtggcccggatggagccgcccttcgtgccgttgcgacggatggccatcgtctggcgcgcgtcgaggagcctttgccggaaggcgcgctcggtatgccgggagtgatcgtgccacgtaaaacggtcgcggaactgcgcaagcttctggatgaagtaacggatacggtcgatgtcgccctttccgatacccgtatccagtttgtggcgggaccggtcaccctgaccagcaaactgatcgacggcaccttcccggaatatgagcgtgtgatccccaaagataacgacaaggttctgcgggtggggaaaaacgatttttctgctgcggtggcccgtgtggcggctatttcttccgaacgctcccgcccggtgaaaatggcgctcgaccgcaatctgctggttctgtctgcctccagtccggatcagggaaccgcgaccgaggaactggacggtgaccgtatccagtatgaagccggggcgctggagattggtttccaggcgcgttatctgaacgacatcactgatcagatcgccgaggaagtcgagttccgttttgccgatggttccgccccgacggtggtacaggatgcagccgattccagcgcgctttatgtgctgatgccgatgcgcgtctgaggggcaatcgctggctatctctctttccgcgactgaagcgactgttgtctccagcgtggaggggccgttgccccatatccggacgctgacactgacccggttccgaaattatgccgctctggcatggtctccgccgccggggctggtgggggttgtcggccctaatggcagcggcaagaccaatttgctggaggcgatttccctgctttcccccggtcgcgggctgcgcaatgctcgcacggaccagcttgcaagacagggggaggggggagatggcagttgggcagtgcatgcccggattctgtccccgacagggccggtggaactggcaaccggcgtcctccccggcaccgagcgtcgtcaggtgcggattgatggcgatattatccgtggtcaggccgaactgggcgcacatatcaccacggtctggctgaccccgcagatggatcggctgtttcaggagggccctgccggccgtcgacgatttctcgatcgtctggtttatgggctggaaccggcgcatgcacgggaagtcgcggctcaggcggcgagcctcacggaacgagcgcggctgctggcaatgcgggccgatccggcctggctggcagcggttgaggattccattgcccgtcatgcgacggcggtgacggcttcccgccttgcgtatgtcacacggttgaatgatgttctggttcagggaggcgcaggaggttttccgcctgcaaggctggatctgaactgtgccattgctacccgtctttcccgccatccggcagtcgaggttgaggactggctgcgtgccgccctgcgtgacagccgcgagactgatggagaaagtggcacgcagggaataggcgcccatcgcagtgatctgctgatgaaggatgcggcaacgggccgttcggcgtcgattgccagtaccgggcagcagaaagctctgctgatcggagtgactttagggcatgccgtcctgttgaaggcggtaagagggcgggcgcccgtgatgctgctggatgagcctatgacccatctggatgccgaacgccggaggctgttgctgacggcattgcggggactgggtggacaaggttttctgacagcgacagaccgcgatgcgttcgatgcggatttatcctgtgtgacctgtctggaaggatgcctgcacccggtatcctagaggatagacttctcttttcagccggatggagccgcttgatgggggggaagccccggttagggctgtccctcggggggatagtcgagtataaataggtgattcccgcgctgtcctggagctttttgccggcatgtccgatcctacgccgctgccgcctgattctgatgcttatgatgcgtcctcgatttccgtactgcgggggcttgatgcagtcagaaagcgccctggcatgtatatcggcgacactgatgatggctccggcctgcatcacatggcgtttgaaattatcgataatgcggtggatgaggctcaggccgggttcgcgagcgaagtcaccctgaccctgaatggggatggcagtgtgaccgtgaccgatgacggacgcggcatccctacggatattcacgccgaggaaggcatttccgcggcggaggtcgtgctgacccgcttgcatgcgggcggcaagttcaaccagaattcctacaaggtctccggtggcttgcatggcgtgggagcggccgtggtcaacgctctgtccgaatggatggaagtgcgcatctggagagaggggcgtgaacatttcatccgcttccgtcatggcgatgcggaggctccgttggtcgagatcggcccttcaccgcgcggttccggcacgcaggtcacgttcaagccgagcaacctgacttttaccagggtcgaatttgaattcgccaccttggaacgtcgcttgcgggagctggcatttctgaattcaggcctgaagatcgtgctgcgtgacgaacgtcatgtgccggctcaggaaagcgtgttctgctatgaaggtgggctgaccgctttcgtcgaatggcttgatcgcggcaaagtggcgctgtttgatccaccgatcagtgccgccggttctgccaatgctgatcagggtgatatcaaggtcgaattttcgctggtctggaacgacagtttccatgagaccatgctgtgcttcaccaacaatattccccagcgtgatggtggcacgcatctggccggtttccgtcaggcgctgacccgcgttgtttccaaatatgctgaaggactgggcaaaaaagagcagctggctctggttggcgaggatatgcgcgaaggtatgaccgccgttctgtcggtcaaagttccggacccgaaattttcttcgcagaccaaggaaaagcttgtcagttccgaagtgcagccggtggttcatgcagcggtcgccgatgcgatcgggcactggtttgaaacgcatcccaaggaaacccgctccatcatccagaaggcgatggatgcggcctcggcccgtgaagcagcccggcgggcgcgtgaactgacccggcgcaagggtgtactggatatttcttcgctgcccgggaagctcgccgattgtcaggagcgcgatccttccaaatgcgaaattttcatcgtcgagggtgacagcgccggtggctccgccaagcagggccgtgaccggaaatttcaggcgatcctgccgctcaagggtaaaatcctcaatgtggagcgggcgcgttttgatcgtatgctcggcagtgccgaaatcggtacgctgattacggcgcttggcaccggtatcggccgtggagagccggagcagggtggattcgatattgccaagctgcggtaccatcgcatcgtcatcatgactgacgctgatgtggatggtagccatatccgcactttgctgctgactttcttcttccgccagatgccgcagctgtttaccaatggacatctgtacatcgcccagccgcctctgttcaaagccacacgtggcaaggatgagcgctatctgaaagatgaacgtgctctggaagagtatcttctttccaaggcactgaacgaggcgcaactgactctggcggatggacgggtgttcgccggtgatgaactggccgaggaagtcaaccatctgcgtgatgttgcggcccggatgcgcaggctggccggtggtattcctctggcgctgctggaacaggcggtggtggcgggggcgctgcgtcctgatgctacgccggataccctgcaaacactcagcgcgcggctcaatgctatttctcccgcgtccgaacgtggttggatcgtcgcttcggaaggcgaggggctcaccatgcgccgcacagtacggggcgtcgcggagcgtcatacgctggaggccactgctttgaggagtgcggaagcccgctggctggcggagcggaccgaccagttggcagcccgctatacgcagccggtgagtctggcgctggatgcagcccggctggagctagccggacctgcctcggtgctggagcgtattctggcccatgggcgtaagggtctctccttccagcgcttcaaagggctgggcgagatgaaccccgagcagctctggagtaccacgctcgatccggcgacccgcaccctgttgcaggtgaaggtcggcgatatcgaagatgccgggcagattttcagcacgctgatgggcgacgttgtcgagccacggcgcgattttatcgttggaaacgcattgaaagtggccaatctggatgtatgatcgtgcaaaggcgatcctgtcagcactggaacgcgttgttacggagccggaatctcaattgggattgacgctgactgctgtcgcggcagctgcaaatgcttgtggcttcctcgcggtcgggcgctttctgtcgcatatgtccggcgtggtctcgaccatggcctttcatgcagcagccggagaggtcgagattcttctgctgatggcgggtgtgttcatattgtttgtggccggggcagcctgctctgccatgattgtgaatgaagccgtccgtagacgctatcgcaacgtctatatctggccgctgattctggaagcaatcctgcttgcggcatacgggattggttcgaccatggcgctgccggagtggcgttatgatgtcgtgatcggtttcagcttcctgatggggctgcaaaacgcgacgatcaccacaatctccggcgcgcggatgcgcaccacacatattaccggggtggtaaccgatatcggcactgaaatcggtcgactgctctatgagcggtcagggcgccgcgtcatccccagcctgacctccaacccttacaagctcgttctgctcctgtgtctggtgacatcgttttttctgggtggtgtgctcggtgtactgagttttacccagatcgggttactgacctgtgtgcctctggccttgatccttgccgtcgtgatcataatcatgcaccggtattatcctaaccggcctgagaaataacacgcaggatcggcagcagcggttttttcccgagctactgcatcagcacggcgtggatcagattatctcctgacgcaagcttggttccgtccgatgtatagatgtcgagatatttgccgctgttgagaagatatcgcgttgccgtatcgcttgtggggtaggtacgggtgatgccctcctgctgaccgatcagcgcaatacgatcatgatccgggtcgaaatttttaatcgtcagtggcccggatgccaggctgttgacccagacggtatcatcgcctgcacccatcacgatggatacggcacccccaccgagagccggtctggtggcgccaaaaccgatcgagacaaaatccccggcatttcccagttgcagactggcatcttcatggccaaggaaaatagcgctttttacgccgcctccgacgaaattcagagtctgatcctggttgacaccatcgccaatcacccaatggcgatatgtgctgtcccctgcgggctgaagagttgaggcttccgtgtgataggaaagcgtaccggctgaccccagaaatacaagctgctggccggttccgcccgtcacggtgtcattgcccttggacagaaccggcacgctataaccgctgcctccgaccagtttcatgccgggaccattggcaaaaatgaaaccgtccgccgatcctgcataaacagtatcgttattgctgatgacgacattggtatgaagtgtctgaccatccatatcaatggatgcattgccggacggagatgcaaaccaccactgggtttttgccgtgctggcaagcccggtatcgtacactgtctgataattgttggagatggtgacaaattttgaatttgccatggaggcatcaaaattctggtcggtatcacgggaaatcacgggatcggcgatgtcgaatgttgctcccgttccatcaagggactcaccgccgtagaaatacgaaccaaggctccatagagacatgttcatcagggatgatgaatacgatgaatgttccagagcaagatttctggccagatctacaacagcggaattcagatcaattgtaatatgatgcaaggccccctgatcttctccccatttcagataatcgccgcctgcatcagaggaaagtgcattccaggcaaaattggtacctgaaaaataaaggcgcccccatgaaggtggggtaccacgggaatctgccagcggaaactgcagaaaaccgttcaacgtcggcagagcagcattataatttggattggatttgctattaaaagcaatcgtaaacgaattcagcccaaaggttgcaccttgtccgtggccagtctggaaaatctctgacaagcgttgttgagaagaaaaagtaatttgtttgtcgaaggtgtaatttgatgccgcattaagcgaggtcgacaaaaacagattgcggcctccgggagatgtgtcgcctatattggcggaagaaccgtcctgcccatctatcgttgtgatacgatacgtccattgaccaggcgaaccatagacggacaaagccattgtcgaggcttcgttggtccatgtgtaatcagcggtccccagaacattgtcggcataaagtgggtttccagtggtatagatcgaaggattcagaaaactttcagaatgccattggatgatgtcccattgagaattcacagtatagggaagctcaggaggacgcgcataatattctgctctgccattctcgacagagcctgtattaaacctgaagcggggagaaaggaggctgggattattgaaagccgatattcggggcataaaaaagaggctttcatttaaaagtagaaatattacgaatcaatcatcatttgattgatgatgttaatatatatatgaacttatagttgaaaaacaactaattttttccaaaaatttagagaattgattcctttgtttatgaaaaaaatctgtagacttattatttatagtattaagcttgaaatttatagtatatagaaagtcttcttatagtttttttagtaaaatgtttgctgattataattaaaatattattttttgaagcaatcgttaaaatgtcatataagcagtgatatctataaaaatttgtggaaaatatgaatattattggaataacaagagtatttaatgaagatgatattattgaatcatttgtccgtcatcattcgattttttttaattcccatatattcatcgataatggaagttcagatcaaacagttgatatattaataaaattaaaaaatgagggatttaatattattctttttgaaaataaatctattatttttcaggaaatgcaaattaatacagaattttataaatttgcaaataatatgaatccggattggattatgtatattgatgcagatgaatttatagacataagaaatagtgaaaacctgttttacgaaacgctaaaaattcagaaagaagacattgaaagcgttttgtttgagctgaacaattatcaaaatacttttgaagatgatcatgatgaaattgcagtgcctgtcagaattacccatcgtctgccctgtggatccaatgtctggaaaaccgctgtcagggggcaaatccggtcaaatgtggttatcgaagctggtaatcacggggttatcatagatgatcgctatgctcgagattgcaaaagtcatcaggtaaaactggctcattttaacagacgctctgtctggcaggaattaacaaagattatcatcggtcatctgaaagcaatcagtacagggaaagaagcaaaagaaagaaactggtctgctcattataaaccattttacgaaaaaattaaaaacaaaccttgggaaatattaaaaagtgattatattttatcgaaagacaataaaaatcgacaatatttttatgatccaatgaattatttgggcggtgatttgagatatacgaataaaacggactatgatatgaaaagtattatatcaataataaattattttgaaaatctttcacaaagccatggagatattgttgatctgttaagagaaaataatattgagagcatgcattctgtcatcagacgaatattttaattaaacagcagatcatagctattttttactttcctgctgctgaacaaaaatggttctgtgcctgaaggaaatccagacccgtcgggtagccagataatcggttcccagcagcatatcgccccctggtaatgtgatatcgccgacagcgatgggctgattcaggaattcctccctgccgacggtcagtctgtcaaaggcatggcgatagatggaaaccggatgcatatccatgcctgatccacgattcagcacgtcatccgggtggagggtttcacctgccttatgggtgctggccagggtgatgacggatatggaggctccactatcaagaatagccgtcagagaggtattatcaacgtacaccggcagtcgaaccagcgcgttccgccagtcggtatgcaggggcaaggcggcatatttgcctttccatggcagaaaagcaccgctgcatgcttcgctgtcgtaaagatccagcgtgcgatgagggatatcgagcgcaatgtcatactggcccagtatatcgaggcccagcaggcccactgctggagaggcagtaccctcgatctccggaacacctgcgaccgccagactgatatcatggatgctggcctgaccgagttgcaacgtatgcagctgaacattggcatggctgtacaaaccaccgatgccctggataatggaggactgggtcggatctggcgccagatgcagtttctgaatggcattgacggcaatgacggttgcggctgcacccgtatccacgatcatcgttgccggctgatcatcaatgatgactggtacggcgaaaagatgtccatacgggatcagcgtcagatgggcatggcgcgtcagttcgcaacgggatccagctgaggcatcgcaggcggacagtaataaaggcagcagccacaacccttgacgccgcatgctgatagctttcagcaaggatctgatcaggctctgtgctgtgtaacgcagggtgtggctccacatgatcagggctggtcaggaacaaaccgcctgaccagatcagacagatgcccgatttcctccagcttcagcccttctggcggggagggacgatttttgccgcgtgctacccgacgcggtcggcaggccgcttcgaagccaagcttggcggcttctttcagccgtgcttccgtctgcggcacttgtctgatttcgccggacaggccgacttccccaaaaaagacttcattggctgcaacgggctgttctgttgcggccgagatcagggcggcggcaacggcaagatcggcggctggttcagtgatgcgcaacccccctgcgatattcagataaacgtcattctgggccaatttcagtccacagcgtgcttccagaaccgccagcagcatgcccagtcttgcactgtcccagccgaccacagcccggcgcggcgatccacccgcattgggggccagcagggcctgcacttccagcaggaccgggcgggagccttccatccctgcgaaaaccgcgctgccggcgatattaccgcgtcgttccgccagaaacagggcggatgggttggcgacttcagacagacccagatcggtcatttcgaacacgccaatttcatccgtggcaccaaagcggtttttgacgccgcgcagaatgcggaactgatggccccggtcaccttcgaaatacagcacggcatccaccatgtgctccagcacgcgcggaccggcaatggcgccttccttggtgacgtgaccgaccagcaccagcgcgaagccgacgcttttggccagccggatcagctcgaaaccgcaggcacggacctgcgctacggtgccgggggcgctgtccagactatccagccacatggtctggatcgagtcgatgaccaccagcgctgcatcacgcgctgtttccagcgtggcggcgatatccctcacatggccgctggcggcaagttccagtggagcatcggccagatgcaggcggcgcgcccgcaggcggacctgctccaccgcttcttcaccggagacataaagcgccctgccgcctgcccgcgccagcgccgccgcagcctgcaacatgagggtggatttgccgatgccgggatcaccccccaccagaatgacagagccaggaaccaggccgccgcccaacacacgatccagctcctcaatcccggttgcaatacgggggggaggggcggcatccgcgccactggcaggcaggctgacgaaagccagcctgcgccccggcgtgacccgcaccggagcagaggatggcgcttcctcgacaatgctgttccattcgccacaggcttcgcagcgtccggcccatttggggtaaacggctccgcaggcctgacatacatagcgggcgcgatctttgaccatccccgatcagaaacaggtggatggcatcatcgtcaagccgccattctgaaagctggaggtcggtgtagggtcttgctatgtccaggctgtgccccagatccgatccaatccctctcgctctgcccgtggtccgctcgttgcagtcgttctgccgggcaatgaatgtttccagccttcagcagcaggcgccattgctttgttgcaggctcagttggcgccgcacgcctgtcatacacggccggttattttcgcgacggaaccgaagaaagaggcagcttttcctggcattccgttctggccgatcagacctttgccactgccgattcctcgctccgcgcgctattctcatgccctgaaagcggctctggcgcaggcacagcccgatttgatcgaggtgcataacaggccacgccttgcgattgacctggcaaggcgctttccgggctgtccggtaagcctgtttctgcataacgatcctattgccatgaaagacgcgcggacagtcgaaaagcggatcagactcagccgagtactggctggtgtgacggtggtctctgcttttctgcgggatcgctatacgggtggtcacgaggatgtcgccgccccggaggttcagccgaactgcctcgatctggcggccctgccaccttctctgccgccggagcagcgggaaaaactgattctgtttgccggcaggctggtggaggaaaaaggtgccgaccgttttgtggcggcgtgccgcgccgtcttgccgcggaggccgggatggagggcaatgatgatcggcgcgtcacgtctgcgacccggcaaggatcttccctatgcgcgtagcgtgcgggcggaagcagaggcggcaggcatcatggtcgatggctatcagccgcatgctgctgtgctggcggccatggcacgggctgccattctggttgtgccgagcctctgggaagaaccgttcggtctggtggcgctggagggtatggcctgtggggctgctgtcctgtccagcaaccggggggggctgccggaagtcacgggcgatgccgcgatcctgatcgacccggaccagccggagcaatttgcgtctgctctcctggctctgaccagtgatgacgcgcgccgcgctgccgtgtcggaagccgggcgggtgcaggcagcgggatttgacgcatctttggccgcggcccggctggatgcgctgcgcctgaaaaccatccgcgcctgggggcagcgctgagattactcagcccggcctgatggcggccagagcggtcagcacgtcttccggcggcagcgtggaaagatcatcgcgcttgatccagcatgcgtcttgtccccacggtgcggaaatcaccgggtcggtatgcgcggacatcagcatcagggtcggtgtaccaagggcggaggcaaggaaagtcgcaccggtatcgtttccgacagccagtgcgctgcgtcgcgcgaccgccgccagagcaggcagggatgtgcggccagccagatcgatcagagcgggaaattgcagtcggatagcacgaatggcatctcgatccgcctctgttcccaccgcgacggaagccagtccttgttgctccagcgtcttggccagcgcggcatagcccggtgcaggccagcgtttccatggcagatgtggagagcagccgggaatcagcagggcaaagcgcggtggcagtgccagcgcatcaatattcgcatccagccagtccatcggtgcgggcgaaggcgggggcaatccggcggtgcggagctgtgccgccattttatcccggttggaaaaggtgccggtggaaaaatccggattgggatgagacgctccgcgtgccgcaccgatccattcggggcgctcgcgatgagggatcagtgcgaagtaccgcgccgtccggctggagcactgtaaatcatacacgcgctgaaaccgcatccggcggaaccattgccgccgtgacagcagggcatccagccgccaccatgccgggcgcggatcaaagacgacgtcatcgaaccatggaatcaggctggtcagcccgcgataggctggtgcagtcagcaaggtgatcctggcggcgggatgatgaagccggatggcatgaaatgcatccagcgcctgcaccagatcgccgaatgcaccatgcttgatgacgagaatccgttccatcactgtcgcgggcggctagacggtgaattgctcggcgatgatccgttctgacaggttgtgatccggatcgaacaggacggtcagcgacatggagcgatcttcgctgactgtgacggagacgacatcccgtacttcgcgtgaatcggcaaccgcggcaacggggcgcttttcggcctccagcacttcgaacacgacatgggcatcgcagggcagcagcgcaccgcgccagcggcggggccggaatgcgctgatcggcgtcaagggcagcaaattggccgatagtggcacgattggcccgtgggctgacagattataggcggtggagccagccggggtggaaaccagcacgccatcgcagatcagctcctccagacggacccgatcatcgaccagaatgcggatttttgcggtctggctgcgttgccgcagcagagagacttcattgatcgccacggcttcttccacggtgccatcctgcgtgacggcccgcatgcgcagcggatgcagatgggccgcatgagatttccgcaggtgctccggcaggtgggaggccaccgtcgggttcatcagaaaaccgaccgacccgcaattcatgccgtaaaccggcagatctttgcccatcacatgatggagtgtctccaacatgaagccatcaccgcccagtgctaccacacagacggcatcttccagcgggcaatccccatactgggcgaccagccgtgcgcggaattcctccgccagcaaggtcggtgcagccagaaaagcgatccgcccgggggctgcctcggctgcgcggcaactgaaggcggcttctggcatcagcggggcggaagggagcggatggggactcaagccagaacccgatgagtcaggaccggcatggattgacggactcgcgcgctcagggcggtgtcgatccgcgtagtggcccaacccgtgccatcagacacgcgagccaccaccatgccccaaggatccgcgatcagggaattgccataggtgaagcgtggctctcctttttcttcatgtcggccataggtaccggatgcggccagccagcactgggtttcaatggcgcgggcacggatcagggtttcccagtgatccttgccggtcagcagggtaaaggcggctggcagcatgatcagatccgcgccctgtcgtcgcaaggccagaaacagttctggaaaacgcacatcatagcagatcgcacatcccacggtcagcggaccagcgcgataggtgacaatctcccgtcctgcgccataggtagcactttccagatatcccaccccgtccgaagtctggacgtcgaacagatgaatcttgcggtagcgggccagttcgcgcccctctggatcaaaggcgagtgtggtgttgaacaggcgttcttccgatcctgccggatcacgctcaccgatggagccgccatgcagatagatgccatggcgacgggccgtatcacgcagaaaagcataggcagggccggtctccgcattgctgccgggggccggcagatattctgcctgagcgaatttatcggtccgctctccgcccagacaggcccacatttccggcagcaccaccatttccggccgttctgctgcgacggcagcctcgatcaatgtggccgcctgtgcgatattcgcagcccgatcatggccgggattcatctggatgacggtgatgcgcatgggcagctttcttcccggctctgtataagagatgccttctatagcggcaaacagttcaggctcactcccggtcgaagcgcggctctgatctgctgaaacgggttgccccgtcccgtggccggctgttctggcggggtgtccgcatatcatccgcccgtcgcctggactctccacgcatctggccatgcatctggggcaggtcattctcatagttgggcgtgtcataggccgatggaggaggaaaatactccgcttcctgtggggctggcggaattggcggacgcgtgtatgcagggcgatcctgctcctttcggatcacgggaggagacagatagttcagcgccatgtcgtcatattgtccgcgtatcggctcgggcaggcgcagggtcagagcacgaatttccccctgtatctcgtccagccgggcttccagattatccagtcggcttttgacgccgaaaacgctgaacggcatcagcagaaaaaccagcatatacagcagcgccgggaccagaaccgcgaaggtcagccagggaggagcccagtcgggcagggagaaaggtatcgtcatgcggttgaatgtatctggaaatcaaccgtctttgcacctcgtttcagaggaaccgacaggtttttacgctcttgatgagtgccgcgccggttactggtgggtcagtttctctacaagctgacgcaattcatcgggaagcggctcttccagaacactggccagactgcccttgagagagcggctgacccatagatcaaggacatcctgagccattttcggtttcctgacaccacccgaggggcggggagtgcctccttgctgtaaagggtagtgcgccatcatagggtgataagtgctgccgatacagtcggttgcacccgacactttatttccttggcacgttacatcaatcacatgattaacccgccgaggatgacagatgcttcattttccggggggctgatagggtgttgaggggttttccggtttgatgccggccccctgcaggatgaaatgcatcaggctgcgggcaaggcatacacgatgttgcagggcgatgtccttgacacggatattaccctcagtatgccgagacatcgcacctgtcgtgacccatcgccgcatgatgtcgaagcgcggatacagcgcgacaccatccggcacggcggcctgctccagcgcgtcctcgtaaagggcaggatcggcataggtgttcagcaggtggctgtagggcaggtcaatcagcacaatatcggtattggcagacaacagacgcccaaccccgtccttcagcgcatcataataggctgaaggcggcatattccgttccgcttccacagtgccgctctgccacagtgcgagatcgtaatgggcatccttcaggatactgggtagccggtcagcggtcgtctgtacctgttcgccgcgggcgccttgcgggctgagaaaaatcgtaacctgcggcagggcctgtttcagcatgaccgccgtcagccatgggacggcaggcatggccttgccggtccggctggctggtgtcccccatggtcccagcgtgacgatgcgaataagatgactggtctgtatggcctgccgcacatgggcaagttcacccggatcttctgccccggcatccggggggcattcggccggtccagcaggcaagagggccacatcctgcgaggtgatttccacgatgctggccgcaagccccgccccgtgcggagcatcattcccgcccagagcaaggggtatcgcaaggggcatcgtgaagagcagactgctaccggtggccagcagcagcactgtccagcgtttggccgggaaggagagagagaaagcctgtttcatcaccggattccttcagcttcctgcgcgggtttggcagcctgggcattgcgggtggagcgattgcggcttttggcctgataccaggcggcgaccatcgcaattcccgccagaatcagggtgccggaggcattgacccagatttgacgccacaggccgctttcctgctccatcagcaggcgccccatgaaagacaggaatataccgctgcaaaagaccggcagagaatgctgtcccgccagaatgaacggtgcggcgatccttccccgcagccagttggccgaggccgggatcagtcgcgctgccagccatgccatagcgagaatggaggcgaggcgcagcggatgcaggctttccttgtcaatggagaagagcagatgcggcagcgtggcggaaaggtcatggaccgtatccggccaacgggaaagaatttgcaggcctagccccagaatcagcatgatggcagccagcgcatcaaggccgatttgcaggctccgctgccggggatgcggaatggtggagggcgcataggcgacgattgcgccaatcatgaacagcacctgccatgccagcggattgaaataccatcccccaccggtccagttcggcaggatcagcccatcaaggcgggtggcagcatacagcgtcagagacagcccccccagcagccagggtcgtctcagaagaggcatcaggaccgaaaaagccagtagcagaaccacatagaccggcaggatattcatgtaggcaggctggtagtgcagcagcagcacatgcagcagcgccccgtaagggtctgcccccagcacatccagattgatctcatccagataatcggtacggtccatgaactgggcggcataggttacctgggccgcaaagactacgaacaggaagatatgggcgatataaagcgtccaggcccgccgggcgcactcggcggcggcataaagccagccgctgcgatccattgcttttccgtatgccagtccggctccgtatccggccagcatgacaaagacttccatcgcgtcggacaaagcgatgtttttcagcgtcaactcgcccagcacattgcctggcatgtgatcgacaaagatcatccagagtgccaccccccggaaaaagtcgatcctgaggtcacgattgaagcggatcagatccatggcggtgtcttgttccacatggcgggtggcctcggaaatgctggcccatccgtatcaggcgggccgccagttcatccggcggcccaaccattgacgaagctgtagcaacgcttccgtggtgggaatggtggccagtgtattgctggtggcggccccatgagccagcaggctgatggttcgggagtccgcgaaagtggccagatcggtcgctgtgacggcctctccggaggcccggcgccacaaggcaatcgttgctgccggggaaagatgaggcagcaccagtgtaaagctgaggcgtgatgccgccatggcggcattcaacgcgagcagcagggccgggctggaaactcctctgatgccgtgttgtgccagaatttctccgcatcgtggaatgcctgccagggccggatcgcgttccggtgcgccatcctcggtcacgcagtcgagcgtgaaaagaggctgcgcgacactgctcagggccgatagagatttatggatcgccgggccacgtaacagaatggcatccactgaaccattggccagaaccgagctggcggccgctgtatccgtgatgcccagcaccggcaccggctcaagaccgagcagatccagtgcgagcacaaccggcatttcaggcccgatagaaccggaaacggcgatacgggggcggctcccggatttcagcgagaaactgtcgcgccgacagaggacaacaccggataccgttccagccataaccggaacccagccggatgcatcgaagtggacccgtgtatctcctgcaagccatgcgagggcggcggcaccgggtgccagcagagcggtctgcccatccggtgcggtgcgggcttcaaattgattggcgcccgtcacgccatcggctgcgccttgaaacacaatggcgggtcgtgccgatccgttcagatgcccgccaagagcatccgcgacagcatgcgccagcggggccagtgcgccgttttcggttccggcaaccagaatggcctgaagatttgaagcagtgctctgggcacggccatagcggggaatggccagcacagaccctggaatcgcccccatagcggcgcaggataacagcttgatcaggaaggaacgacgggcctgccctgtcagcagggcgtcaggagagccttcccggtttatgatgtctgacaataacggctgattggtctgtggcacagggttcccctaccttcatgactgaagtggaggagggccggcccagcccggtctcctcacggcccgaagtatttgccttaaccgagttgtgtggtgacagcaaacgctccggggaacgcgaaagatattgtcatccgttttcaggcgaaaacacggcgcatctgccatgaattcgcctgaaatcaggatataaatgacacatcatcagaaagcgggatcagtcctgataatcaaccagcgtttcgcatggaacgttcagccgctcgcggcctttcaggaaactgagttcgatgatggtggcggcagcggcgacgtcagcgccgattttgtgtagcaggtcgatgccggccgcgagtgtcccgcctgttgccagcagatcatccacaatgaccacgcgctgtcccggtttgatcgcgccttcctgaatttccagacggtcggtaccatattccagcgcgtaatccagaccgatggttttgcccggcagtttgccgcgcttgcgcagcatgacgaagccgcagcccagcttcagcgccagcggggcggccagcaggaagccacggctttcaaccccggccagtatatcaggatgatgaacgcgcactcggttggcgagtcggcccatggtgacctgccaggcatctgcatctgccagcagggtggagatgtcgtggaacagaatgccgggctttggaaagtccggaatatcccgaatatacttcttgagatccatgcgcgcgggccttgctcttcgtccaaaattttacctgcccggacctgtcgcatggcgcaggtgcgcctttctagcggtaaccgcgggcgcgcttctatagcggtaactgcgaggcgtttaaatgcaggatgtgatcctgtcagaccggttatcgctctccgatcagccggcaatgaacaggaatgatctgcccgttctgtctgggcagcagaccctcatggctggagcagtcgagaagattgtcggggcctgatcgtctggccgaatagacattgatcagaatcctggcagagtccggcatgattctgtcgagatttttcttctgaaagcccctcccggaaatagtagcgcggccgccagttgcagagagggtcgttttttcctgaccaagagcaatttccccttccgtggcctctttttgagtcgctggggtggggaggccatcataaaagacggcaacggtaatggcctcatggcgcccgagcagcgtttgccgagccaatggcgaaagggtgacatcaaccgcaaagggaacaataggctcagggccatttgcattggccatgctaccggccatcaggcatagcaatgtcatcgctttgacaggatatagtatcataggaaaagcccgaaccatgtgatggggtccatcgaacatgcgggaaagaaaatcggctggtcggagtgagaggattcgaacctccggcccctgcgtcccgaacacagtgctctaccaggctgagctacactccggccgaggccgggcgtataaccaaactcctgtgatcatgcaagatgcctgggcataaaaggtgatcgtaaatctctcttgtccctcccccctttctggatgtggttgttatgcgagtttaaagaaaagcctccgctatgggcattcacatgcggcggtggatatcatggcgaacaagggaggcgcccgcactggtcttgaccagtgcgggcgctgtcattgagatcaatgatggttcaagttggttcgcaggtctggtatccactttgatacatccccggcatgatggcacatcttgggtataaaatgtgctgtttcatcatagatgtaaccgtaatcatcaagaatgctcagccggagcagatccttgcggggaatagctatgcctgagcagttagctgctgctgcgcggttggagagaacacgcatttctactgatcgagcatgtccccaggaagcacctgtgatgagtggaacgattatgaaagccgacgccacagaaggcgcaaattttccgggcaggcagtccaatgcatatattgcgatgccgataaagaaaggcaccaatataggtgcttcgtgaaagtcgctaaatgcccatgcgactccaaggctttctctgccaacggtaaattctgccgtccataataacggtattacggttaatacagtaccaaggcgcttttctattgtgttaaaggtcagggagcgggtgaatagaaacgcccagactataagtgaaattgctcctgcaatgagggcaaacgactcattttgattaccaaatccacccccgatcattttggtgaaatacatcaggtgttcaaaaaggctggtaaccttttctgattttgtaatatgtatattaggcacaagcatagtcagccatacagcaacaagaaaaagaatggcatgtaacaagccaatcaacaggcccttgcgtatttctttggagcgcagcgaaatcatgacaaaatgtgcgccacttgcaagccacagagcgccgccttgagcttcagatcctgttgcaagcagacatataatgaaaatggcagggtaggcgcggaaaccatagcgttcgatcaatagaagcgagcatgccagcatagctagatctagataccaccatatctggaagctccatagcaggtagcttgtctgtgatggattgagaagtggcagggtaacggtcagaatggtcaggaatggataggtctttatgatggttgattgacgaagtgcaaaccaaagcatgataccactcgacagcagaagaatggcattttcataaataagtgctttcatccagatttcagtcgcttgcagggttgccatagcgacgaccagatgaaatgcaataagatgttcgttgctacgtgccttgatcagatcgattaagcctgcatttccagaagaaaagaagttaatatatcgtagaaaaccataatcatcattagatggccatattggcccataatgataaacccatgcaaataaaatgattcctgttataaaaaaggttgaaataatcattattttctgaataattttttgtgtatgcataatttttccctttatatttttctattattgaatgatggaagtaaatttccaatttatatctgtaaaaatagcatcaagatttcatttttttgtaaattccggtggcacgtcttttaaagacgatccaaatcgccattttctttttccggcatcttttgtagccggtcgagaagcgcggacacatctggcacgacctcatacaatcgctggcaactggcatcggcgaagccatcttctatggcggtgtccagcaccttaatcagggcatcggcccagccatcaatgttacagatcaggatcggcttatcgtggaggcccagctgtctccaggtcacgatctcgaacgtctcatcgaatgtaccgaggccgccgggcatggtgacgaacgcatccgccagatcgaacatgtgtcgcttgcgtgtatgcatgctgtccgtcacgatcatgtccatgaccttttcatgcatgacctccttctgacgcaggaagtcggggatcacgccggtgactttgccgccttcggccagcacgccatttgtgacggcccccatcaggccgatcttaccaccgccataaatcagtgtgatcccggccttggccagtccacgtcccagcgccagggaggcttcgtaccagaccgaacgattgccagtgcgggagccgcagaaaacggcgaccgctttcacagtggggtgcggagtggcggtaagaggaagcccgttcatgccggcgtctttcaagagtggctcctgtattgagcaatgtccaaaagaaataaatcgaaggatcaatcagcccccgaattgccgcaagagcaggagtgtcagcagcagggcgcacagcagcaccagcgctgccatgcctggtccggcaagtttgggtgttctggtggcggcgggcaggcgttttttaccgctgatgaactgccgtaacgggctttccccggagatatgcccggcgatcaggagcaggagcagatgcagcgcaaacagcgcaccgagaacgatcaaggcaacactatgggcaaaagcggcgttggcagcttcctccggcggaagcagacggaaaaaaggatccgatggtaaggcacataatcccgtcaggcacgcccctgacagggccagcagtatcaccaatatgagccatccccctgcagcaccatggccgaaatcggggcgtgtggcctgaccggggctcgaagccatgaggcgggttggcgcgtggcgttttgtattccgcttttccaccccgctcagcggcgcgacgaggaacgcgctgaatcgggaggtctcgctccccgcgaatccccagccaagacggaacagcagcagaagaagcagcgtctctgcggtccagcggtgaatgtcaggccagccctcgacccagctcaatgccagcaaggctgccagaagagtggatgccccatgaaacaggcgcagaggcgcatcccatactcgcatcgatagccgaataccactcgccgatttcatgctctatccgtttgttcaggccgtttattcagggtcgaaaccgcggcaccttgacgcaaggcagcgcatcacgcgatccccttttgcgacaagttgaccgttttgtggaggccagcaccgcatggcaatcgcggcatcccaaccgccgggcctgcttcagacgataccgggtggtccggtgccctatgcgctggttctggcggccctgataccatggttgttgcggcggggggcagcatggtccggcctgaacggtctggcaacgatcgggggcggtgccgccatgctggcgggctggctgctgttggcacccgtgccgacgccttcttatacaagtggcaaagccgtttcattattcgagtcgctgctgctgttggcggttgtgtctactctgctgctgccatggcgattaccatccttcctttcccgtgctgtgaccgctgtcagtgcagggaaaagctgggtgccccttatttcccgtgggcttctcctgctggcagcaggctggtggctgacccgtgtgagcgggattcctgtgagtatcgccagatgggcgacgtttgcgttggctggtactggcgctgttctgttgcttgatggctccatgcgccagagggcagcagggctgctgacggcggcgacctgtctggctctgacgctggacgcatgccgtgtgacgagcccggtggggctgcgatggtccggtctggcatgggttgtggcggcggcggcgctgggaacatggttcgccgggggaagaagggagcggcctgccggcgtcaaacgcccggctgcgggcaaaaaaacgtcgaacgcttctcgtagcaccgggaaaaaactcgtgcagaccaaaccacctgccttgtcccttggggcggatcgggtggagcaggccgaccatcctctgcggccgcttcaatatgccgcggcgacactgatactggccgtggcgctggtcgccctgcatccgggcggagcatctgttgccccgctttcccgagccggatatgcggccgggctgatctggcttcccccctggataggcctgtccttatacagccgtttccagcggaaagggcgactactgaaaccggagccggttgcagccacgatggctgtcctgctgactgcgttggcgacctattcagcagcagccttggccggtttgcgataggctggagtagtgtgaaacccctctcgcttgcccctctattcagaaggtttcataaccgtacgctccatccccaaagggaagtctgcccagatgtccatggttcaatctgtcaaaatggttctcgctcctccgcatccggcggcgcggccattcctgatcggcggtgtggctgtcgcgttggtcggactgtttctgtcccactggatcgtttggctgggtgttgcctttacgctgttctgtctgttcttctttcgtgatccggagcgtgtgccgccgggccgaacggggctggctttggcaccggccgatggtcatgtcgtatccgtggcccccgccgttcctccgccggagcttggactgggggatacgccgcgctggcgggtagcgaccttcctgtctgtgctggatgtgcatgtgaaccgtatgccggtggatgggacggtcacgaaaatcgcctatcggcctggtaaattcgtcaatgcgagcctcgacaaggccagcgaggataatgagcgtaatgcgctggccatccgtatgccggatggacgcacagtggcggtggtgcagattgcggggctgattgcccgccgtatcctgtgcgatgcgcgggagggcgatgtggtgaatgccggagcacgtttcggcatcatccgcttcggcagtcgtacggatatgtatctgcctgaaggcgtggtaccgctggttacggaagggcagaccatgatcgggggcgagaccgtgatcgccgatctgacgccatgagcggcgacgaaacatcggcaagaccgcacggagacgcggcaaggcatccgcgctttgccaaatcactcggcatgcgccgccgtcgccggttgcgtcgtcgcccgcgtttcgcggggccttctttcaaccggatcattcccaatctgctgaccctgctcgggttgtgtgccggcctgacctccatgcggctggcgctggaggggcggttcggatgggcggcggtggccatttgtgtcgcggcctgcattgacggtctggatggcaggttggcacggctgctgagggccaccagccgcttcggggctgaattcgacagcctgtccgactttctgtgcttcggggtggctccgtctttcgtgatgtatctgtggtcgttacgcccggttcatggattcggctttgtgccgtgcctgatgttcgcggtctgcatggcgctgcgtctggcgcggttcaatgctgcgctggatgagccgaaggactccagcgtcagtaaaccggcctatgtgcagaatttcttcaccggtgtgccggcgccgatgggggctgcactggtgttgttcccgctgttcatcgggctggaagcgcgggaaatggagtggccgggcctgctggcattgtcgcattccccgctgttctgcgccctgatcctgatcggcacggccttgctgctggtgtctacactgccggtctggagtttcaagaacttcaaggtaccgtcgcagtatgtgctgccgcttttgctcggcctgacggtttatattgctttccttgtggcggatccatgggctgcactggccgcgtttggagtgctctatgccgccatgttgcccttcagcgcccgcagcttccgccgtttacagaacgaggcgctgctggaggatcaggaggtgacggaggcggaagggcaggggaacggtgtcagcgattccggcagataaagcggatgatgggggcaaccatcggctgacaggcgcagggcgtggggcgcgattcccgcgtcacgcagcatgcgcatgacagcaggcccacgtgactggagcggtttcagctttggccgcccataagcgagaacgaccagatcggcttcatcggccatgcgcagcaaggctgcatcattgcctggtccaacaggatcactgaccgcggccagttgaagctgatcggtcgcacgataaccgaatgtattgcccaccagcagcgttccatatccccagcgccgggcatagcggccgcatttggccacactcgggtcatcatgggtgggaatggcggtagaggggttcatcataatgaacatgaccacaggtgcagccttgtcccagcaccgtcgcaattcgtaacgatagcaattgccggggccgtcaaaaacagcattgccgatggtgccggatggcaggcgcagtaaacgtttcccgcctggatcatgctcaggcagggaagaagaggcgggaggacggcgagcgatgatagtcatggccctgttctgccatgcaaagcagccgcaaaaaagggggctgtgtgccccctttcccgatatgtcttattttacatttttaccgatatagtctttgaggttgccaaggccggtcttgatcatcgtggtcatggcactgacggcggcggcatcgttcagattatccggcggctcattgccggtatcgccacgatagaagcggccatcccaggtgattttcgatccgctgccatccggcgtgaccgtcagcttcacgttataggagctgaccggtagagcggtgacatcgtcatcgacgcgccgccagccgatctgcttggcattttcatcaataaaatcaagaccttcgacaatctttttgccggatttcagggtcagggtgcgttcctgcccctgatccttatcgtttttgaaagtgactgcggtgaactgggaatcccactttccgactccaccgaaatccttgacgatcgcccataccttgtccggcggggccgacacggtgacggattcgtccaccttctgcggcgtagggccgtgcgcatgcgcggtgaggggcgaaatcagggaaacgccgagaatcgcgcccataaaaagccgtcttttcatcgaataaccctcttgcgaagcatgtgagcatcacggctgtacgcaagctcgaagagcacgcaaacctcatgaagagggttgttattgaaaagcagaataaatcggggttttttctattattatatgcatattatgcaattatgtgttcttatttataacttactaaaaacactatatgcttgatttagacaataagtccttaattgaattttgcctctaggaagtcgacgaaacccgttcatacgatccgcccaacgaaacgggaggagacgaaaagtcgatgcgcaaatccaaaacaggactgctcgcgtctgcatcgctctgtgcggtgttgggcgttgccgctggcgctacgtccgccatggctgaggacaagctgatcgagctgtccaagagcaacgaaaactggctgatgccgggccgtacctatgaggcccagaactacagcccgctgaagcagattaccacgaagaacgtgaaggatctgaaagtcgcgtggactttctctgatggcgttctgaacggccacgaaggtgcgccgctggtcgtcaacaatacgatgtatgtcacgggtccgttccccaaccgcacctttgcgctgggtctggacaatcctggccgcatcatctgggaaaacaacccgaagcagagcgccaatgcccgttctgtggcctgttgtgacgttgtcaatcgtggcatggcctactggccaggtgacagcaagacccctgctctgatcttcaagaacctgctcgacggtcgcctgacggcgatgaacgccaaaaccggcgacgtcgtttggcagatggaaaatggcgacatcaaggtgggtcagacggagacccaggctccttatgtcgtgaaagatctcgtgatcacgggtagctccggcgctgagctgggtgttcgtggtttcatcaccgcctatgacgtgcatactggtgcacagaaatggcgcgcttatgaaactggcccggattctgatctgctgctggcgaaggatttcaacatccacaacccgcaatacggtcaattcggcctcggcacagagacctggcaggaagaaacctggaagatcggcggtggcacaaactggggctggtatgcatatgaccccggcaccaacctgatctattacggcagcggcaatccggctccgtggaacgctacgatgcgtccgggtgataacaagtggacgatgaccatcttcggtcgcgatgctgataccggtgaagccaagttcggctatcagaagaccccgcacgatgagtgggattatgccggcgtcaacgtgatgatgctgtccgaacagaaggataaagacggtaagctgcgcaagctgctgacccatcctgaccgtaacggcattgtctacaccctcgaccgtacaaacggtgatctggtttccgccaacaagatcgacgacaccgttaactgggtgaagcatgttgatctgaagaccggtattccggttcgcgatcctgaatacgcgacctatatggatcacaagggtcgtgacatctgcccgtccgcgatgggctatcacaatcagggcttcgacagctattctccggaaaagcaacagttcttcctgggtgtgaatcacatctgcatggactgggagccgttcatgcttccataccgtgccggtcagttcttcgtcggtgcgacgctgaacatgtatccgggtccgaagggcaatcgtcagacctatgaaggtctgggtcagatcaagtcctacaacgcgatcaccggtcagttcaaatggcagaagatggaacgcttcgctgtttggggtggcacgatggctaccgccggcaacctggtattctatggaacgcttgatggcttcattaaggctcgtaatcaggataccggtgagctgctgtggaagttcaagctgccgtccggcgtgatcggttacccgatcacctatgaacacaagggcacgcagtatgtcgccatctactacggtgttggtggctggcccggtgttggtatggtgttcgacctgaacgatccgtctgccggtctcggtgcggttggtgccttcaaggaactggcccattatactcagcagggtggcggcgtgttcgtgttctccctgggtggcaaaggcccgtatgacgatccgaaggttggcgagtacgccaactaatcgggttcgcctgtgaagaaaggcccgccatgatatttttcgtggcgggtctcacagcttcagcaatcgaatggttttacgatgcgctatcgtcatatgaacaaccggcgtcgctatgttgcggcatcagctttgggtgcattgtttgcaatgtccgccacagtgcagcccgcacggtccgatacgactggaagcgcgtcttccgggcaggatacgcagaagactttgcgaatctgcgcctctactaaacaggctccgttctccgaacctggagcaacaggtattgagaacaagattatgactgcggttgcggaggcaatgggccgcaaaccggtttttgtctggactgatcggcctgccatttatgctgtgcgtgaccagctttacaaaaatacctgcgatgtggttgcgggcctggatgaaggcgatgatcgtgttctgacaacgaagccctattatcgttccagctatgtttttatcactcgtgaggatggtaaggcgcagccgaaggactggaaggatccggcgttcgagcatatctccaaaattgccgttgcgtttggctcgcccggcgagctgatgctgcgtcagatcggtaaatacgaagataatctcagctatcagcagtctttggttggttttaaatctcctcgaaaccagtatgttcaggttccatctgacaagataatttccgaggttgcatccggtaatgccgatctcggagttgcgtttgatccggaggtagcacgctatgtcaaggcgtctccggtaaagctgcgcgtcactgtcattcccgataatgccactcgctctgatggccagaaagtgccgatgcactatagcgaggtcatgggtgtgcgccgggatgatgcggcgttgcaggcagagctcgatggtgctctggaaaaggccaagccacagatcgccaatattctcaaggacgagaatattcagactctcgcgcctaattcctgagaactcttaaagaccgatagctgtgtaatatcgagacgcacagccgagaagaaatggaacgaacccttgacgtttaaatatatcctgaatggaactctggctgcctccctgtttgcggctgcttttgcggtttctgtgcctgcgcatgcaggtgatacgcctgttccgcccagcgccctcaaattcaccaacacggtcagtggtgatccactggacctgaacgactccctgccagatgggcgtgatacgcctgccgtcaagcagttccttcagaccgggcataacccatacaatctgattgaatcctgccttcccaacggcaaaagcctgtggctttctgcctgttccggttgtcatggcggagagatggagggcaaggttggtccctctctggctgatgactactggacttatgagacgaacaagaccgaccagggcttgttctccacgatcttcggtggcgcgaacggtatgatgggcccgcataatcaggatctgaccatggatcagatcctgcgcgtgatggcctggattcgtttccactatgaaggcccgaagcacacggatgaagacatgccgtggctgacggacgctcagcgcaagagcttcaagctcttcaagaaggaagatgaggccaagttccccgccagcgaggacgcaaaagcctgcaagcttcccggctaaccatccaaaccaaatcaggaggaagtcatatgttcaagagaatcatccagggaaccctggcagcggccctgatcgccggtgcggctggtgcttccgttgctcatgccgcttatgacggcacgcattgcaaggcgccgggcgtgtgctgggagccggaacccggttatccggcaatcctgaaagggtccaagtacgacccgcatcatgatccgaaagaactggcgaagcagcaggctgctctggacgctcaggaagcccgcaacaagttgcgtgtcgaaaacttcgtcaagaccggcaagttcgagttcgatgtgaacaagctgcagggtcagggtaactgaggtctctgacttttatgtcaggatcaatggccgacgccagcgccgaggcttttagcctcggtggttggcgggagcgtgcgattgcgttcgaagcggcagtgtctggtgccgttctgggacagcaacgtgtcgttcgtcttatgaccatcgctattttggcacggggccacgtgctgctcgaaggcgatgtgggtgtcggtaaaaccactcttttaagagctgttgcaagagcgattggcggtccatacgagcgtgtcgaaggcacgatcgatctgatgcctggtgatctgatttaccatgcagccattggcgatgatggtaagcctaggctggagccggggccggtgctgcatcatggtgaagatctggccgtttttttcttcaatgaaatcaatcgtgcccgtccgcaggtgcattccctgctgctgcgtctgatggctgagcggagcgtaacggcgtttaatcgcgaaattctgctgccgcatcttctggtttttgcagaccgcaaccgtctggagcgtgaagaaacctatgagctgcctgctgcggcccgcgatcgtttctttatggaaatcccggttgaaacccctgccgatgataccattaggcgacagctgatcttcgatcgtcgtttccacgatgtggacagtctgatcggtgcggttgagaccaatattctgcctcataccacactggatggggtggcaagggctattcaggcccgtatccattcttcagatgcgttcgaagcgtatgtggtacggctttggaatgctctgcgctatcccggtcagcatggcatcatgctggatggtgtcgatatggatcgtctggtgcagggaggtgccagcccgcgtggtctcagctatctggtgcgtgcggccagggtcaatgccttcctcaatgggcgcgatatggtcgtgccggaagatctccgtgccgtgttcatggaatccatggcacatcgcatcttccttgatccactctatgaacttcgacgggagactctggtgccggcgctgtgccgtcaggtgctagagcgcgttccggccccgtgagcgacgcaatgccggcgttcgatgacgccgcgttgcctgatctggcctataaagtgcgttggcgagtgccgggggccagacccggcagtcaccggggccgccagaatggcagcggaggggagctgaggggatatgttcccttctggtcctctcccgacacacggcgtatcgactttgcccgctcggcgaaggagccggacggcacgctgatggtccgccagattgagcaacgcagcgccattgatgtctacgttatcgccgatctgtcggcgtcgatggatccgaccgaagatggtgcacgccgcgccgaaattgccaaactggtgaaggctctgtcacaatcagcccgcagaagcggggatgcgttcggctttatcggtttcggggaaactgtaatgcgggacgaccttctcaaggcttcccgcgtcaggggagcagagcaggctgttcttgagcgtttgcagacggagccgctgacggcacgcaacatcaatggcctgaaggatgttgctgcctatctgggtacccgccggcgtctggtgttgctggtgtctgattttcatgccccgcgatcagtgctggaaccgtcattggcggcgctggggcgtcatgacatcgtccccattgttttgcgggatcggcgcgagcgcgaattgccatccggttttggctttatccatgtgcgggacgtggaaaccgggcagccgcgcagtctgctgttgcgtcccgctctgcgtcgacgatggtcgcaggcggcagccgagaatatgcggatgctgggacagttattgtctacatatggccggcctcctttctttgcctgggaccggatcaattacgaacgcttgagcgaacatttgctggcaggctgagatgaatgctttttcgcacagatcggcggttgcgttgctgttggcaataacagctgcgaccgtacatccctcctgtcccgtcagggcggccgacatgacgcatcatgatgccgccatgaaaggtgcttctctggcatttcatccacctgatcgtctgttcggctattatatcggggatgttctggacagtacggtcgatataacccttgccaagggtgaggcactcgacccgtctaccgtgccgacacccggcgatatcaattactggctgaccctgcgcagggtcgacgtcatccggcacaagcgtgcagatggtggagaacaggttcggcttactctacaatatcagacgttttatgatccgttggaaccaaagaaattgccggttcccggctttacactcgtgatccatggggcgggagcggacagaaaactcagcacgccaacatggcagttcttgagttcgcctatccgcgaagtcagccctggcgaagatgtcgatgccagtttccttcaaccggatcattggccgccactgccggatgtcaccatcccacgcagggctacgttggcggcgctgggtgtggcgctgctgtctctgatctggctcggctggctctcgggctggttcggcacgatattgcgtcggcggtcacggccttttggatttgcggtccagcagattcgccgggagcgtggtcgggaggaaagggaagcgtatcgcaacggcctgaaagccttgcacgaagctttcaaccgtaccgaagctggtctcgttctggccgaggatgtgccgggtttcatcacccgccatcagcgttttgccggattgaaggtagagatcgagcaattttttgaagcgtcgagacgctgcttttatgcatccgatgttgtgcaggcgatgcaatcttttccaccgcaagcagtcctggcactggcgcgtcaactcagacggtctgaacgcgcatgatgcatctcgccattgatagaccatgggtcttgctggcgggattgctggcattgtggccgttattgggcgccggcttccgccgggtcgcttttccatccgtcatggtggttccggcggatcgtctctctgctgtggtggtctgggttctgcgtgcgctgggggcgatggcgatcatcgcggtggtgttggggctggccggtctgcatcgggaaaagctgacgatccagaaagtcggtcagggtgcacagatcatgctgttgattgatcgcagcatcagcatggaccagaccttcgataatcagacaccgaatgccgccaaggaatccaagactgatgcggccattcgtctggtgaaagattttttccgtcaacgcccgcatgaccgttttggtgttgtggcgttttcaacatcccccattctggcaatgcctttgaccgagcaccgtgcagcggtagaggcctctctggatgccatgaggcgtcccgccattgcccgcaccaatatcggtcgtggcctgtcgctcgctttcgcgcagcttcagaacagttctccagatgcggcgcgtgtggttctgttcgtatcagacggtgcaggtgtcatcgatggagaattggagcctcggcttcatgccgaggctgtaaagctcggtgtccatatctattatttatatctccgcacggaaggcgatcccggcttgcatgcggcaggcgaaacggcggatgctgatgcccctgcagcgttggatgcatggttttccggtctgggtgtgccatacaaggcgttcgaggctgataatccgaatgccctgaaatccgctgttgataccattaatcgactggaagcagcgcctatcatctacaacgaatatgtgccgcgtgaggattacaaccggttctgctacggtattgcagcgctggttctcgcggttttatgcatggcacgatttctggaacgcgatctgtatcgcggcaggagggcggcatgataagcagaatacaatggttgacgcccggcagaatcagaatcgctttggcatggctggtgttcggcggggctttgggagttgccggatggcaggggatgcactggcagcgcgccctgcgtgatacgcatcttatgaagcagctgcgacatcgcaatgatgtggccattcccgccaatgcggcgcccgaggtttatgtggcccggggacgctacctgctggaaatgggcaaatacgaggatgcacggtcagtgctggagcatatgcagcatgctcctccgcatctgcgtgcgatgctgtcttacgatattgccaacacgatgatgcggcgggctatcgacgagattgataatgatgctctggagaaaagcattccgctggtgatcagcgccaagcaggattatcgtcgtgcgttgaaagatgatcccctgaactgggatatgaagttcaatctggatgtggccatgcggatggtgcgggatttccccgctgccgagcaggaggaaggcgattccctgcctgcgaccaaaaaattgtggcccaacatgccgggtcagccgcagggattaccctgatggcaacgccgcgtattctttcctggcctgccgcaggtgatccaaggttctggttgagtgcaggcgctgttttcctgttggtcctggcagtcattttgccgcgcgtttaccatacaggtccgtcttaccgcatggttgccgtggtcgatatcacgggcagtatgaatacgcgggaccagatgctgaatggtcaagtcgtcagccgtctggacaaggtgcggcatgatctgagtgattttgtcgggcgactgccgtgtggatcccagttcgggctggcgatttttaccgagcgtcgcccctatctggtggttgagcccgttgaaacctgcgcgaattttccagctctggacgatgagatcacgcatctggactggcgcatggcatgggaaggagacagccatattacggaggggctgtaccgctcgatcgtgcttgcgcatgatctgaatgccgatctgatgttcatgacggatgggcaggaagcccccccgctgccatggactggaccgccgcctttcgacgggaagaaaaacattgtcaaagggctgatcgtcggtgtcggggggctgacgcccacgccgattcccaaatacgacgatcatggccgtcaggttggattctggaggccgcaggatattccggcagaaaacgaggcggcaccgccgccgccggatgcggaaaaccgtgaaggatacaacccccgtaatgcgccttttggcaatgttggcggtaatgcatcaggctcattatcggcggtggatgaaaaacacctgcaatcactgggaacaataaccggcctcgactattttcatctcggcacaggcgatctgaatggcgttgctgaaaagcggatgacgaaacgtccggtcaggcaacgggtggaaatttcatggattcctgctctgctgtcgcttgtggcattgggtttatgttatcttgtccttcccgtattgggtgtggtcgcggtctggcgatcccgtgcgcaggcccggcggcggctggaggacagaaatgcaggaagagacagcaataaggcgtcctctgtggcggtcaatcctgctcccacggccctttaccgcgcttaagcattctatcaaggcccgtctgatcgtgctgccgctggttattctcgcggcagcaattctgtttgtcatcggcgtggtcctgttcgattccaacaagcggatcgagcaggaaattcagtccggcacagaactgggcgacatgctgattcactatgcattgcgcagcctgggccattctggcgatcaggatgctgagatcgagcatttgatttccgatctctcaaacattcgccatgtaatttttatctatgtgccttccggggccacgccgcctcatgcggctccgccacttgtggagagcggggcacccgcatggtttgcgggatggtttcatgttccacgtcccgttcgttccttcccggtgcagattgaaggcgtatttcgtggcgatatcgtgatggttggcgatcctcacaacgaaattgccgaaatctgggaggagcttaagtttctgctcggattgctggcttgcgtatccttgatgatcatggcggccatgttctggaccgcccgctatgcgctgaagccgatcagcacgctggcggagggcttgcagcgtatgcgagccggccagttcgacgcgcttccacctctttatgtgacggagctgaagcctattggggagcgtttcaatcagcttgccgaaacgctccgtgcggtgcgcggcgataatgagcgtctgctggaacagatggtttcattgcaggaaacggaacgtcgtgaactggcccgtgagctgcacgatgattttggcgctactctgttcggggctcgtgcagagctggctaccttgttgctggaagcccgcaggcagggcgatgcagggcagcccattatcgagcgcgctcatgctgtcgcgagattgatcgatcagattcaacagcagaatggccgtattctggaacggctgcgtccgatggcgctggatcacatggggattgccgatgctattcgggatctgatgacccaatggcaggatcgctatccggagatggagtggtggctttccatgccacgtgatctcaggatagaaaatgatcagatcaacctggttctctaccggactgtgcaggaatgcctgaccaatgctgtgcgacattcctcggccgagcgggtcgatgtcactctgtcatggcatgatggggcgtcaggacatggttcagcgcgccgtctgcagcttctggtaaaagatgatggcactggcctgccggagcatttccggatggggtttggattgttgggaatgacggagcggttgcggcaatgcgggggcgagttgaaagtgcggaacaatcatccgcatggcactctggtggaagcagttatgccggttgcagccgtgcagaaggaaacagcggaatgacgcagccgatgatcaaggttctggttgtggaggatcatccgctggtgcgtgccggatgccatcgcgtgctgagccgccgggacacgctggaagtgctggaggccagttccggtcaggatggtgttgccatcaatgctgcacagaaaccgcatgtcatcatcctcgacatcaacctgccggatagcaatggcttcgatctgcttgatgatctgctgagtgataatcctgatgtgcgtattatcgttctcagcatgtatggcgatacgcatttcgtacgccgtgcgcttgatcggggcgtcaaaggatatgtcaccaagaacgacgatccggagacaatcctgctggccattgatcaggtgatgaataacggcgtctatctggggcaggtggtggcgcagtctctggctctgggaaggctgatgccggattccaatgtggccgctgagctgtctgtcaaagaaaagcgtgtgctggaactgctcggcgatgggttgagcctgtcggaaatcgcttacgagctgggcgtcagctacaagacagtggccaatatgagcggtgctctgcgcacccggcttaaaattcgcaccggggcagcgctggtcaagttcgcagtggaatggaaggcgcgtacccagccgtaaaggcaaaaagtgccgcgcctgcctgataggacggacttattgccgcccgtatgtgtcttccagccggacgatatcatcttcacccagataggcgccggactgcacctcgatcagggccagcgggatatgaccgggattggacaggcgatgcacagtgccgagcggcagatagatgctttcgttttcccgcaccagaatgtcttcctcatcgcgggtcacgatggctgtgcctgcgacaacgacccaatgttcggcccgatggtaatgtttttgaaggctcagacgatgaccgggggaaacgacaatacgcttcacctggaaacgatcactctgaatcaggctctcgtaaaagccccaggggcgatagatacggttatggctggctgcttcgggtttgcctgagcgtttcaggcgatcgacgatctttttcacatcctgtgcatgatcgcgatgcatggccagcacggcatcttttgtcgtgacgatcaccgcatccttcagcccgatcacggcggtgacgatgccgtcagacctcacatagcagttgctggcgctttccagcatggcatcgccctgaacgacattgccgtgatcgtccttatcgcccagttcccacaatgcgctccagctgccgacatcggaccagccgatatcggccggaaccacggcagcacggctggttttctcggcgacggcataatcaaggctgatatccgggcaggttacgaagggttcccgggccagtcgcaggaaatcgagatcctgcgtacgtccggccacggcggcagtcacggcttccagtacggcgggggcgtgctggcgcatctcttcgatcagtgtgcgggccgtaaagacgaacatccctgaattccacagatgctggccggaactgaccagtgcctgcgcggtggtggtatccggcttttccagaaagcggcgcaggcggtgcacaccggaaagctcggtgatcgagtcgccgacttcgatatagccatatccggtttccggagcggtgggctgcatgccgaatgtgacgaaatatccggctttcgccgcagccacggccttgccaagcgccgcaagcagagcatccggtcgggtgacggagtgatcggctgccagcatccacagcaccgaatcgggattggtttcagcggcaagcaaggcagccgccagaatcgccggtgcactattgcgcccgcatggctccagaacgatgcgtacgttctcgactccggccgatcgcgcctgctcggcaatcagaaagcgatggtcctgattacacaccagaatgggaggggcgaattgcggtccttgcgcccggtgcatggtgtcctggatcagggagttttccccggtcagattccagtattgcttgggaaacgactcgcgggagacgggccacagacgggttcctgtgcctcccgacaggatcaccgggataatggcttcctgcggagagagcggctggaaaggcgctttgggggagtccgggccgctttcagtctgatccatgggaaccattatcctgcatcaataaaggcttgggccggaaaaagcttgtgcaggccgatggcctttggggcggttattccgacaatcatgggattatccgttggcatagtccgggagcaacgtttctctcagagtggccgacgtgcacgttccagcaggcgtcccagaaaaccgggtttacgcggttccgtcggagcgtgcgcgggctgggctgcctgctgacgggcggcttcggcttctgcccgttttgcggtcagccatttgtccagtgacataccagccttggcggcgcgccgctcctcataggcacgctggcctgcggacaggggttgtgctgccttcggggatcccttgggggccgttctggtagaggaagcagaagaagatctggtcatgcggttcccggtgcatactgaaataaggaggcgtcgtctggcttgcctgttgaaaggcaattttatccggacctccatgattcttctgcttgtgccaaagccgcggaaggccagcaagccagggtgtaggcagttataaggagagcatccggaggaaacccaccgggattgtccggccggcgggagcgtggtttcatgacgcaatcacaatcaagtgatgtcgagcatcaatcggcacgatcggattggaatggctgccatgagtgaggcaaggatcaaggccagactttgggtgcaggccgcacttcgtcaggcggatctgacaggccgcccggggatggttctgcgtcatggcgatgatgatgccggtggaatcgcagctgttctgagggggcgggatggattttgcgtgctgatgcagacgcgggcggcggatggaagtcctgcctggatgcgtgccggggggggagccggttcccttacacaggatcaggtcgatcaatatctgacccgccagacttccatcgactccgacctgtgggtagttgaattcgattcccctgatctgactccacccttcgaggcaaaaatattgtaggaaacagacgcttttatcgtgagaggctgacaaactttccggctgcagaaggaatctgtggccgtgctgcaacagtgatggataaaggcatcatccccacctgcaactgtgcgactaagctgctacgttctcgtttaccgagcacaggcgaacgggcaagcccagccccgtgccttggctgcgcaaaagcgcaggttttgaacgaggagagatagaatgaagctccggagtgcgctcctggctgcgaccgtgcttgcagcacctgtcgctgcgaaggctcagcccgtcaccggcctgtatgtcagcggcggcgttggtgttaatcttcaacagaaccagaccgtcaatgccggcggcattttttccggcgccggtttcaacacccgctctgaacccggtgtgaccggtcaggtcagtgttggctacggtctcggcaatggtctgcgcgcagaactcgaagggttctacagctggaacgacctccgctccatcaagagcagcggcccgaccagcagcagcggcaagaacgagaaggctggcgctttcgtcaacctgctctatgacttcgacctgggtctgccggtctacccgtatgttggcgttggcgccggctacgtttggaaccacaacgtgatcaactccgtgggtgccggtggcaatgatgctctgcactacgacaagagcaccgacaatttcggttaccagggtatcgctggtctgtcctacccgctgccggttcccggcctgtctctgacggctgaataccgcttcatgggccttctggacccgcagcctgccgctggtggtgctgtttacggcctgacgaacggtgctgtcaccagccaggcgcgtggcaacatgaagttcggcaacgacttcaaccatcagatcctgatcggtgttcgttatgcgttcggcgtgacgccgccgccgccgccgccggccccgatcgtggcgccgaagcccaccgctgcccgcacctatctggtgttcttcgattgggatcgtgccgatctgaccgcccgcgcgcgtgagatcgttgccgaagccgcccgcgcttccacgcaggttcaggcaacccgcatcgaagtcaacggctacaccgacaagtccggcacgccgcagtacaaccagcgtctgtccgtccgtcgcgcccagagcgttgcggccgagctggtcaaggacggcgttccgcgtaatgtcatcttcatccatggtttcggtgaaacccaccccctcgtgccgacggcacagggcgtgcgtgagccgcagaaccgccgtgtggaaatcatcctccactaagcgcgtttcgcactctggatggaaagggaggggcatttcggtgtccctcttttttttgcttatttttttgcaatgcgtcattttcataggacttgcccgttgcgtttttgtcgtaaaccagccgcaatagcttcctgacatcgtatgatacgtctgtccgtcacggagcgcacatgcaggttcctctcgctgtttcagccgactccgcaccccatccagacccatttcttggatacgatccaggacagtatttctgtgaactgactactcacagggatggcggtagtcaggccggtgaaaaagtgcgtcagcgtctggcgaagattggtctcgataatcttcgtcaaagggctgccgcagcggaaaatgatcttatcaatctggggatcacttttacggtctattcagaggcgacggcgatagaccgaattctgccgttcgactgcattccccgtattatcaccagtgccgaatgggcccagcttgaggcaggcgtgaaacagcgtgtcacagcgttgaatgccttcctgcacgatgtttatcacgagcagcacattctgaatgatggcaccattccgcgtgatctggtgctgggcaacagcaattaccgtcccgaaatggagcatttcccgattcgtttcggcacctatgcccatatttgcgggatcgacatcgtgcgtgatgaaagcggtgcgtttcgcgttctggaggataatgcgcgcactccctccggggtgtcctatgtgattgaaaaccgtcatctgatgctgcgggccttcccggatctgatgtcgggcatgcgcttgcgtccggtggatgattatggacaccggctgagggaggcgatggcagaaatcgcgccggagggtgtggatgatccgcaggtcgtgctgctgtcacccggaatttataattcagcctatttcgagcatgtctttctggcccgcgagatgggcgtgccgctggtcgagggcgctgatctgacggtcgagaatgaccgtgtctatatgcgcacgactgccgggctgaagacggtgcatacgatctatcgccgcatcggtgacgattttctggatccgaccgtgttccgtccagaaagtctgctgggtgttgccggtctgatcggcgcatggcggaagggtaatgtcactctggccaatgcagtcggtaccggcgttgccgatgacaaggcgatctatgcctatatgcccaggattatccgttattatttgaatgaggatccgatcctgtcgaatgtggatacccatatctgtcgggaaaaagacgggctggcctacacgctggataatctggacaggctggtcgtcaaaccggttggtgaatcaggtggctatggtatcaccatcggtccgcgggctacgcgggaggaactggatcatgcgcgcgcggcgttgctggccgatccggccaattggatcagccagccggtagtcaatctctcggttgcgccgaccctgacaccagcgggtattcagccccgccacctcgatctgcgaccctttgcagtgaccggcagggatacctgggttctgccgggtggtctgtcccgtgtggcgatgaaagcaggcagcctggtggtcaattcttcccagggcggcgggtcgaaggatacctgggtgctggaggatccggtgacggcccctccatcctcttccggtctcatcgaaccgggggccattggcagcgatgctcagccaatgggcgaaaccaaacctgttacactgatctgacgagaaaggttttctcatgccctcccgtcacgtgccgctgcttgcccgttatgccgaatccctgttctggatggcccgttatctggaacgtgtggaaaatctggcccgtctgattgatgtcatccagaatttcgaaagtccagggcgggaaacggaatcctggtacagcctgatctgcatcaacggggatgaggccaatttccgcgagagcggtctgcaatccgatgctgacgggatcaagcgtttctatcttttatcgcctgataatccgaccagcatgcaggccagcatcgaggcagcccggaccaatgcgcgggcattgcggccgttgatcagcacggaaatgtggcttcagctcaatatgttccatcgcgatgttatggcgatccgcgacagtgacttggagggggatcatctctcacgtctttgcacccgtctgaaggaaggagtgcaggcgcatacggggattaccgaaggcacgttctttcgtgatgaaggatggcatttctaccagttgggacggcagatcgagcgggctgaccagtctacccgtctgctggacatcaaatataatctgttgatgccaaaaaacgtggaggaacggcgggttaaggaactgacgcagtggatggccatattgcgtgctgcagccgggtatcatgcattccggcgcatttcttcgccttcatttctgccgggtgatattgtcgcctttctgctgaacgacacgtcttttccgcggagcgttgcggtctgtgttttgcagatcgaatggcatgtgacgcagcttcgtcgccaatatgggttgaaggggacggcgcctgcgctggaacaggtcgagaccttacgtgattgcgtgatggtgccatccatcgctgatattctggccggtgggctgcatgattttctggatggattacaggatgggctgagcaacctctccttcgagatcgggcaggcctttttccgtgactggccgccccgtttaaccgagcagccggcccttcctgcttcgcagagccagacgcagactcaaaatagtccctgatttacccccgatgtgggcggaaacctgcccagccattggtggcgtcgtacagatagtcatatccgttgaggaaatgcacaccggtattgacgaagatcggtcgctgcacatgtccgtcggtgcgggcttcaaccagtatcacggcagagggggtcatcaggccgggatccccggtgatgaagctgtattgtgcggctgagtctcctgctgtgatcgtgacaggggttccggtggccagttcttccccgttgcgggagagatcggacagccaagtgacgggaaccgtcgcgaacatgcgggtgacgccggtatccatcagcattgtgccgccgcatgcaggagaatgagaggcgacgccgatacaggccgggattggtccccagtcgccctcaatattggaagggggcagtttgacgagagaaaatccccttttcgccagggtcatcgcgccgccagacggcaaaccgatccgaaccgaacggaaggtgatgacgtagccgggcgtgcctgtatcgcccgccatgccgggggagggattgaggaatggattgtgagaggggccgctctgttgctggtggtcgccttcgcgggcaaacccgatccccagcatggcgacgtggcggggatgatcgcttggcgtacagctgcgggccgtcggctgacaggcgatgtgcgtgacggccagcacgggaatgggggaggagataaattgatgcccgtgtgcgccggttacggtaacgcgcgtcagtacccaccgtccgatcatgatgcggccggagctgctgtaggtcagttcggctggccccagatcgcgcaatggcgcattctccggcagggcggtcgcactgattacgaggccggtcgacccggtatccatgacggcctgcatccggacaccacccaccgagacaaacagagaaggcgactctctccgtgcctctcccggtggtggattgttcaggaatgtcagctctacactgccatcgttattgtttgtgaagcgttcggaatgccctgtatgaggtgcgcaggaggcggcaatgagcgcagtgcaggcagtggccacgcgtgccagccataaagcagcctgcctgcttgcatcgtgctgaccgactgacatggaccgtgaccctgcgctgaagaaaccggtcatcaaataacggaagcaacccggattgcgttggtgccgcccttcagacccaacggaataccggcggtcaccacgatttcctcgccaacggaggcaaatccttccgactgcgcatgccgtatggcacggctgaccgtatcggtcatggattgggtggggggtgtgaccaccgcatggactccccaggctacggccagacgacgggccgtgttttcctcggtcgtcaggccgatcaccgggcattccgggcgctcccgggctacgcgcagggcggtgcgtccactggcggtgtaggcggcgatggcgcgggcctgaatggtctgtgcaatctgccgggccgcggtggcaatggcatcggcggttttcggctcgggcgcggggcggttggagtcggtaatggcacgccagcccgcgtcgcgctccacgcgggcaacgatgcggtccatgatgttgacggcttcatacggaaattgtccggcggcggtctccgccgagagcatcaccgcgtccgccccatcaaacacggcagtggcgacgtcggaggcttcggcgcgggtcggggcgggcgcattgatcatgctttccagcatctgtgttgccacgaccacgggcaggcccagtttccgggcggcgcggatgatgtttttctgcgccagcggcacttcttccggcggcagttcaacgcccagatcgccacgcgccaccatcacggcgtcggaggcttccagaatgccttcgaggttttccagcgcctgcggcttttccatttttgtcatgatccaggcccggtcgccaatcagggcgcgcgcttccagcacatcctcgacccgctgcacaaaggagaggccgatatagtccaccccatggtccagtgcgaaagcgagatcggcgcggtctttctcggtcagggcgggaatcggcagcaccacatccggcacgttcacacccttgcggtcggagagcggaccgccgaccagcacggtgcattccagatgatcaccccggttgcggtccacatgcagccgcagcttgccgtcatccagcagcagggtggtgccgtaggtcgcagcctcgataatttccttgtggggcagctgcacccgttcgcgatccccgggggtcgggctgagatcgaggcggaatttctgtcccgtctgaagatgtgccctgccaccgccgaacatgccgacacgaagctttggcccctgtacgtctgccagaataccgatggggcggcgcatttcggcttccagctcccggatcgcacggatgcgctcggcgtgatcgctgtgggagccgtggctgaaattgatgcggaatacatcggccccggcctgaaacaggcgggccagcatctcgggcgaggagctggccggtccaatggtcgcgacgatcttggtgcgccgctggcggcggagacgggagcgaatggccattgatttgatccggcgtagttttttgcaacggtggttggcgggacgggtggtgactgagtttgtcaccacccgtctgatactcaaaggataacgatggcccgaatgtcgttgacgttggtcagggtggcaccggttttgatcagatcaccgaccgcatcgaacagcgagtagctgtcatggccatcgaggaaggcgcggggatcgagtcccttcgcccgggcgcgggcgagtgtatcgggggtcacgatggcgccggcggcatcctcggttccgtcgataccgtccgtatcgcctgccacggcatagatgttgctggccccgttcagggtcagcgcgaggctcagcaggaattcggtattgcgtccaccgcgtccggtgctttgtcccttggcgatagtcacggtggtttcaccaccggacagaagcacggcaggggttttgagtggatagccatgttgacggacgctctgggcgattccggccagcagggtgccggcgacatggctttcgccttccagactgtcgccgaggatcagcggggtcagcccctcggcgcgggcggcggcggcggcggcctccagcgccatcagcggtgctgcgatcatgcggaaatcgccttgcggctgagccggtttggccgctgcggcacggtccagcagcgcggagacttccggcggaacctcgatcctgtaacgcttcagaatggcctttgcatcctcggcggtggtgggatcggggacggtcggtccgctggcgatcacggcgggttcgtcgcccgggacgtcgctgatgcccagtgtgatgacccgtgccggagccgcggcggcagccagacggccacccttgataccggaaagctgacggcgcaccgcgttcatttcgctgatcgtagcgccggagcgcagcagggcacggttgatatcctgcttgtgagcgatggtcagcccttcacccggcagcaccatcagggaggagccgccgccggaaatcagtgcgatcaccagatcatcttcggtcagcccggacacggtctccagaatacggcgtgcagcggcttcactgcgtgcgtcgggaacggggtgggaggcttccagaacgtcgatacgctgtgtcgggcaggtatgcccgtcccgtgtaaccacgacgccggacaggtccacatcgggccatgcgttttcaagagcggccgccatggctgccgccgacttgccggcaccgacaacgatgcagcgcccgcgcggcttttcgggcagatgcgcggccagaacctgatgcggatcggcagccttcaccgcggcggtaaaaattgtgttcagcgcacggcgggcgcggtcctcggtccattccatcgttgctctccccctcccggatacctgtgttgatcaggtggccggtgtcatggcgtcctggcagttctagtccgtcgggtatggcgcagcgaccggggcgatgccatctctgtcagcctgccatagcaccatctgtgccgtccttctggactgcatgaggagaaaagccaatgcccgttcccgatttcgatgcacaaacccgccttgaactggaagcagccgcctttcgcaggctgcgtgatcacctgcgcgaacgcagcgatgtgcagaatattgatctgatgattctggccggattctgccgcaactgtctctcccgttggtacagggaggccgcagaggagaaaggactgacgctggcggatgccgatgcgcgggagatcgtttacgggatgccttacaaggaatggcaagccctgcatcagaaaccggtgactccggagcagcaggctgcgttcgagaaggcgcagaaagcacactgactgcaagcccatctggatgtaccgggcttgatccggtggcctgcgcgggcgtatgcccgccggcctgacggcgtggtgcatccgtgggcagcctgcgggataatgacgcgcaacaggtatctaaggaaggagccggggatcatggccttggacgatacggacagaaagccggatgacgtgaacagcggcggcatcgccgcagaccgtctgcgcagcatcatcgatcgtatcgagcggttggaagaggagcgcaaagccctcggcagtgacatcaaggatatttattccgaagcgaaatccgccggattcgacgtcaaggtgattcgccagctgatccgcatccgcaagcaggagcctgcggaagtcgaggaaatggaaagcctgctggacgtttatcgccgcgctctgggcatgtgagacatgcgcgcctggtgcgggaacggtttgacgccgccgcccgggcgcttaaatgctggagcctgacgaatgacaaggatggctccgcatgcgttatcgacttcagggtgtccatacaccggacgggcaggctgtcaccgccgggtccggcagtgatgcgggcggacagcttccggcatgggatctgtccgatctgtatcccggtccggacagtccggcgctggaggctgatattgccgcggcgacccgcgactcggtccggttcgcggagcgctatgccggtcaactggccggtctggacggggctgggctggatgaggccctgcgcgactatgagcggatcgaggaaattctcgggcgcctgatgtcctacgcccagttgcgcttcagcgaagacagctccgatcctgaaatcggtcgcttctaccagtcgatgaatgagcgtgtgacggggatcagcagccatctgatctttttcacactggaactgaaccggctggatgacgcaacactggaacggcaactggccgatccaaaggcggcacggtggcagcccttcctgcgtgatctgcgcgtgttccgcccgcatcagctttctgacgacgtcgagaaagccctgcatgaaaaggatgtgaccggccattccgcctggacccgtctgttcgatgagaccatcgccgccatgcgcgtcacggtgggcggggaggaactgacggtcagtgccgcgttgaaccgtctgtcctcaggcaaccgtacgatgcgggaggaagccggaaaggcgatcggggccgcgttcggtgctcagaaacggctgttctccttcatcaccaacacgctggcgaaggataaggagatcgtcgatacgctgcgccattacgagcgtccgggcagctatcgcaaccgggccaatatggtcgaggatgaggtggtggatgcgctggtctccgccgttcgtgccgattacgggcggctgtcgcatcggtattatgcgctgaaagcgaaatggctggggttggataaactcagtcactgggaccgcaatgcccctctgccgggcgatgatgaccgggagattccctggccggaggcaaaacgccgggtgctggatgcatatggcgcgttctcaccggagatggcggagataggcagccggttttttgatcacccatggattgatgcccgtttactgccgggcaagtcgggtggggcgtttgcacacccgaccgtgccttcggtgcatccctacattctgctgaactatcatggccgtacccgggacgtcatgacgctggcccatgagttgggccatggggtgcatcaggtggtggccgggcaggcgcagggctatatgctctccaacacgccgctgacgctggcggaaacggcttctgtcttcggggagatgctgactttccgcgccatgctggaggccgagaccgatcctgtgcgccgccgtctgatgctggcctccaaggtggaggatatgctcaacaccgtggtgcgccagaccgcgttctacgagttcgagacgcgggtgcacaacgagcgtcgatccggggagatcctgccggagcggctgggggaaatctggcgtcaggttcaggtcgaaagcctcggcccggtctttgacttcacgccggaatatgatgtgttctgggcctatattccacatttcatccacacgccgttctatgtgtatgcctatgcgttcggcgattgtctggtgaatgcgctgtatgcagtgtttcaggatgggcatcccgattttcagcagaaatacatggatatgttgcgggccgggggaacgaagcggcaccgtgagctgttggctccattcgggctggatgcctctgatccggctttctggaagaaggggctggatgtgattgccggctttatcgacgcgctggaggagagcgcctgatggcgaatgacgagcggcgcagcctgttcggggaggtgcggcgtttggcccgtacctccggcgcggttggcggtatcgccgcgcgtgtggcgggggagcgtgtattcggcgtcaaaaccgatcgttcggcccatgccgatgatctgcgggtgattctcggcgggctgaagggaccgctgatgaaggtggcgcagtttctttccaccgtgccggatgcgcttccggcggaatatgccgcgcaactggcggagttgcagtccaatgcgccgccgatggggcctgccttcgtgcggcgccggatgagcggtgagcttggaccggactggcaatcccgcttcgaatcgttctctgaaacggcggctgcggcggccagtctggggcaggtgcatcgcgcccggctgcatgacgggcgcgatgtggcctgcaagctgcaatatccggacatgaccagcacggtggaagccgatctgcgtcagcttcgcatggccatggccgtgtaccggcggatggataacgccatccagcaggaggatatttacgaggaactcgccgatcgtttccgggaggaactggattacgagcgtgaggcgaagcagatgcggctttatgcctccctgctgtccggcacgccgacggtccatgtgccggagccggtgcctgaactcagctcccgccgtctgttgaccatgacatggctcaacgggcgtccgctgttgcagcgtctgaaggaagacccgccgcaggaggagcgcaaccgcattgccgaggcgctgttccgtgcctggtatatccccctgtatcgctatggcgtgatccatggcgatccgcatctcggcaattatcaggtgacagaggaaggccacgtcaacctgctcgatttcggggcgatccgcgtgtttccgccacgtttcgtgcggggggtcatcgctctctatgaagcggtgcgggatggcgatgacgaacgtgccatggacgcctatcgcacatggggcttcaccgatctgaataacgaaaaactggcagtcctcaatgaatgggcgcgcttcctgtatgaaccgttgatgcaggacagggtgcgcccgattcaggaaaccgatgatccgaatttcggccgggcagtggcggagcgtgtgcatcaggggctgaagcgcactggcggtgtgcgtccgccgcgtgaattcgtgctgatggaccgctcggcgattggacttggcagcgtttttctgcggttgaaggcggagctgaactggtatcgcctgtttcaggaaatgatcgaaggcttctccagcgaggatatggcacgccgtcaggccgaggcgcttgccgcggtggggttggagatacgacaggattgaggcgaggatgccctctcagtaacgggtgggcggcagggcggcggcgatgtcatggaacaggcgtgcgggcaggctgccgcctgtaatgtttcgcatgggcgttctgtcgtcattgccgacccacaccccgatgacggtacgatcatcaacgcagccgataaaccacgcatcacggtaatcctgtgtggttccggtcttgccgcccaccatatgtccgggaatggaggcggcccggccggtgcctcgcgccaccacggcttgcagcatgcgggtcatgtcctttgagacttccggcgtcatgactgcttccccgaccggtgcggtgatctggatcgggcgatgatcggcggtgcctgcctcgatggcacggggggtcacgcgatagccgccattgaaaaaactggcataggcggcggtcatttccagcaatccagcatcggcggttcccaatgcgatggaggcattgcgggggaaattatcctccacccccagacgatgcgcggcctcgatcacggcggcgggtccgccatcacgcagcagcagacggacggctgccgtattgacggaatgggccagcgccgtttccagcgtgatgtcacccaccgagccgggctcatagttggaggggctccagttgccgaccctgatgggggcatccgacacggtatcatccggttcctcgccattttccatcgccaccagccagacgaaaggcttgaaggaggagccgggctgacgccgcatgatcgtggcgcggttgaaggagctgtgccggtaatcggccccgcctaccatggcgcgcaccgccccggtgcgggcatccatgaccaccacggcggcctcatgcacattcgccgcggcaccggggccgtccagcatggcggtcaggcgcgcttcggcaatgctctggatatggctgtccagcgtcgttctgatgacggcatcggccccttgcggcaacaggctctgtgcccgttccgccgcccagtcggcaaaccatggggcgccggtcggggcctgctgacggaaagagattttcgcggcttcggcgcttgcctgcgcggcggtcagcacgtgggtttccaccatggcctgaagaacttccttggtccttgcaatggcggcggcgggatcgaccctcgggttaaaccgggagggtgcgcgcggtaatccggccagcatggcggcctgccagatgttcagatgacgggcggagatgccgaaatagacatgcgccgccgcatccaccccccatgcacctgcgccgagatagacgcgattgagccatatttcgagaatttcctgccgggtgaaatgctcggacagccatatggtcagcatgagttcctgcactttccggcgcagggtgcgctcgttggacaggaacagggtttttgctacctgctgggtaatggtggagccaccctgccgcagacggccggagctgagattgacccagattgcccgggcgatgccgatcgggtcgatggcgccatgggaccagaagcggcggtcttccacggaaacggctgcgtcctgcatggcgcggggcatgtcgcccagccgcaggctttcccccaccacatcgccataggtggcgaaggtcaatccttcctgatcgcgcagaatcaggctgggtcggcgtggcgcatcaagcgcttcctcgggacgcggcagatcccaggcgaaatagaccagaaacaccgccgctgtgaggccaccccagatcaggaccatgatcccccagcgcagccagcgccatttcttccggttggaaaccgtttctttcgcagtctctcccttgcgccgggaggagggaggagggggagacggtcgccgctttgaacgacctggcggcgggccacggcggatgaagtctggatcctgtacggcgtcctgatcagcccgatatcgggcatccgggcgggcggtacggctacggggctggtcctgacgcggcatgaggggcgtatggatgaacccgcgtggtgcgatcgtcaacggtcgtggcaggcaggcctgtaccgatgcaggtaccacagcagccgacaaaacagacctcatggctgatgaaatggatacatggtccttgcagtggcagggagccgacgttaagcacgcctccatcatgatccagttgcggtccttgttccgccagtcccgcatccttcagcaccggctgtctctccggctgatgcagggtgtactggcgcgggtgctggtgattctggtcatcgcgggcatgctggcgcagatggcgctgatggcattgtcccgtcccggtgaggtgccgcgtgccgcgctggagcgtctgaccggactgttgctgaccgatccggtgaatgtgccgacagatgcctcgttgagggaaggtgactgccttgatgcctcccacgaggcggatatgtctgtcacggtgccgcatgaactgatggtgcacatgcatcatggggggcatgtgcaacgggaccatgaccaaccggggcatgatcagcatcaggcctgctccatctgtgtgtttctggccatggcggcagcattgctggtcatgcccgtgttgccaccgctctcttccggcatatgggtgcgcattgtccggcgcgtcatgcagccacgcgcgccacccggttcggggtggctgtccgcctatgcacgaggccctcctgtccctgcctgaaagcgacgcgtcgatcgtgtgcgcatcttttcaaacatcaggtcaggatttttcatatgatcaggcatcttcaaggtcgggcagggcgtgctgcgctgctcgcctccggaaccattcttgctggcaatatgctggctgcaggatggcctttttctcccgcatgggcgcaaggcgctgcttctgcccccaaccccatggtcgactctgctcccctgcccaccttgcgtgtgctgggggacagtccgctttcgctgatcgaggagccactggataagacgacagtgtcgcagaccatgatgaatcgtaaccggctgaacagccccgataccgccgaactgttcaaaggagtggcgggcgtcagtttctatcaggctggtcgtgtctcggccctgccggtcatcaacggcatgaatgacgaccgtgtggcgacggaggtcgatggggtgcggatcagcgcggcctgtcccaaccatatgaacccggccctgtcctatgtggaccccggcatggtgaaaacagcgagcgtgattgccgggattactccggtcagcgcggggggtgacagcattgccggtaccgtttcggtggaacgggccgatccgatcttctcgaaggacaagtccattctggcgaccggccatgtgacggccagttaccgcagcaatggtaatacggtcggtacgtccggcgcggtcacggtcgccaatgatactgtcagcctgcgttacgaaggatcatggtcgcaggccggtaactacgaaggcggtggagatgcggggatcgttcgttccaccaaatatcagagcttcaatcatgcggtgacgctggggctgaagcgggacaatcatcgtctgacgctgaccgccggacagcaggacattccgtatgagggtttccccaatcagttcatggacatgaccaataatcgctccaccttcgtgaacggtcattacgaaggtgattattcatggggtgaactggatgtgcgtggctattggcagcgcattacccatgtcatgaacatgctggatgacaaaggcggccattccgccactaccggcatgccgatgaattcggattcccgtctggccggttatgccatcaaggcgaccattccactgggaagctggaacacgctgcgccttggcagttctttcgatcatcaggggctgaacgactggtggccgccattgatgggcagcatgatgatggggccggatacctatcacaacatcaataacgggcatcgtgaccggctgggtcattttgctgagtgggaatcccgctggaccaaccggttttcttccctgctcggtttccgcaacgatatcgtgatgatgaataccggggaggtatcgccctattcttccggcgggatgatgatgggtacgggtggcatgatgggcggcatgagcaatcccgatgccgccgccgccagggccttcaacgccatgtctcgggggcggaccgatgtgaatttcgatgttaccgcactgggacgttaccgtgtgtcggacatgatcagccttgaaggcggttacgcccgcaagacgcgttcccccaatctgtatgagcgctatgcctgggggcggagcgccatgaccagccagatgatcggatggttcggagatgggaatggctatatcggcaatccggatctgaagccggaaatcgcgcatacgatcagcaccaccgtcctgttccgcgatccggagcaggaacgctggaaaatcagtattcagcccttctacacctacgtagagggtttcattaacgccaatctgctgaaatccctgtcgagcgacttcaatcagcttcagttcgccaaccacaatgcgcagctctatggcgtcaatgtgtcgggttcggcgcggctgtggcattccgcgcgctggggccatggtgaactcggcggcacgttgagctatgtgcggggtgaggatctggagacccgccatagcctgtatcacatgatgccgattaacgggctgatcggtctgtacgagacgcgcggcaactggagtgggcgtgccgaggctaccttcgtcaacagcaagaccatcatcgacccgaccagaaacgaaccgcgcacaccgggttatgcgctgtttggtctgggggctggctacaactggaaaaacgtgaaagtggaaggggggatcgagaatatattcgatcagaaatattatcttccgcttggtggtctgtcgctgggtgatttcgatgcaacgggcgtcctgcgtgccctgccggggctggggcggtcctacaacctgtcgatgaccgtttccttctgattgaccgggtatggcctgtcatcgaaaattcgtggtcgatgaagtccatgaaatgggtgagccctatattgctgaagaactcgcggcacttttgaaaatggatctgatctcatccccgtttctgcgggatgggatcagcacccgaaaaatgaaaggccgggttccgccgtaaaacaagttacgctagaaggctgccggaccgggcgtggcggaacggtatacgcattcgacttaaaatcgaacgcctttatggcttacgggttcaaatcccgtcgcccggaccagcacatatgccttgaccggcttttgggaaacagtctcagcatgtccgactatggcttgccgcccggcctgaacgatattgcggcgcttgctgaacgcgccttgcatgaaattcctctcggtcagtttcccagcatccgggaattgaccatcgcagtggaagactcaccggatgacgacatgctggccgagcttggcctgtcctccccgtgggagttgacggggctttacaaagggattccactcgatcagcgcgggatcgcagagtgggggcaggagcctgatcaggtcgttttgttccgggagccgatcctgctggaatggatcgaaagcggggaatcgctgccagatctggtgcggaccgtgctgatccacgagatcgcgcatcatttcggcttcaccgatgagcagatcgaggcgctggagcagaaaacccgcgacggtgccgcccggcactgaggcagggcactgaatatttcagatcaatcttcgtgatcgtgcaaaggctttccttcggcgtcctcttcgtcatgcggctcgatcatatggtcgatcatggcggtcagcatatcccgcacatggccgtcggcgatggcatagaacacctgtcgcccctgccgtgccgctttcagcagccgtgctgcccgcagcaggcgcagatggtgggaaaccagcgactggctcagcgcggtccgttccgctaacgtcccgacattcagcggttgttcgaggcaggcaacgacgatcatcaaccggttcggctcgcccagcagacggaatgtttccgccagctggctatattgatcttgtggaaggtccattcccgcgccgcacctgtctgccaaacgaagacatgctctagcctatccgctgtaacgtgccaaaggggccgcttcacttccctatgccagagcgtaatccgcttccacggtgtaaaccgactgttccttgcccagttgagaactgaacagggtgaagtgctccaccgggatggggtcggtacggaacagattatggctctggacataggaagccagacgattgtctgccgtgccatccaggcgtgccagtgtgacatggggcatgaagcggcggcgttctgggggcaggcccacgcgctgtaacccggtttcgatcttgttctgaagatggtccagctgcggattcttctccacgccgacatacagggtggagcgtccggcccgctcgaaaataccgatccctgtcagcaccagagagaaaccacgtgcccgcaaggtggacagggccagatcaagctcatcggcgcgatggcccggtacgtcgccgatgaagcgcagggtcagatggtaattttccggtgaaatccagcgtgcccccggcagaccgtaggcaatcccgtagagttcatctttcagaatccagggaagatcaagcccgacaaacagtctcatgggtgctctcccgggggaaggggtggcgggggcagcatgcgcgaggcaatccggctggcaggaccagagtaacgcaggacggtgcccggtcacatcagccatggtcaaccatgacggatcatggccggttattcattttccatgcaggggggcaggcggtcaaaggcgtttcttttacatcttgtcataaacgcagagcttgatcgctttttgccctgaaacaagataatgtgacatcaagatccatggccgggctttgttccgaccgtctacaggagaatcgtgtatggcctttcgtccagataacagcgtccgcccgggcgtctggggtgccgccgacaccgcatccatggatgccggtctgcgcgcctacatgctgcgtgtgttcaactggatggcatcaggtgtcgccctgacagggattgtggcctacgccattgcccataccagcctgatgaatgcgttctatcatccggtgatgaccgagcagggtgtgagcattcagcccacggcgctggccttcatctccatgatttcgccgctggctttcgtgctggtgctgagcttcggcatcaaccgccttagcctcggtacagtgcaggcgctgttctggctgctctgtgtcgcgatgggcgccagcctgaccaatatctttctggtttataccaatgcctcgatcgtgcagaccttcttcgtgtctgcggcgacattcgcggcgatgagcctgtatggttacaccacgcgctccgacctgacccgcttcggcagttttctgatgatggggctgatcgggatcgtcattgcctcggtggtcaatatgtttgtccatagcggcatgatgggctttgtgatcagcgtgattggtgtgctggtgttcaccgggctgactgcctacgacacccagcgtatcaaggtggattatgcgcagttcgccactcagggaggcagcgattttgccgctcgccgttcggtgttcgatgcgcttcagctttatctgaacttcatcaacctgttcatgatgctgcttcgcctgctgggtaaccgcgccagcaacgactgatccaacttactgtcagtcctgaatcagaaccggtcgggaattgcgtcccggccggttttttttgtgtctgctggaggaagaaaaaatccggctcagcgggctgccggagcgatggcgttttccagcgtcggcagatcgactgcaccgggaaacagcttcgacccgatgacataggccggtgtgccttccagccccagcgagcgcccgagagcaatattatccgccagccgcttttcgatggccgggtcctgcatgtccttgtgaagtctgtcgacatccagccccagcgtgcgggcctgccggtcaatgtcctcctgcgtcaggtcgggagaaccatgcatcagggctgcccgcagctgcacatagccaccctgtttctgggctgccagcaaagcacgggagccgagttcacttttggcgccgagaatcggcatgtctttatagacaacacggagttcaggatgtttgcggatcagctcatccatgaccggcaccatgcggcggcaataggggcagcgcacatcatagaattctacgatcgaggtggaccctttcggattgcccgcgacgggatcggccggatcgctggtcagacgtgacgcattggctgcaatggcgccttcccgggcggagagggcgcggctgttttcatcctgttgcagggcggtgatagcgtctttcagaatggtcggatctttgaccagggcctgacgcaggatgctcacgatttctgcgcgttgggccggtgtgaaggtttcgctgcgggcggcaccgggcagcagcaggccggcaaggatgggcagggcaagcaggccataccgccgcaaagactggcgcgaggcatgggaataaaagagcggaaggctggacataaggctgtttcctgcactgcttttctgcccgaagccgggcgtggcggcctatcgattggccgtgatacgcaagctttggcggatcggggcggtaacgtccagttacggtcaggtcaggattggcggaggaaagccgcaagagggcagacacaggggcagacacgggggcaggccaaggggcagacaggcatgcggtgcgacgttatgatcccgctccgcgttgcccgcagcgggaagctgttttaagccttgactgattgcggcatcatagcggtgccgccgaatcaatcatgaggggtcgcagcctgtgaattccgcccggatacgatggacacaccgcctgcggctacggtggacacaccgcctgcggcagggtgtcgcattgtcggccgccctgatgatggcaggctgctcgacagtcagcggcatgagcgatctcgtgttcggctccgacaagcctgtcggtccccaaccgggttatatcaagggttttgttggcggagtggccgctgatgagccgcgcgcggccctggtggcgcgcgatgtgctgtcttctggcgggaatgcggccgatgcggcggtggcgctggccatgatgctgacggttacgctgccatcccgtgcgtcgctgggcgggggcggtgcctgtctggcctatcgccctgatggcaagggagggctgaaggaaccgcaggcaatcatgttcctgccgcagcccgcatcgcagatcggcggttcttcccgtccggcggcgattccagccatggcgcagggctttcagcttctcaacagccgtttcggcagcaagagttttcgcagtctggtgttgaaagctgaagaaacggcccggttcggctttcctgtttcagcggcgttggcggcggattttcaagtggttggcggggctttgctggaagatgccggcagccgtgcggtgttcggtaccaatggctggctgcccggtatcggcgatcagctggttcagcccgaactggccaacagcctgttacggctgcgtgggtttggcgatcagagttatgaagcggccattgaagctgctgctccgaagcttggcctgagactgacgatcgacgcatcacaggccaaactcgtgcctccggtggtggtgcgggcagggcgggacaatgtcgcttttctgccgccgcctgccgatggcgggatcgctgctgccgctgcgttcaagctgttgcaatctgatccgggtcagtggcgccgggcgcaacagcgtgcggaagcggcagcttccgcatggcggagtggtcatgcctcggtggaaggtgttctgaacggggctggcagcagccgtgccctgccgcctctgccggcctcaaccagttttgtgaccatggatcgggatggcaatgcggtttcctgtgccctgacgatgaataatctgttcgggaatggggaagtcctgccgggaaccggtattctgctcgccgcttcgcctgatcgtggtccgcagccgctgttgtcggcggcgctggcatggaatcctgcgaaagacgcctttcgtgcggctacggcgggatctggtcaggaaggcgccccgctcgccgctggtgccgcgatggccaatgccctgcgcagccgtgaagccattgcgacaaaactgccggaaccgacgcggatgaatgccattggctgtgccggctatctgccaggcagtagtggaagctgtggctgggtgaccgatcccaaaggggcgggagtcgccttgggagcacgctgatggccctgaaaatcgggcggggtggtttgacccctcctttcatcgtcatggatgtgatttcagctgccaatgcgcgggcgcagtctctgccccccggaatgccgggagtgatccgtatggaggttggtcaaccctccaccggcgcccctgccggagcgatcgaggccgcgaagcaggcgctggggagtggtgatccgctcggctataccgaagcgttcggcctgccggtgctgagggagcgtatcgctgcgcatattcgtgactggtatgacattgaggtgcctgtttcccgtattgcggtcacggttggtgcttccggtgctttcccgctggcttttctggctgcgttcaatccgggggatcgggtggcattggcggcaccctattatccaccttatctcaatatcctgaaggcgctggggctggagccggttgttatcgaaaccggacctgatacacgctatcagcccgatcttgcggcgcttgaagcgctcgatccacgccctgatgggctgatcatcgccagcccctgcaatccggcgggaacaatgctgctgccggatgagcttaaagcgctggcggagtggtgtgagcgggaaggggtcagattgatctcggacgagatctatcacgggctgcaatatgagacgccgctttcgaccgcctcggctttttcatcctctgcgatcgtcatcaacagtttcagcaaatatttcagtatgaccggatggcgggtcggctggatggtgctgccggaggatctggttcgtccggtggaacgcctggcgcagaatctgttcatcagcgcgccgcatatcagccagcgtgcagctctggcggcgttcgactgtacggcagagctggaagcgaatctcgaccgctttcgctgcaaccggttggaacttctggccaatctgccccgctgcggttttgcccggctgtcgcaggcacagggggctttctacatctatgccgatatttcaggccggaccggggacagcgctgccttctgcacccgtatgctggatgagctcggcattgctgtcacaccgggactcgatttcgacgctgcgcgcgggcatcgtacgatgcgcttcagctattgcggtgcggaaagcgatgtcaaagaggctgtggagcgactctccggctggcgctgatcctgaaagactggcggatcagggaagcttgatgatcttgtgatagccgcgtccgaaatagatcagcccttcatgggatgggccagtacgaatgccctctacttcacagaaaaacacggtgtgggtgccgacatccgtagcctgcgcaatgcggcagtcaaaggaaacgaccgccccgtccagcaccggcgcgccggttgccagagtggtccattcggcctgtgcaaaggcatcatcggctgcatgatcggaggatgcaaaaagattggacagtgcttcctgatgcgcagacagcacgttgacgcacaaaataccgttccgggcgaaagtggcatgacgctggctggagcggttcatacagaccagcagggtcggcggatcatccgttacactgcacacggcggaggcggtaaagccgcaccgctcctgcctttgcccggggcgcgatggagaggctgtcgtgatgacgttgacggctgcacccagccgggccatcgcgtcccggtattcctgtctggataccatgattgatctgatcctgcctgatacgcttccggtttgaagaccgggagataattgaaaccgttatcacgcggagtttggcgtgacatacgatcctgccatgtgagttaagccgcggggcggcctttttccaagagacgcggtcgcaatttctgccatgcaggcggagcacgtttggttacggtatcaatctgtatgaacagggtttcaccctgccgctttgttcctgtcacgtgttgtggtgcatagaagagacacacaagatttttcggcgccggattggccggaaaacgacattgtcaagctgatctttgttcactgtcatctttcggtcacacaaaaaggattcgctgtatgtctcttcgtcaggatcaacctgaaatccatgtggcacccgattattcggcttcggccaccattctgcaccatgccccgcgtcgcgcccgcatgttcctggcggcggcgctgctggctgccacggcattgaccggctatggcattgagcatgttacccaggctgaagaattgacgaaatcggttcctgctgccgcaccgatcggtgatttctctgctctggtgcagcatgtccgtcctgccgttgtctctattaccgtgaaaatggtgccgcgtcaggtcgcacaggacatgccgggcggagtgccgcttcccttcgggatgccgggcgctggtccgggtgctgaagagggtggacagcctgccccccgtatggcggaggcgcgtgggtccgggttcattatcgatgccaatggtacgatcgtcaccaacaaccatgtcgtgaaagacgcgaaaaccgtctccgtgactctggatgacgggacggagcttcccgctacgatcgtcggtcgtgacccgcgtactgatctggcggtgttgaaagtctcggctggtcatccgctgccgtatatcgagctgggtgacagcgaccatgttctgccggggcaatgggtggtggcggtcggtaatccgttcgggttgggcggtacggtgacggccgggattgtctctgcgcggggacgggatatcggctcaggcccctatgacgactacattcaggttgatgcgccgatcaatcagggtaactcgggcggcccgctgttttctcaggatggcaaggtgatcggcgtgaatacggcgattttctcaccgaccggtggcagtgtgggtatcggctttgccattccttccagcattgttcgcaatgtggtcagccagcttgagagtggtggcaaggtcacgcgcggttttatcggggtgacggcccagcaggtggacaaggatatggcggcagcgctgaatctgccgctggcgaaggaaggatcacctaaaggggcattgatttcctccattgaggagaacagccctgctttcaaagccagcctgcgtccgggtgatgtggtgcagactgtgaatggtcaggttgtcggctcgccgcgggatctggcgctgaaagtctcctccctgaagccgggcagtaatgcgacgctttctgtggtgcatgacggtacggcgcgggatgtcgcggtgaccatcggtgccatgccgtccacggaaaccgccagtcttcagagtggcaccggtgcagaaagcgggcagggccggattggtgtggcgttgcagccgctgacgccggagctgcgcaacgagcttgaaatccccgctgagatcaagggagcggtgatcgccaatgtgcaaccgggatcggctgccgagcaggccgggatcaaggccggcgatgtgttggtaggcgtcaatacgacaagcgtgaccagcccgtcgcaggcggcttccgccattcacgcggccagcaagcgtaacacagtggcgctgcgtattctgcggaatggccagatcggctttgtcggggtgaatctgaagggcgataccaacgacggatgagtagataggaaggatggccgattattctggccatccctctgtcagtgatcgcttgttcagccggagcggatcatccgttccggctgatttcgtacagagcgatggcggtggcgacggagacattcaggctctccatcccctcggccatggcgagggatacgatttcatcgcagctctcccgcgtcaggcgacgcagcccgtccccttccgcacccatcaccagcgccacgcggcgcttgcccagtgccgggccggataagggggcgccttccgcatcgagaccgaccacccatagatcggcggctttcagggccgcgagggtacgggcgatgttgaccacgcgcagcatcggcagccggtccagcgcaccggacgcagccttggccatggtgccgctttcttccggagcgttccggtcctgcacgatgacgcagcaggcctgaaaagcggcggcagagcggagaatggcgccgacattgcgaggatcgctgacctgatccagcaccagaaccgggccgggacgctgcgccagaatctcacccagcggcggggagggcagcttgtccgccagcagggcaatgccctgatgcaccgattcggtaccgagcaactgatccatatgggcgcgttccgtgcgctccgctaccagtgcccagggtggtggcaggcgctcggcaagggttgcctcggcctcttcggtcagcagcagacgacggagacgacgggccggattacgcagagcggcctcaaccgcgtgcaggccatgcagccacaccgcgcccaccggagcctgcaatgcccgtccgccggagcgggaaggacgctctgcagccggttgcgcctgcgcggtggtgtccgatctggaatggtcggaacgcgggcggcgctcggcatgctcatcggagcggttggctccatcacgcggacggaaagagcgtcctcctgacggtcgttcgccgccctgccgatggcgggtggggcgttccgtgcgttccccgaaactctgctcctccctgggagcctcgaaacgtggacgccgttccgtgcgctcgctggagtgatggccagatcggggggctccatcatgggaacgaaaagagggcttgccgcctgccgggcgttctccgccctgataggaggggcgctccccacgctcggcgaatcgctgttcacgcgtgggcctgttgccctcgaagtgctgcttgtcggagcgtgagcggtattccccgccctgttcgctgcgtgcggtcccctcacgggatcggaaggattttcctcccgatggacgggcaccgccgctctgatcgctgctggagcgtcctgagcgggaaaaaccgccggaggatgcgttttttgtgggccgaccacggcccgtatgttttgaaggtggcttcattgcgccggtataatctgctttcgcggggctttaaatatccagaaatgcgtatcggatacgttgacaaggctgccttttggctctagtccgcaccccgctccggaggggtgcccgagtggctaaaggggacggactgtaaatccgttggttaacgcctacgttggttcgaatccaaccccctccaccatctttcaggggccgacaggcccggatatctcagggatggacagcacggtttaaaggctcgacgcgacgcgcgtcctgcgctaatccgtttcagggctgcgggtgtagctcaatggtagagttccagccttccaagctggctgtgcgggttcgattcccgtcacccgctccaaaattcccctgataaatcaatagcatgtgtgcgctgtagtagccttcgctgccacaatttgttccgctgtgccaaatccgtgccaaaactgtttcagggacccggcagggcactctcttcgaggagtgtcttttggaggccgcttcccgaacccaacgccccctctttgaagctgtggcagttagggaccgcagccagcggtgctcatcaccccgattttttcgctgataaaccgctgcgccagccattgagacgccggtccctgtggccgctgtttgtgccagattaattccatggcgactggccagtccgccgtatcgaaggcgaggcgcggaatgacgaggtcactggcggcgctggatgcggcaatgatgtgatcggagacgaacgcccagccgattccctgccgggccagttgcagaatgacccactggctttctacccaccaaacatcggctgcaatgcgcagacggcgcttttcctcgctttcgctgcgggtggcgaccatcagttgccggtgtcgcttcagctcttcccactcgatcacctgctccgctagggggtgatcacgtgcacagaccagttgcagcggcacccagccaagggtgtgaaagcccagcacggccggcagcgtttcctgccgccacataatgcccagatcggcctgaccatcgagaacaaggcggctcacatcctccatgaatggaaacaggatttccagttccacgctggggaaagcttcggcaaaagagtgcagaagacgtgcgaggaccggttccggatataattcgtcaacggccagaaccagccttgtctcgacatgtttttccagactgcgggcaacgccgatgaaatgcgcatgacgatccagcacgacccgcgcctctgccagcagccgggtgccggcttcggtcagggatggtgtgcgcccggcccgtgaaaacagcgtcacacccagatcaatttccatattgctgatcgcggtgctgatcgccgactgggcttttcccaggtgacgcccggcagccgaaaaagagcctgtttcggctgtggcgacgaaaatcgtcagttgctcaaacgatatgtccatggctgaacgcaggcctatctgaaaaacagataatatctaactttatctgctgaattctactgatagatagagccaagtcgcctgctcagcgggcttaatgaagtgaaaatggtgaccatcatgcgttcgtcgtgggatcgtatccggcatgccatcctgttcgaggtgatcggtcttctgttgctgattccgattggtcatgccgtactgggcgtggatacggggactttcggtagtctgagcgtcattgtcgcagtgacagctgcgatctgggcttatctgttcaatcttggttttgaccaggtgatgctgcgactgactggctctactcgcaagaacacggctgtgcgcgtgctgcatgcggcgttattcgagggggggatgcttgccatgtttctgccgctcaccgcttggtatttgtcgatgagtctctgggcggcgctgatgaccgatatcggcatttccggattctatttcgtctatgcgtttgcttataactggatctacgatcaggttttccccgttgctcatgcaagcatttgcgaggctggccgctgaggtatcgcattggtaacggctgcgtattcggctatggcgccattatgaacacgttggttttcaacagccggtctgccggtgctgatgttgcatgggtagcggatggtaccgtgctggcctgtcgctcggctgaggctcaggatgctgcatcacgtctgccggtactggctgcggaggttgtggaggaggtggagcggacatatccggctggtcgccagcctgatgcagtcatcgcttccatcggtccgggcagctttaccggtattcgtgcagctttggcagtggcgcagggctatgcgttgggagccgggctgaggctggctggtgttgcagtcgacgaggcgctggccgtcatggcgccgcctgagccgggttatactctctggacggttattcctgcccggcgggatcacgtctatctgaacgatggatccggttttggggtggtgccgcttgatggaatcgctggattgcctgtgcctggcagtcggatctggctgatgggggcagctgcagagtcatgtgccgggttgttgtcccgccggaccgacctccatctgcgtgtcggtgcaatgcgggagcctgatgtaatggccctggatcgggttggtcgtgcacgcttatccggggagatagcatctcgcccggcattgcctgtttatgcggaagaagcacggatcaaggctggaacagtccgtcctgctccccggacatgacggcgcctttgccggatgatcatgatgccgtgatagtggtgggtcctggtcatgcggcgctattggcggtcctgcatgaagcggcttttccgccggaggagcagtgggatgacgcttctttcattgtacagcttcagcaaccggggactgtggctctgatggcggtcgcgggtgagcacgcaactgagccggtgggttttgtgttgttccggaccattttcgaggactgtgagatcctgacccttgccgttgcaccgtattgtcgcaggcaggggataggtggtttgttgatgcgggctgccatgaagcgtgccgccgaacagggcgcggagcatatgctgctggaggtggagaccaccaatctcccggcccgcacattatatgaccggctcggtttcagcgcgattgggttgcgtcgtcattattaccatggtggcggcgatgcgctggttctccgccgttctttgggccgttctctggacagcacaaagattactggcggcgaataagaatacgcgtctgcccgggctgcggatgttcgatagcgatgatttcgtggccgagtgcggcggcactttgcggtacgttacgcgatgcttcgtctccggccgtcagcacggacagcaatgctccggatggaagcttgtccagtgcgatccgggtccggacgaaggtcatcgggcatatatccgcagtgacatccagcattgtcattgtttcgctggttcttgccggtattgaaatgggatatggttcatactggtgcatatagataccattattttaagaaacaccctgttgattaaacagcgttgacaagtataataatgcgatcattttgttttttaacaaggctgtttcttgatgtccaattcagaggcgtctgctgatttactggcgttgactgcacagattgtttccgcccacatctccaataatgcgattcagaccgaatcacttcctggattcattcaggaagtctatcgtgcgatctcgaatctcgggcatgaggaacaggttccggtcgaaaagccacagcctgccgttcctgtccgcaaatccgtttttccaaattatatcgtctgcctggaagacggcaagaagctgaagatgctgaagcggcatttgaagagcgtctataacatgacccctgaacaataccgggagcgttggggcctgccgccggattatcccatggtggcacccgaatatgcgacgcatcgcagttctttggccaagaaaatcggccttgggaccaagcccagggtgcgggactgaactgcacaattgtagtcggaaaaggcggccggatcatgtccggccgccttttttgtgcatgctgcgattataagcatggtgatgtggctgtctttcatggcatcgtcatgataccggttatcgacacgccatgtctgatcggctacctcgcactgatcagcaacctgcctgagtgatctggccgggctgaatgggatcaatcggacgttaaggatcgatgggaagccgcccgatggaacgccgctcttctgagccttctccggttcgccgtactccggcaaaccattctccccacgcgccagagcggcagggtggcagcagcatagagcggatgtgcgttgagcggggcctcaaaatgaccggccagcgccgtgtgatcgcccgcgtcctgtcggaagccagtgatcatccggatgtggaggagctgtaccgccgtgcctccgcccttgatgcccgtatttccatcgcgacggtctatcgcactgtacggctgctggaggataaaggcattcttgcccgccgtgatttcggcggtggacgtgcccgctacgaggccagcgaacatgggcctcattatcatctgatcgatgtcgagaccggtaaggtgattgaattcgaggatgaggaacatgaacgcctgatgcggtccattgcggcccggctggggttcagcctcgtttcgctgcgtctggaactgttcggtcggaaactggtcgaccctgcagccgcagatcagaaaacggctgctgcaaaacgaaagtcaggccgatgaccgctgagacccccttaggaattgcgacacgaagcgaacgaagcttcggagaactccgtgccggcaatctgggggtccgcattgcggagagccagtctgaaatcatcgcggcccaggcgctgcggtaccgggtattttatgaggaaatgggggcagagccagcccccgccatccgcagggaccggctggaccgggatgaatttgatcccgtcgccgatcatcttctggtgatcgaccatgaacgcggcagcggaccggaggccattgtcggcacataccgcctgattcaggatgccgatgcgcataaagtcgggcgtttctacacctccaatgaatatgacatttcgatcctgacttcatttcccggcaagctgctggaactgggtcgctcctgcattgcttccgattatcgggggcgtgccgccatgcagctgatgtggcgtggcattgccgcttatatctttttgcaccagattgatctgatgttcggctgcgcaagcctgccgggtacgaatgtcgacgcgctatcgaccgaactgacctatctctatcgcaatcatctggcccccccgggtttgcgcccccgtgcactggaaagccggtatatcgacatgcgccggcttgatccggttgaactggatatccggcgggcacaggcgatgctgccgcccctgatcaagggttatctccggttgggcgggtttatcggtgatggggcagtcgtcgataccgaattcaacaccacggatgttgcagttgtggtcaagacggatctgatcacggataaatattaccgccactacgaacgtcagctgcgtgacgcactgacttgattgcatcgccggcgatggctgtacctgcttctccgtctgccggacccgctgcacgctggtatgtgcgcttgcgtgatctgacaggatggcgtgctgatggcaccggggttttggccggtgctgctgcggccctcgccctgccgccttttttctgcattcccgttcttctgctgtcctttcccaccctgatggcgctgatcggaggggctgccaatcggcgtgttgcgttcaggcggggtttctggttcggctttgggctgaatgtcgccggtttgtattggattacggaagccattctgctggaggcggctcggtactggtggttcgtgccgattgcggtgcccggattgtccgccctgatggctctgttcattgccgccgcctgtgcattcggcaaaggttttctgcgtggcctgccccgtctgctggcctttgcggccgcatggacagtaatggatctgctgcgccagttcctgttgacgggctttccatggaatccactggccagcatttgggcaatccccgggctggccggagatatcatgctccaaccggttgcctggattggcacaccaggtgtgacggcgttgacagtgtttctggcgtgtctgccggtgctgcgtcctttcgcatggggcgtaggggcctgtgccatggtggtgtgggctgctttgggatggatgcatctgtctgaacatccggaccgggccagtgccctcaatgtggtgctggtgcaggggaatattccgcagggccagaaatttgaccggcgtttcctgcgtacaacgtgggacacttatctgcgcttgacccatgagggtgtggaggccgcgcataaggcgatgcctggtgatcctgtggttgtagtctggcccgaaacagcgagcgtcgcgctgctggccgatgatgcggctgcgcgtcagagcatcgcagaggccgcggaaggcaatccgaccctcattggctccgtgcggtttggcgaagatggacgtccccgcaacagtctgatcgcgatggatggccaggggggtgttcaggatttttatgataaatggcatcttgttccgggcggtgagtttgcgccgggctggctgcctttcgcggtacagctggtgccgggtggcggctttgtccctggtccgggaccacgcaccctcgacctgcccggtctgccgccttttgcgccgctgatctgttatgaggccatttttcctgcacagatcgtcaatgagatccagcgccctgcctggatcgtgaatatcaccaatgatgcatggtttggccaatcaacaggaccccatcagcatcttgcggctgtcaggatgcgtgcggtggaggaagggctgccgattatgagagcagccaataccggtattaccgtgggctatgatgcatacgggcatcaggtggcgcgtatgaatcagggtcaggccggttttctgctggtcaggctgccaggcccgttagcccccacttttttcagccgatacggacttattgtgcccgcccttctgacgattatgctgctgctggcggccattatttgcgggcgtcataaaattcgagcgtggccactctaaactaccagggaaggtgagttgcgtaataggctttagggaagatttatttttttatattgcctatcaacataacggacttgaaaccgatctgtgttcatatgatgttcgatggtttccactttgtaatgtgaaggcagattatccagttgtcggaaagtcacatcggtatcggccagaattttgaaaaagatgatcagcccaatacgctggatcttcacgtgggcaggcggattcgtcttcggcgtgcttttcttggtgtgtccgagcagaaactgggtgatctgatcggtatcagcgcatcacagattcaaaaatacgagacaggcactctacgggccggagcagtcagattatttgatctggcccgcgccatggatgtgtcgatcagcttctttttcgacgaaatgccggagcaggaggtcgccaatcatggcgtagccgctatctcccggctgggtgggttcgcggaacctcaagagggctttggcgatggcgataccatgcggcaggaagcgttggagctgatccaggcctttttccgcatcactgacccggccgtgagggaacgtattctggaactgataagatcactggcgaaagagtgatctgtccacctcatatgtaagcggcatgactgtggaacgggcttccctcacggcgatgaaggttgcaaagtccttcctatgaatggatcggtgcagtttcggggccagagatacgcaagctgtgctgcaaggccggatatggatgcggcattcccgccttctgctgtactgattatcggcccggcaggggcgggcaagtcagatctcctgttgcgactgatggatcgcggtttccggcttgttgctgatgaccgggttgatatatgcgatggtcttgccagccctccggcggcgctggccgggctgattgaaatccgaggcctcgggatcatggtatcttcctatgtaccggtggcgaagctgtcgctggttgtctcgctggagacggaggaacgtctgccatccccccgccgcgatactgacctcgaccttcccttgattgccattaatcctcgcgctgcttccgcgccctgtcgtgtggaatgggcccttgaatgcgcgttgggccgccgtgccagcagggcaggcgccttcgcgcgggaggaagcagtatgagcactgaccaataccgcagggtggtcgtgatcacaggcctgtccggcgcaggcaaatctacaatcctccgtgctctggaagatgcgggatatgaaacggtggataatcccccgttgccgctggtccatgatcttgtggcccgaggggaagggcctctggctttcgcggtggatgcacgcagccgtgggttcaccgcggacgggctggccctggccatggaacgcatgaggcaactgcccggtgtcagggcggatctggttttcgtgcgggctgatacggcggctctgctgtcccgctatacggaaacccgccatcgccatccgctggcttcaggggtgggggttcgggatggtatccgggctgaagaaatcctgaccgcatcactggtggatgtggcggatctggttgttgataccaccgatcttccggtcacaaggctgagggctatgatcgccgaacgctatgggccggaggaaaccgggcagggaatggtcgtatccctgatttcctttgcctatcccaagggattaccgcgggaggccgatctggtgctggacgcacggtttctgcgtaacccccattatgatcccaccctgaagccgcgcaccggtcaggacagggatgtggcggcctatattgaagcagacccggattatgccactttccatgacaggatcgatgcgttgctgaggcttttgctgccgcgcttcgttcaggaaggaaagaaatatgccaccatcgccattggttgtaccggcgggcggcatcgttcagttcatctggtggagaagctgggtgaagagttacgcgctcagggctggtccgtcctgcgtacgcatcgagaattaggaatcagtgacgatgctccgcaggcgggagccgccagagtatccactgacgataggaatggaagaccggaagagcacggcagcgcacaggcgcccgatgaactctcccgcacaacatcataatggaatacatgccatgatcggtttggttctggtgacgcatggacggctcgcggatgagctgcgccgcgccatggaacatgtggttggcgcgcaaagcagcgtggtgaccgtgtgcatcggccctgatgacgatattgagggcaggcgttctgatatccaggcggggatccagcaggtggataccggggatggtgttatcctcctgaccgacatgtttgggggtacacccagcaatctggccatttccatgatggatcgaccgggtgtcgaggtgatcgccggtgtcaacctgcccatgctggtcaagctggcgaaaatccgctgcacacaacccttatgcgaggtggtggaaggggctcagacggccgggcgtaaatacatcgctgcggcctcccatgtgctgcacggctgccgataaacagaaccacaggtaaaacgcgccatggaaaactctgtgctcagccgccgcctgactgtctgcaaccggcgcggcctgcatgcccgtgcagctgccaaattcgtcacgctggcagaacgtttcggggcttcggtggaagtggggaaagatgggcagttcgtctctgcccgctccattatgggattgatgatgctgggtgcgggcaaggattcggaaatcgagcttcgggtcgagggctgggatgccaaggaagcgctggaagcgctgaccgagctggtcgaggctggtttccatgaaacagattgagccgcctctggcgggtccatgttctgctgattcgccttctgccgggccgtctggtctggggcaggatattcggttggaagggatcggcgtcagccccggcattgccatcggcccggttttcggggtggtggaaatcgaggctccgcaggaaaggcggcccattgccgcgcatgaggtggagtatgagcgtgcgcagctcagccgtgcggtagaggaatccagacgtcagcttgaaaagctgcgtcaagggctgcgggaactgccggaggccgggcaggaggaattatcggcgctgatcgacgtgtatcagcgcatgcttgccaattcccgtctggtgcgaggagcgcatcggcggatcgaaaccgcactggtctccgccgcgacagccgtggtcgatgaggtcgaggcgacggttgccgccgtgctggcccccggcggggaatgggccgaacgcaccatgcgggcccgccaggcctcggaaattcaggaggtgggacagcgtctgttgcgcacccttgcctccacgccgttccgcagcttcaaggccgcaccgcgcggggcagtgctggtgtgcgagatgctgcgcccgtccgatgcagcgctgctggaccccgccgtgatcgcaggcgtggtgacggaggaaggcggtgcggacgggcatgtggcgatcatgctgcgtgcgctcgggcttccctccgtgctgggggttccggcactgatgcatacgatcaggcagctgactttgtcgggcctgggcgtagatatggtgctggacggagatcagggtgtggtcacggtcaacccgtccaaccacacacgccagcaggcaaaacagggtctcgctgcccatcagcaggaagcgctggtgctggcgcagctcagccgcctgcctgccgtgacgacggatggcgaggcagttctgttgcaggcaaatatcgaactccccgctgaattgccccagatggtgcgggccggtgccagtgggatcggactgttgcggaccgaattcctgtttatgaaccgggaaagtttgcccgatatcgcaacccagatcgaaacctattcccatgtgatcgcggcggcagaaggggaacaggtcacgatccgtgtgctcgactgggggggcgagaaagaaagcgaggcccttcgcaccgccggtctgttgcgcagcgagacggagcataatccggcgctgggtctgcgggggatcaggctgttgctggcccatcccgagttgctggaaacccagttgacggcgattttacgggcagcgcgtgatgtgagggccgaaagccgcgtgcgtattttactgccgatgatcacgaccttgcaggaaatgcgcacggcccgcacgatctacacccggattttgcagcacgaggcatgggatggggctgccctgccgctgggggcgatgatcgagacgccagccgcggccctgattgtggaggaattggcgcaggagtcggatttcctcgccatcgggaccaatgatctggcgatgtatacgctggccgttgatcgtggggatgccgggctggcgggtctatatgatcccctgcatccggccttgctgcgcttgattgccgcctgtgccattgcggcggcgcgggccggtaagcctatgtcactatgtggcgagatcgcgggtaatccggcagcgattcctgttctgctcgggcttggtttccggcagttcagtatgggggcgggagcagtgccgcgtgtgaaaaaggcgatccgggccacttctcttgatcaggcaagacgtgccgctcaggaagcgctgacgatcatatgattgttcgtgacgcctgttatggggtctgatcgtatcagcgtatcagaaggacaggaccatgaaagtcgtgctcgatctcgaccgtctgctgcgggaagggcagataacaccggaggagcgggacaggctgatccggcttggcaaggtccagacggggtctctgttcgtgaacgtgctggtcggtttcggatcggctgcggtgtgcgccgggttgtttgcgctggcgcctgatccgcttctgggcctgctcatgggggtggttgccatcggggctgcggtgttgctgcggcatgagcgggcgcagcaatggggcattctgtcggatattttcgctttgctcggcgtgttgaccaccggcatgagcctttactggattggccagggaccgtcttcaatgctgctgctggcgctttgctgtgccggtggagcactgttcgcccgtagtgcgatgctgagcgttctggccgttctcgctttggcagcctcgctcgatacctcgttcgcttatgtgcatgccacctatatgttgggggtggaacggccggcacagacgattctggtgtttaccggtcttggccttgcattgctgttcgcctcgacccgtgtggcgcctgtgctggagggcgtggtgctggccgccgcccgttgttcggccttgatggtcaatttcgctttctgggttggctccctctggggagaagaccggatgttgttcaacgataacaggggcgtcgttctgttgtccgccgatatattcagtatcggctgggccttggtgctggtggccgcggctgcatggggggcatggagcggtcgccgctggctgatcaccacagccgcgattttcggggcgatccatttccagactcaatggttcgagcgtttgggggcgaccccgaccagcgtgctgacggcaggcattctgacattgctgctggcagcattgctctggcgggtgctgtacgcccgcaaaccgtcagtgcctgcataaggcgctgacggtttcttccgataacggagcgtatcagcgggacaggggacgcggaccgatctgggcgatgatttcagccgcggcccggctgccctggaggccgcagtttttcagatcctgtccctgtgcgaagctggcaaggaacccggctgcataggcatcgcccgcaccggtcgtgtccagcaccttcgtggagacagccggaatctggattgtgtctgagccgtgaagaatgacgctgccagcctcgctgcgggtcagggcagcgagtgctacgtcaagccgtgccagttcagcggcttcctcgaatgtgttgcgttcgtacagcgcggtgatctccgtttcattggcgaacaggatgtccacgttcggcagcagagcgaggaaatcatcacggtggcgatgcacgcagaatgcgtcggacagggagagggctaccttccggcccgcctcatgcgcggcagtggtggccttgcggaaggctgcctgcgcagccggcggatcgaacagatagccttccagataggtgatggcggaatcagccaccaaagacgtatccacatcctcggcggagaaggtgacgcaggccccgagataggtgttcatggtccgttgcccgtccggggtgacggcaatcaggcatcgtgcggtcggcgctccgccctgaaggccgggagtggggaaatgcacaccggtttccgtgatatcgcgacggaaggcctcccccagcgcatcgtctgccactttgccgagaaacgcgaccttgatccccatgctggcagccacggcgcaggtattggccgcagagccgccgctgacttccgtgccgcggggcagtgccgcatacagtgaggctgcctgttccgcgtcgatcagcgccatgctgcccttgtgcatgtcatggcggctgagaaaagtgtcatcggtcagcgcaatcacatcaacgatcgcgttaccgatgccgagcaggtcgaagcggggtgcagtcatgcggagaggctccagaatgtccatcgaggggtggcgggcgacctgcccgataccgacgctcgcaggtatcaccgtgaggggcctgctacaatggcggtctggtcaaattggcttctccggcggactatccgcccatgaatgatgatcaattgtccattgctggccaggcttctgttctccagccgctccagcgggcgatcactcagttggaggatgcgccgtttcgggctgtggtgatgcggtctctcggctgggccttgttgctgctgtgcctgttggtgtggctcggtttcaagggggcaggctggttgcccgtgcattggtggcagggcgaccattggggtggatgggactggcttgccggaatcgtgggagcgatggcgattgcggcactcggcctgtggttgttcgtgccgatcagtgcggcgatcggcgggttgtttgccgatacggtggcgatctgtgtggagcgtcgctggtatccggaatggcagcccgccacaccggccccacttcagatgcagatatgggacggtctggcgctgggtctgcgcgtgctggtggtcagtctgatcacgctgcctgtggttctgttgctgccgggggccggatttgtactgggatggctggtttccgcctgggcactggggcaggggctgttcgtcagtgtcgccatgcgccggatgagccgggctgatgccagacgtctttatcgcacatggcgtggcacgatactcgtgcagggcggaattcttgcggccatcgggatgatcccggctgtcaatctgcttctcccagcccttgggccggccgtcatggtgcatgttctggcccggattatgatgcatcgccgagccttttgagagcgggacagcaggcatgaccggatcgatctgtatgcggaatgtcctgcaacatattgaggaagcgggttgttctgctcctccggtcatgttagcgaatcgaatcgtgacgtccagaatgatggagtgcacgtgtttaagcgacgcaaacccgacgaccagtctcccgaggctggggatatcaaatcagcggcgggagcttccccgggcgcgggaacgtcatcctctgacggcccggttcgtctgggcgtaccgcctgccccatccggcgccgcgcccggccagcaggccgcaagtggtttcggtgttccccctttccgaccaagccatcagaaggaggccgaagccgtgagccgtgcgcctttcgccaataccccgtcctctaccgctgtgccgccccgccctggcgcacccgctgccgcagcttcaggccgtccggcaggcaaagatacggcggagcgtcgcacgctcgtggtgggccgcggtatctccgttcagggcacggtgcaggatgccgaacgtctggtggttgaaggcacggtcgaagcgaccatgatccgcgcgaccgagctgtccgtttcactgggcggcgttttcaagggtgaggtcgaggttgaggacgcagaagtcgccggaaccatcgacggaaccctgactgcaactgcaagcctgatcgtgcgggcttccggcaaggtgctgggcacggcccgttgccgccgcctgcaagtcgaggatggtggccagatcacgggcagcatccagatgctgaccgatggcacccgtccggttgatgcgccgcgtccagatgcgtctgcgccgcgcccggcggttgatccggtgccgggccagtcaggtgagtaagccttcaggaaactgactgttctgcatgagcctgtccggtctgatgaaaagccgctccgtccaacggggtggctttttcgttcctgcggtcgattccagccatgagttcaagctgtccggcgatacggtgaagggcttcctgtaaagcctcggcgctctcctccacctcaggccgtggcggtagagaggataccggaactgcaggggcacgggtggcatcgagacgggcttcgatatggttgaatgccatggcgatccagtctttccagatgattaactgatcccgatcaatcccgtccctgctggccagatgcagcacgctcagccgcccggcgatgcgacgcagggcagtgtcggccaacatcaccggttcaatccgtgctgccatgctggagcgtcgcggttccagcatggtgcgggacaggctggcctccagattattgctggtgagaccggcctgacgtctggcctgatgcgccatatcttgtggagcttcgccgatcagggcggacagggtcaggttggcataatgcgcatgggccttgatgctctggcgcaaggcggtatgcaaccgtcccggttcccagctcggccacagcagcagattgccaaccagagccgttaaaccgccgagcaccgtgaacagcgcccgcatcgcggcaatatgcaggtcattttccgatccctgctcatattgggtcaagagcacgatcatgggcgtcagaaagacgatgaacagggcatagcttgccggccgaagtgacagggccagaacggccagcggaaacagcgctattgcggttgccaacggaccatggatcaggaacgtcagcacgcctgccaatgctccgcctgccagtgtcccggccacgcgctcaaatgtgcgctgcatggtcatcgcgtagtgcggttgcagggtcacgatcagggtgatgatcagccactgatgatacggcatcggatgaaaggagcatgcggcaagcgcaagcatcaccagcaggctggtgcgtgtggcatggcgcagcatggcggaggaccatgccagattggaggccaagggagtcataatgacatcccgcccggtcgcagggcgcgtctcatcgccgggcagacgggttgcgggcgtctgaacggcgataatgaccctcaacctctcctgtatgacggtttccagagccgccagcgtggcgttggtttccgctcgtccacgtgtcaaggccggaatgatgcgggacaggcgctgttcgggtaaagcggtctggctgtgtatacggcgcgccagcatcgaaagtacagggcgaaggcggcgcaggaacacggcggcatgcgcgtagcgtgttgaggaggcagcggtgacagggctggtgccttttccggcctccagaatgtcactcatggcgatcagggcgccgaagatctggtcggctgcctccagcctcgccagcagcatggtgcctagttcgctccccacaccgcgccgatgccgcatatcgaccagcagcccgcgggcccgttcgatcatgtccctgatccgggcgcgatgcctgcgcgccatgttggaccatagaaggacatggtcgtgatcggccgatggggcggccaatggtgcatccagtggggaatggagttgggaggaggatatggacagcacctccaccatctcctccaccatatcagcgagggaggaaaacacggccgagaccgcgcgtttggccgggatgaacggacggatgttccagacccccagtgcgatcatctgcgtccacaagctgccggcgagaaaggcggcggctccggcccaacccaaaaggctggtatcgtgatccggcatggcggcacgccccatgcagagagcgacgacaacacccagcagattgccgacactttgtgctgaaagaccgtaaatccttgcgaagctggtcatgaagacgatcatccccgcgacagggatggcaatctccggccagggagccagcgtgccgagcagcagcgtgattgtcgcccccagcactccgaaaatcgacaatggcctgatgcgttgcttggtagggccgcctggatcgcagtaggaactcagcagcgcccccagcgcggcttccagcaggaggggctgatcaaaccatgcattcgcagccacccatggggcggtggcaaaagcggcgcgcaggccttcggccacgctgatcgcccaaggatccatagacagcgaaagccgcccaagatccttgggcggctttgccgataaaagggaggcaggcagagggctgtaacggcgcgtcatggtcttttcccatgctcattccccggacagggaatgatttggtcgtgccgtccggcctttttacccgcctctggcggagtgttcttacgccgcgcgggccatgccgcgcagcacgtaatgcagaatgccgccatgcttgtagtaattgacttcatcagcggtatcgacacggcacagcagcggcaccttgtcgacagaaccatttgcacgatggatgaccagggtcaggtccatacgcggtgacagatcatccagcccgacgatgtccagcgtctcgctgccatccagccccagcgtgtggcgcgtcatgccgtccttgaacagcaggggcagcacgcccatgccaacgaggttggagcgatggatacgctcgaagctttccgcgattaccgccttcacgcccagcaacagggtgcccttcgccgcccagtcgcgggaggaaccggtgccgtattccttgccgccgaagacgatcaacggcacaccatcggccttgtatttcatggcggcgtcatagatcggcatgacttcgccggagggctgatgggtggtgacgccaccttccgtgcctggtgccaattcgttcttgatgcggatattggcgaaggtgccgcgcatcatcgcttcatggttaccgcgacgggcgccatagctgttgaagtccttttccagcacctgccgttccagcagatactgccccgccggagaggatttcttgatgctgccggccgggctgatatggtcggtggtgatggaatcacccagcagggccagttcacgcgcgccgaaaatatcggcgacacccggcggctccatggtgatgttggtgaagtagggcgggttacggacataggtggagctgtctgaccatttgtaggtgtcggcgctgccatcgatctcgatcgcctgccactgctccggccccttgaacacttcggcgtagcgggacaggaactgttcgcgggtcagattggcatggaccgtatcggccacttcctgtgtggtcggccagatatccttcagatagacgggcttgccatccttgccggtgccgagcggagcggtggtgatatcttcccggatattgccgaggaaggaatacgccaccaccagcggcgggctggcgaggtagttggcgcgcacgttcggatggacgcggccttcgaagttacggttgccggacagcacggagacggccaccagctttccgtcctcgatcgcatcgacgatggtgtcgtccagcgggccggaattgccgatacaggtggtgcagccataaccgacggtgttgaagccgacggcatcaagatcggcggagaggccggaacggtccagatattccgtcaccacctgtgatccgggggcgagggaggtcttgacccacggcttcggcgtcaggccgagcgcacgggccttccgcgccaccagaccggcggccaccatcacataggggttggaggtgttggtgcaggaggtgatggcggcgatcaccacgtcaccatgaccgatctcgtagttcttgcccttcacggcactcttgcgggcgacgtcaccggcggcgacgcccaggctcttggtcagttcggtattgaacgcgctggcggcttccttcagcagcacgcggtcctgcgggcgcttcggcccggccaggctcggctgcacggtagacaggtcgagttccagcgtgtcggtaaagatcggctcctgcatggtctcgtcgcgccacatgccctgcgcacgcagataggcctcgaccagggcgatacggtcttcgtcacggccggacagacgcagatattcgacggttgccttgtccaccgggaagaagccgcaggttgcgccgtattccggggccatgttggcgatggtggagcggtcggcgacgggcaggtgatccagtgccgggccgaagaattcgacgaacttgccgaccacgcccttcttgcgcagcatctgggtgacggtcagcaccagatcggtggcggtggcgccttccggcaggcggccggtcagacggaagccgatcacgtccggaatcaacatggcgatgggctggccgagcatggcggcttcagcctcgatcccgccgacgccccagcccagcacgcccagaccattcaccatggtggtgtggctgtccgtgccgtacagggtgtcgggataggcataggtcgcgccatccacatcggcggtccacacggtctgtgccagatattccagattgacctgatggcagatgccggtgccgggcggcaccacgcggaaattctcgaacgcttcctgaccccagcgcaggaacttgtagcgctcgccattgcggtcgaattcgatatcgacattggtcttgagcgcgctgggcgtgccgtaggtatcgaccatcacggagtgatcgatcaccagatcgactggcaccagcgggttcactttctgcggatcgccacccagacgggtgatcccgtcgcgcatggcggccagatccaccacggcgggaacgcccgtgaaatcctgcatcagaatgcgtgcgggcttgaacggaacttcctcggtcgaggaggctttttcaacccagcgcacgacggcctttgcatcctcgacggtgtaggaagtgccgtcctcgaaacgcaggacattttccagcaggattttcagcgtcaccggaagacggctgatatcaccgattgtcttggctgcttcgggaagggagaaataattgtaggtcttgccgccgacagataatgtccggcgtgtttgcagggtgtcccgaccgactgacttcatagtgcttgcctcatcaatggcacgcctgcccgcccccgcggatggctgcgttgcaacacggcaccgcttagagcataggcagcatcaggacaaggatgcagggatgccgtcagcgtgaaagcaataaaatctgcacgagagatgggcctggcgggatgctgactgcaagggggttggcagttttccgggcggagcgtctggtgttccgcgatctggatttttccctcgtgccggccactttgcgaccggcaggagagggggcaccggatgccgtgaccctgatcggaccgaacggatcgggcaagtcgaccctgctgcgactgctggctggtttcgtccgcccggccgtggggaccgtgtggtggcaggaggagcctctgccggcggatcctgccgatcgtgcccggatcgtcacctatatcgggcatcaggatgcggtcaagccggggctgacggcggcggaaaatctgctgttcgatgcgtcatggcacccgcgtggccgacgacgggaagccattttgaacgcgctggaggcagtaggcctgtcggccctgtcggccctgccgggccggatgttgtcggcagggcagaaacggcgcttggccttgtcgcggctgatgctgagggaaactcccgtctggctgctggatgaacccacgctggggctggacgatgcgtcgattgccctgttcggtgatatgttgcgggcgcatcgcgcccgcgggggcgttgtgatggcggccactcatgtgccgctgcctttgccgggtgcgggtgtgctgtcgctgcatcctcatgcactggctgcgcaaacggggcaggccgcgattgagggggccggcgatgagtgggccggagatgagtggggttagggataactggatgatcacgtcatgatcgcggcattgctggcccgtgagttgcgtctgtccctgcgtcacggggctgatacgctggccgtgctgctgtttttcttcgtgactggcagtctgttcccgctggcgatcgggccgggaccggagatgctggcgcggatggcgccgggggtggtgtgggtatgcgccttgctggcggcgttgctgccgctggaacggttgctcggcgcggatcaggaggatgggtcaatggaccacctgttgctgtccggcctgccggctttcggggtggcagtgggcaaggcggtggcccactggctggtcactggcctgccattgctgctctgtgccggcccacttgccatgatgctgcgcatgcggccggagatcgtcccggttctgcttgcgggattgctgccggggacgatggcgctctctctgctcggcacaatgggggcttcggtggtgctgggggcacgcaggggcgcggtgctgttgccgctgctggtactgccactgacaacgccgatcctgatttttggcgcggcggcagccgatgcagcggcgggaggtctctccccacgtccgcatcttctactgctctgcgctgttgctgtggtggcgatgtccctgtgtccgttcgcggccggcgcaggcctgcgtgccgcggctgaatgagtatgccatattctgccaccacccgagattttgagcgtattgaaggtcatccatgatccagcccctctctccgtcttctccgcccgtctggtccgaagagcccgtctggtctgaagaggatgtgatccggcaggattgtgaggatggcggcaaccagcggcccggccagaagatcgctttctgtgtgcttgccctgatcattactgcaggtgcactctggacgctgggcagttttatgcctgcgctggcgtgggccgcggtgttcgccattgcgacctggccgctttatcgacgcgcgcgcaatgcctggccgggcggtggacgcgtgttgctgccgttattgtttaccgtggcggtcacgctgctgtttctggggcctttgaccctggcggggattgaagtcgccaatgacgcgcgcggtgtgatcgacggggtcgagcatgtgctgcataatggtcttccagtgccatcagccctgtcctccctgccattcggcagcccggtggtggagtggtggcaggataatctcggcagtggtgaaggagcagcccgcctcgccagacatatcgaccgttcccagttggtggcgatcagccgtcatctgagcgccgtgctggcacatcgtgtggtcctgttcagcttcatgctggtgacgctgtttttcctgtaccgtgatggggatacgctgacggctcagctctcccgtgccagtgcccgcgcttttggtcctcatggagcacgggtcggacggcaggtgatcgcctcgatccatggtacggtcgatgggctggttctggtcgggctggccgagggaatcctgatcggtatcggctatgccattgcgggtgtgccccatcccactttgttcggtgccgtcacagctattgccgccatgatcccgttcggtgcaccggcggcgtttctgctggcggcactgcttctggccgcgaatggtgcactcctgtccgctgcgattattgccggatacggttgtctgatcgtgttcattgcggatcatttcgtgcgcccgttcctgatcggtggggccacgcgactgccgtttattctggttctgctcggtattctgggcggcgtagagtgttggggtttattcggcctttttctcggcccggcactgatggcggctgtgacccatctgtggcgtgaattcagcgccgccgggccagacaaccgggatcgtcagggcatcacagaggatgccccttgatcatgttatcgaccagattagcaatactgacggtcagtttcagcccgactacaaaagcatccggaatggattttggccgggtcgggtaacgtaactgatccgggttgatgatatactggaggtttggagtaatccgcaccgtctccagagcctgaaacgtgtagttcaactccatcatgacctgattgcggttggttccaggtggcagcccggccagcgttctggcttcgctgacgccttgaagggccgcaccgctcagggattgattgttgatcatgaaacccagcgtatcataaggacgctttttgaaaggtgctgtcattaccatcccagcttccagaaaataatcctcggccaaacgaccagacaagccggtcatggctacgccgaataatgtcagaccgcgggcggaatgatctgggcgccataccatctggtcaaagcggatataggcgcctgaacggccatacagcgactgtgccggaaggccgctgacctgtacatatccaccctgtgtatcccgtgatggatcattgtagttcgtggcatcgtaccatccaccaatctggtaatgacggggcagacggtcattttcaaaagttgtagcatatccgagttcgaaagggatcatcacgccattggcacggtttgtggaccagttgaagccatgatcgttattgccctgaaagctccgatttacttcataggcaccggcatgcaggtacacgcgcggggtcatccagaatttgacgcgtcccatccagctggaaacaggccaccatgtcaggctgctggtgcggaatacgaaagtgggattgccgcaggcagagtttgactgaaactggcaataaaatggtgatgacaggaattcggtattcgcgatgctccggcctgcttcaagaataaggcggttattgaaggcttttttctcgatggtgaactgggtcagacgcgttgtttggccgccaccccagatttcctgtacggaggtactgttgccgatggcatcgcgggacaggttgcggccctgacgattggtgacagcaatatgcacactgacaccgctcagcccgaccagtttattcatgtctaaatcggcaccggccagaatctgcccggcataagcggcttcctgtttgattccacccaccggattggcggccatttctgccgtataggcggcgatgaaatcgactccgtttgcaagtgcgacatgatcgggaagattatgcggcgtcgcatcaatgccgagccgggtcgtatctctcgtgatttctccaatgctatttttctgaacccgccaggggtcgctgtgacgggtgaccggcttgtccggctcggtagcaagcgccggagcgagcggggacagttctgccgtcaacaggaaaagagctatgaaaaaacggagcatggccataatgttctgaatgtgaaatgattttacaggacggcttctttcgggcgttttttcttgagtagcccggccagaacggcggtgatgattgttccggctgcgagtgcggccagataccagagcgggtggctgatggcattggggatcggcagtacgaacacccccccgtgtggcacgcgcatctgcacatcacaggccatggagatggctccggcgatggcggcaccccctgctgtggcgggcagaacgcgcagaggatcggcggcggcaaaggggatgacgccttctgtaataaaggctaaccccagaatgctggcagctttaccagcctctctttcctgcgtggtaaaacggtttggatagagtcgtgttgccagcgccataccgagcgggggtgtcatgcctgcgatcaccacagccgccattggcgtatagatcccgctggcgagcaatccgacggagaaagtataggcggccttgttgatcgggccgcccatgtcgattgccatcatgccgcccagcagaagaccgagaagaatggcactgctgccctgaagagtttgcaaccaatgcgtcagggcagagagcaggtgggctgccggatcgccaacgccatacatcatggcgaggcccgttaccagactaccgagcacgggcaggatcagaaccggtttcagaccatccagattacggccaagcttgatccagcgattgaaaaaagccgtgctgtatccagcaataaaccctgcgagaataccaccgagaaatccggcgcccattgaggacgcgatcatgccgccggtcaatccaggagcaataccgggacgatcagcgacagaataggcgatatatcctgccagaaccggcacgatcagtggaaaagccgatttcgcaccgatgagaaacagcgcatgtgccagtgtgcctgcctgcgatgcatcggtgacattaacgccgcccagtgcgaaggccatggcgatcagaatgccgcctgccaccacgactggcagcatgaaagaaacaccggtcatcagatgtttataggggcctgtacggggcggcgtggcgttatctttcgaccggtcggaggtggagggagcagcctgctctctgttgtcctgaccccatatgccggcctgctcaaaagcttctgtaatcagggccgctccatccctgatggccgctttggtgccggttttaaaaagtcgctttccgttgaagcgggatagatcaacctgtgtatcggctgcaataatgaccagatcggcagaggcaatttcttcagcactcagcgtatcccgtgcaccgaccgacccttgcgtttccacccggatcatgcagccatgcgcggcagcaccctgttgcagtccctcggcggccatgaaagtatgggcgataccagtggggcaggaggtgatggcaacgatcctgcccccctttgcaggtttcccatccagtgatgcagagggtgaactttgtacgtctccaatattatccagaacaagatctgcatcagccagaatagtatccaatgtagtcgtatgttttggaaaacctgaaagcttgtctgctatatccagatatgtgctatcgctttcaccttcgccgaccagcaacagggtggagatcatgcgtgtgtcgggctcaggtgatgctgagccaacgacgcgcagatcgatttcaatgctacggttacggttggaggcagctttgcgcagtgcttcggccgccaggactgcatgtgtgcggcgtgcctgtccatcgatgatggcgagaatggtcatgacggcaacactcccgcggtatggccggtatttcggaaatggcatgcattatcttgcagcgtctgaacgatcaggcggctttcaagcgttagcaccagatcgggtcccggcagggatgcgcccggtaatgtcaatttggcggatgcaagcgccacggcgcggcgtgccagctgttccagtggcagattgtcatgcagtgccgtgacaatcccggcaaccagcgcatcacccgcgccaacagtgttcagcacctgcatggggggatgctgcacatggacagcctgatcgtcagtgacaaacagggcaccctctgctcccagtgaaatagcggcgagggttacgccacgcgctgtcagctcccgccctgcacgcaggaggtcggttacatggcccagcggggtacccgcccattcttccaattcatgtcggttaggtttcaaacaaaagggcaatgtctccgcttcgttcagcacagctcccagcgcggctccgctggtatccagtactgtgcgaagaccttgacggtgcagcatgtccagaagcgtgacatagatatcgtgcggcattgcgctggggacactgccggccaatacggcaatgtctccggcctgtgacactgaagagatatgcgcgatgatcgccgcaccttcatcattgcagggcaggcccggcgtgttgatgtcggtggtctcttcggctgtatgatcgatcagtttcaggttgcggcgtgtatgaccggatacgcgcaggaacagatcctcgatcccgcgttcggcaaaaaacgtcgagaacaatgcatcattggcatcccccagaatgccgcaggctctgacgggcggagcattttcatctctggccgcgaaccagtccgcaaggcagcctgcgacattgacccctttcccaccgggataggaggccgcagccaaggcccggttgacctgtccgggatgcagggccgtcaactccaccgtttcgtcgatggcggggttcagggtgatggtgagaatcgcgctcatatggcttctccaaagccggtatcagcatggaaggtggtttccagcgctctcacttcagccggagaggaagcggccagagcgcgctcggccaatgccttcaggtcgtccatgcggtactggcgcaggcaggctttgacaccgggaatgtcgcggggcgtcattgacagctcggtaacacccaacccggccaacagcgccgcaccgaacggatcaccggccagaccaccgcagaccccgacccagcggcgcagcggtgcggcggcttcggccgtgcgccggatcagcgcgagcacggcagggtgtaatccgtccacctccgcggccagcccggaattctgccggtccatggccagtgcgtattgtgtcagatcattggtgccgatggaaaagaagtcgacatggggggcgattcggtcggccagcaaagccgccgccgggacttccaccatgatgcccaatggcacttccggagcttgcaacgcggtgcggacccggtcgcagacggcacgcaggccggcaatttccgccagtgacgtgatcatcgggaacatgattgacagtggcgcttccgcggcgggttccgtttctgcctgccagcgcctgacatgaccggcggcacggtacagcgcacgcagctgaggctccagcagatcagggcgacgcagcagaagtctggcaccccgcacgccgaggaaaggattttcctcgtgcggaaggttcagatgcggcacctgtttgtctccgccaatatccagagcgcgtacaaccagcggcctgccatccagcgcctccagcatcgcacggtaggtttcgaactgttcctcctcatccggggcatggtcgcgctccagaaacaggaactcggtccgcatcaggccgacaccttcaccgccctgttcaagcgcgaaagccacctgatcggggcgattgacgttggcggccacagtcaggtgataaccatccgtggtacgggccgggcggctccgctgcgcagcttcttcattgcgcagctcggtctggcgtaatgaccagtcctgtgccgaggcaatggctgtctcatccgggtgcagatgcaccacgccggcacggccatcaagaatgaccatgttgcccgacgtcagttccatcacatcaggtccggctgccgcaatggcgggcaggcccagcgtccgggcaagaatggcagtatgggaagtcgggccgcccagcgccgtgatcaaccccagcacgcgctccgggtccagtcccgccgtatcggaaggggcgagatcatcagccaccaggatgcagggataatccggcagggtcagcagcgatcccccggcctgggacggatcaagctgggccagaacccgcctgccgacatcccgcagatcggccgcacgggcggccagaaccggattgccgagtgcagccataccttcggcggtctgttcgacggcatgatgccaggcccaggcggcgccatgtccatccaccatcaactgacagacgcgggtgatcaggtcggtatcatccagcaaccctgcctgcgcctgaaaaatcgcggcatcggcggctcccagacggcggcccgcgtcatcggccaaggcatgaagctgcgcgcgcgtgacgcgcaatgcctcattcagccggtccgccccctcccgcagatcctgcggatgatcagtcacggatatgctctgccctttcaggacatagaccggcccgatagccagtccgggagcggcggaaacgccatcaatccgcatcagagcatggggtggcgtccagcctgcgacgggccgggcagcacggatggctttttcagcggcggcgcgttctgcggcagtcaggccgtccatggtggatttcagagcctgcaaggcctgttctgcatcgtctccatcggcggagacggtaatgcggtcgccttgtttcagcccaagctgcagcaagccaatcaactggcgcggatcagcagtttcggcatcatgcctgatttgaagccgggcgcggaagcgttttgctgtttcagcccacgccgaagcgggtcttgcatgcaggccgcttggataggggatgctccattcaaaatgatggcggagatcggttatcaccgtatcagaggacatgctgacggcggcaggatgtgcatcctcgctcagggcagcttgcaacagggcggcatcgccagtctggaacagtgttttcagacgctcctcatcctgcaacagccgggtcaggcggcggagaatggcgatatgtgcgtcagatcgggcggcgatcccgacaaccagatgagcgatctgtcccggattccacacgacgccttgcggcacctgcagcaccgcgatgccatcggtgcgcaccatggcgcggtcatccaccatgccgtgaggaatgacgacgccgtggccgagccatgtattggcgacattttcccgcttcagcatgctttcggtgtaggcgggatcaacatgcccggcagcagccagaagctgggcgacttcctcaatcgcctgctgcttgtctgccggcgccgctcccacgcgcaccatggcacgcggcgcggtctgtgcgctcgcgattgcattcatctcgcggcgtcctccccaatccattttgaacggccggtctataagccgggtgtaaggttatatgaaaacgttttcacagctacgtcaaagaatttatttcgtgaaactgatttatgctgcattctatctttgctgcacctgcgaaaaaattgctgaaagttgcttatgcggataggttccaaatataataaggaaaacgttttccagatgatttgtccgcagttagaaccacggagaaagtcttgaaccattcagtggatggaacttcctccacaatgcgagccgtcggtatcaaggacgtggcagaggcggcgggtgtttcacctgcaacggtctcccgcgtgttggctggtggcaaggtcagtgcagccctgaaggcgcaggtggaggatgctattgcccgctccggctatcgccccaatttgtcggctcgccgtctgcgctcccgcaatacccagacgatcggtttgattgttgcggatatccggaatccgttttttaccgctgtcagccgttcggtcgagcagattgcctttgcgtctggcatgcgggtgatcctgtgcaatacggatgaagatccggaacgcgaagccatgtacctgcaattgatggaagaggagcgtgcaaccggcctgatccttgccccgactctccctgcgatcagccgtctggcgatacaccggccttcgctaccggtggttctgatcgaccgtgaaggccctgccggctgtctggactccgtggtgctggataaccgggaggccagccgaaccctgacccgccatctgctgcaaaatggatatcgccgtatcggcggcctgttcggaatggccagtaccacggcggtggaacgtcgggagggctatgaacaggcaatgcgtgaagcgggattggcttttgaatcccggcagtctcccgccacgatcccggacagcgagcagacggcccatgcctggctgagcagccctcatccgccagaggcgttgttggtcagtaacagtctgaccctgatgggggttacgcgtgccgcccgctcgctcggcctgtcgattccccagcagctggggctggccggattcgataatgatcactggaccgaactggtcggaccaggcatgaccgtcatggcccagccggtcgaggaaatcgggcgcatggcgatggatatgctgttcagccgcttgcgtgatccggatcaaccggtgcgcaaaatcgtgctcagtggccgtcagattacccgcgggtcttctgtccggacagccgcctagccttcaaagctggcgaaacgtgccgatcgtccgatctttttcgaactgcgtgccgctcagaacctgatcatggaatgcaagatgcagcccgggtggcagcaggcgcagcgccgtcagcgccgctgacaggttctgcacggcatccgagccatcaatatgcaggggcgccatggcccccgtaaacacgacggggcgcgtcaggacggcttttccggccgcgacgcgggcttccaggtgacgcatcgtctcgcgcaccgtatcggtgccatgagtgacaagaatgccgccaaagcggctctccgcaccaaaaaccgcatctgcaaccgcatcacgatccgcgtcggtgaagtccagactgtccttcagcaccggctgcaccatggtgatctccgtctgcggcaggcgcagtcgcggaccaagcgctgctaaccagtcaggatgcgggtccagtgccccggtggcttctacataacgcttggaaattgtcccgccagtggacacgatcagaacggaaagagggccgctgcgcatcacaggctccatggcaacaagatgttggaagtgatcaaaacgggtcgttaaaaatcatcaccggtggcatgtgtgcgacgcatcggcggaggcaagggcatggggccggtatcatcgggggaggtcagtgcccccagcagagcctgtctcaacttggcgagcttgcgttcgttttcgacttttagcccgaacacgtctttcacataaaagacatccaccgctcgcacgccgtaagtggtgatgtgggcgctggcaatttgaaggccctgctgcgcgatcgcggcggcaatatcatgcatcagtccggggcggtcacgcccgttcacttccagcaccgtatgggtatgggaggcatgattatccaccaccacacgcggcggtacatggatcgcccgcatccgtgtgccaagcagggggttggaggccttgcggatttcttcgtcgatatcgagttgaccggacagggcctgttcaatcagcacggcgattttcgccagccgattcggctgatcgaaggcttcgccggacgtgtcctgcacccagaacgtatccatggccatgccattggtcatggtgtgaatacgggcatcgacgatggaggctccggccacggccagtgcaccggcgatcttgccgaccagaccgggcgtatcggcgacatagacggtcacttccgtcacagcgcgggcaggtaaaggctgggtatcgacggtcagaagctgcgtgcctgcggcacggatcatgcgggcatgacgcgcatgggtctcggggtcgaaggacagccagtacccgggataaccaagcgtcaggaaggcttcccgctgctcctccggccagtcatagagcaattcggcggccgcttccttggcgcgggcgacgcgggtgtcgcgttctgtggtggccagcccgcctgccaaaacctcggctacgcgggcatagagttcacgcagcaatgttgctttccagccgttccagaccttggagctgacggcccgcatatccgcgaccgtcagcaccagcagcagcttcagccgctccggtgactggatggtgtcggccagatcgagaatggttttcggatcgtctatatcgcgccgaaacgcggtctggctgagcagaagatgatgcagcaccagccaggagaccatttccgtctcttctgaatccagccccagtgccgggccgatctccagcgccagttcggccccgagttcggagtgatcgccaccccgtcccttggcgatatcatgcgtcagcattgccacatacagggcacggcgggactgaaggtgatcaaccaccccggtggcgaccggggctatatcggccagatcgccatgttcaagctggttcagaacgcgaatagcctcgatcgtgtgctcatccacggtaaagacgtggtaagtgtcgaactgcatctgtccgacgatacgcgcccattcgggaatgaaccggcccagaaagccggtttcattcaggatcgacatccagcgtgcgccgctcggacgctgggtcgggcgctggacgccatccggcactgtattgccgcacagcagatcaaggaacaatgcggcggcgcgttgatcgtcacgcagggcgatggcgccccgctcattgcggatcaggctgcgaatgccgagaggatggatttgcagatcgcgatcacgcgcaagcttcatgatgcgcagcatctgaatcggctcgcgctcgaaatcgtgggaaggggcaggcaggagtttgccttccgccagcacgaagcccgcattgatcaacgctatatcggtttcagcggcgatagcgggagggccgagcgcagcgcggatcaatgccggttcaagcacgcgggtcaggcgcaggacttcgcgggccgtcagaaagtaatggcgcatgaagcgctcgacgccattctggcggccatggcgcgtataccccatccgtgcgccaatcacgggctggacatcgaaggtcaggcgttcctctgcccgtccggcgacgtaatgcagatgaaatcgcagcgtccacaggaaattccaggatcgtttcgccaggcgggcttcgttttccgtaatcaggccgccgccaggggcgcctgtgcctaccagatcaaccagtttgcgggtaccgaagacatagcgggacagccagtaaagtgtttgcagatcccgcaacccgccacggccttccttgatgttcggctcgacgaaaaacggactttcgccataccgaagatggcgtgcatggcgctctgcctgttttgcggcgatgaaatcatgttcgcccgcctcggtgcaggcttcccggaacgcggtaatgaatgcgtcgaacaggggctggttaccggccagatggcgcgtatccagcagggtggtgcggacggtcgtgtcttcggttgcggcttgcaggctctggctgatggaacgggtcgcgtgcccgactttcagcccaagatcccacaggaaatacagcatgaattcgactacggcgagcgtgcgggccgaaggggtatccgctgtgatgaacagcagatcgatatcgctgaatggagccagttcctgccgtccatagccgccggtggcggcgacagtgacgggttcagtctgctgtgtggcagaggccggaatggcgatactgtcagtatattggtagagtgcggcgacaagtccgtcggtcaggtcggacagtagatgggcagccgtcaggccagccagcctgccctgttcaaacgtatcacgcacccggccttgaatccgcgccagatggcgacggaacacacccagcgcggcattgcgttccagttgcgataaaggacccttgcgggggccggggccgaactcttcctctaacgccgtcagagcacgatctagttccagggcggcaagctcggatgccgtctgtcgaggcgctttctgcgcaaggccgggggaggaagatgtcaccatgattccgcttctacatcgccattgtgcgcctgcgaagaaagcatagacttaaaatgatacataagatcgagtgcttcgcgtggagtgagtttatccggttccatctgacccagtgcctcgatcaattccggcggtagagaggcgggttttgcttcatgaatgccttctgccggctctgtctctgtttcgttgccatggctggcggcgaacaggggcagagtcgcgttatcggtcagcccgacggaacgttcctccagtgccgtgagcaactgtccggccctgcggacggtggcggcaggcacaccagccagtttcgcgacatggacaccccagcttcgtcctccggccccttccgccacttcatgcagaaacacgaccttaccgcgccattcctgcactttcattgtataggggcgcagcatcggcagttccccttgcaggcgcgccagttcgtggaaatgggtggcgaaaatcgtgcgtgcgccgatacggctatgcagggcttccagcactgcccaggcgatggccagaccatccagcgtggaggtgccacgcccgatttcatccacgacgaccagggaacggggacccgcctgatgcagaatggcggcggtttcagtcatttcgaccatgaaagtcgattgcccgcgtgccagatcatccgacgcgccgacccggctgaacaggcgatctacaataccgatatgggctgctctggccggaaccggtagtcccgcctgcgccagaatgacaatcagggcgttctgccgcagataggtggatttgcccgccatattcggcccggtcagcagcatgacgcgtctgctggcggacagatccgtatcgttgggcataaagggggtcggaccgccttccagggctgcttccaccacgggatggcgtccggcctcgatagtcagcgtctggtcatcggtcatgacggggcggcaccatgtgccgctttccgccagacgggcagcggattgcagcacgtccagacgggccagcgcctcggcgcaggcggcgatggaaccggcatgggcctccaccttttgccgcagggcggtgatgacgatcatttcccgttgccgggcgcgttcggcggcctcggtaatgcgtcggtccagctccgacaggtccggatgggtaaagcgtgccccgttggccatgccttgccgcaggatcaactccggcaccgtccgcagtgtttccaccgcgacggcaggcacttcgatcatgtaaccgagttgcgcgtgatgacggatcttgaggctggcgacgccatagcgctgggcgtattcggtctgaagtgcggcgatgaccttgcggctgtcatcccgcagcccgcgttcggcatccagttccccgtcgaagccgctggcgattacgccgccatcctcgatgcgagcgggtactggatcggcgagcgccgcctccagcatttccggcagatcgggtggcagatgcagggcggcgtgtaattcagccagtgcggagggcaggatgccttccagcaatccggcggcttccatggcaatgtgtgcaccatcgcgaatggcggccagatcgcgaggcgtgccgcgtcccagcgcgatacgccccagcgcgcgggccatatcggggcagccccgcagagtttcccgcaggcgcatggacaaagtcggctgttccagcagccagccccatccatcctgtcgggcggtgatgactgttcggtcggtcaagggagcacccagccatgcggcgagcattctgccgccagccggggtcagggtgcgctgaacagcggacagcaaagtgcgttcggtgccgccatcgcgggcgcggtcgatctccagactggcgcgggtggaggcatccatggccagtcgcccggcctcgcccaccggcacgggatgaccgaggcgaggcaaagcccccatctgtgcatcccgcacgtaatccagcgcctgcatggccgccatggcctcggcatcggtaaagctgccgaatacgttgatatggctgacatcgtatgcttcagcgagtcgtgccctggcattggccgggtcgctgaccggttgttccggtccgcgccgtgcatcccacatttccagatgcagggaagaggggcagagaatttccgccggatcgagccggcccagcagggcggtcaggccggattcgtccagtgattccgtctcgaacagcccggtggagatatccagccaggctgcccccagacgattcccggactgcgtaatggccagcagcagattgggacggcccgcatccagcaaagtttcctcggtaatggtaccgggggtcaccagacgtacgacatcgcggcgaatcgggccttttccagcgcggtttttggggttttccatctgctcgacaatggcaacccgccaaccgcggcggatcagtcgggacagatacatctcggcggcatggaccggcacgccacacatgggaatcggttcgccttcatgcagcccgcgcttcgtcagctgaatatccagcgtggcggcggcattttccgcatcctgaaaaaacagttcgtagaaatcgcccatgcggaaaaacagcagcgcatcgggatgctggtttttcaggacgaaccattgcgccatggcgggtgtggcgcctgccggaatggcggtagccgcttcactgccggccccgttggaggcacgggcggcactgcttccggggggacggccccggcgtgtgggagtcgatgcaacgggcatgcaatgcagtgtaatggctcccattttttcggccagcatgccgagatggcggagcgtagactgttgtataatcgcaacatctttttatggtctgccgtaagcttggccagccgtcgggcaaagaaagccgactctgttccagtttatgcagcctgtcagcggcgcccccttgaaaatcatgatattgtctccagttgcggttgatcccgccggagtctggtgcgactgaggggcggtatggaaaggaacggcatatcgtggcggcgctgatcttcggcgtattctatctggccgcgattatcatgatcgtggcctcgcacggctttgcgacctcccgctatcagcgtgaaatgcggcgctggggcgatgaggaagccgcatttttcggctgctttacccggctggcaagcgatacggtcagtggctggctgctggacaggcgggttgatcgctcgcaagggccgattgtcgtttctgctcatcgccatggccggatgatcggcctgacgacactggcgatgccgcagaatggggattctcccctcgattttacgctgactctcgaaaaaccggtgacagaaagcgatctgttgagtgaacgtgtcgttctgtgggcaagggatggccatctggtccgacaggttgtgatggatgccgtgttgcagcgccgcctgatcggcaatatccattgatacagactgcattgggagcgggcgcatggctctggataatgagacatatccgcgtgatctgatcggctacggcaaaacgccgccttttgcgcgctggccggggggcgccagaatcgcagtcaatttcgtcgtgaattatgaagagggtggcgagaacagcatcctgcacggcgattcggcatcggaggcctttctgtcggagatgattggcgcacagcccgtacccggcctgcgccatatgaatatggaaagcctgtacgaatatggcagccgggtcgggttctggcggttgatgcgtctgttcgactcatacaggttgcccttcacctgttttgcagtaggcatggcgctggagcgtcatccggaagcggcgcaggcaatgatggcagcaggccatgagatagcgagccatggttatcgctggatcgattatcagttcgcgaccgaggacgcagaaagagccgatctggcgcgcgcgatcgaggcgcatcgccgtgtgactggcaagcgcccgctcggctggtatctgggccgctgttcccctcatacgcaccgtctgatcgcggaggagggcggttttctctacaatgccgatacctatgccgatgatctgccgtactgggatctgcaccatgatcggccgcaactgatggtgccgtatacgctggatgccaacgacatgcgttttgctacggcacagggattcaatacggccgagcatttcttcacctatctgcgcgacagtttcgatactttgtatgaggaaggggccgtgaccccgcgcatgatgtcgatcgggctgcattgccgtctggccgggcggccggggcgtcttccgggactgaaacgcttcatcgaccatgtgctggcgcatgacggtgtgtggatttgccgtcgcgaggatatcgctcgccactggcatgagacccatcctcccccggcccaatgtgtgccgggatagcaggccggactgttttcagccccctccggcgagtgccagccattcctcttccgacagggtgcggatgccgagttctgcggcttttttcgctttggagccggcatccgccccggtcaccacgaagtcggtttttttagagacgctgtctgtgacttttgcgcccattgattcggcccgggcttttgcttcagggcgggtcatggcctgaagcgtgccggtgaaaacgatgattttcccgttgaggggagagtccagcgccgcagaggacaggccgccggacggggcggtgatggtcagcatcccggccagttcatccagcgtgtcgatattgcgtggctcggcgaagaaatccaccagctcctcggcgatggtgggtccgattccggtgatgctgcccagcgccagcctttcgtcagagccgatttgtctggcggccagcatctgggttctccattccgtgaagctgccgtaatggcgcgccagcaatctggcattggtctcgccgatgcgcctgatgcccagcgcgtagagaaagcggtcgaacggtatgctgcgccgtgcctcgatcgcctgtgaaagattgcgggccgacagggatccccacccatcacggcgggcgatctcatcctcgcgggcggggaggcggaaaatatcagcggggccggagaccagcccatcacggtgaaattcgaggatgcttttctcccccagcccgtcaatgtcgaaggcggggcgggataccatgtggatcagccgttccaccacctgtgcttcgcaggtcaggccgcccgtgcagcggcgtacgacctctcccggtggtcgtattgccaggctgccgcagaccggacagtgctccagtggcgcgaaaggccgggcaccgtccggccgcttttccagcacgaccgagacgatctgcggaatgacatcgcccgctcgttgcagaatgacggtatcgccctcccgaacgtccttgcgggcgatttcatcctcattatgcagggtggcgcgtgtgaccagcacaccgccgacattgaccgcctgcagatgggccaccggtgtcagcgcaccggtgcggccgacctgaatgtcgattttctccagcacggttgtcgcctgttcggcggggaatttccatgccgtcgcccagcgcggggcacgcccgacaaaaccgagtcgtcgttgcagagacagatcgtcgatcttgaacacgacaccgtcgatatcgtacggcagagtggaacgccctgccgcgatccgcgtggtgaacgcggcggcagcgttttcatcctcgatcagctgcgacaacggattgacgacaaatccccagtctttcagacgcgtcagataatcccagtgcgtttccgcgaccggtgcgctgctctctccctgcgcataggcgaagagtgccagaggacggttggcagtcacggacgcatccagttgtcgcagtgatccggcggcggcattgcgtggattggcaaaaatcttctgccccagccgggcctgcgtttcgttcagttccagaaacgcggccttgctcatgaagacttcgccgcgaatttcgatgaaggcaggtgcctctccatgcagggtttgtggcacgtcgcgcagggtgcggacattggctgtgacatcctccccctccatcccgtcaccgcgtgtcgccgctctggtcaggatgccgttttcgtaggtcagggaaatggaaagaccatctattttcggctccgccacgaagcggggcgaggctggtaaattcaaaaaccgtctggcgcgggcacagaattcggcaaactcttccgtgtcgaacacattgtccagcgacagcatcggcacacgatgccggattttcgcaaaggcggaggagggggccgtgccgacgcggttggcagggctgtttttcagaatggcatcggggaacagacgctcgatctcggcattgcgttgccggagagcatcatagtccgcatccgtcaccagcggagcatcatcgcgataataggcatcatccagctcggcgatgcggctggcgagccgttcaagctccgcccgtgcttccgcgggtgacagagcctctggcggagtcagcgaaagagagggggaatccggatttgtcatggtttcgccagcagatcgtcagcggcggcgcgggccgcctcggtaatggtttcgcctgatagcatccgggcaatttcctcacgtcgttccgctccggtcagattctcgaccgtggtggcggtgcggtctttggtcaccgatttggccacacgaagatgcgcctgaccgcgcgccgctacttgcgggctgtgtgtgacgaccagcacctggctgtgccgggccacctgcgccagcctttcgccgacagcggcggccgtcgccccgccaatgccggaatcgacctcatcgaagaccagtgtcggcacggtggagcgactggccagcaccactttcaaagccagcatgagccgggacagttccccgcccgaggcgactttcgccaatggtcccggcggctgacccggattggcggcaatcaggaaggcaatactgtcctgccccgcttctccccattgccgttccggcagggtttcaatccgggtgaagaaacgggcgcgttccagcttcagcggtggcagttcggcattgatggcctgttccagtagggtcgcggcctgttgccgtgccgcgctcagggctgcggcggcctccagataggcgtggcgggcccggctttcctccgccgtcagtacggcgatggcgtgatcgccgctttccagtgcggatagtcgttggcgcagcgtttccagcaggcccggcagttccagcactgtcacattgtgcttgcgggccgcggcccggagcgcgaaaagccgttcctcgatattttcgagttgccggggatcggcatcggaatcgttgatcagccggctcagcagcatctccgcttcggcgagcgcttcttccgccctttccagtgcggccagagccggggcggtcggcaggtctgccccctgatcctcaccgtgaagggtggtggaggcccgttgaagggaccgtgtggccgcccgcaaggcagcggcagggccagccgagcgccggtcccgcggtgtcagctctgccagagcggcggcgatcgcttctcctcggcgttccgcctgctgaagccgggtgcgctcggcggcaagttgaatgtcctctccttcctgcggggcgagtgaagacaactcgttggcggcatgcgtcagccagtcacgatcccgttcggcttcttccagtgcgatgcgggcttgtgaaagacgctcgattaccacgcgccagtcagcccagcacgtggcaactgctatccgcagggacggatcgacgccgaacgcatccagcatcggtccatgcagggcgggatcagccagccccatctgctcatgctgaccctgaacctcaaccagtaaagcacccatacgccgcagcaacgcaatgctgactggctggtcattgacgaaggcccgtgaccgtccatccttgccgaggatacggcgcacgaccagctcatcttctatctccagctcatgctcggccagcagggcttcgacaggatgggagggcggtggagcgaaacacgctgtgaccgaggcctgatcggccccggcacgtagcaacccggcctcggcccgtgcgcccagcgccagaccgagactgtcgagcaggatggatttaccggccccggtctcgccggtcagaacggtcaggccggtgctgaacgtcagatccagacgttcgatcagcaccacatcccggatcgagagcgccgtcagcatcgggatgaaccccgttcaggaaacgccagccaccattccgtcagaatacggagtgccacatgcgggagaagaaaccggaaccggtggtgccggcgcggggaacaggctcccccttcaccagattttcagcggccagatcatcccagctgctctgataccaggaactgccgggatagttgtgtcccagcaccgccgccgtgcggcgcgcatcgctgcgcaaacccagcagcagatacagttcggtcaggcggtgcagggcttcggggacatgattggtcgtctgatattccttgacgacggtctggaagcggttaatggcggcggcatagagatgctcccgctcataataacgaccgatttccatttccttgccggccagatggtcccggcagagatcaatcttcaggcgggcatcgcgggcatagccgctgtccgggaagcgggaaaccacttcctgaagagcagtcatggcatcctctgtgcctttctggtcacgctggatatccgcgatctgctcataaaaagacagcgcgcgaagataataggcgtaggcgatgtccttatgagtcggatgcagctggatgaaacggtcgagcgaaccgatcgcatccatatatttatgttccagatactgggaatacccctgcatcagctgggcgttcgccgcccatgacgagtagggataatattgctggacggcatcgaattgctgggccgccgtggtgtagcggtggtcctgcatggcgtcgacgccggtattgtagagttcttcaaccgacattttcgccggatcgagtttggccagttcgtcatctttgctgctgccgcacccgctggcgagcaggggaagaagcagggctgcgccgatgcggcgagccgcctttgcgcgcgcgaaggatgagagaagcaccatggacaccgactgatctgtgagacgcaccttaccgcgcttatagcacggactggcgcggggcaagctgttgtcgcaagacaaggaccagcggaaggggtatcaggcggcagaaagccaatccattgtattggctgaaacggtctgccaggcggatgcgtcactcaacagcgcgcgcagcagacggttattgagggcatggccggtacgatgccccacgaaacgaccgatcagagggtgcccggccatagccagatcgcccactacatccagcagcttgtggcgcacgaattcatccggcatgcgcaggccttcagggttcaagacctgatcgccatcgacaacgatggcattatcgaggctgccgccacgggccagtccggccgcacgcatggcctcgatttctttggccatggtgaatgtgcgtgcactggccagatcatgacggaaattatccgtgtccatcgtcatggtcagagcctgtcgcccaatggcagcggcatcgaattcaatggacagcgaaagggaaaagccgctttccgcaggatgcagctcggcgaaggcacttcctgcctcgacgcgaacaggtttcaggattttgatgctgagacgggactcggattgttcttcgacccccgcacagtcgatcaggaacatgaacggtgcagcggagccatcaaggatcggtacttccggcccgtcaatttcgatcagcagattgtcgataccctgcgcggccagtgcggccatcagatgctcgactgttccgacgctcgcatcagggaaatccggcgcagtcagcagagtgcacaggcgtgtatctgtcacgttgtcaaaagcggccggaatatcaaagccgagatcagtgcggcgaaatacaataccggttcccggtgcagcggggatcagccgcagccttgccggtgcaccgctgtgcaatccgtggccgacgcagtcgatcggtgatttgagggtcacctgccgcttgcccggtgtgaaagaagggctggaaagggaggcaggcgaaaaaccgctcggcattcccgtcattccatccattcctttaccctttcctgtcatcactgtcccgcgcggcctgttatgcatatggccgcgcagaaaggattgaagtcagtgcccacccatcatgaaaatggccggcagggagaagctaacgcgctttgccctgccggccaattcaaggattatttctgactattacgctataagcggctgattttcaaagattttgtatcaatccgttacactcggtcaggctttgtcactcaggaggactgacggcgcaggaaggccggaatgtccagccctatttcttcggttgccgctggccgaacagaggggcgcgcctgctggtcgggcgaggcatgattgtcggcggcctgctgaccatcatgcaacacgggttcggtacggggcggctgcggcgtaaccggggcttcatgggcgggggcgctgccaccccccatgctgcggcggatggcgccggtcaccacattgaagatgctgctgcgcggcggtgcggcctggtgggcaggctgtggcgcataggcaggctgtggcgcataggcaggctcctgcgtgaacaggccgcgcggtgcgctggcgggtagcggcgcgcgcggtgcttcagcgtccgttccggcatagccatgcccatggccggccgaaggcggcggcgactgcacgaaaggcgcccggaccggagcggtgggggagggagcttgcggagcctgatgctgctgggtcggtgtcccaccctgcgcagggaaaggggccgtttctgccggcgcataatggccgggctgataggcggcgaaggcggccgcctcagcctgctcggcagactgcgccgacagggaaggaccgggcgagacggcatcgaccggcatggccgcaccgccaccgactgccaccagacggggacgctcggaggacagggaggacatatggttggccgggctgtcgatcccggtggctacgaccgagacccgcaccttgccgttcaggctttcgtcaatggcagagccgaagatgatattggcttcctcatccacttcctcgcggattcggttggcggcctgatcgacttcgaacagggtcatgtcctcgccgccggtgatgttgatcagcaggccgcgcgcaccgctcatcgacgtgtcttccagcagaggattgctgatggccagttcggcggcgcggatggcacggttttcaccttccgcctcgcctgtgcccatcatggccttgcccatttcagccatgacggtacggatatcggcgaagtccagattgaccagacccggtgccaccatcagatcggtcacgccgcgcacgcccatataaaggacattgtcggccatcttgaacgcttccttccaggaggtgcgctcattggccaggcggaacaggttctggttggggatgacgatcagcgtatcgacgtattgctgaagctcctcgatcccggcctcggctgatttggcgcggcggctgccttcgaagctgaacggcttggtgacgacgccgaccgtcaggatgttgcgttcccgtgccatgcgggcgatcaccggggccgcccccgtgccggtgccaccgcccatgccggcggtgatgaataccatatgggcaccgtccagatgccggtacagctcatcggcggcttcctcggcggcggcgcggccgatttccggcttggctcccgcgcccagaccctgcgtgatgtgcgggccaagctgcacgcggcgatcggcgcggctgtgcatcagctgttgcgcatcggtattcgcaacgacgaaatcgacaccggccagattgagcgcgatcatgttgtcaaccgcgttcgtgccgccgccgcctacaccgatcacggtaatgcgcggggtgaaatctgtgtgcatctgctgcgggatggtcaggttcagagtcatgggcggtctccccccttgggcgctggctggacgaaatgggtgacaggaacaggcatcagacccgctccttcagaaaattgacgaagcggcgcaccagaccggtcgggcgctccgcctcaagatcgagatcatgcatgctgcgaccctgcccggcggcccaggcgagcagcccggctgcggtggcgaaggcggggccggatgcattatcgggcaggccacggagattatggggcctgccctgtcttacttgcttgttcaggatggcagccgccatttcccgaacgccggaaagctggcttgcgccgcccgtcagcacgacacgggcaccggaggcacgacccaggcctgagctttccagcctttcacgcaccagctcgaacgtttcttcgagccggggcttgataatggagacgatggtgctgcgcggcaccttcgtaatgtgttcttcgtcttccccgaccagaggaaccggcagcatttccctctcatcgtcgggggaggcttgcgtactgccatacagcgttttcagccgttcggcatgcgcgaccgtggtggacagcaggcgggcaatgtcgttggtgacatgcacgccgccaatcggcagctgggcggtatgcagcacctgtccttctgcaaaaacagccattcccgtggtcccgccgcccatatcaatgacggtggcccccagttcacgctcatcatccaccagggtggacatggacgccgccatcggtgcggacaccagttcggcaatgtccagatcgcaccggccgatgcaggcgctgagattacgcagcgcggtgttggtggcgtcgatcacatgcagccgtgcggtcagtgtatcgcagtgcatgcctctgggatcggccaccccccccatttcatccacggcaaaattgagcggtatcgcatggagcgtttcccgtccttccgtcatcgcgcgggagcgtccttcctgcaccacgcggcggatatcggcatcggtcaccggtctgccgcccacgggccactgcacgttgaacagcctgctctccggctgaccgcaggagaggttgacagtgacactgcgcagccgcgtatcggccatatcctcggcctgaccgaccgccgcgcgaatagcgcgttcggcttcatccagatcggtcacgccgccgccgcgcacgccccgtcctttctgccagccgaagcccaacacacgcagggtgccgtcggcctcggcacgaccgatcacgcaggcaatcttggtggttccgatatcgagcacgccaaacggtccgctacggaagtggcgattccgtggcagtgtttcaggaccagccgagggctggtgcagatggcgggcgctgtcgctcacgtctgtctccgcacggtccggattgcgggtttttccgtgatcgcctcggaacggggacgcagcaccatgcggtcaggcagtcgaagatctaccgattgcaggggccggtcgagcagttcatgctccttatgaagggccgccagacgtttgatagcctccagcggatgatcctccggcagcagcacgtcggttccgttctggagccggagattccagcggcgcccattgacccggacggcggcgatgacgtgggctttcacctccggctcggttttcagcgcatccagcaacgtggttgcggcggcaggggcgcccgctccgaccaccagcggcagggtgcggaaggtggcgacatcctgatcggccacgatctgaccatcccggtcgatcagcacgaatttgccctgattctgccagatggcgaagggacggcgttcggtcagcttgaccacgatggtaccgggcaatcgccgctctaccgatgcgttttcaacccaggacagggtttcgatgcgctgccgggcttcagcgaccgagaaaccaagcaggggatcgcctttacgcaccccaagcgccgcattcagcagcggctccggcgtgttggaacggccttcgatcacgatatcctgaatgcgcatgccaagggtggccgtatgctcccccagtgttttgcgcaggctggccaatgtggcggaggctccgttcccgttgatattgggctgtggtgctgcgacatgcagcagcacgccgattcccacgacggcgctgattcccagcacgccccagcccagcgggcgcagcagcctgcgttgccgccgcagcaggatggtcatgcgggcaggccggtcctgtatgcgctgatttttggaagaggatgcgcgccgttcgcgcgtctgggtcacgcgcgacatgttgcctgctccaccatccatcggcacagggagacgaagtccatccccatcagggctgcctgttccggcagcagggaggtcggcgtcagacctggctgggtgttgacctccagcagcaccagccgccccggctcggcgcgtgtatcgtcatagcggaaatccgaacgggtcgcgccccggcatcccagcgcatgatgcgcggccagagccacatccagcgcccgcttgaatgcatccgggtgcatctgggcgggcaggatatggcgggagccaccttcagcatatttggattcatagtcatagaaggcggagcgcggcctgatatccgtgaccgtcagggcgcgatcattcagcacacccacggtcagttcgcggccggggatatattcctcgaccagcgcctgtccgccgaagctccagctgcgggcaatttccgtgcgccggttatcgccttcatgcaggatatgcacgcccaccgccgagccttcattggccggcttgatcacgaaggggcgtggaagcggatcctgttccgccagttcctccaccgtgaccagcctgccttcggcaaccggtagaccagcggccagaaaggcggtgcgtgcggcggccttgtccatcgcaatggcggaagcgcgaaccccggaatgggtatagggaatgttgagccagtcgagcacaccctgaatggcgccatcctcgccgaaacggccatggagcgcgttgaacacgacatccggcgcgggcgtcagggcggcgatggtatcgcgcagatcagccccgacttcgatcggggtgacctcatagcctgcttcacgcagggcggcgacgacctgttgaccggagatgaggctgacggcccgttcttcggagatgccgccatacaggaccacaacgcgtctgatgctcatgactgacactccggatgatggaacggaattccgatccgtttgatttcccaatggagggtcgtgccacaactagcctgcacccgttgccggatttcttcgcccagcgcctccagatcggcggcggtggcttcgcccgtgttcagcaggaagttgcaatgcttttcactgacctgcgcaccgccgcggctcagaccgcggcagccggctgcgtcgatcagctcccacgctttttgtccgtccggattgcggaatgtggagccgccggtacgcgccctcaccggctgggcggcatcccgggcggcgcgtatatcctgcatgcgggcgatgatgtcggcggtattgcccggtcgggttcgcaggcgcgcccgtactacggcacagcccggtggcagcgcggcatggcgatatgacagcgacaggcgggacgcttccagccgggcgatgtcaccatccagcgccagttccacccagtccagcacggatgcgatgtcgctgccataagcgcctgcattcatggcgatggcgcccccaattgtgccgggaatgccgcacagaaattccagcccggccagacctgcctgcgctgcatgttcagccactgtcgcatccagtgctgccgcccctgcgatcatcccgtcgccatcggtggtgatctcgttgaaaccgcgtcccagtttgacggtaatccccggcagcccgccatcccggataatcaggttggaggccgcgccgatgatcgtcatcggcaccagattgctgacacgccgctgcagggtgcacagatcatccgtgtccgcgggacgaaacagggtttcagcctggccgcctacacggaaccaggtttgcggtgccaacggcgcagcatgcgtcacccgcccgcgcagggcggtgaagacgtccgggttctgctgcgccgaaacgatcatcctccgctccctgtcctgcggattttgctgctttttgcctgtaacgtggcgagttcctccggcagggtctgagcccatgcggtgatgttgcctgcgccgaggcagaccacgaaatcaccggggcgtgctatggcatggatcatctcggcaagatgctccggaccggggaggggtacaacacttttgtgcccgctggtgcgcaggccatcgaccagactgtcacgatccacaccctcaatcggagattcgcccgcattatagacatccgcaacgatgacggtaccagcatcattcatgcaggtacagaattcgttgaacagactggcaagacgggagtagcggtgcggctgtaccaccgcgatcacatcgcgggcaccggcctgccgggcggcccgtaacacggcagcaatttccaccgggtgatggccgtaatcgtcgatgattgtgatgccgccggtttccccggttttcgtaaagcgccgcttcacgcccttgaacgatgcaaacgcgctttgcagcacggaatcggaaatccccatttccactgcgacagcaatagcggccagcgtattggcgatattgtgctcgccgagcatgggcaggcgcagcggtggcgtgcggcgggtgcggcgtgtctgccggtcggtgatcacgacctcgaaagtcgcgccgaatttatcggtgttgatgcgctcggcccgcacatcggcctgcggcgagaacccgtatgtgatgatgcgatgatccgaaagctgggggatcattttctgcacagtcggatgatcgatacacagaaccgcaaagccgtagaacgggatattgctgacgaattgctggtatccggcctccatggcctcggcggtgccccaatggtccagatgttccgggtccatgttggtcaccacggcgatgacggcaggcagacgcagaaagctgccatcgctttcatcggcctcgaccaccatccattcacccgctccgagcctggtgttggtgccgtaggcattgatgatgccgccattgatgacggtaggatcaagctgggccgcttcaagcaccgcggcgatcagggaggtcgtggtggtcttgccatgggtgccgcccacggccactgcccatttcagccgcatcagctcggccagcatctcggcgcggcgtacgacagggatcagttttgcgcgggcggcggcgacttcgggattgtcacgcccgactgcggaggaaatcaccaccacctgagccgtgccgagattggcggcatcatggccgatcatcacctgaatgcctgcttcccgtagccgtcgcacattctggttgtcgctgatatcgcttccctgcacggcatagccaagattgtgcagcacttctgcgataccggacatgccgatgccgccgataccgacgaagtgaatcgtgccgatggtcagtggcagcgccctcatgacttaatctcccccttgaagtcgccctggggcgcacgggctgtatccagactctgttccaccgtgtcggccagccgtgccacggcgtcttgcataccaaggcgagccgcgttgcgggccgcatcggcaagggtgccgggttcggccagcagcccggcgatgcgggccgccagcgtatccggggtgaaatccggctgacggatcatccagccgccctgcgcatcaacgaggatgcgggcattggcggtctgatggtcatcaatagcccccggcagaggcaccatgatggccggtcgcccgattgtcgccagttcggcgacggtggaggctccagcccgggcgatcaccagatgcgcgtctgcgatcagggttgcgacatcggtgaaaaacggcgccagaatagcctcgattccgcaggccgcataggccatccgcacgcgatcgatatcttcggcacggcattgctgagtcacccgcatgcgctgccgcagagccgggggtagcagcgcgagagcggcaggtaccacatcgctcaacacgcgtgcaccgagtgacccgcccagtatcagcagattgatgaccccctccgtgccgggcggtgtgtaggacgtgcctgccagtgcggcgatggcgggccggaccggattgccggtcaccagagttctggtgcctgccggcacatggctggtgctggcgaagctgagcgccagacagtgtattttgcgggccagcaaccggttggcccgtccgagcacggcattctgttcatgcaggatgaccgggacgttgcgggcgcgcagcctggcccccagcacgggtggaatgcagggatagccaccgaaaccgacgatgcagccagcctccagcctgcgcagcaaggctccggctttcacaacgccgtgccccaatgcgatcacggcctgaccggcccgccggatgccgcgtccggcaatcccggcccccggcagcacgaagcgatccgtatcggcaaatacggtgctggtcagtccgccggagcgagcatcggtcatcaacacaatttgccgcccgcgccttttcagctcggcggccagcgcctcggccgggaagaaatgaccgcccgtaccgcctgcggcgatgatgatcgggcgctgtgcctgatcgcgcctcatgacacgtctccatgatggcgcgtgcgggtcagggccagcagcatgcccatcccgagcgaaatcgcgatcaccgaggagccgccataggaaacgaaaggcagcgtcatgcccttggtcgggatcagatgcagggtggaggccatgttgacgaaagcctgcaacccgaagctggtaaccagcccggcagaggcgagcacgatgaacagatcctgctcccgcatcagacgcagcaactgcctgatgacgatgaaggcaaaaatcagcacgatgatgctgcatagcaccatgccgaattcttcacccgccaccgcgaacacgaaatcggcatgggcatcgggaagctggtttttcacatagccttcgccggggccgcgccccagcaagccaccattgccaaacgcttccagcgccttgtccacctgatagctgtcgccggattgcggatgcagaaagcgctccacgcggctacgcacatgggggaataatgtgtaggcggccaagcctgccccggcaaagccgccgaccccgatcagcaccagcagcatgttcagccctgcaatgaaaagctgggcgaaaaacacggaggacagcaccgccagcatgccgatatccggctgtgatttcagcagcatggccatcaccagaaacagcccgaccgccaccagcgtgccgggaaaaccacggctgcgcttgccctccgcgatcagccatgcggccacgacagcaaaggaaggtttcaggaattcgctgggctgcaaggccatgccgggcagggcgatccagcgtcgggcccccttgatctccaccccatgcaccagtgtcatggcggtgagcaggatggcccctgcacaggccaccagtgccagcctgcggatattgcgcggggtcagcagtgaggtggccacaacagtcaccgatgcaagcgccagaaagatcacttgcttcaggatgaacatatcgcggttttcaccgatgcgttccgctacggcggggctggcggctagcatcatgacatagccgaatccgatcagcgtgctgacagccagcaatgtccagcgatcgaccgtccaccaccagcggcccaaaagggatgtgtcggtgcgggacaggctcggcatcagacgcctcccccgatctgctgctgcaccaggctgcggaaatgatcgccacgggcctcgaaatgcgcgaactggtcgaaactggcgcaggcaggggagagcagcacgatgttactgccactttccttcaccagtgcggcagccatggtgacggcgttgtccagcgtaccggcatcggtatgcggaacaccatgcgcccgcagcgtttcggccaatatcggcgcatcccgcccgatcagcagcgcatgcgtcacgcgcggcagcaagggggccagatcctcgatcccgccttccttggcgatgccgccggcaatccagaggatccgttcatggcagatcagggcgcgcgcggtagaatccgcattggtcgccttgctgtcattgatccacaggatgccatccgcctcggcaatgcgttcctgacggtggggcaagccggggaaactggcgacgcccgctgcaacctgctcacgcttcacacccagaaaaagcgtgattgccgccgctaccgccgcattctgcgcattatgcgcccccggcagcgcggcagcctgcaccatgggcaggattggtccctgcatgtcggtcagggtgccgaactgcatgccgtattctgcttgcgtatcgccgcagagcgcccctgaaaccagggctatgcgggcgggatgaccatctttccggagcgtttctgccatcgcggcggaaagcggatcgtcgatgccgatgacagcgagatcagccccggtctggcgctggaaaatctcccgtttggccgtttcataacccgccatatcgccatggcggtcgatatgatccgggctgagattgagcatggcggcggcatcgaagcgcagggtctgcaaccgttccagcatgtagctggacatctccagcacatagacgccgttatcaggcagcaggggcagcgccagcgcggcaggccccagattgccgccggctgcaaccgggcagcccgcttcccgcagaatatgcgcggtcagcgcggtggtggtggatttgccgttggtgccggtgatgccgacgaaacgggcgcgggatccgctcaggcgcacggcctgatacaacagctcggcatccgacagtaccggcacaccggccagcaacgctgctacggcgacagggtgtggtttcggcaggcgatgtggaatgccgggggacaggatcagcgcatccagcccctcgaccgaaaggggggagacagtcagtccggcattgccggcttcgctccgagcggcctcgccgtcatcccagacggtgacatctgcacccatcgccaccagcgcttgcgcggctggcagaccattccggccaagcccgagcacgccgtagcgcttgccgtgcagcagcctgtcggaaaagccgctcatcggattttcaacgtcgccagcccggccagagccaggatgaaggagacgatccagaagcggatcacgatggtggattcaggccagcctttcttctcgaaatgatgatgcagaggggccatcaggaacacgcgccgaccggtgcgcttgtaccagaacacctgcacgatgacggagatggtttccaccacgaacaggccgccgacaatggccagcacgatttcgtgtttggtggcgatggcgacacccccgagtgcgccacccagcgcaaggctgccggtatcgcccataaagacgcgggccggtggtgcattgaaccagagaaagcccagcccggcgccgatcagggcggagcagaatacggtcagctccccggtgcctgcgacctcgttcagttgcagataggtggcgaagacatgattgccgaccagataggcgatcagcgcaaatacaccggcggctatgatggtggggacaatggccagcccgtccagaccatcggtcagattgacggcgttggaggcccccatggcgaccagcatgccaaaaagcggaaaggcgaagccgagcggaatcagcacgtccttcagcagcggaatggccaatccggtggagagcggatcacgcgtcagcgacatgatccagatcgctgctatcagcccgatgacggcctgaccgatcagcttgacgcgaccgggcagccccttggtgttgcgcttgctgagcttcaggtaatcatccgcaaagccgatcccgccatagccgagggtcagcagcaggaccgcccagacatagccgttccgcaaatcggtccagagcagggtgctgatgccggtggcggcgaggatcagtacgcctcccatggtgggagtgccctttttctccagcagatggcgttccggtccgtcctcgcggatcggctgaccaccgcgctgcacgcttttcagccagcggatcagcgcggggccaagcagaaagctgacgatcagcgccgtcatacacgcagcgccggagcggaaggtgatgtagcggaacaggttgaacagaaagaactgctctgccagcggatgcgcgagatcatacagcatcagcgtgctccctcgcggatagaatgggtcagggcatccagcgctgccgtcacgatgcacatgcggctgccgaaggagcctttgaccagaatggtatcaccatcccggatagcggcgctcaccaccggggcgagggaggcagaatcggcttcatgcgcaccccgaacagaggcaggcagggcatcgaacaggtggcgcatcatgggtccgcaggtaaaggcaagatcggcacaggcggcgatgtcttgcgccagaccggcatgttcggcaaccgcctgatcgcccaattcgagaatatcgcccagaacgacgatgcgccggctggccggggtcagtctcagcacgtccagagcggcacgaatgctggcggaggaagcgttgtagctttcatccagtaacacggcctgaccgtcattgagggcaatggaacgcttcgcgccacgccctgccagcgcatggaaattttccagcgcagcggcagccgggtgcgggtcaaaccctgccgcatccacggcggagagggctgccagcgcattcatggccatatgacggcccggtgcgccgatggtgcaggacaggctttgcccccgcactacaatatcgagccgtgaactgtccgttgccgcttcgatctgttgcagtcggaccatgctgttggcgtcagtgccgaaggtcatcacgcgatgaggagcagcctgcgccatcaggcgcggcagcatcgggctgtcggcgggcatgatcgccacgccatccgctgccagcccggagaaaagagccgctttttcgtcggcgatggcctcgatactgccgaggtgaccgatatgggagcgttcgaccgtggtgatgatggcgacatgcgggcgggcaagggctgcgaggggtgcgatttctccggcatggttcatgccgatttcgaccacgcagctccgggcgctttccggcagtcgggcgagggtcagcggcacgccccaatgattgttgtaggaggcataggccgcatgtaccggcccgaatggagccagcgcggtgcgcaacatttccttggtcgtggtcttgccgacactgccggttacggcgaagacggtgccgtggaagcggtcgcgtgcaaagcggcccagcgcctgcaaggcactcatggtatcgttcaccagcaggcgtggtccgggaccgtcacgatgggctaaaacacctgccgcaccccgcgccagggccgcctcggcatggtcgtgtccatcgccattgtctccttgcagcgccacgaaaagatcggcaggctccagcgtgcgggtatcaatcgagacgccatgcgcatcgaagggcatggagaagcggccgccggttgcggccagcagggcctcacgggtccagagtgcgctcatgacgtcacctgagcggcgatagcgcgggcgaccgagacatcgtcgaaaggatgcaccgttttgccgatggtctggccctgctcatgccccttgcctgcaatggccaacacatcgccaggctgaaggctgcggatggcatgggcaatggcttcggcccggtcgccgatttcctcggcatcggggcaggcagcgagaatggcagcacgtattttcgccggattttccgagcgggggttgtcgtcggtcacgatcagacggtcggcatgggtgcgggccgcttcccccatcagcggtcttttgccgggatcgcgatctccgcccgccccaaacacgacatgcagctttccgctggtatgcggccgcaacgcatccagcagacgctccagagcgtcgggggtatgagcgtaatcgacatagatcgcagccccgttgggcagggtggcggcctgctccatccggccgcgcacgccggtcaggcgtgacagcagaggcacaatcccccttttgccgagcgaggcggcaatcgtggcggcggtgatgatgttgtctgcctgaaaacggcctggcagaggcacgttgatgcggtgtgtggtgccctcttcccggatggtcagatactgtcccccggcatgaggctcgatcgccagcagcggcagcggagagtctggcgaacccgcaatgatcagcctcaacccacgccgtctcgcaataccgcgcagcgcctccagcgtgatctgatcgagcgtgggggaggcaatggcaggcgcgccagcgggcagcagatcggcgaacaggcgcagcttggcggtgcggtaggcggcttcggtcccgtgataatccagatgatcgcgggtgaggttggtgaaagcggcagccgataaccggacgccatccagacggaactgatccagaccgtgagaggatgcttccagcgcggtatgctgaatcccggcccgtgccagcatggccagagtttgggccagtgtcaccggatcaggcgtggtcaggctgtcctgcgggtgaaagccttccgcgatcaggccgagtgtgccgaggctggcagcagaacgacccagcagagtccatatctgccgcagaaaatccgccgtactggttttcccgttggtgccggtgatggccgcgatggtgtgaggttgtgctccggccagccgtgccgccatcaaggcgagcaatcggcgcggttcagcatcctgaatcatcgggcggggcggaacgccgggcggccaggccgtgccggcgggtgccagaatggcggccgcgccgcgctccacggcatcggcgataaagcgtcttccatccgttttctggccgggcagagcggcaaagacccagccgggcataacctgacggctgtcggccgtaatcccgctgatatgaacgcccgccatgccggtcaggcttgtgaccggggctgcggaagtatctgccaggagattactcagcatcatcatgacccgccggtacgtcgaagcgtgcctgatggcgcagatccttgatatgctgctccctgagttgcctttctgtcggggttgagacctccggagaggcttgctcacgtgcgctgcgcttttcggcggccagagcggccttttcacgggcggcattggctttttcttcggcggaggacaccatggtgcgtcgtgcgcccgcagggacgccgggttgcagggggatgtccagactggcctgaatggcggcgcgtttgtcctccggtgcgggcatcaggcccagcatcggcccgatacgggcgatgacacgccccgcacccggcgcactgacctgcccggcggtggagtagccaccggtttccttggtgccgtgcggttcatcgagcatgaaatacaccgcatagcgcggcgcattcatcggaaacacgctcatgaaggcgctgacattggcgtgttttttataaccatgcgcaccgattttttccgccgtgccggttttgccgccgacgaaatacccaggtacgtccgcggccttgccgtatcctgcggtcaccaccagccgcatcagcttgcgcaaggtggccgaggtttccggtgccatgacgcgcgtgccgatggcttccccggccggagcatcttccggggctgccagaatggtcggttttaccagaattccgccattggccaatgtcgccgttccccgcacgacatgcagcggagagaccgcgatgccatggccgaaacccaccgtcatggtggtcagctctttccagcgggaggcgggcggaacaatcggcagacctgcttccggcaattcaatgccgatccgctggaacatacccatggcacggagccatgtgcgctgtttttccgcccctgccgtcatcgccatatgtgcggcaccgagattggaggagtacgccagcacttcgggaaaagccagcgcacgatgcttgcctttgaaatccgtgatcgtgaagcgaccgatacggatgttgttggccgcatcgaaataatcccacagatgggcagagccggtatccagcgccagcgcggcagtttgcagtttgaaggtcgatcccggttcgtacatgccggtgaccgcccggttgaatcgatcattggcctcggtctggccgaaggcgttggcatcgtaatcgggcaggctgaccatggcgatgacttcgccggtgcgcacatccatcacgattccgcacgcgccgatcgcggtgaaggtggtcatggcggactggagttcttcactcagcacggcctgcacgcgcacatcaatggacaggcgcagcggcgttgtgtccttgcgcagtcgatcatcgaaagcgcgttcgacgccggccaccccgtgttcatccacatcgaccccgcccagaatctgggccgccacgcgtcccagcggatagtgccgcttttccgaaggctggaaatagacaccgggaatgcccagcgcattcaccttcagcacatcgcggggtgtaatctggcgggcgatgtagacgaactgtttctggctggccagtcgtgccttcacgacgtcttcgtccagttgcggcagcacggtcttgagtttgtgagccgcttccgccgtgtcgatcatttcgcggggattggcgtatagctcggaagtcggcagagaaatcgccagaatctggttgttccggtctacaatggtcgcgcgctgcacaaaggcggtgggcgcgtcggatttatgctcgtcttcccctgatttataggcggtgtggaccgggatatgcggcagcatcggctggagtacggtcgcatctgccagcttcagcatgacggccgtgtaaagacccagaaatccgaaagcggcaaacagcaatcgcccccgcgtacggtccatcaaggcgcggcgcgcaagatcgggtgccgtgatgcgcactgtttcagatggcaggccggacggatcgggctgtacaaaacccaaccccgccggacggcggggggcagaatcgggtgggggtgcctgggtgccgaaatcgtcagtcatagggtcaatagccgcctcctaccggaaccggaggaggcaggctggagccccggttcatcccgagcgcggacgccatcagcggggcagcggatgcaaccggcgcggcacgggccacgaccagattgccggataaagcacccttggcctgatatccgccattgttacgcggtgtgccatgagcagcggtctgtaacagaaccggtttgggggcggcgatggcggaccgtgctgagggctgggcgggggatgagccaaagcctgtgccgacggaagccgttacggtacgcggcgtccgggtgtggttcgtggaagtcgacttcagtttcatgccatcatgcgatgcggctttgctggccgtatcctggttcgcctctctggtcaccgtgctgtccatatcgtccccggcataggcaggcgcggacagcgaagccatgccacgcggagcaatgccgctggcatccttatgtggctgggtatggcccggttctgccggttccatagtgttgcgggccatctgcggatgcggcgtccggtccagacgtgccatcggtacggctgtcggtgctacggtcgggccggacggcacctgcagatcgctctctggcggcagcaggtcaggcggtgtggcgggctggctgcccggcggcacaacggcaggcaagcgggcgttcagatcggcaagggaggcaaactgcgtcggcgcggtcggcttcaggttcagatagcgcgtggccagttcgttcaggcggtccggtgtgttcagcagtgcccattccgctttcagcgtgtcgatgcgcgcacgcacctggcgggtatcgcgctcgatctcggtgatctggcgatccagcatgcgggtgcgatgtttggtctgatacagatacaggccggagatactcgcggcgagcatgcagatgcaggtgatggggcgaatcatggcgtcgtctccctgcgcaggcattctattgcgcgcagccgggcgcttcggctgcgtggattggcgttctgctcggctgtgccgggacgcactgccttggatgtgatcaggcgaaaacgcggttcagtgcgggcaaccaggccacgtggatcgtaacgggaaggggaaggggcattgccagcggcatcgttcatgaaacgctttacaatacggtcctccagcgaatggaaggacacgatgaccagccgtccgcccggttgcagcaggttggttgcctgctgcaacgcccgttccagctcaccgagttcatcattcacggcaatccgaagcgcctgaaagctgcgggtcgccggatcaatgccggagcgatcaggcggcacgacgcaacggatgatggaggcaagacgaccagtggtcgtgatcggttcttctgcccgtgcactgacgatggcgcgcgcgatctggcgggatttacgttcctcacccagttcatacagaatattggcgatttctgcttccggcagacgtgcgatcagatctgccgcggacgtgccttcccctgccatccgcatatccagcgggccatcggtgcgaaaactgaaaccgcggtccggatcatcgatctggaaggaagaaacgccaatatccagcacgattccgtccagcgcgttgacaccccgatcggtcagcaggcttgccatctggctgaaattgccctggatcagatgcagcctgcctcgataccgtgcggccaacgcttcgccgcgggtaatggcggccgggtcacggtcgacggcccagaccgtgctgtcttccgccgtatcgagaatggcgcgggtatagccgccacctccgaacgtgccatccaggaacacgccgcccggagcaggagaaagggtttccagtacctcgttcaacagaaccgggacatgggttcccgtggaggaatggccgccggaatgccctgaaggagcggctgtacgtatgggaagggcgttcatgcggcccctccacgtggtgtgccgggcagggtcagcccgcgtgcgcgggcacgttcacgcgcttccgcccgacggcgctctgcggcggcaggctcccagatctggaaggtgcggcccagtcccatgaacacgacgctgtcggtcagcccggcatgggcggtcaggctgtcgagcaggatgatgcggccttccttgtcggcatcgaccgggaaggcatcggcataaagggctgccgcaagatcatcatgagtttcgctgaacatatccagttgatcgagcggggtcgcaagcgtctggaaaacgggcagtggccaggcctcgatgcagggatgggtgtgggaagggcgcaggatgatctgtccattgccttcgccgaatgcccttaaggccgcacggaagggggcagggacggaaactcgtcccttggcgtccaacctgttctggtgggtgccaagaaagtggctcatccgcccaggaaccgcccctcgttgatgcgcacccgaaccggaccgggcgtgcaaggtttgttgtcacaaagcaccatcccctgaccgaatgtctgaggtggcgaccgtcttacggatgctgatgcccccgtccccatcactgcgggccccccgccttttctgggatgtcatgggttaccatgggataatatgggcgtcaaaagatattctgcgccaaaaccatggtgatgggcttaaattcttattattttccagtttcttagcgatatctccggacgcagggggccatccttgccccggccttcacggctttgtgcgaaacagagagggcctgttcggctcaaaagacggcaatcgattcaacgcgccgcccatagcgatgtggaaaagaagcgccagacggcctgtaagccgggttctgtccacccgtttccaaagaagcggatgagacggccattcctctgggacgtacatcgctgcacgcctcacgcgaccaacccgggcagcggagcgggaatgctcctgcgccggcccatgaaatcccatgaccttgcggtcctgagcacacgggcctcgctggccgcccctattcggtcttgctcccggtggggtttgccctgccacccccgttgccgggggcgcggtgcgcttttaccgcaccgtttcacccatgcccttcggatcatgccgaagcatggtggaagggcggtttgttttctgtggcactatccctggggtcgcccccgccggccgttagccggcaccgtattcccgtggagcccggactttcctccaacccctctgcccgaaagcgggagggtcagcggccgtccgaccgtctggcagggggtaggtcgcgcagcggacaggttctgtcaaccgtgcgatgtcgcacggtctgccatttcgtacgcatgggcgacggttgccagacgggcgagggtcgccgcatccgcgcttccatcgggccggtcaggcaggaaacgtcgttgaaaggcgcgtaataccatgtccagcggaagatcggtccggtagccgatgcggcgcagaaaatcccatggatcgttctcctgcttcggcctgtccttcaccggagttgcatcgggccagacgccgatcccgtgctgcgccagccagcgccagtcgaacaactcgcctggatcctgtttgcgatccggcgcgatatcgctatgggctacgatgtgggcggcgggaatggaatgctgcctgacaatggcatgcgccagcgccaggaccgagcgcatctgggcctcggggaaagcgcgatacccccattcatggccgggattgacgatctcgatgccgaccgaaaaatcattcagccatgatcgcccccgccagtgggaaataccggcatgccaggcccggtactgttcccacacgagtcgccagacagtgccgtcttcttcgaccacatagtgggaagagactcgcgcctccggatcgcacagccggtcgatcgctgccgctgcgctggtcatgccggtataatgcaggaccagcatatcgaccgctcccggtgttccagccgtggcagagggtcttgcatcgtaattggggcttggccgttcccggatgggtggcatggggaaaggttccaccggcatgtttacaatcctcgctcccgcttgatccggtcccatgccgcattgacgacggccgcctgatcggaggctgcctcgatctctgccggtgtagcaccgcgtgcagccatgctgtcggggtgaagatcccgcatcagcgtcttccaacgctgccgcagcgtcgtatcatccgcaccgcggctggttcccagtaccgtataggggtccggctcatccggggcggggcgggctgctcgggctgcgtccggatcgcgggcacgctcccacgcaatgtcattcaggcgaaaacccttcctgacacgcagcagaaatgtattctcagcctgattgatcggcccgtcagaccgggcaatggcaaaaagggctgacagcgtgtcttccagacggccctgatcatccgcaaagctttcccccagttggtcagcgtagaaagcaaaggattcgccactgtcacgggcctgatcgaacagatgaccgacctgtttcacagcttccggcgggatacggaacaattgcctgaatgtgtcgatttccacacgtttcaccggcccgtctgcccgggccagcttggccgacagcacgatgatggaaagtgcgtaaagctgttccttctgtccgagcagggccgcaatgcgggccggtccctgtgtggaaagaccacccagcacttgaccgaaaggcagtttgaaaccgtttatcccctctttgaactgccctgctcccggcaggatgcccttatcggctgcgtggccgagcgccgcccccatcatggcaccgaacggaccgcctactgcgaaaccggccacactgccgaggattttaccccaataactcacgtgattccgtccaaggtttcaaccggtggtgctgtgacgggagcatgtcatcagctgattgagtcgccatacagtcatgagcatgacgtcgtatggccaggcgagccagtccctcagccaccatttccattcgccggaggcgcggaaatcgggggcgatcccggcgcttgcggcaatcccggccagccggagcagcgtcacgcaacgccccatatggtagcgtgaggtcgccacgaaaaccggagcatgacacgcaccatcctcccgcaacaaggctgcgacggcttttgcggaggaaagcgtatccgtgccggtcggttccatcagaatcgcggcatccgacacgccgagcgtcagcagaagacgacgcatgatttccgcttcggcaggcccatgacggcctacgccgcctgttggcatgaacagaacgtccggtatcgtctgccccagcgcatgagccgcctctaccctgcgccggagcgtcgggcttggaatgccgcccggatgcacagcggcaccgaagatgacgatgcagggacgctggccgggccggggagaaggatgggtcatgcccggcctgatcagtccggtgcccgcagaaggaggcggttggcacgttccagagcgttaaaggtggtgctccagacccggtcaaaggcctcgccggagaagcggctgcccagcatatcgcggacatccccaacgctgtgtgcgccgtcgatcagcttgagaattgaagctgcctgtggcggcagggccagcggcacggtcagcccgtcaaaggtcaaaggcagcacaccatccggtctgatggcccgggccagctcggggacgggcatttcacgcgcaatcggaatggctgccgggtcgagcggatcggcgcgggctggaacctcccctttgcgaacgcagtagaccacatgcgtgctcatgtttccggccaggttttctgccagagccgctttttccagcggagtcatgtcggccattctcgcccgaagtttcgggtccggcagccagacggagggatcgtaccgaagcggctccatccaggcgcggacttccagaccggcgtcatccagcagggcgtgcaggactggcaccgtgtaggcgcgatcgcgcgggttgagcagcagatcgtacagcccggcatcaccgccctcgaaatggtcaccgaaatacagattgcggcgtagccatgccgtctccggcagatggcgcatgacccgttttgcgacatccagacgctggcgaggctcttcctccggcgaggcgaggctgcggagggcatcctgaagcatatagaccccggttcggccatgcggggcataaaccatcagccccatcccgcccccgggggcaaggaccgaggtcagggcgcgcaatccttcagcggggtccggcaggtgatgcagcaccccgcagcaatcaatgtaatcgaaaggaccaggggcgacggctggcagatcaaggatcgagccagccctgaaatcgaccgtcagattgcgtacctccgcccgcgcctgcgcggtctggagggcggcccgggaacgatcgagataggtcacgccaccgggtcgcccgtcacgcgccagatgtgtcgccagcatgatcgtgccgtctccggtgccgcccccggccaccaatgcgcgcagccctgcggagcggggacggttggccccgaacacccagtaatcaatttctttcagatggctcgggctgccgatgatcaggcgtttggcctcgtcccgcggatcgcgttgcggatagggaaaagcttcgtactgatcggccagatggcggtcggtgctgtcattcatgcatgtggcatagcctgtctgaagccaaccttgcagggggctgttggagcataccgcatcctgttatcgggacttgcatcgcaggctgcaacgccgcaaagcctgactggatgacagcatgggagcaagcgggcgtatgacggcactgtcttcgcgggggtatttcggcatcggagtggagggtatttcaaaatccgccaatgtcggcgcgttattgcgcaccgcgcacgccttcggagcgcatttttgcttttccattgctgccggatttgatgcgcgggctggcagaagtgcggatactgccgatacgcctgctcatgtgccgttttaccgcttcgattctgtcgagacggtggtgctgcccaaaaactgcgcgctggtgggggtggaaatcaccgatgatgcgtccctgctgcccagttttcgccatccggccaatgccgcttatgtgctggggcctgagcggtccagcctctctcctgcgctgctggaacgttgtacgcatgtggtgcggataccgacgcggttttcgctcaacctgtcggtggcgggagccttggtgttgtatgaccgcttgctccagcatgggcgttatgccgagcgtccggtgatggcaggtggagcagcacagcctgccggaccacgcggcggtcatggcagtccggtttttcggcgtaccgtgcctgagtggatgaaaaacaccgataagacataatttggggttcctgacgggatccgggcctgctcacctgcgagggtgcattgagcacgcaacgcttgctccgccggagcgggttccgtatctacctgcaatgtcccgcgttttaccctgtctgaccgtccttattttggctgttgccggctggatgcctgccgtttcggcagcatcgcatcgccatggcgcgaaggcgcgggccgatggtgcgcatgtgctggggcgtttcgatgactggacggctgccacacatatcgaagccggggaaacggtttgctacgcctttacctacgcccatacttccgatccaaaattgtcggggcgttcccgtgtcgtactgaccgtgactgaacgggcgaaggaccgcgatgccgtcgcgatcagcgccggatatgcttatccccccaatgccacagtgcatgtgacggtggatgggcatgtgacagtggatgggacagccttcgatttctataccgcccagcgatccgcctttgcgcgtcaaggcaacgaggcggtggcggcattccgtaatggcaggcaggccgtggcgcgtggtcccggtccccgtcaacagacggaggttgccgacacgttcagtctgcgcggtttttccgctgcttacgccactattctgaaagcctgtccgtcatcatgacctccgcttcccaggctgctcctgtcgcccttcctgtgatgccggatgcggaagatgcccgcatcatggcgaaggctgccctgttcgctccgccgccatccgtcatggaggacgggcgcaaggatctggtcggtctgtcgcgggagcaattgacggaagcactggcggagatcggttttccggcttttcgggccaagcagctctggcactggatctatcatcgcggtgagaccgatttccgggtcatgtccagcatcgccaagccccagcaggagacactggccgagcgtttcgtcatcagccgcccggcggtcaccgagtgtctgaccagcgtggatgagacccgcaaatggctgttccgtttccgcgacgggcaggaagcggagacggtttacatccccgatccggtcgaggaccgtggggcggtgtgcatttcctcgcaggtgggttgcacgctgtcctgccgcttctgtcataccggcacgcagcctctggtgcgtaatctcggcccggcggaaattgtcggtcagttcatggccgcccgtgatgcctacggtgagtggcccagcccgaaaggggagacgccgcggctgctatccaccatcgtgttgatgggcatgggcgagccgctctataattacgaaaacgtgaagcaggcgatgcgcatcgtgatggatggcgacggcatcgccctgtcacgccgccgtatcactttgtctaccagcggtgtggtgccgatgatggatcgctgcgggaccgaactggcggttaatctggccatttccctgcacgccgttactgatgaattgcgggacgaactggtgcccctgaatcgtaaatatccgatcagggagctgattgccgcctgtcgccgttatccggctgcgagtaatgcgcgccgtatcacctttgaatacatcatgctggatggcatcaatgacagtgaggccgaagcacgcgagctggtgcgtctgatcgcgggcattcccgcgaaggtgaatttgatccccttcaacccatggccgggcagccagtatacgccgagccgtccgaaagcgttggaacgattctcccggatcgtgatggaggcgggctttgcttcccccattcgcacaccgcgtggccgggatattctggccgcctgcgggcagttgcggacggaaagcaggaaagagcgccggatcgactgatgacttgcccgtgccgacccctgtaaaataaaataataaaaacgaaacaataaagctggggaagaaagccgatcatggagcagcccgttatcctgagcgcggcccggaccgccattggccgcttcgggggcggcctgtcctctgttcccgcccatcaactggggtcggttgcgatcaaggcggcgctggaacgctgtggcgtggcgccggaggatgtggaggaagtcattctcgggcaggtgctgacggcggggcaggggcagaatcctgcgcgtcaggcggcgatcgctgccggtattccggttgaacataccgcctttggtgtcaatcaggtctgtggctccggcttgcgggcggtgatgctggcagcgcagcaggtcatgactggccatgcccgactgatggtggcgggtggtcaggaaaacatgagtctggcccctcacatcgcccatctgcggaacggaacccggttcggtgacattcagcttgtcgatacgatgatacgggacggtctgtgggatgtgttcaacggctatcacatgggcatcacggcggagaacgtagcatcggcccacgggatcagccgtgagaggcaggatctctttgctctggaaagtcatggccgggcgacccgggccatgcaggccggtgttttcagggaggaaatcgccagcgtgttcctgcccggtcgtcacggcacggtagaagtcaacgaagatgaacatatccgccctgataccacgctggaggccctggcggccttgcggcccggcttttccgaaaccggcaccgtgacggcaggcaatgccagcggcatcaatgacggcgctgcggcgctggtgattgccagtgcggtggaggcgtcccgccggggattgctgccgctggcgcggattgtctcctttgcctccgcgggggttgatccggccatgatggggctgggaccggttcctgccagccgcaaggcgcttgcgctggccggatggcgggtcgccgatctggatctgatcgaggggaacgaagcctttgccgcgcaggcctgtgccgtcaacgccctgatggggtgggataccgcccgggtcaatgtgaatggaggctccatcgcgctcgggcatccgatcggggcatccggtgcccgtgtgctggtgacgttgctgcatgaaatgcagcgccgtcaggttcggcgaggtctcgccacactctgcatcggcggcggcatgggtgtggccatgtgcatcgagagactccatagctgaagcagaagcagggtggacagaaagcgatcattcgttgaatctccccctccctgttcggcggcctgttttctggcaggccgggaatctgtcaaaagattcatttctctggccccgtcagtgacatttcttcactttcttttgtgaagaacgtgacggaaggtgctcatgcttcaggaaaatcctgttgcgcaccattgagagatcagttcagccgaataccttttccgtaagggagaacgatgctcgacctgccacatatcctgctcgccatttccggacttcttattgttgtcagtgcaattcagccattggcgcggcatctggtgatttcagatgcggtgctgctggccgtggttggggtggcgatcggtgtgggagcgacggtggtgatgaaaatcgatcatcatactccgcttgatcacgtggcgagcacgttgctggcaattcctgtcgacagtgaggccttcctgttcgtgtttctgccgctgctggtgtttcatggcggtctgtcgattgatgtgcgcggcatggtgcatgatgcggcaccgatcctgctgctggccgtggtggccgtgtttctgaccacggcagcaatcggatttgcgctttgtccttttgcgcctgtgccgctgatcgtgtgcctgatggtgggcgccatcgtggcgacgaccgatcccagcgcggtggtcggtgttttccgggagatcggggcggatgcgcggctgacccggctggtggaaggggaggcgctgctgaatgatgcggccgcgatttccctgttcaccatgctgatgaccactctggtcaggcatcaggtgccgtcggtcatgggggctgccgccaatttcgtactggccttcatgggtggcctgctggtgggatacggctttgcccgcatcatgttggccgcaattccgcgactgaacgggatcatcgccgcagaggtgacattaactctggcgctgccctatctggcctatatcgtcggcgacgaatttctgcatgtgtccggggtggtggcggcctccgtggccgggttgaccgtcagttccatcggtccctcgaccttccgtccgcagagctggtcctttttgcaggatatctggaaacagatcagtttctgggccagttccatggtgtttatcctcgcttcgatgctggtccctcgcctgatgatcggggtgacccgatcggatctgctgctggtggctatcgtggtggcggccgccatggcggcacgggcgctggtgttgtttggattgctgccggctttggccacgttgaaactatcccagcgtgtaccggccaaatttcaggtcacgatcctgtggggtggtctgcggggtgccatcacactggcgctggcgctgtccgtgaccgagaactccttcatttctactgatgtgaagcggatggttgccattctggctaccagctttgccctgatcaccttgctggtgaatggcaccacgctccgttatctggtgacatggctcgggctggatcggctgtctccggtcgatcaggcgctgcgtaatcaggtggtcgccatcggtcttcaggatgtgcgggatgcgatcgaggaacgcgggcaggagtatggtttttctccgcaatctgttgatcacgtgctgcggatctataatcgccgcattgccgaggaaacggcagccaacaccttcgacaccgccattaccgaccgggagcgcgtgttgattggtctgttgaccttcgccagtcaggaaaaagccaccttgctggagatgttcaaggatcgcgcgatttcccgtcatgtgatggaaaacctgctgcgtgcggcagaaagcatggtggacggggtccgttccgatgggcgcctcggttatatccgcgccgcccggcggcggctgcgcccgaccctgaaattcagggtcgcccagtggatgcacaagcatctgcgcatcaataagccgctgatgtaccgtatgatggagcggtatgaaattctgctgctcagctatctggtgtatctcaccatgatgcgctttatgaagcggcggatggagccggtgctgggtgagcgcgtggccgagatcgtgtccgagattgtcggtcgccggcgggaattgctgtccgaggcgcttgatacgctgcgtgtgcagtatcccggctatgcggaggcgctggagacccgcatgttgcggcagatcgccctgcgtcttgaagccaatgaatatgccgaactgcaccgggaatccctgatcggcgaggagctgtatgaggaattacagcgcgatctcgaagcgcggcgtgatcggctggcccagcctctgcgctttaatctccagacggggatggataaccgcatccgcgaattccccctgctgaatgaattgcagcctgctgtgctgcatgacctgtcgatgaatttcagcatgcgttttccagtgccgggagaggcggtgttcaagcgtggagcggttgcccgatccgtgttcttcatcagctccggcacggtggagctggttgatggcaatcatgtcatcacgctcggagcaggtgatttcttcggtgaggatgaggtgctgaaaggcggtcgtcggcatgccacggcgcgttcacgcagtttcggccagttgctggagctgaaggccgatgtattccgtgatctggtggcggagcagcctgatctgcaatccctcatcgaacgtattgtctcctcccgtcatcctcgttctatagtggaggagcctcagctcgttgaagaaaaagccaggcatgatgtcaccgggcgccctttgatcagctttgatcgcaagcggctgggggagaaagggcagccggcgaaggcttcggccccttatcctgcggctgaatagggtggaggcttgataatgtctgccgcgcctgggctttcgcgtgacggcagcagatgattcccgttaggcttctggctatcgagaatggacatcatcaataatagcctcggaagaaggctggttgggggaagtatggcaagagtggcgctcgtaacaggcggtacccggggcatcggtgcgtctatcagcaaggcccttcaggcacagggtcatcgtgtttttgcgaattatcttcataatgatgtggcggcactcgattttgcggaggaaaccggaatcgagaccatccgctttgatgtggccgattacagtgcctgcgaggccgccattgctgagatcggcgcaagggcgggtcgggtggaaattctggtgaacaatgccgggatcacaagggatggcaccatggcccgtatgacgagggatatgtgggattcggtgctggataccaatctcggggcctgtttcaacctctgcaaactgacttttcccggcatgagggagggaggattcggccggatcgtgaatatcggcagcattaacggtcaggcggggcagtatggccaggtcaactatgcggccgcaaaatccggcattcatggttttacgaaggcgctggctcaggagggtgcgcgctatggcatcacggtcaatgccatcgcaccgggttatgtcgatacagagatggtccgtgctgttcctgccgatgtgttggagaagatcatagcccgtatcccggtcggccggctcgggcgggcggaggatgtggcccgtggcgtatgcttcctgaccgacgagacagcagatttcatcactggctccaccctgtccatcaatggcggtcagcacatgtattgatgatagcaatgcagccagaaagaaatattttgcaacaaaatagaaatatacataaataaacaagaaacaataaataatagttttatataaaaagaaatcttcttgaaactgacatagaagatttctgctcctgtttctaaaccccgcccgatcatctgattgagatgatggaagcaggggtcttctttaatggttttttctattgcgatgcgtcgtgccttgctggcaggcgtcgccactgcctgtatgtcggcgcctgcgatggcgcaggctcaggattcttccggccgtattcaggagctggaacgccagatccgcgctgtccagatgcagcaggcgcgtcagatacagcaattgcaggctgaattgcgccatatgcgtacgcaggtggcaatccatgcccagaaggtcgaagttgctcatcagcgggctattgctgccgccacgcaggctcatgcggaggcccagaaggcgcatcaggaggcgctcgtcgttcatcacgatgccgagcacattaccgatgctttctccagattgccgcctccgccgcaggggtcgccgattggtggtccggccttcacgcaggttgaaaaaggcgcccctggggtccgtgtcgggtttgagcgtggccgtcccactctgtcggccattgacggtcgttacgccttcgccgtcggtctggcgctgcattacgatatgggcgggtatatcatgcccgatccagcccccggcacgcgcccggcggtgacacgtctgacctcattcggtaccaatctgcgccgtgggcgtatccctttcatgttccggtatggaaacgtaaccgccaatatcacgccggaattcggcagctcggtggatggtgcagcagggctttatgaagccaacctgaattattccggtattcagccctttgtgttcacgttgggttacttccagccgcgggtgacgctggaagattccaccagctccaacgaattcctgttcctggagcgcccgtctattgttgatatagcccgtaatattgctgccggtgatgcgcgtgcgacggcgggtggcaaagccaatggcaagcgttggtatgctgcactgtatggcacgggttcgagctatggctcccagatgaccgaaaccctcagcggcaaccagacgggtggtgtcgtgcgtgtggcaacccggccgatcgccgccaaagatgttgatatgcatgtcggcttttcggccagcaaggcgttcaaccttgatgatgtgaatggcaacacgacgcttcgtctgcgtgatcgaccggaagtccgtattgccaatatccgcttgatcgacacgggtagtctgtccgcgaccagtgcttatgaatacggacctgaatttggtttccgctataaaaacctgctgatccagggtgaatggattgcaatcggagtggatcagaaaccttcaggtactctgccgagaccgtcgcttggctttggcggtggttatgcctcgatcagctatgtgctgacgggtgaggtgcggcagtacgatcccagtgcagcggccttccgtggccccagcccggtgcataattttgatccgtcgcatgggcattggggcgcgttcgaactggttgcacgctacagcattgccgatctcaacagcaatgtgacgccggggattgcggcttccgtcacgggcggtacctatggtgggcgtcaggcggtgtttgcggcaggtgtcaattggtatctgaaccggcatttccgcttcatgcttgattataactacattgatgttgatcggatgaactccgcgggcaaggttcagatcggccagaccctgcattcaatcgtcggacgggcacaggctgcgttctgacacgatcggcaatgttctgctgatgaacccggatgtctgtgcatccgggtttttccggtatcagcccggttgccaaccgggtggggcaagttcgaagccctcaaaccggaaagcaggggctacgatgcagctgaccagagtccagcttccgagactttccgccgcctgccatgcatgcggcctgaccacaccctgaagcgtttcgccttgactgagataaggcccgatccgcaagcgtgtggtggatgtcccatcctctgacagatgcagatgaagcggcgcaccagcctgccatatccatagctccgatgcgtccaccctgtgccagtggctgcgttgcccggcagccagcaggaacaggatcgcggttccggcttctctctctgccggtcctgacgctgcggcacgccaggtttcgcggtaaaaaccgccttccggatgaggggtaagaccaagatgcgagatcactgtcccggccgggagggaagtgtcgcgcagatcaatcccgggcagaatgttgccggtcacgcgggctttggcacgctgcgggcaagggctggttcctgagaaatggtctcgaaccattgggcgaggcgcggatggtctgaacgccagtcctcatggctgaaacgcagatcgagatatcccagtgcgcaggcgaccgagatgctgccgatatccagtaaggtatgggggagcgcggtttccagaaaatccagcccgcgcagcacggcctgacgctgccgttcaatgacggcatcacgggcttcctctccggggcgggtttcctcgccacgccgcaggactgcagcatccatgataccatctgccagcgcctgttgccgcaggacaacccaccgcgccgggctttccggacggggaaacagcttcatgccgccatccgggatgctgtccagatactcgcagatcaccgggctgtcatagatcgccaacccgtcactggtcagcagggtgggtatcttggacaggggattggcggccagcagttcaggcggtgaggcatgggggctggttgggatcagagtgatttgctgatcaatttcgcgcgcgatcgcacaggcgatgactttgcgtgcgaacgggctgagtgtggaatagaacagtttcacgaggccgcactttcaatgaaataaagatcagaaccggtctttcatctgcctcaactcaccaagggcatgggggtttgaggcccggagaaacgggttggtcgccagttcctgcgccagagtaacgggcagggatggctgccctgacgccctcatccgtgtgacatcggcggttcgtcgctgcaagactgcgttgtccggatcgacatgcagggcaaaacgggcattggcggacgtatattcgtggccacatgctatcagcgtatcggctggtagagtagcgattttacgcaggctcttgaacatgtcctctggcgtgccttcgaacaagcggccgcatcccaggctgaacagggtatcgccgcagaacagaaacggtccctgcggcataaaataggagatatgcccccgtgtgtggccgggcgtgttgatcacctggaattcggccagcgttccgaagggcagcctgtcgccctcatgcagggcatgatccagccggggcagcctgtctgcatctgcggcggccccggcgatcagggccccggtccgctcccgcagggctgcggcggcggcaatatgatcatcatggtgatgggtcagcaggatcagagccagatgtccgccactctggcgaagtgcttccagtgcgggctgttcctcgcagggatcaatgatcgcgcggagatcgctttccgtgtcgctgaccagccacgcatagttgtcggtgcgcatgggaacaggatggagtgccagtgtcatggtgttagtgtaccatggctgggaggctgcggaaatacacaggccatacacatgggcaaagccatgtctgtagcagggcctgtggcagatggggtttgtgaaccggatgcgtcggatggaaaaactacccgacatgcagcaggccgccgcgttctatggcactctggcgggggaggtcgtggccagtctgctgcgtgcaagactgcgtctgttatggccgggcgaagaatgcgagggccagaccttgctgggtctgggccatgccgccccctacatgcgatgctggcgcagcacggcgtatcgctgtgttgtcgggtctttgcatccttctgccggccaggtctggccccctgccggtcgcacactcagttgtgatgcgactccatcggcattaccgtttccggatctcagtatcgaccgcatcgtgctggttcatgcgctggagatgacggatcacgcacgcgctctgctgcgggaggtatggcgtatcctgaaagatgacggacggctgatggtggttgcaccgaaccggaccgggttatgggcgcatctggataccaatccgttcgggcaagggcagccattttctcacggccagatcgagcgtctgctggctgcttccctgttccgggtggagcgaagggatgccgcgctgtatatgcctcccgtgtttcatagccgtgcgcttctgcgtgctgcatggctgtttgaatcgaccggccgccatctgatacccgggcttgcaggcgttacgatcagtgaggccgtcaaggatgtgtatgcgggtgtgccgctgcgcccgaccatccgcaagcggttgatggtacaggatgcggcggagcatctggtatcacagaaggcatttacacctgtttctcacccctctacgacttctgattgtggggtagcatccccggatcgatcatcagtcggaaactcatgataacgcgccctatcggatctaccccggcttcgtgcgcaggagatatcgttttgcggcgtgcccggattttgaccgtgtccctgctggttccagctttgctcgggctgaacgcctgcggttcatccaacagtcatcccgctccatcgccgcttgctgccgccacgtcattggatgcctatgatggtagctacactggcagccgtacaatctccgcggtgaaaggcagccgggccaaatgcgggcaggatttcgatcaggcggccatcagggtcacccatggcatggccattctgcgcttcatcgcgcaccggcatcctgtcgtattccgcactcctgtcgcgccggatggcacgttcatgtctaccttcaagggaaataccctggacggtcattttaccggagacagttttgagggggttgttgatacgcgggcttgcacctatcaggtgcaggcaaagcgggatgaggctgttcgctgaaataatgatctgcttttgcttgaaacagggcctcggcatgaatccataaggccctgcgatagaacggagatcgtccggtcttgcgctgtgctgtctcggtcaaggctgaatggcattgccaatcttcagctgtgttgtatagtccacagactatcaaccaatgcgacagagctgcctttaggttccatgctgaagcaggtcgatgaattgattttaatgtcatttatactggcgatatctttagcagtatgaaaagattaaagtaatcaaaacttacaatttactttgggcatattaggttaattatttttaatatctcaagccagcggcgagatctgacatttgaccgacatctcttcttcttctgcacaggacgcttctgcatctgttcctgtttcgcatattccagcctcctcgaccgaatctgccccgacacagcagcctgctcctgagatcaaatcaccttatcctgcagtggctgatattccgacgcaggaagggccgcgcggtattcgttatgatttcaatctcggagcacgggtgtcactccctgaacgtcaggagaagccgttcattgtctgtctgagggatattgataccgggaacatcctgttcctgtcctctgggcctgcgacattcatcaattcggcaaagcggtttttcgtccgcttccggatcgagatatgggactctcccgatggcggtccggccagtgggaaggagccgttttttgtgcatgattacgatgcacggggccgtgatatcctggtccagtttccggtcggcacgctcggcgatatcatggcgtggtttccctatgctgcccgctttgccgagaagcatggctgcaagctgacctgcgccctgtcggaactcatcattccggttctggaaaaagcctacccgcatatcaccttcgtcacgcatgacgagatgaaggaaaagaagctggcggagacattctacgccacatattcgctgggtctgttcttcgatgatgtcgactgtgcctggcagccgactgatttccgctttgtaggactgcatcgaacggcgggctatattcttggtgtggatccggaagaggaagcacctcgtctggcgctgccggatgaaagccgcccgattccggagccctatgtctgtattgctgtccagagttcgacccagtcgaaatactggaataatccgaccggctggcgcagcgtcatcgctgagttaaagcgggctggctaccgcgtgatctgtatcgaccagaaagccgttcatggagtgggtctggtctggaatcatattcccaacggtgcggaagacgaaaccggcaatcgcccgctgacggagcgcgcccgctggctgcgtcacgcggatttcttcgtcggtctgagttccggcctgtcctggctggcctgggcagccggaacgccagtggtcatgatcagcggctttacccacccgaccaatgagtttcacacgccttaccgtgttcacaactggcatacctgcaacagttgctggaacgatgccagtattcgctttgatcatcacgattttatgtggtgccctcgccagaaggacacaccgcgtcaattcgaatgtacccggctgatttccgcggattatgtgattgataagatccgcacgatcccggcttttcagaagcagctggcgcggatggaagccagcgcagtggtcaaaaagaatgaaacagcctcccatccgaaaaaacttcagaaagcctgaagcattggctgactgctcattccgctcatcccggcagaactcgcggatgggcggaattatttcttcaagacgctggttttaccgccgagcctgaaaaaagctgcgcagcaaagcgactgcttctgtctctcgcacgccgccgatgatttccggctggtgatggcaggaggaagcattgagcactctggcaccatgctcgatgccgcccccttttggatcgtacgcgccgaaaatgatcctgcggatgcggaaatggctggccgcctgtgcacacatcgggcaaggctccagcgtcacgtagagatcacagcctatcaagcgtgttgagccgagtcgttttgcagcttcacgcatggcaagcatttcggcatgcgcactggcgtcatgattggcctccgtcagattatgcgcctgcgccagcagatatccttccgggctgatcaccacggcaccgaccggcacctccgccgcggccgcggcgagacgggcctgttttagagcacgttccatggcctcacccggaccggggcgaaacaggaaagggggacagttttcctgcatgctcagcgcattgtgccgtatatgccgcgtataacgtgtttcatccgccgccaatccgctttagctagagaccatgaacaatacgactcgtcccctgattggcgtaactctggataccgagcaacctggcgggtattcgaaatatgactggtacgccttgcgtgcaaattatgccggcgcggtcattgcggctggcggtttgccggtggcattgccccatgatccggtactggctgaagcctatctggagcggatcgacggtctggtggtgacgggcggtgcttttgatgtcgatccggcgctgtatggcgacggtgcaatgcatgagaccgttactctcaaggaatcccgcacggcctctgaactggccctgacacgaggggcattggcgcggaatatgccggtgctcggcatttgtggggggcagcaattgctggctgtggcgctgggtggcaccctgattcagcacattcccgatagcattgaaaacgccctggagcatgagcaacccaacccgcggcatcagccggggcatgaggtcacaatcctgcccggcactctgttgcacaggattgtgggggcagagcagatgcaggtaaattccgcccatcatcaggcggttcgcgcgccggggcctcatgcacgtaccaacgccgttgccccggatggggtggtcgaggggattgaggatatgcgttatcgcttctgtctcggcctgcaatggcatcccgaatttctgatcgaccccggtgacacccgtatttttgcggccttcatcacggcctgcgcatcatgacggaggagcggatggaagatgctgattcagggacgccgcgtggtgagcgcattgcgaaatggctggcacgggcgggcgtggccagccgccgtgacgcggaaaagctggtggaagatggtcgggtccgcctgaataaccaggtggtaacccatcccgcgacatttgtggggtcgggcgatctggtcaccgtcaatggcgctttggtggaggcgccggatcgcacgcggctgtggcgctatcacaagactgatggagtgatgactacccatcgcgatccgcagggccgcccgaccgtgttcgagaagctgccttcgagcatgccgcgtgtggtgagtgtgggacggcttgatctcaacagcgagggtctgttgctcctcaccaatgatggcatgctggctcgcaggctggaactgccgcagaccggttggatcagacgctatcgcgtgcgggtgcatggtgatgtgacgcaggcgatgctggatagtctggcgcgtggcgtcaccgtggaaggtgtccgttatggctcgatcgaagccgggctggacagcagcaagggcagcaattcctggctgactgtttccctgaaggaggggaagaaccgtgaaattcgtaaggtcatgcggcatatcgggctgcatgtgacgcggctgatccgtatcgcttacggcccgttccagcttggtcagcttggcaaaggcgaggtggaggaagtaaccggaaaggtgctgcgtgagcagcttccccgcgattaaggcgccgtcatgaggatcgttgccgggcaatggcgaggccgggcgttgattgtcccccccggacaggcgacccgcccgacggcggaccgggtgcggcaggctttgttcgatatgctgctccatgcaccttggggcggacgtagcctgcttgatggcgccaccgtgctggatggatttgccggtaccggcgcgctggggctggaggctttgtcgcgcggcgcgaaggaggccgtgctgattgagcgtgatcctgcggcactccgagccttgcgggctaacgtcactgcgctgggggcaggggagcgggcaaggattctggcggccgatatgctggcccctcctttggcgtctgcggcatgcagcctcgtttttcttgatccaccctatcgtcaggattatgtgccgaaggcgctatcggctttgcgggtgaaaggctggatagcacccgatgccctgatcatcgccgaatgtgcatgggatgaggtacaaccagtcgaagcgaccggggcgttgctggccgaacgggagcatggtgcggccaggatcatgatctggcgatccgttgactcggtctgaccgatcctgtgcggagtgtacctcgctcatcagcacagttgatcttggtttcagggagggatgatgagctgttacccggacacaataagctgggatgattttgaaaaaatagatctcagggttggaattatcagatccgtagaacgcaatgaaaaggccagaaaaccggcctatcttcttaagatcgatctgggggataggggagagaaaatttccagtgctcaaattacggataaatacacacaagacgatttgatcgggatgcaggtactatgcgtttgtaatttgcgcccgaaactggttgccggggttaaatccgaagtcctggtcacgggtatttatgatgatcagcaccatgttgttttggctactttcaatcatgctttgaaacctggaagcagactcaggtaggaagctgaaaagccaatgcttatgggtgaccgtctgtctcttcgtagcgatctcatccattattgagctgtgtgtgctggacccggcaccatgattcgccagtttccttgtgcaggatcaaggggccgataaatctgtccaatgagcgagggcagcggggtgccaatttctcccgcactggctgaatggtttgattgctccagaatgatggcgctgaaggtcttatcctccagtgctttccgtaacaggtgatcatcccccgataaggcaacgttctggccgtacaggaaaaagtcgaggacgaaattctgaccagcccagaagcatagagcaggcatttcacaggcgacaggcccgggcatcgccgcgatccgggtttccatggaacgccaggcacgcagatcgtcagtgagatggcgtcgttcgccgatgatttttggaatggcaaccagtccgacgatcaataacggcgcggcgataaacactcgcatgcgccaaggattgtccgccggaatggaggcgctgccagaaacggccacggacaggcaaagcgcgatcgcagcctcgatatgggcattcacatctacgccttgcccgctgcgctggaaaatcccgagtgggagagcgatcaggacgaaaatcaggatcagatcaagccgatcatcctgtcgccgcatttgcagtagtggccgggaggcaatgagcatcggcagcagcaccagcagaggtacgatggatttatcggccatgcgaaggatggagagatgccgtttggcgccgacaatgtcgcgcatcatatccggcccgtacagcatcagacagagcacggtcacccccgccagaccgaccagtgcggtgatgcaccagatacgccacgcacggcggtgatacagcagcagccatatccctactgcgagcggtgcagccagcagattatgcttgatcatcccgccgcacagcagcagcagtgcggagccgaccgtgcaagccgccgagggtgattccccggcctgtttcggcaggatcagggccatcccggccatcatgaccgcatccgccatccattgcgggtcatccagcccgacatagcgtcgcagcagggtggcattgagcgccatgaacaacagcccacccaaccatggtgcataatcagccggcgaggcaactctgatcatcaaccgcctgatcatccagacgatgatcccgcccacggtgagcatcgacaacagcgccagcagccggccggcaagaatagggtcaccggtcagttttgcagtccagccgacgatgtaaaacgagagtggcggataattgttgccggtcagcccatccagaggcgggtacaaggcctgtccggacaaagcctgccgggtctgaaacgcattccatccctcattgggatcgcgtgagagatgatcccccagactcagtacccgttccgcaatcagaccgaatgacagcagtccgagcagccataaaagcgcatggctggcgcgtccccaccataatgatggagatgagggggaaatatttttcatttcaccgccgcccgaacaggctctcgatctcggctttgctgaggcgcaatacggtggggcggccatggctgcatgtggcggcgcgtggcgtggcctccatctgccggagcagggcgttcatctccggcacggtcagacgccgtccagcgcggatggagccatggcaggccatacgtgcaatgacggcatccagcctgctttccagcgcgatgctggcgcccagctcggccagttcctcggcgatatcccgcagcagggcgctgacagattgcggcttcagcagagcaggcaaggcgcgcaccagaacagccccggggccgaaggcttctatatccagtcccagctttgcgagcgaagaggccgcatccagcagatgggtcgcttcccgtggcggcatctccaccacttcaggcagcagcagcgcctggctgtttacggtgccatccagcagggcgctgcggagagcctcatgggtcagtctttcatgcgcggcatgctgatcaacgagcaccagcgctccgtccgccgcgacggcaatcacataggtatccagcacctgcgccaccgcggcccccagcggataggcgggatcagggagcggtggtgcgggtgccgatcgatcctgaaccgtctcgggggcagaggacatggcgccacgggcggctggtgcatcctgaagcggtaactgggcctccgcgaagccgaagtgcgggcgtaccgggggagcagcagcgtagccaccaccgcgcgtcggcgtatagctgggtcgggaaatattcagccgagggggcggaatgctaagggtggaagatgcctttcccccattctcggtttgtccgaccggtccgccgaccccggctgcaagagtgcggctgatcgcgccgatgatcagcccgcgcaccgcggcggcatcgcgaaaacgtagttccgtcttggccggatggacattcacgtccacatcttccggcggcacggtcagctccagcgccacaaccgggtggcggccataggggatcacgtcccgataggccacgcgcaaggccgtgcgcagcatcggatcggtaaccgggcgtccgttcaccacgaaactctgggaggctccggtggcgcgggtcagggtaggggcgcagatgaagccacccagcagcagcgtatcgcgttcggcagaaacgggcaggatggcagcagcggcttcttcccccagcagcgcggcgatgcgtgcctgcggggtggcggcgggaaggtcaaagatttcccggccatcgatttcacagcggaacgcgacatggggggcagagaaagccagccgccgcacggcgatttcggcctgatcggcctcactgcgaggtgttttaagaaatttgcggcgggcgggggtcgcaaaaaacagatcccgcaccacaatgcgggttccttgtggaccggaggccggtatgaccgctccaacgcggcccccttcaacggtgatactgtgggcatggtcacaggcggcggtgcgactggtgatgctcagccgtccggcggccccgatagagggcagggcctcccccctgaaacccagtgtggcgatgcggatcagtgagtcgtcggtcagtttggaggtggcatgacgctggatagccagagccaactcctcctccgtcatgccgctgccatcgtcccgaacctcgatccgcgtgatgccgccgccttccagcgccacgacgatgcgggtcgctccggcatccagggcgttttccaccagctccttcaccacggcggcgggacgctcaatcacttcgccggcggcgatgcggttgatcgtcgtatccgacagcaggcggatgcgcggcgagagggagggagcggcagagtctgtcatggatcggataatagaccgaaacggcccgatccagaagaaaccggctcagaagatcccgaggaagctgctttttttctgcggggtctgtgtggtggcagttgtcggaggcgggggaaccgtgatgcccttctgacgcaggcgggcggcttcctcggcagcgttcagcgtggtggggacggtatcgtcctgccagaacatcagcttgtccatcagaccggattttttggtctgcccgggtaagggctcggcctgcataggctgcggctgtctggccggaccggcggcactcagcagggccttttgtccagacctggccgtggtgcccggatcggccagcgctgcggaaggactcagcgcggcttcagcgctgatctgctcattctgttcctgcggacgaggcgcaccggggcgcggtggctgcaacggcccgtccagagtggggggaatgtccagcggcgcgcgggtcgtgaccttgaattcatcgggcgcatcgtgcaccagcccgaacgtgcggagcgtgctttcgccgcagccggaaacagagcaaaggattgcaatggcggaaagggagcggaacagtcttgtgcagcaggcagtcgggcggcgcggaaatgtggtcatgggtgcagtgctcatcatccgggctgggtcacggcactggcggccgggactggcgcattcttgagagggaagaatagcgggaacgatgccgtctgtctgcaccggccatgccataacggggctatatcagccttctccggttcgggtttccctttgggtccgcccgatcagcgtatcgataatcagcagggcaacgccgatcacaatggctgcgtcggccacgttgaacacaaaccatgacaactcgcctacatgcgcatggatgaagtctacgaccgcgccgaagcggaaccgatcaatcacattcccgatcgccccgccgccgatcatccccagcgcgatggcaatcagccggttttccgcacgccgcatccacagcagcaatccggcgacgatcaggatcgctccgccgcccagtatccagataccggcaggcccaaacccgttcagcaggccgaaagtgaccccccggttccataccatggtcaggttcaggacgggcagcagcacaatctgatgtttctccggcaagtttaccgtttcgaggatgaaccatttgctgccctgatcggccaacagcacgatgagggcggcaagaataccgatcggcatatagaatcccggaaaccgccgtgctttctcggcggctccggcgcggcggagggcggcaatgctgctcatgacgtcgtatccttcgcctcttcctgtaaccccgatttcaagcgctgcggcagatcagaccgctctcgaccgcatccgcgcagcgtacacacagggccgggtgggcggcaatgctgccgacttccggaaggactttccagcagcgcgcgcatttccggccgggcgcgcgggtgatggagacctccatctgcgtaccatccagcacgcctttgctggctccatcggcatcgcgggtaggatcatagacctgttccagcgccgagacgatggtgatgtccgcccagtccgcttccgacagtaaatccatttcctccagcgatagcggcaggcggacggcagcctgaagagaggcaccgatctgattggcccggcgggcttcctcgatcggcgctgtaacgcggcgacggatgctgcggatttcctcccagcgccgggcaagaaccggatcgtgccagtgatgcggcagggtgggcagggtctggagatgcacactgtcctgctcgccgaagcgggcggtccaggcttcctcggccgtgaacaccagcacgggagccagccagatggtcaggcagcgatgcagatgatccagcacagtccgcgtggcgcggcgacgcgggctgtcggtgcggtcgcagtagagcacgtctttgcggatatcgaaatagaaggcggatagatcggtggcgcagaaattgtgcaggtccgggtaaagtccggtccagtcatggctttccaccgcctgccggaagcgtgtgtccagttcggtgaggcgatgcagcacccagcgctccagctccggcatgtctgcttctctgacgcgttcggcttcttcaaacccgtcgaggctgcccagaatccatcgcagcgtgttgcgcaggcggcgatacagttcgccctgctgcttcaggatttccttgcctatccgcagatcgtcccgcgtgtcggaggacatgacccacagccggagaatatccgcgccatactggtcgatcacttcctgcggcgcggtgacgttgccgagggacttgctcattttccgtccctgctcgtccagcacgaagccatgcgtcagcaccgcttcgaacggagccgatccgcgcgtgccgacggcttccagcagggaagactggaaccagccgcgatgctggtcggagccttccagatacagatcggccggccatttcatgtcccgtgcttccagcacgaaagcatgggtggagccgctttcgaaccagacatcgatcacgtcgaacacctgttcgtaatcctcgggattgcgatcattgccgaggaagcgggaaggcggagaggaataccatgcatcggccccttcctcccggaaggcggagacgatgcgctccatcacggtggcgtcacgcagcacctgtccggtggctttttccacaaatacggcgatgggtacgccccaggcgcgctggcggctgatgcaccagtccgggcggttggcgaccatggagccgatccggttgcggccctgatcggggatgaagcgggtacggtcgatctcggccagagcctgcccgcgtatgtcttccgacccgtccatgcggatgaaccattgcggcgtggcgcgatagatcagcggtgctttggaacgccatgaatgcggataggaatgcaccagcgtgctgcgggccagcagcatgcccgcttccgacaatgcggcgcagaccggctcggcggccttgtagacatgcaggccggcaaacaggggaacgtgtttgtagtaggtgccgtcatcccccaccgtttccggcacctcgatgccatgggcgcggccgagctggaaatcttcctcgccatgggcgggggcggtgtgcaccagcccggtgccttgctcggtggtgacgtgatcgcccggcagcaggggaacatcgaactcgtaacctcggccacgtagaggatgggcggcgatggcaccttccagcgcagcccctttgaactggcgcagcacgcgatgctccgtgagaccggcggcagccagagtttgcggcagcagggcttccgcgacaatcaggatttcagtcccgccggagccggtgggaatctccaccagcacgtaatcgatctccggcccgtaggcgacggcgcggctgcccggcatggtccatggcgtggtggtccagatcaccacataggccccgatcagatcagcctcgcgagcgctgagcaccgggtagcggacatgaatcgtggtgctggtatggtcgtgatactcgatttcggcctctgccagagcggttttctcgaccggactccacatcaccgggcgcaggccgcgatacagtgctccattcagcaggaatttgccgatctcgcccgcaatggcggcctcggagccgaaatccatggtggcgtagcgattggcccagtcggcctccacccccagacggcggaattcggcagactggatatcgagccatttgcgggcgtaatcgcggcattcggcgcggaattgaagaaccggcacctcatccttgttgcggcccgatttgcgatattcttcctcgatcttccactcgatcggcaggccatggcagtcccagccgggcacataggcggcatcgtatccggccatctgccgggcgcggttgatcacgtccttcagaattttgttcagggcgtggccgatatgcagatgtccgttggcgtagggggggccgtcatgcagcacgaacggctccgccccgatgcgggcatcacgcagcttccgccccagccccatcgcctcccagcgcgcgagaatgcccggctctttcttcggcaggtccccgcgcatggggaaggaggtcgccggcaggaaaaccgagttccggtaatccgcggtctggttctcttgggtctggggatcgctctggtcttgactatgagacatgatggtccgccgctggagggccgccaggatacggcccggaaagaaaagaagaaaatggaaatcgccgcgtctggctggccgtcgcaacagggcacgcaggcaggtgcccgggcggccagctacctaattcgcaggcggggtcgggtggagatggactgaaacggtctggacgacatggctgcattctgcatcggggggcggactatgcttggcgcgcaggaagctggtcaagcagcttccgtgcttcagtcgcatcctgggcaatctggccgcgtagatcatccagcccggcgaattttcgttccgcccttaaaaatgcgtgcaggctgacagtgatatcctgatcgtacagatcaccgctgaagtcgaacagatgtgcttccagcctgctttccggcccttcattgacggtcgggcgacggccgatattggcaacacccggatattcggtgccgtcaggcaaccgggccgtgacggcatagacgccgcgggccggctccagatgccgaccgaaggggatatttgccgtgggaaagccgatggtgcgtccgcgtttgtccccgtgcgagacgatgccgcggattccccatggccgcccgagcaactgtgccgcacgctccggatagccatcctgcaacaggcggcggatgcgggtggaggagagtggcccttctgcatccatgacgggcggtacaatggtcagcccgatccccagcgcctcgctgcgggtggagagcagggtgatatcgccgccgcgtcggtggccgaaggcgaaatcggccccgcaggccagatgttttgcatccagcccggccagcagaacgccggagatgaattcctcggcttccatcaggctgaaagcctcgtcgaaggccagttccaccacccatgtcacgcccagccgtgccagcgcatcggcgcgctcggcagagagggtcaggcggaagggcggatcatagggacggaagaactcccgcggatgcggctcgaaggtcagcgccatcaggggggcggtcggtctggccgcatgggcggcacggataacggcctcatgcccgagatgcacgccgtcgaaattgcccagtgcgacgcttgcgccgcgggcttcgggggggatgtgtcgccagtccgtgatgatccgcatgccgccgtttgtgcgcgaaggctgcgtcgggatcaatcattcagtgcagcagaaacaggcatggcaccgtgacaggtggggcaccatgacaggcgggcatgaatgcggcagcctgtgttttcttacatcgcattgaccgtaacgggagtctccccctgatggccgcacgtttcgaaaacatatccgcgccgaggcccacacgggaaagcctcgccgcgggacgggacgccgtgctggccctgatggaagcaggagcatgggcgcaggccctgtccaccatggatcaggatcggcgggattatgcacgctggtcggcattggtacacctggctttctcccgcaacacggcggaggtggaggcgaaagcggagcgcagctatgcggattctctcgcgccttttgcgcaggattgtgaggtcacgctgaagcggcgcgtgctggcccatcctgaccgtgcatcgattctgcctttgctggcaccgccttatggcgagcatgtgctggcgctgtgggaggcggatatcaccacctttatcccggccattgcggatgatctggaacaggaatcaaagctggaggcggactataccgagcttctggcggcggcccggctggagatcggcggtcaaaccgtcaatctctccggcctcgccccttatgccgagcatgcggatcgcgcgatccgtcatgaggcggagacggtccgctggcagtattttgctgatcacggcgagaggctggacggaatttacgatgctctggtccggctgcggcatggcatggcccgcaagctgggggatgagaacttcatcgctctggcctaccggcggctgcgtcgcaccgattacgggccggaggatgtcgcccgctatcgcgatgccgtcgcggaaaaggtgaccccgctggttgcccgtctgctggaagcaaggcggcaggagcatggctgggacaggctgcgtttttgggacgaagcgctggtcgatccgcgcggcaacccgcaaccgctcggcggggtggaggtgctgggcgaggctgctcagggcctgttcgatgcgatggacgcgcatctgcccggaggagacgcaaaaggcatcggagcctgttaccggttgatgcgtgccggcggtttcatggatctggataaccgtcccggcaaggcgggtgggggattttgcacctcctttcctacgcaatcggacgggatgccgtatattttcgcgaattttaccggcacgcatcacgatatcggcgtgttcacccatgaaatgggccatgccttccagaattatgccagccgcaccctgccgggtatcgatctgctctggccgacctatgaagcggcggaaatccattccatgagtctggaattcctgacctggcccggaatcggcaagctggtgggagaggacgaagccgagcgttaccggcgcatgcacctgatccagtcgctggcttttctgccgtatggcgtctgcgtcgatcatttccagcatgaggtctatgccaggcccgacgccaccccggcagaacgccatgcgatatggcggcggctggaagcccgttacatgccgtggaccgattacggtgatctggcgtggccggcggcgggcgggcgctggcaggcgaagcagcacatctacaattcgccattctattacatcgattacacgctggccttgtgctgtgcgctgcaattctgggtgcgcatgcggcaggattatgcctcggcactgacggattatgtcgctctgtgcgggcgtggcggcgcggccccttttaccgctctggcacgttcagccggtctggccagcccgttttcccccggtgccctggatgcggtggtggatgaggcggcgaaaacactcgggttgatatgatttttctgtgataaaatcacaaaataatccagaatatcagtaaggacggtatcaaaagggttggtcggcaaagaggccggccgggggtatcagtgatgaaaatcatctcccggatcggggtttttacagtctcgttgctgctgtgccttctgctcggccccgccacggccagccgtgccgatctggggcagtccgagtttgatcaggctctgcaagctttgcagggcattgatctggccagcctgttgccccctccgcccgcccccggcagccgacaggcgcagatggatatggaggcggtccgtcaggctgtcgccgcccgcacgccggcgcaggagaaaaaaatccgcgccgatcatgagtgcgtgatggagcagttcgcctccgtgatggggccggatttcgatcatcagcattatccgcgtctcgccgccatgctggatcgtgtctatcgcgtggaggcgcaactggtcgcgcaggccaaggcgaagattggtcgtcctcggccctatacgctggatcctacgctcaaaacgctggagacacgctcggcgcaggcttcctatccgtcggggcatgctaccttcgcctacatgacagccgccattctggcccggattttcccggagaaacgggaggcgctctacgcgcgtgccggcgtctttgctcataacagggtggaggccgggtcgcattttccaagcgatctggaggcagggcaaattgtcggtgaatggattggcaatgccatagagaaagctagattacccaatataattgactctgacctaggtgctcgatataaatgagcttcctgattattcaggacgtgcatacaccccctgaccagaaaggagaattagtgaagcttaccttagaggttaatcacacaactgtctatctcttcctaataatcttggaaaaatattttctttgaaaaccagaaagggctgatccaaagttttgggccagccctttcaagtatatttacatccccgtatgcacgggggagcagctttatttgaagccgagcttgagaacgctagcgggctatctccattaatatggaggtgtataattttacctgttaaatactagaacggaaagcaaattctgccaacagcctatcgcggatcactcatctgaggctgccgcatagcgttttcggaaaaatccggaatcggcaccggatactcacccgtaaaacacgcatcgcaataatacggcttgctgtcatcgcgtccgggccgcccgagtgcgcgatacagcccgtccagagaaatgaacgccagggagtccgctccaatcagcttggccatttcctcgacattgttgcgggcagccagcagcttgctgcgttccggcgtgtcgatgccgtagaagcacgaatatgtggtgggcggagaagaaatgcgcatatggacttcggcggctccggcctgacgcaccatctccacgatcttgcggctggtggtaccccgcacgatggagtcatccaccagcaccacgcgcttgccctccagcgcggcgcggttggcggagtgtttcagctttacgcccagatgacggatctggtcggtcggctcgataaaggtgcgacccacatagtgattgcggacgataccgagttcgaacggcacgcccgattccgccgcatatcccatcgcggaggggacgcctgaatccggcacgggcacgatgacatcggcctcgacatggctttcgcgggccaactcgcgcccgatgctcttgcgggcatcatagacggaaatgccttccagcactgaatccggacgggcgaaatagatgtattcgaacacgcagaagcgggaggtcgtgcggccgaagggacggatgctgtgcacaccctgatcgttgatgacgacgatctcgcccggctccacatcccgtacgaattccgcgccgacgacatccagcgcgcaggtctcgctcgccaggacccatgaccccggcgcaccggcggcgccgggaatgcggcccagaatcagggggcgaacccccatcggatcacgcacgccgagcagcgcatcggtggacagggccaccagagagtaggcccccgtcacctgcttgatggcatcaatcagccggtccaccacagtggaatagaggctgatcgcgatcagatggacgaagacctcgctgtctgtggtggactgaaacaggcagccacgccggaccagcgccttgcgcagggtcagggcattggtcaggttgccgttatgggcgacggccagacccccgaactcgaaatcggcataaagcggctgcacgttgcgcagcagggtctcgccggtggtcgcgtagcggttatgcccgatcgcgtgcggaccgggcagggaggccatgatccgtgcatcaccgaaattatcgccgaccagccccaggcccttatgcgtatgatggcgctgcccgtcatagctgacgatgccggttgcttcctgtccgcgatgctgcagcgcatgcaggccgagtgcggtaatggcggcggcatccgtggcattccagatgccgaacaccccgcattcctcatgcagcgtatcgtcctcggcccgatcgaccatcagggtctgcggcgtcatgggaccggttccgccggaagaggcggcggcatcgtgaagctcgtcggaacgggtcggctgcgccatttatttactctcctgcccctcgctgggccgtcttccggtggcatagccgcgggggcttgcctgcatatagtcctgcgccctggtgtccacctttgcaggggcagccagtttcgggcggtattcttccgggacttcttcggtcaggcggaccgctcccgcatagatatagggtaaggcacgtgctttcagtaccggctccggccagttttgcacaggaatcagcagccctgccgcgatataggcgcagagcatcagagcgaagccgcgcacgatgccgaagaccagccccagcgtgcgatccagtcccccgagaacggagccgcgtaccagtttcccgatcatggaggcgacaaccgacagcacgatcaatgccaccacaaaaacgatggcaaaggcggccggatcggccagcgcatgatccgggatcagagtacggatctgcggagtgacggatgtaaagcttcgtgccgcgatccaggcggcccccacccatgcgccaatccccagagcctcgcgcacgaagccccgcgtaaaggccagcatggccgatacggccagaaccgccagcacggtcaggtcgacccagttcatagcggctggatcaaggcagggcgcataacagcgccatggagggtggcccggttcacggtcatcatcatgtcacgaaaaggtgcagcgaggcgcatatatcgaccctctcgctctgatgccagcgcggaggctgcattgcagcatatcctcgcaaaataagtgaccatcatgtcacgctttgtcccgggccggtatagtggcataagcccggtcaagcatgcccggacgttgacagaaaccgatccgtcactggcggcgcaggatcgaacagggcaaggtgccggcatggatgtgtcgatggcattgctgaatctggctggctccgtggcgttgctgctgtggggcgtgcatatggttcagacaggtattcagcgtgcactgggggcgcggctgaatatttttctcacccgggcgctgcggaaccgtttcaaggcctttctggccggcatgggcgtcaccgccattcttcaaagcagcaccgccaccgggctgatgctgaccggattcgcggcaggcgggttggtggaacttgctccggcgctggcggtcatgctgggtgccaatgtcggcagcacgctgatcgtccagcttttgtctttcgacattgccgctgtggcgcccgtaatgatcctgatcggggtcatgatgttccgtcgcgggcaggcggccacacgggataccgggcgcatcatgatcgggcttggcctgatgcttatggcgctgcacagcttcgtggccctgctggaaccctatgagcacgcagggcaggcgcgggagctgctgggcgttgtggccagctggccgttgctggatcttctgctgggggccgggttgacatgggcggcgcattccagcgtggcgacggtattgctgatgatgagtttcgcacagaaaggcgcgatttctcccgatgccgcttttgccatggtgctcggcgcgaatatcggcactgcgatcaatccggtgctggaaggggcatcgggagaagatcccgcggcccgtcggctgccgttgggtaacctgctgctccgcacactgggggcggtggtggcaatggtggtgctggggcctgtcggtcgtctgatggtgcagatcgagccggatgcgggcagggccgtcgcggatttccataccgccttcaaccttatgctggcgattgtggcgtttccccttctggacgcattcgcaaacatgctgaagcggatgctgcccgccagacaggatgaggatgatccggcccgcccgctctatctggatggagcagccgtggaaagcccgcccgctgcactcggtggggcagcgcgggaggccctgcggctggtcgatgtgctggagacgatgttgcatgggctgaaggaggcattcgcccgtggtggccgaaaggggattgccgataccaggcggctcgactcggtgctcgaccgcctcaatgctgcgatccgctcctatctgacccggatcgatccggaagccatgagtgaggccgatcatcgcagggtgcgggaaatcctttcattcggcacgaatattgaaaatgcgggcgatgtgatcgaacgtaatctgctgtctcaggcgatgaaaaaatttaagggcgggattgccttctcccccgaggcggatgccgagatccagacattgatcgagcgctgtaccagcaatcttcgcaacgctgcggccctgttcatgaccgaggatgtgcgcctcgcccgccgtctggcagcggaaaaggaagtgttccgggatgccgaaaatagcgccaccgaacaatatttccggcggctgcggacggaagggaaagcggccgagctggaaaacctgtatctggatgtgttgcgtgacctgaaactgatgaacacgcatctcgtggccgctgccgcctatccggtgctggaggcgcatggggaactggccgccagtcgtctgcgggttgaatgaggcttccttctgcggtccttggttgacgtcggaccgtttccgattgtacgtgagcagcgtgacatcagaagtcaaaacccgtccctttttccgcgtgcgcggtcggtccttcattgctgtcgtcctggtaccggaacaaccggtgcatgactggctgggggagcttgatgcgcagatcgagcggtcaccgagctttttcgaccgtcgcccggtggtggtagacctgtctgttgccgggttgcaggaacccggcctgatggcactctttgccgagctggaagcccgcaatatccgccccatcgggattgaggggctggatgaagccgaagaagaatggagcgaaaatctgcttgcttccctgccgccggtgattcgcggcagccgtgctgcgggcgatctggatattcctgaagaaacccggccggaagaaatgatggccctggtcgtagagcgccccgtgcgctccggccaatctgtcgtgcatgacaagggggacgtgattgtgatcggctccgtcgcatccggggcggaggtcgttgcgggcggttccattcacgtctacggcacgctccgtggacgtgcgattgccggattgatggaagacggaaccccccgtatcttctgcagcaagctggaagccgagctggtggcgatcgaaggcgtctggaaaaccgccgatgatatggaaccatccctgcgcggcaggccggtgcagatcatgcgtgacggtgaaacgatcaagatcgtcgcgttcgactaaaggggcctcttacgctgggccgatatgttggctatcgtcgaaacgataaggcatccgtgtttcagtggccctgatgatcatggcacagcgtgggtgaccgggtcatgatctacggtggagcatccccaatgtggatgcggttgagcgcctgagggaggcttgaatgtctaaggttttggttgtgacctcgggcaagggcggtgtcggcaagacgacatcgactgccgcgctgggtgcggcattggcccagctgggcaagaccgtctgtgtcgtcgatttcgatgtgggcctgcgcaatcttgatctgatcatgggtgcggaacgtcgtgtggtgttcgacctgatcaatgtagtgcaaggcgatgcgcgcctcagccaggccctgatccgtgacaagagggttgaaaatctctccctgctgcctgccagccagacccgtgacaaggatgcgctgaccccggaaggtgtgcagaccgtgattgaggaactgcgcacacgttttgactgggtggtctgtgacagccccgccgggatcgaaaaaggcgccacgctcgcgatgcagtttgccgatgtcgcggttgtggtgaccaatcccgaagtgtcatccgtgcgcgacagtgatcgcatcatcggtctgctggattcaaaaacggacaaggcgcagaaagacgagcgcatcgacaaacatctcttactaacccgttatgacgctgtgcgggcggcgaagggcgagatgctgaaggttgatgacgtgctggaggttctgtcgattcctctgctgggcatcattcccgatagcgaagaggtgctgaaagcttccaatgtcggctcacccgtgacgttgaatgcaccgcagagcgtcccgggcaaggcctatttcgatgctgcaaggcgcctgctgggtgaggatgtgccgatggtggtgccgtccgagaagcgcgggctggttggtcgtctgttcggcaggagggttgcgtgagcttattcggctttctccaacgtaaaccgacggcccaggtcgcccgcaaccggcttcagattctgctggcgcatgagcgggggctggagggtaatgctgaccttgccgccatcctgcaggaagagattattgcggtcatcgcgaagcatgtcgagatcgaccgggaaaaggtgcaggtcaagcttgatcgcggctctgctttttccacactggaaatcgatgtcgagatgccaaatggaaagaaggcttgagcatccgggcaggccgttcagggtgaaatcatcctgcctgttgcttcccttcagtctggccttatgtctgggtttggcaggatgcggttcttcacatcatcgttatacaggcggcggtacgccttataccggtggggcatcttatgaggagtccccttatcctcaagcggggcagacgctcgatttccggactcgtgcacaggtgaactgtgccgccggggatgccgggtcctgcaaaattctccgcgccatccgctgagatttttgtgatcacaggcaaagacaactgatcactttgtggggcgttatgtgtcttgacccgaactttatcggggacaaatcacagccagagggacgcgccatgaccggaccgctttatcgtgaccgtcataacctgactgcggcagccatattgttgatcagtgttatcgtcagtgggaaatcttttgcgagtgagcatggcgctgaagcaccggccggttctattgcagcggcgaaggccgtgcatgtcggtttgggcattggcagtggtgtcgggtcacaatactggtatgtacctggtgccccttacagtgcgggggatgcggactcatccgagcatgaaaagggcagcctgcgtcagatgtcggacggtgtggaaccgtcctggtatcccgtaaaaaaataaaggctatctgttatcagggtttttgctgaagcgtctggataatctcgaacccttcgaattcaggatgcccgagataaagcggtcgattgctgccggcatttttatgagccgcgcggaaagcttctgatctggtccaggcttcgaaggtagcgtggcttgcccatattgtatgcgatgcatagaggacatgatcctcacgtaccgggcctttcaagagatgaaattcgatgaaacccggtacagtctccagaaaactgggccgattggcccagacttcctcaaatgcctgtgtggcatccggcagaaccttgaaccggttcatggcaataaacataagcacttctcctgctgccggttggccagcctgatgtagcgggccgccccttgtatccggcgatcgtgcaattctgacggataggcggcaagggggggaatatgccggatttcaggtgatgacgcgcagggcaggccgtgcgtcgacacccagcttgcgatagatcgccaggtaatcctctgccatgcggcgtgccgtgaagcgtttttcaaacatggcacgcacatttgtccggttgagccgatcgagcttgcgcgcggcagcgatggcgcttttttcatcctcgacgataaagccggtcacgccatcatccagaatttccgggaccgagccgcgattcatggcaataactggtgtaccgcaggccatggcctcgatcatcaccagcccgaacggctccggccagtcgatcggcatcaacagaccaagggcgccggagagaaattcggcttttcggtcatccccgatttcgcccaccatttcgacgcctccgcccggcagcatcggtttgatcacggtttcgaaatagtcctgatcggccttgtccactttggcggcaatgcgcagagggatacccactgcacgggcgatgcggatggccgtatcgggccgtttttccggacagatgcggcccagaaaggccagataatcctgtttgccgggctgaggcgtcagcaggtcggcaggcagaccatgcaggactgtgccgatgaaatgagcgttcggcaaagggcggcgctgggaatgggagatggaaatgaccggtgtatccgggaaggcatcataaatctgggacaattccggcagatccagccgcccatgcagagtgctgacgaacggggtcggttggcgggaaaacaggctgaacggcatgtaatcattatgaaaatgcagcacgtcgaactgatccgccatctgccgcacccgttccatttgcaaaatctggggtgccagcgtgtcgcggatcgtttgatccagcctcagcgcctgcggccatgtcgcttccagctttgccccggttatggaatctccgctggcgaacagggtaacgtcatgtcccattgcgaccagctcctcagtgaggaaggagacaacgcgttccgtacccccataaagcttgggcggaacggcttcgtgtaatggggcaatctgggcaatacgcatggcgataagctccatttttgctgcggataacgatctggatgccggtgtcgctgcgtaaaacatgcatcctgatacaggcagtaataagacaggtttgccttagtgctgccgcaatgatcggtaaaatgtgctgaccaaaggcaatgtcctgagaatgcccgacctcatggttcagcatttctgccgggaccgaaacggatcagttcgtaaaaggttgctgccatgatgcctcccggtaacggcctgtgctgatagcaggaaggaagactctcattttgaatgaggtgccgcttctgttgaaagggcagtttttctggcctgagcagcaacagtaaacttattgacgataacggatgcgcatcgtgggtgacggatcgatcaatatcacgtatccgggagtactcatgtccaataaacccgtcacgatcactctttcagaccattccgggcagaccattccgggatgtgcgcaatggttgcaaaaagactgggtggtgcagcagatggcaggatcatgaaacacctgcggcaaatgctgtcggtgaagccttttgagacagtccccggggggcgcgtgaacaacgacaaccaaacccgcagcctgccgacccggacgctgccatttatttttcactacgttcgccgccatcctgtcgggcatctgaccgtcctgttatccgtgctgatggcggtgtcctttgcaacgttctcccaatacggcgtcaagaatctggtggacgtactttccggcaatcgtgtggatgaagtctggagcgcattcgccattctcgccggcttgatcgccgccgataatatgagctggcgtatcgggggatgggtctccacccacacattcgtcgcggtcacaggcgatctgcgccgtgatctgttcgaacatctcaccggacactccccggcctattttgccgatcgcctgccgggcatgctcgccggacgtattacggccaccgggaatgcgatctttcagcttgagcagcttttcgcatggaacgtgttgccgccgacttttgcggtcgttctatccgtggcgatgctggcgctggtcagcccgctgatgtccgcgacactggctctgatatcgctgggactgggggccgtcctgatgatctgggcggcacgcggcaaccggttgcacgaacgttacgcaacggatgcggcaagggtggatggcgaactggtcgatgtcatcaacaatatgccgttggtgcgtgctttcggcgcgacgctgagggaacgggagcgatttgcggcccgcgttcaggatgaaatgtcagcccgtggccattccctgcgctatctggagcggctgcggctgtttcatgcggtgtttacggcggcgctgacagccgggttgctggtctgggcaatcctgttgtggcagcacaagatggcgagcaccggggatgtcgttctggtgactacgctcggcttcaatattctgcatggtacccgcgatctggccgtggcgctggtgaatatggtgcaggatgtggcccgtctgtcggaagctctggcaacattactgctgccccatgatctgcgtgaccagacggatgcgcgtactctcccttctgctgtcggggcggtcgaattcagggatgtcacttttgcctatccgggtgccagcccagtcctgaagaaattcaaccttgttgtccccgccgggcagcgtgtcgggttggttgggcgctccggctctggcaagaccacggttttgaccttgatgcaaaggctgcgtgagctcggggagggacagatcctgatcgacgggcacaatatcgcgaccatgacgcaggaaagcctgcgtgatgcgatcagtatcgtgccgcaggatgtcatgctgttccatcgctcggtgatcgataatattcgttatggcaagcctgatgcgagctttgccgaggtggaggcggctgcggaagctgcgtgctgccgtgacttcatcgacgatctgaccgaaggatacgatacgatcgtgggtgaccgcggggtgaaactttccgggggtcaacgtcagcggctggccatcgcccgggctttcctgcgtaatgcgcctgtgctggtgctggatgaagcgaccagtgcgctcgacagtgaaagtgaacgggccgttcagagggcgcttgatcgcttgatgcagggtcgaaccgtgattgccgtggcgcatcgtctgtccacgctaaagaatttcgatcggatcgtggtgatgcagcatggccgtatcttgcaggatggctcgccgaccgagctggagcgcaatgacgggccgttccgggatctgttgcttcagcagaccatgatgattgccgccgaataagcggccagggtgctatttaaacaggggtaggggctgggcactgcaggtgtccggcctttttttatgcacatccctgagaggagaagcagaaaagaggaggaagccggcgggggataatcccccgctgcggtctccgatccggctccgtccgttgataaggctccaccagaatggcgcagaggacggaagcggttttcaggcgggctggttatcaccaaccctgtccggccgcccgatggctggccgggtatatgtgcgggaccgttgggcccggcttggcggaaggtatatcagaacccttcacgctccagacgcttgcgctccagcttgcgggcgcggcgaacggcttcagcagcttcacgagccttacgctccgacggcttttcaaagtgccgacgcagcttcatttcacggaaaatgccttcgcgctgcatcttcttcttgagcgccttgagcgcctgatcgacattattgtcacgaaccagaacttgcactgggtagtcatctcctttctctgggcggtctgaacccgggccgcacgaacgggttccgctggagactccaacggaaggcggggcgtataacacagtttcgccgaagaaaacaaagcctgtttctgtggcctgatattttctggctctggcaggtcgaaacaggtctttctgataccgtttcgtgccttgcggtgtccggcttcgtaacggacaatatgatcgaaatcaggccaggtggcagtggcaaatacgggagaggcgagcaatgtcgattctgaagatcgcacgcatggggcatcccgtgctgttgcgtcgtgcagatcctgtgcctgatccgactgcgccggagatacaacgcctggctctggatatgattgaaaccatgatcgatgcccccggtgtggggctggcggcaccacaggtttatcaatccctgcgcatgttcgtgtttcgtgtgcctgtctcccgcggtggtgaagaagtctctcccaccgtgctgatcaaccctgagcttgaatgggtgggggatgagattcagatgtgctgggagggatgcctgtccattcccggcttcaggggggaagtgccccgtgccatgcgcgtccgttatcgtggcatcggactggatggggctgttatcgagcgtgaggccagcggctttcacgcgaatgtcattcagcatgaatacgaccatctggatggtatcctgtatcctatgcgcatgaacgatctcgggaggctgggctttgaggaggagattgcccgcgcacaggcagccctggcagcggaacagaaggatgatgcagaatgatttccccgctggactctctgatagacgaccctgagcaggatagggttattgcggcgctgctgcctcatgttccggttctggggtggaccgaggccgctttgcgcagagccttgagcgatctgtccctgccacccgatgatgcgcctttattctggcatggtggggctgctggcctgatcgaggcatggtccggctggctggatcggaccatgatggcagaggtcgagcaggcatccggtgtcacgaaactgagcgcccgtgtccgtctggccattgtggccaggctttccttgatggggccgcatcgtgaggccgcacgcagggccgctgcggcattggctttgccgggccgggcccgtgttgcagcgcgctgtctggcgcgaacggtggatgcaatctggtatgctgcaggggatcgttctgcggataccagttggtacacaaaacgcattattttgaccggaatatggagcgggacattgctggtctggttgcgggagcgatatgatcatgatgaagccgcactggcttttcttgatcgcagactggctggtgtcgcacaattcggacgcctgaaggcacggatcacggaaggattggcaggtggcccgtcagctccccattcacactcggaggcatgacccttcgcaacagggcgcaggaacgccaatcaggatgagcacagttttatgccccgcgtcctgatcacccatatcaccacgtatcgctatcatcagccggtttcgctgggtcggcaccggttaatgatgcgcccgcgtgacagtcatgatctgcgtatgaacgatgcgaccctgacattctatccgccacccgtggagacacgttgggcccatgatgtttttggaaattcagtctgctatgtgcagcctgacccggcagagtctgatcggttcgaaatcacatcacggcttgatctggatcattttcccagcaatgaagatttgccgattgatccggtggcgcgcacatacccgttcggttatgcggccgaggaattaccggatatcgcgcgtttacaggaacggcaccatcccgatcctgatcacaggctggagctgtgggcacgcaaatttgtccgcaaagggcgtgctaccgggacgatgcggctgctgatggatatgacgcgcgcgattcagcgggactttacttatgaagcgcgcgatacgcagggcacccaggccccgctcaagacgcttgatcttggcagaggggcatgcagggatttcgccctgctgatgatggaagctgtgcgatcgcttggtttcgcggcccgttttgtcagtggttatctgtacgacccggacataaaaggttccaccatggttggaggcgctaccacccatgcctggtgtgccgtttatctgccgggtgcgggatgggtggagttcgatccgaccaacgggctgatcgccgggcgtaacctgatccgcatctgtgtggcccgcaccccctctcaagccgtaccgattgccgggagctatatgggacattccggtgatttcgctacattgtcagtcgatgtgcagatcaagacggaaacggcttgatcgctatgccgtgccttattgggcgaggtgttttcttatgagtcattcgtacctctcccggattgtctggaccggtaatcgtgggtgcggtacatccggctatcgcgattatgatcgaagctgggatattgcggtgccgggcaagccagtcatccattgctccaacgatccgttgctcggtggtgataccaccagaatgaaccctgaagatctgctgctgtcggccttagccgcgtgccatatgctctggtatctgcattacgcttcggagtcgggcattgtggtcacgtcctatgaagatcagactgtcggtattgcagaggtggcggcgggaggcgccggccagtttgtgtcagcaaccctgcacccccgtatcacggttcacgcacaggccgatcttgccgtggccgaggccattcatcaccggattcatgaagtgtgtttgatcgcccggtcggtgaaatttccggtttattgcgcgcctgaatttatatccggctaaggcgggccgggcaaaacagtctgcaacatggccttcaaacggaaaacggccccgcagggcggggccgttccagacgccagcccgggggtgccggcgtctcatcgcgtcgattggtccgagccgaggggcgacgtcgaaccgatcggcgcatccctgtcgcggtgtctggaaagcagtgttgcggaaaggggactctccagcggtcagggaccagctccggctgccctgtgttagggggcaggacagccggatttcgtcgttccgtattagtggaactgctcttcttccgtgctgccggcgaaggcagtggtggaagactgaccctgagacactgccatggagatcgcgtcgaagtaagacacgcccacttcgcgctgatggcgggtggcggtgtagccatcggcctcggcggagaactcggcctgctgcagctcggaatacgcagccatgccacgatccttgtagccacgggccagctggaacatggagtagttcaggctgtggaagcccgccagcgtgacgaactggaacttgtaacccatggagccgatcgcgcgctggaattcggcgatcttctccggcgggagcttcttcttccagttgaagctgggggagcagttgtaggccagcatcttgcccgggaactgcttggcgatcgcgttggcgaactgctcggcttcttccaggttcggctcgctggtttcccaccacagcaggtcggcatacggcgcataagccagggagcgagcgatcgcgtaatcgacgcccacgccttccttgatgcgatagaagccttccggggtgcgctcaccgctgatgaacggatggtcgcgctcatcgacattggtggtcagcagctgtgcggcatggctgtcggtgcggcacagcagaacggtcggaacgccttcgacatcggcggccagacgggctgcgttcagggtgcggatgtgctggctgatcggcaccagaaccttgccacccagatggccgcacttcttttcggaagcaagctggtcttcgaagtgaacgccggcggcgcccgcatcgatcatggccttcatcagctcgtaggaattcagcgcgccaccgaagcctgcttcggcatcggccacgatcggggccatccagtgaatgtcgccatcacggccggccttggcgccttccatgtgggcgatctggtcggagcgacgcagcgcgttgttgatgcggcggacaacggccggaaccgagttcgcgggatacaaggactggtcgggatacatttcaccggccaggttggcatcggcggcgacctgccagccggacaggtagatggccttcaggccggccttgacctgctgaaccgcctggttgccggtcagggcgcccagcgtgttcacgaacggctcgttacgcagcagcgtccacagacgcttcgcgcccatttcggcaatggtgtgcttgacgcggaagctgccagccagcttctccacatcggcctgggtatagtcgcgcttaacgccggcgaagcgttcttccatatcgaagggaacgctgccggcgccgtccggcgcgaaacagatggaggccatgtgacgcataattattactccctcggctcttaactgcgcaacatttggcacttttttctggctttgacacccctaaaattaaaaatttgctgaaatttagtaaatttgtttacgctttggttgtaattttgcaaactgtgtaaattacaaagcgtgaaaataatgtcatgtctcgtcctctgatcgggcgcaccgtgcgccggttgcgacaggaacgtggagagtcccagcaatcgcttgccgtgaggctggggatttccgcaagctatctgaacttgatcgagcatgaccagcgtggcgtgacggcatcgttgctgatcaaactggccgaaacgctgcgggttgatctgcgtgccctgtccggccagcaggagcggcatcttcagactggattgcgagaggttttcgccgatccgatgctggcgaacgagagcgtatcggtggaggaggtggaacagcttgccgccgccagtcccaacgcagcccgggccattctcacgctgtatcggtcctggcgtgtcgcacgggaggatgcgggcgggatcgcattgccgtctggtcgccgtatcctgctaccgaatgaggaggtacgcgatctgtttgccgagcggcagaattacttcgcggaactggaggcagccgccggagcgatctgtgccgatctgcgcaccaccccggcagaggccaatcatgccattgccgagcggctgcgcgcccgccatgggctgaccatccgggtcggcccttcagaaggcgtacaccgtcgttacgatccttctggttccaacctgttgctgtcggaacaactgccgcgcgaaagccggggtttccacatggccttccagctggccctgatggaaaccagagaagcggtggagggggtgatcacggcctcccgtctcagcacgccggaggccgaaggactgctgcgaatcggactgctgaattataccgcggctgcgatcctgatgccttatgaagcgttccggcatgcggccctggaattgcgacacgatatggatctgctggcggcacgcttttgcgtcagtttcgagcaggcctgtcagcgcctggcctcgttacagcggccggaagcacgtggggtgccgttcttttttctgcggacggatgcggcggggaatgtgtcgaagcgtttttccgcagccggctttccattcgcgcgtttcggtggctcctgcccccgctgggtcgtgcatgaggcgtttacttcccccggcgccatccgggtacaggtggcacggctgccggatggtgcgacttttctgtgtttcgcgcgctgtgtgcgtggggtggcagagcgatggggagatccgccgccgcttcatgtggtggcaatgggctgcgacatcgctcatgcaccggacattatctacggtgatggtatcgacatcgaacgggcagccgtgggaatcgggctgtcctgccgcctctgtgaccggcgggactgccgcagtcgcgccttcccgccgctcgaacaccgcattgcgattgaccccaacacaacggcagagagcccgtatcgctttcaggagcaacattaggactgattgccgatgctctttcggatcggtgcgactgcgtatttttaagctcacgttacaggctgatatcgtcccgtaagactctgacaccaaatatttttagttctttcgatcacgaatcgttgagtgtgggtctttggctgtgccccaaaagacacagttttttggacagagtgttgctaaaacctcgttcattcttcctcataccgacggtgcgcccatgacaacattgcagtccggtgcgactatcattccgttcccttttcggccgggcgtcgtaaagcgcctcatggcacgttccgggttcggggaggcttatgaaagcgattttgccgcccgctggggatttgcccgtgtcactgtggtcgatggcgaggcggataccgatccctacatcgctctgtatcgggagggggaaagctggtctgcctggggcatcgcctatgtggatcagaaatatatgccctggcatggcgcgaccggccgcgatctgggagaattcaacacgcttgatgatgctatgtctgctgtcacgatgtatgctactctgccgctcactgcgccgcggcaagccgatgcgcggcagctggcagttctccgcaaataagggttcagaaggacagaagcctgccacgtctggcgagcagatcctgaagcgcacgaatgactggaaacggttcctgattcatgtttccccccagcgcatcatgggctttctgttcctgttcgacgatccagcgatcctcgctgaagatgcgctcggtaaaccagcccagtaaaggccacgccgcatgcagcagaaaggctgcacgcggcttcttgaccgataacaagccaaaagtccgaatgcgtttctggtccttgtccaccggcacatagacgatccacaactgcatcacccggtccgatttcaggtcgatcgtcaggccttgataaggataatcggtgcggattgtcatcaggctgtcattcggttcggccttgccttcccgcgttccgaaaatcagcctctcccccagtggttgccgccctgccgttcgggcgaaactgtatcgtacttccagccagtcttcgccggcatcatggcccagataacgcggcctgatctgtcccatctgtttccggtgtaaaaactgatggttcatatcaatcaggttttcatgcatgaagctgtaatggcaggcgacctcccgcccgaaacgccgtgtccgataggctgggtcgcttattgatggcagcacaggaagcggggtcatttcagcgcgggccgcatcgcccggaaagatgaaaaccagcccctctttctcctgacagggataggcgcgaaccccgttgggtagtttatccttgcccagatagggtacgtcgatgcaccggcctgacatatcataggtccagccgtgatagcagcagcgcaaacaatcaccctctacaacaccggcatgcagtggtacctgacggtgggcgcagcgatcttccagcgcatagacacgccctgattccccacgcaccagaacgatgggttctccggcgaaatggcgtcctgttgccttgccttttctgatttctccggaccaggcgaggggataccagtaatcgggatcaatgccggtgcggcgcagatcgaacaggtccggtcgggatcgctcaaaagaatcgggcaagaggtcagcctccttttatggaagcaacgcgtacggagccggaatggttgaccgcgcccgcatgttgctgaccatgcggggccgacatctgggcgatcgaactggtgaaagagagcagcgcgtctccggcaatcaggccgccggcaaggacttccaggccggcagtccctgttttccctcgacgggtcacggccagcctgatgacgagcccggcgagtacggcccatccggcggcgctgttgttaatcagcagtccggtggcaaacatgatcccaagctggcggtgtggtccaccaccgccttgaagagcaacaccgatcagcagccagggccagatccgcccgatcagaccgggagcaagaccggattggatcagccctgcgaagacatgatcgaccggggggagtaacccggctttcagatagtctccgccatgcagggccaccagtatgatggcgaccccgaatgctgtcatggcggccagaaactgttgccagcgtccatcccgctcgaaggcgggatcagttccttcgccacgcagcagaaaaccggcccgcaggtcgcagcccatatctccgaaagcaggccctgttgcagcggaaaaaccgaccagcagagccagcgctatcggcggaaagccgatgatcatgcccaccagcagggtcacaacggcggcagcgaaagcgggaaaccaaccggaatgcatggcggccagtccgacaatcagttcatgcatgtaggcggcaaaagcggcgaagattacaaagcccaacatcatggcaggcggcatatgcgtatacagccctcccagcagcgccagcagcagggcgatgcccagatagccagccatgcccagcccaagcacccgccgcagagaaggggcgtcggtcccggtgtcgggtgaacgcggtcgcctaccattgcggatcaacagtgcgccgacctgtaccagtgccgcgagtccagcgccgagcatggcggcatggggtgcactggcggccgccagatcacggcttggcagcaaggcatgcaggggtggaagcgcaaagaccgcatgctgatagccgcgtgtcagtaatccggcagcaaagaaaagcagcgcccatggattgccgataaaagcgacgcccatggcagacatcggcaagcccagccatgatccagtggctccggcggccattccggctccgagggtgacggccttgcgaccgccttcatcaccggccctgatggcttctgcggcggcgacgcctggtggccacggcgcttctgccggaaaaatggccgtcccgaaggtgctgtacatcagccaggcatccagcaacatcgcaagagccgccccggccagcatcggccagacaaggtccggcatgcccagggcccatggaatcccgatgggtaacagaagcgcattggctgcgccgaaggtggaggcggaaatagcgctctgcaccagattctgtcgatggatggagcggaatccaagcaggggctgccacgggatacgccccagaatcatggcagtaacggcacctataatggcggtgttgggggtaacccccagccgtaccagaatctgcattccgacaatgccgcccagaaccgagaggatcagaatgaccagcagcgtcggcagttcactgacacgaggatgggcttccacgcatggggaagagactgtccgggtacactctacgtggatagccgtctcctccggcgcgtaggcgagccggttcgggttctgcttcggatcaggaagaggcacggtcaggggatcacgaaaattctgcctgaaacagggctatgcggggggtatttacccggcgcacagcagcatgaccacagccagcatcagtcccgtcagtcccatccagtaaagagtggtcttctgattgctgacggcgatgctgcgggctgcagtccgggggcgacgctgcatatcagtggtccttcctcaggaggtggatcgaaaacagatgatcagagtcggtccaggtggcggaagcatgccaccctgcctgccctgccagagtatgaaacccttttactgtatgtttgtagctattttctgtgtgaatggtttctccttgatggaaatgaatgattctggagccaatccgggccttttgcgggcgtcggctgaccagatgcatctcgatccggctttcatgatcattccatacggcgcgatgggcaaatccgtccgggtcgagatcggcgccggtcacatcattgatatggttgagaatattgcgattgaacgcggcggtcacgccggcccggtcattataggccggcagcaggatggcaggatccttgcggagatcggctcctaccaggaaacacgcatccggtccggtcagaagatggacatcccgcataaaggcaacagcctgcgccggtgaaagattgccgatggtggagccagggaaaaacgccagctgcgggcggttggcgacggaagccggcagcgattcgagtgttgtgaaatccgccaccaccggctgcacggtcagagcgggatgggagacggacagtctgtttgtcagaccggacagagcctctgccgcgacatcaatggcaacatacgtgttcacgggctttcccgcctcaagcagcgtttccagcagcaggacggccttgtcctccgaactggcgccgaactcgatcagggcaggacagtccgggagatgggatgccagatccgcccctataccccgcagcaaatgacgttcggtacgggtcagataatattccggcagtgtggtgattgcctcaaacaggcggcatccttccgcatcataaaacagctttgcaggaagggtttttctgatgcgggacagcccatccagaacctcctgcataatctcgtgaactggttggacgggggaaggctggaccaaatcatgactgacactcggcatgtgttccggttcctgattgttcaaggagatgaaggggaaggggtcaaaggaggaatcgcctgatcgatatcgcgggccagcctcagaccgctgaactgccatcgcctgtcaggatggaagaaattccggtaggtgtttcttgcgtgcgacgcgggtgtggcgatggaactgccacgcagcaccatctggttgatcatgaacttgccgttgtattcgccgatcgcgcccatgggtggctgaaagcgtgggtaaggacgataggcgctggcggtccattgccatacccgaccgtgcatatcattcagccgctggtcggaagccgcaatttcccattcctgctcggtcggcagtcttgcaccagcccagcgtgcataggcatcagcctcgtaccagctgatgtgacggaccggggccgtgttttccagcggcagcaatccgcccgggcccatctgcatccagcgtccgttctgctcgatccagtaaagcggcgcctgccagtggcgggcgatttcatagccttccatcatccagaaggtgctgttccggtatccgcccgcggcgataaaagctttccagtctccgttggtgaccagatcggtggccagttgataaggctgcacaaacacgtcgtgggcgggggtttcgttgtcgaaggaaaatccgggctggctatgaccgatgggcctcaagccgccgccaagcgtgatgaagccgtcggtgctgaggcctggcctggggggtggcactggtgtgtcctcccagcctggcagcatggcggggtagaggggactttgtgcaaaagcatgcagcatatccgtgaccatcagctcctgatgctgctgctcatgttgcaggcccaactccaccagatcggccagttccttcgaaagttcctcctgtcccagcaggcgtagcatcgccatgtcgataacatggcggtattcgcggatggtgatgcaggatgggcggctcagcagaccgcgttgcggacgcggatgacgtgcccccacggcctcataataggaattgaacagcagattgaaggcgggaaaacgatcttcgtaatcatggtcgtatggtttcaggatgaaggtctcgaaaaaccagcttgtatgtgcgcgatgccatttgaccgggctggcatccggcatggactggatacactgatcctcatcatccagatggctgctcagccgttcggtttctgaccggacctgcctaaagcggcgtgtcagaggaggctcagagccagacatgcatcctccatctttcttgttccggtggaggatgcaaaactcctggttgcccatgaagttccggcttctgatgtgctgcgaagccgctatccgatcatgggccgccatgctatccggagacattgatttaaagatgaatggctttacatgactgatcatactcaagctgcgcctgatacagagcatgggcaaagcccgttcgagcaggaaatggcgtcccttatcgtcgaaaccctgcatctggaaaccagaccgcaggatatcgcaccggaagcccggttgttcggagaagggctgggtctcgacagtatcgatgcgctggagctgtcactcgccatcagccgcgcttacggcgtcaatctgaaatctgatgatgcggaaaatccggctatttttgcctccctgcgggcgctggcggctcacgtttcagcgcatcgcgcctgatttttcatgacgtggcgggatgtgcgacggcgggcggccctgctcctgctgatcacgattctgtgcggatgtgctgcggaggatttctcccgcctgcatccgcatacagaggcggaggagcatgcctatacacgcctgttcccatattatgtggatatctgcgcgacgtcccagataaaaaaaaagccgggatttggtgcatctgatcgcggtggtgtgggcggccatatgggcttcttcctccgcggcgcctgtgcggatcgtgatgcccattacccggtgctgcatctctgtcgccccggtgaggaagatggcgttggcatcggtatggatgcccatttcagctctgccaaatggtctgcggcgcgggggcgcagctttttcttccatggcgggatgagtcccgacgaaacactgacaccggcgcggtatacgcagatcctgcaacaggcacggcagaatggagtgctggatggtatttcctttcacgatgaccggttcgatgaaaaacccgccgctgtttcagaggaggattggaaatatcagctgacggccggcactgatttcgcgcttggtatggggcgcggcagctattgcgcgcgcgtgccggtctcgcagaaagatatgctgcaaattattgatttcatgaacgcacagaacgcgccttaccgatccggcaaggaagtgttccggtggagcgtttttacggataattgcggtcatctggcccataatgcgctcagtgccgccgagtattggcctgaatggccgattgacaggcctatgctgctggcgatcttcgactttccggttccgaagaatgagtatgtgaatgtcatgatgcggtcgcagtctttgccgcttgaggacgtggctgccctgtatcgtgatgatgatatccgggccatgcttctgagcgaaaatcgcctgcctcccggtccgggcgtgctgtcggtgttcgagcctccgcaggcgcggaatcaggtctacgatgtcgataatctgatgctgctgttttatgatgaggccattatcgggcggtatcgccaccgttttcaggatatccagtcggagcctcgtttttacgatctgcacgccaatattctttggtggcatgatcgatatgcacagttgattgcctcccgccacccggcggagtggtggttgcagcgtctgaccttgactccggccgggcgggccgatttcaggattttttatgatcggtactacgaatatctcgatcgccagcttgattggaccacgcaggcactgcaccagctggggaattaagtctgatcaggatctgcgttcagtcgtgatgatcctgaaaagctgatcgaatgtcgcctcttcggcttggcggggcagaatgaacggtgcaggcgcaccaaatcgcgtcagggtggaggcggtttggtgcgcaggaacgggctgggacgaactttcgttcaataccagccagtcgacactcagccctcgcgcctggagggcagagagagcagtcagcgtatggctgattgtgccgagataggttccggcaaccagcagaatgcgcggctgtaatgctgcgatccagtccagcacagtgtgagaatggtccagcggcaccatcacgccaccaacaccttcaatcaatacctgcccggtacgtggtttcgcgcagtgacggatcagggcatcaaaggggatgctccgcccctcctgctctgccgccatatccggggagagaggggcggcaaatcgccagggcgcaatctcatcaaggtcgaggtcatccgtatccggtccttcctgtagcgctttcatcagcagatcggcatcggtggggggatgggccgtgccgctgagtaccggctttaacgcctgtatctgctgtccggcccggatgaaagctttgatcaaaccggctgtgacatagcttttgccgatatccgtgccggtggctgtgatgaaaacagggcgcaggacgggatcagtcatggttgtgatcatggtccgcatgatggacctggccaggaagaggagagaggcggcatggatggtcgtcggagcgtaagccggtttccatctgcactgtcgcatgcgagataccgaaccggtcgctcaaccggtgctgaatggcatcgagaatacgatcccggtcctcgcccgtctcctctccggctccggtcacggcatggagggtgatcagccggtcattcccggtcagggaccatgcgtgcaggtgatgaacgcgctgtacacctgggatggtgtgaaccagatcactggcaatggcatccagatcaatatcggccggagtgccctggagtagtacatgggccgatcctttgaccacactcacggcaccgcgcaggatcatggcggcaaagatcagtgacagcagtggatcggcgatcacccagccggttatcatgatgatcagcgcagccaggatggcagcggcaaagccgaacaggtcgctcagcacatgcagccacacgccgcgcatattaaggctggattcccgtccttcattcaggatgagcagggagatggcgttggccaccagcccgaccgcggcaacggccagcatcaggccgccgccaatcggttggggattcagcaggcggcgtactgcctcgatcacaatccatatggagacaatcaggagggaggagccattgacgaaggctgccagcacttccaaccgccggaacccgtagctgtggcgtgtgctggagggacgccggccaatgcgtaaggccgcccatcccatcaacagggacagtacgtcagataccatatggcccgcatcggccagcagggccagcgatccggacagcaggccgcctacgatttcagcaccgagaaaaaccgtgagaatcattccggcaagggccagtctgcgttcgtccttgacccccgcactatgggaatgccccaacgcaccatgatcatggcccgcatggccgtgatcatgatgcgtatgggaatgagaggccggcgtgatgatggcttcggtcatggtgaacctctatacgctttcttaaatatatgaatacatattcatgtatgtgcggtcaagtccatatttcccgatggtcatcctgctgtgtcagacagtaagggcctgatcaactctgccagacgcatgatgtcgctgtcaggggtcagggcagtgaaagtcagccgcagacgggctgttccagccggaacggtggggggacggattgcggcagccagataatcatgctccgccagcatcgccgaggcagacagggccgcctccgcggagccgagcaggatcggcacgatagggctttgtgcatccggcaggcttgtcagacgggtaaacagcttcgctttttccaatggctgcatggtcagggcgggatcggcggctatcagatccagtgctgtgatcgccgctgccagcgtgccggggggaaggcctgtggtatagataaagctgcgcgcccgattgcggatcagcgccaccaccggcgcggaggcacagagatagccgccatacgcccctaccgctttggagagcgtgcccatctgcaacggaacgtcatgaccgtatgcggagccgtgcccctcgttcaatacaccgattccatgggcgtcatcggtcatcagccatgcattgtatcgtgccgagagttcaaccagcgctgacatcggggcgagatcgccatccatggagaatacgccgtccgtgacgatcagcacgtgatcatgttgagggcgttcctgttccaacagcccggccagcgcctgcatgtcgttatgcgggaaccgtatcgtccgtgcatgcgccagagcagcgccggcatggatgcaggcatgagcaagctcgtccaccagaataaggtcgttgggggcgatcagggccggaataataccgatattcgccagaaagccggaaccgaacacgatggcggcctcggtgcctttcagggctgccaatctgacttcgagtgcggtgtagagcgggtgattgccggtcaccagccgcgatccgcccgcaccgaccccgaactgagcggtggcgtcgatggcggcacgaatggtggcgggatgagtagagaggttgagataatcgttgcaggacaggctcagcatccgtcgttccccccgcatgacccacgggctgctgtctcggccggtttcatgcagcacgcggctcaactgtcgtttttccagcgcggagagcctgcgtgcggcgaaatcgtccagagtctgcatcggattaccctgcatggtgcgtcgactccctttcccccacagaggggcaggccagaggggaaggctaaggggcaggcgggcggaggaatgcgtgacagaaacatttcatccgcttcggaactgctttagtctggttcggctgatgaacggttataaccgcctgttccggaatggaagtgatgcccgatacgaatctcccctgccagagtctggctgactccgccctgtccacgacgcgggaggcgggggctgaagccgtggtcatccgtcacgattggagcagggaagaagtacggtccctgctcgatctgccattccccgaactgctgttccgtgccgctgcgatccaccgtgcctgttttgatccgcgtgaggtgcagatctcgaccctgctctcgatcaagaccggcggctgtccggaggattgtgcctactgcccgcaggcagcccagtacgataccggggtcgaggccagtcgtctgatgcgggtcgacgccgtgctggaggaagcccgtgcggcgaaggccgccggagccagccgtttctgcatgggggccgcctggcgttcccccaaggagcgcgacatggacacggtctgtgagatgatcgagggcgtgaaggcgctgggcatggaaagctgtgtcacgctcggcatgctgacggatcagcaagccctgcggctgaaacaggccggactggattattataaccacaacctcgatacgtctcccgagtattatggcgcggtcatttcaacccgcacgtacgaggatcggctggaaacgctggctcatgtgcgggatgcagggatcaatgtctgctgtggtggtattctggggctgggcgaggggctggatgaccgtgccggcctgatcgtggcgctcgccaacctgccacgtcacccggagagtgtgccgatcaatgcgctggtgcaggttgaaggcaccccgctgaaagggcaggagccggtcgatacgattgattttgtgcggatgatcgcggtcgcccgcatcaccatgcctcatgcacgggtccgtctgtcggcggggcgcgaggctatgaccgatgaggcgcaggcgctgtgtttccttgccggtgccaactcgattttctatggtgagaagctgctgacgaccggcaatcctgcggcggagcgcgatcgggcgctgttgtcccgcctgggtatgcggctggtctgaccggtgagcatcaggcgtgatgtcgccatcggatcaggcagacggttcccgtctttggctgccgtatacgcagatgcagattgctgctccgccgctgcgggcggcgcggacttatggtacccgcatcgtgctggaggacgggcgcgaactggtggacggaatcgccagttggtggaccgcctgccacggctataaccaccctgcgatcatggaggcaatgcgggagcagctcgcccggatgccgcatgtgatgcttggcggtctggtgcatgaccctgccgagacgctggccagccgtctctgtgccattgtgccgggggcgatggagcgggtgttcttctccgatagcggcagtgtcgcggttgaggtcgcgatgaaaatggcgatccagcactggctgaatcgcggagacaggcggcgtagtaaaatcctcgcttttcgcggcggatatcatggcgatacctttgccaccatggcggtgtgtgatccggaagaaggcatgcacagcctgtttcagggcgtgctgccgcagcatgtgattgctgatctgccttgtgatgacgcatcacaggcaaggcttgccgacattctgaaccggtatggcgatgaactggccgccattctggtagaaccgctggtacagggtgcaggaggaatgcggtttcatgcaccggacgtgctgcggtgtctgcgggcggcagcagatcaggcggggattttcctgatcctggacgaggtgtttaccgggttcgggcgcacagggagcatgtttgcctgcgaacaggccgggattgccgccgatatcgtcgtactgtcgaaagcattgacgggcggggtctctcctctggcggccacgttggcgaatggaaaggtgacggccgctttctggagcgaccgaccggaccatgcgctgatgcatggcccgacctatatggggcacgcgctggggtgtgctgccgctctcgcctcgctcgatctgttcgtgcaggaggacaggctggcgcaggtcgcagccatatcggcccagctggaaaccgggctatccccatgtcgtggcagcaggctggtgcgcgatgtgagggtgatgggtgcgatcggcgtggttgaactcgatccgatgccgcctctggctgatatcaaggcccggttggtggagaggggcgtttgggtccgtccattccgtaatattatttatctcaccccggctctcatcatcgggaaaggtgatctggcccacctgaccggcgcggtgtgtgccgtggtagatgaattgaaggcttgcaagaccgcataaaaaagaaaaggccgcggaacaccgcggccagtcatcttggggtcgtcgcagaatttatctgcccgcttatcagtcccatcataatccagataggcctttgcaggtgctatccgatgatggctgataaacgaattacttcgtttcggcgcaagcgtaagcgttgatctcggcgcccagggcaacttcgacaaccttcggggtattccaggccatgatgttctccatggattgataaagtaatccgcctgattattcaggcgtgctctctacataagctgctctcatgaaaggtccaatgaattattctcgggatcatcatcggtctgttcgatcaaccacgtctttcaggcgattctgaacccttttcgaggggtgtcggcatttttcgctgcatggcaggggacttttttctggctgtggatgctggacgggatggtcaggaaagctctgactcaccttcttgtgacgaaatgtggacagatatatgtggctcagcaggatgatgcttcgatggaaggccctgatcgcgctaggggcactgatgggtgcatggggcatcatgattcaggtggggtatgctcataagcccttgtcgcatccgcctgtccacgcccagcccgccgccacatgcgttgcccgtgcgctcgatggcggacagagacgggaattcacccgggccccggtgcagcctcccggaacgctgaccgatccggaggctccccggccagtctatcgtctgaccagccattgttaccccgatcttcaggcggaggccgcctgtcccaccgaatatgggcctgatgcgcatctggccgaatggttcgatattgcgcctttgctggcgaaaaacgctgaagcggcgcaggcgctgggctttgcgatcggggatctggcatggctcagtgtcagccatttcagctatgacaaggggatgcagtattatctgacccggctggacacgccgccgccagaggatgcactgatccgtcaaaccgcgccgcatggctggattgtcgggcaatggaccgggctggctctgccttccttatgtgagatcgggatcagaccgctgccagctccgcaggaataacggttctctctcttctcatctctggcgaggatcggcgacgggatgtaaatagaatcctgatcgcatgaaccgaggatgcaggcatcgtgagagttctgattcttggcagcggagtcgtcggcgttgccacagcctattatctatcccgggaagggcatgaggtggtggtggctgaccgccgggacggtccgggcatggaaaccagctttgccaatgcggggcaggtatcccccggctattcatcgccctgggccgcccccggtattcccctgaaagtgctgcgctggatgacgcagcctcgcagcccgttcgtgcttcgccccaaactggattgggcacagtggcgctggatgacgcagatgctgggaaattgcaccgcgaatgcctatgcccgcaacaaggcccgcatggtcaggttggccgaatacagccgtgaccagttgcgcgatctgcgtgacgaaaccggtattgcctatgataaccgtgaacgcggtacgctacagcttttccgcacccagaagcagatggatcatactgcggatgatattgcggttctgaaatcctacggcgttgcttatgaagttctcgatcgtgccggatgcatcgccgcggaaccggggctgcaatgggcacaggttccgctggtcggcggcttgcgtctacccggggatgaaaccggtgatgctcatctgttcacgcgggaactggcccgtatctgcatggaacgcggcgtttccttcctgttcggaacgcagatccatggattcagcacgcagggcgacaagattacggctatccgttcctcacggggagatctgatggcggatgcctatgtctgtgcgctgggcagttattcaccgctgctgctgaagcagatcggcatagccgcgccgatttacccggtgaagggctattcaatgaccattcccatcacggatgaaacccatgccccggtctcaacggtgatggacgagacctacaagatcgcgattacccgtctcggcaatcgtatccgcgtcggtggcacggcggagctggccgggtacgatacacgtttgcgtcaggaaaggcgtatgacgctggagggatccgtaaaggagctgtttccggattccggcgatttgccagcggcgacattctggtccgggctgcggccaatgacgccggatggcacccccattatcggtccgacgcgctatcgtaacctgcatctcaacacggggcatggcacgttgggctggactatgtcctgtggctccggtcggttgctggcggatatgatcagcggcaagcgccccaacatcgaccatgctgatctggcgatcgcccgctacgcaggctgaggccccggatcaattctgacccgcacaggagcatttgatgcaggctactgaacagactgctgaaggacgacggctgtctgcatcgcagcaatggcggcgctgggggccatatctcagtgacaggcaatggggcacggtgcgggaggattacagcgcgcatggagatgcctgggattatttcccgttcgaccatgccggtgcacgggcctatcgctggggcgaggatgggctggcagggtttggcgatgatcggctgtactggtgcctcgggctgggattgtggaacgggcgtgatccgtttctgaaagaacgcctgttcggcctgaacaatgcggaaggcaatcacggcgaggatgtgaaggaaatctatttccacactgacggcctgccgagccacgccttcatgcggatggaatacaaatatccgcatgcggcttttccgtatgaggctttgcggcgggaaaacgcggcgcgcggtctgcatgatcccgaatatgagattgaagataccggcatctttgcagagagccgttactttgacatcgacattgtctatgccaaaggagatgcggacgatattctttgccggatcaccgtacttaatcgcggcccggatgcagaggatatccatctcctgccaatgctgtgggcgcgcaacatatggagctggaagcccgatgcggagaagccatccctgacgatcatcggcccccgcagcgtttccgccgaacatccttatatgccgaccatgcgctgggatgtggatgccgaagatgcaacgctgttgttctgcgagaacgagacggacccaactttatttggacagcccacgcgtccttactgcaagaatgccatcaatcaagcggtagttgcaggcaatgcatccgccgttaatccagcacaaaccggcacgcgttgcgccgcctgggtgaagcgccgtctggctcccggtgagcaatgcttgatccgtctgcgtttttcagttcatacgcaggtggttgatccgtttgccgattatgatgcggtcatggcccgccgtcaggatgagtgtgatgaattttatgaagctgtacaaaagaacatttctgatccaaacctgaaacgcatccagcgtcaggcattcgccggaatgctgtggaccaagcagctttattattatgatgttcatgcctggttgaatggcgatccggggcagatccagccacctccctcccgaatgctgggaaggaatgcggactggcagcatttcaatgcctgcgatgtgatctccatgccggataagtgggaatatccgtggtttgcatcctgggatctggcctgtcactgcgtcactttcgcactgatcgatccggattttgccaagaagcagcttctgctgctggtgcaggactggttcagccatcccaatgccatgatgccggcatatgagtgggagttcagcgatgcgaacccgcccttgcatgcctgggcaacatggcgtgtgtactgtatggagcaggagcgttgcgggcgcggagaccgccagtttctggagcgtatgtttctgcgcctgacgatgaacttcacctggtgggtcaatcgcaaggatgcggacgggcgcaatatctttcagggtggctttctggggctggacaatatcggtattttcgaccgttccaaaccgctgccgaccggcggacatatgagccagtccgatggaacggcgtggatggcctcctatgcgctgaacctgatgcggatcgccatggagctggcggttgaagatccggtttatgaagatctggcggggaaatatttcgaacatttcctgttgatcgcccgggcggcttcccaggaaaatggattatgggatgagcaggatcagttcttctacgacgttctggtgctgcctgacgggcagaggatgccgctgcgcatccgctccctggtcgggctgattccgctgctggcggtggccacatgggaatcagaaaccgtagagcacttgccggattttcgggccagaacacactggcttctgcaaaaccggcctgatctcgcaaagctggtgtcacgttgggaggagccgggcggtgggcgttcggccctgctatcgttgttacgtgggcaccggatcaagaagctgctggcgcggatgctggatgaggaggagttcctgtctccgcacgggatacgtggtctgtcacgttatcatcgcgatcatccgtatgttttctcctacggtggtcatagcgtttcgttgcactatactccgggagaaagcgatacgggcctgttcggaggcaattccaactggcggggtccggtctggatgccggtcaatgttctgctgatcgaggcgctgcgtgaattccaccgttactatagcgatgatttccgggtgcagtacccccctggcagtgacagcacagcatcattgaaagacctggccgatgagttgtcacatcgtttgatgacgttgtttctgccgggggaaaacggtcgaatcccggctttgggggacagcatcctgttgcaggatgatcccgggatgaaagggagaatgctgttccatgaatatttccatggtgatagcggacgcgggttgggagcttcgcatcagacgggatggaccgggatggtggccttgctgatcgacatgttccaccatacccctgaagaaacgggtgtatgacgatgtatttgaaaagcttgggaaaatgcctgcaatctttgcgtggcaaagccattccggtgctggagctgaaaggtattctgtcccggcgcggaccactgtctttcgagacggtcgaacccgctatccgcaaggcggcagcactggctgagaagcgtggtgcgctgatcctctctatcgacagtcccggcggctcgccggtgcagtccgatcagatcgccgccctgatccgacgcgaggcggaggagaaatccttccgggtctatgccgtcattcaggaggtcggagcctcgggcgggtattggctggcctgtgcggcggatgagatcatggccagcccgatgagcattgtcggctcgatcggcgtcgtgggcggaggtttcgggctgaaccggctgatcgagcggctgggtatcgatcgccgcctgcatacggcggggcaaaacaagcgccggggtgatccattcctgccggaaaagccggaggacgtggccttcatcgccgggctgatggaggatatccatgcctcattcaaggactgggtcaggcagcgtcggggcgcccgtctgaccagtgatgagagtgccattttcgatggcggctacatgctgggccgtcaggcggtgacgctgggtctgatcgacggactgaccgatctgacagctctggtggagcagctgggcgggaagggggcacagccgaagctgttccgtccccgcctccggcgggggctgctgtcccgtctgccttcgctgagcgcaggtgccctgctggatgccatggaggaaaggcggttggatctgcgctgagccgcttgatcaggtgacgcgccgcttttccagcttccgcgccagtgtgcggcgatgcatgcccagccggcgggcggtttcggaaatgttgaagtcggtctctgccagcgtttcgtgaatacgctcccattccagtgtcttgatggaggtggggcgggcactgaccggaacggaggaatcaccgccttcttcccgttcgaaggcggcgatgatgtcatccgtgttggccggcttgggcaggtagtggcaggcacccagcttgatggcctcgacggcggtggcgatgctggcgaagcccgtcagcacgacgatgcgcatgtcggggaaacggtcatgcagaatccggacgcattcaagcccggagccaatgctcagcttcagatcgaccaccgcgtaagaaggcttgttgccatccagcgcgcggtcgattccgtcctgagtctctgaatggaagacgcggtagccccgccgctcgaaagaacgccgaagcgttttggcaaaggtcgcatcatcctcaataatcagcagggcagggtcaatctcgatcggttcagtgttcatagtcagtgctctccgtcggccttatcctctatcaccatggccgccaggggaagctgcacggtaatggaggctcctccgcctttccgattggtggcatgcacggtgccacccagtttgcggatgacattggccaccagaaaaagcccgacaccactgccctgctttccctttgtgctgcgataaggcttgccgaaatcggcaaggatcgtgtcggtaaagcccggcccttcatcctgcacgacaatggtgagggtgttatcctgttttctggcggtgacgccgatccagccaggtgacgcttccagggcgttatcgagcaggttgaacaagacctgtttcagcgcgatgtcagaaacaatggcggggtcgggggtgatgccgatacgcacatccagccgggaaggggaacatgcttcccgccattcctcgatcgtgtctgtcagaaaggctgaggctgtggtgcgtagcgtgccctcgccgcgcgcatcgccggaggagagcagaatatcggacacaatggatttgcagcggtttacctgagcctgcatctcgataatgtcgtcgccaagctctgcatcattatgcaggcggggcatatgctgccagtcattcagaatgacggagagggtggaaagcggtgtgcccagctcatgcgccgcgccggaggcgagaaggcccatgcggacgatatgggcttcttcggcattctgctgtcgtaattccgccagataggcgtcacgctgcttcaggttgcgttgaatgcgtgagacgaaaaaaacctgcaggcaggctgccagcacgaagccgatatacatcccctgactgcggaggtggaagggcaggacatctccggagccggacagatgaaacggaatggcccgcattgtcagaaagatgaagcagaggctggtgacggccaccaacgcccaggcgaaccatgcatccagcaagacggtgccgagaatgacctgaagcaggtagagcgagataaacggattatcagtgccgccactgagataaagctgtgcggtcaaggccgagacatccagcagaagggccaagaaaatctctgtgttgctaaggattttctgtgaccggtagcgtatcagatcggtgatattaagcagcagcaggcagatcagcaccgcactcatcgcccgcaccggtaaagcaataccgagcaggcgatgcacaaagacaatagtcacaatctgtccgataatggccagccaacgcagctggatcagcagcaggaaattgcgtctgttcgtggtatctgcaaaatggcccctgctcacgcgctttcccgtcccgacgatctgcaaagcgtgcattatcccggctagagcaggaacagcgcaagatcactccctgttgaacatgtcagcggcttccggcttcgtgggtctgcagcacggcattggtgacggcatctatctcctccagcctgacttcgtaaccccacaaatccgccagcctctgaagcacgagggttgcatccccactctccagcaggattccgttatgcacgcgatgttgcaggatcaggcggcggtcaccgacgagatcgacatccacgacttccagttccggttccatccgcaccgtatcgaactgatcagccagcgtgctgcgaatggtgcgatatccacgttcgttatgaatggagcggaccagaaggtcagatcggctatcgtcatgcagcgcaaacagcttgagtttacggatcagccgcggactgaggaattgtctgataaaactttcatcccgataattttcccatgcttctttcagcgtttccagaccggccttgtttccggcaatatccgggaaccatgcacgatcttcctcatcgggattttcgcatatgcggacaatatcctccatcatggcaaagccgagcgcataaggattgatgccggaatagcggcgatcatcgaaatccggctgaaatacgacactggtgtgggaatgcagaaattccagaaacgcaccttcctgcaaaaagccctgttcatgcagccggttcatgatgctgtaatgggtccaggtggcgcagccctcattcatcaggcgcgtctgtttctgcggataaaaatactgtgcgacatgacgcacgatccgcagaatctcccgctgccagtctttcagcagaggtgctttcttctcaagaaaataaaggatgttttcctctggtagtcccagaagagattgtcttgccgcccgttcgctcaatcctgacgttcccccggagcgaccgggcaaagtgcgccagagatcgttgaaggtacgctctgcctcggcacggcgttccgcttcccgcctggcctcatcctgcagggtcggaagattgcggcgtggatagcggctgacgccctgtgtcatcagggcatgggccgcatccagaagccgttcgacctcttcctcgccatagcgttcttcgcagcggctgatatagctttttgcaaaatccatataatcgagaatgccgcccgcatcggtccattgccggaacagcgcattgtttttaaagaaatggttatgcccgaacgcggcatgggccatgaccagcgcctgcatcgccatggagttttcctccatgatataaacaatgcagggatcggaattgatgacgatttcataagccagcccctgctggccattacggtataatgtttcgtcccgtgcaaagcgcttgccgaaagaccagtgccgatacatcagcggcaggccgatagagctgtaagcatcaagcatctgttcagaggtaatcacctcgatctggttcggatagacgttcagacccatttcatgcagggcgatcttttcgatcctgtcatagctgcgctgaagctgatcaaagctccagtcacggccggaggcgatgcctggttcgggagcgttcatgcctccacctcgttgatgctgtcgcgtgtggctttgtcacgggtaaacagctgccggaacacgggataaatctgcccgcggtggctgacgtggcgcatggccagtggctggtctgattcagccacggttttgtaggcgcgccataactccgtgtctccaccgggcatgttttcggcacccacctcaagataggcgaaatactggcattgcggcaaaatctctcgcgttaagagggcgcaggcatggctgttgtcggaaggcaaattatcgccatccgatgcctgtgcagcataaatattccagtcctcctttgcatatcggtccttcatgatggccagcattttttccagcgcggtggaaacgacggtaccccctgattcagtgctggtgaagaaggcctcttcatccacttccttcgcgacatgggtatgccggataaagacgatatcgacatgtttgtagcgacgactgaggaaaagatagagcagcttgtagaaccgcttggccagatctttcatatgttcggtcatggagcctgagacatccatcaggcagaacatcacggcgctggcagccgggcgcggcacgctttgatagcggttgtagcgaatatcgatcggatcgataaacgggatacgccgcccgcgggagcgtgcctgttcgatcctgtgccgcagttctgcctgtcgttccggatcggtcccgttttcgagcagacttgccagttcacgttcttctgcctcggtttcctcaaggcgggggcggcccagcgcaatgcggcgagagaggctgttgcgcatggtgcggaccagattgacattggtggccgatccgctgatcgcatatcccgcccggcggggtgtcgcttcctctgccgagcgcaactgacggcgcagcagatcgggcagttccagatcttccagaaaaagatcgagaaattcgtcctgtgacagggcaaaggtgaaggcgtcctctccctcgccatcaggcgctccctcccgcccttttccacgacctccgccgccctgacggcggatctgatcaccttccacaaactccttgttgccgggcagcacatgggtacggtttccggtgccggatgcatggtgcagggtcggctcgcgcagggcatcggtattgatccggataccttcgccgacgccggtttcccggataccctgacgggcggcggcatcgcggactgcctccatgatctgccgccgtgccttgcggataaaacgctgacggttggccaggcttttgccacgtgggttcagcctgcgatcaacaatattcaaatcctgcctccgatcggcgggcgtctcagcccgcctgcttcgtgcgcatataccattccaccaggcgccggacctgccgctctgtatagccgcggctcatcatgcgctggacgaactcggtatgtttcttctctgtctccgcttctttcttggagccaaaagaaatcacgggcagaagatcttccacctgactgaacatccgccgttcaatgacctcccggattttctcatagctggtccaggacggattgcggccgccatgattggcacgggcacgcagggagaacttgacgacttcgttacggaaatccttgggattggcgatcccggcgggtttctcgattttggtcagctcctgattaagcagctcacgatccatcatctggccggtatcagggtctttgaaatcctgatgctcgatccaggcgtctgcgtaatcgacataccggtcgaacaggttctggccgtaatcattgtagctttccagataggctttctgcacctcatgaccgatgaactcggcatagcgtggggccagttcggccttgatgaactccagatagcgtttttcagtgtcctgggccagttgctcacgccggatcgactgttccagcacatacatcagatgcaccggatcggccgcgacctcctgcgtatcgtggttgaaagtcgcggacagcaccttgaaggcaaagcgggtggaaattccgtccataccttcatccagcccggcagcatcacgatattcctgtaccgatttggcatgagggtccgtttctttcagactctctccgtcatagacgcgcagtttcgaaaacaggctgccggaagcgggcggcgtcagacgtgacagcactgcgcagcgcgccagcatttccagcgtgccgggtgcgcagggggagctggccagatcactgtttcggatcagcttgtcgtaaattttttcctcttcggtgacgcgcaggcagtagggaaccttgatcacgcagatccggtcgataaaggcttcattattcttgttattacgaaagctctgccattcgctttcattggaatgggccaggatcacaccctgaaacgggatggcgccgatattttccgtgccgacgtaattgccctcctgcgtggcggtcaacagcggatgcagcatcttgatcggtgccttgaacatctccacaaattccagcatcccctgcgtggcgcggttcagaccgccggaaaagctgtaggcatcgggatcgttctggctgaaatgctccagcatgcgaatgtcgaccttgccgaccatgctggaaatatcctgattattttcatcgccgggctcggttttcgcaacgccgatctggcgcaggcgggatgggtagagcttggcaacccggaaccggtcgatattgccgtcaaactcgtccagccgcttcagtgcccacgggctgagcagcccggtcagacggcggcggggaatggcgaacttgtcttccagcagcggtcccatcgcctctggatcgaacaggcccagggggctttcgaaaaccgggctgatcgctgttcctgctttgagcacatagatcggctcctgctccatcagggctttcagtctctcggcgagcgacgatttgccgccgcctaccggaccaagcaggtagagtatctgtttccgttcttccagaccctgagcggcatagcggaagaagttgacgatccgctcgatcgtttcctccatgccgtagaattcggcaaaggtgggatagaccttgatggtgcggttcatgaagacgcgtcccaaccgcgcatcccgggacgtatcaatcacgtccggctcgccaatcgccttcaccatgcgttcggcggcggttgcgtaggtatcgggcttatcccggcagagcgacagatattcgctcagcgacatgtcgacttcacgacgggtttcgtaagtgtgcctggatttggaaaacagatcgtccagcaagctcatgaagggcggctccgtgacgtttcgggtgacagtccgacgctcccgcgtgggactgtgcagtccgtccggtatcagcctgcctgagatgccgtatcccgtgggagggaacggtatgcagaaaacggcgataccgaaccgccatacgtcgtccgcaacaatcgcgcatgtctctgttccggacggcgcaggctgtacttcaacatcccatatgtgggagcgcggcctgtcctgcagcaggggagggaggaggaaaaaaagcgatttctgcgcttgcagaatgatcgcacccgtcagggctgctccgccgaactcctgaactgatggaccgccggatcgtcccgcatcatggaacttctgaaacacagcctagcagtccggtagaggcatttcgcaactataatcggagacattccacatttttttgcaatcactgtgtcacgtcggcgctgtggtctttgggacacggtttttaacaagggcgattgtctatggccggctttattcagcccttttccagggcctgatcgagatcgcggagaatatcgtcgatatgctccagtccgatcgacaggcgcacataactgggggagacgccggttgcggcaagagccgtttcatccagttgggaatgggtcgtcgtggccgggtgaatcgccagactccttgcatcgccgatattggcgacatgcaggaaaagcttcagccggtcgatgaagcgacgccctgcttccgcaccgcctgccagttcgaatccgaccaggccacctttgccgccaggcaggtatttatcagcccgtgcccgtgcggctcccgtctgatggttcgggtggataacacgaatcacctcctttctgctggccagccagtctgcgacaatggaggcattgcggctatgtgcgtcgatccgcagaggcagtgtttccacaccctgtagcagcagaaacgcattgaaggggctgatcgccgcccccagatcgcgcaacagggtcgtgcggattttgacgatgtaggcgaccgggccaagcgccttggttgcttccacccacaccgcgccgtgataactgggatcaggctggttcagtgcgggctggcgctctggataagcggcccagtcgaactgcccgccatcgacgatcagcccgccaatactggtgccgtgaccgccgagatatttggtggcggaatagacgactatggctgctccatgctccagcgggcggatcagcagtggggccgccgtgttatcaataatgaggggaatgcccagcggacggcccagtgcggccacctctgcaattggaaaaacgtccagctttggattgggcaggctttccgcataccaggcgcgggtacgatcgtcgctggcacgtacgaaagcggccggctcggtggggtctacaaagcgtacctcaataccctgatcgcgcagggtatgggcaaacagattccacgttcccccgtaaagatcggtcgagctgacgatattgtcgcctgctctcgcaaggttctggattgcgtaagccgaggcagcctgaccggaggcaacggcgagagccgcagcgccgccttccaatgcggcaatgcgctgttccagcacgtcattggtcggattgccgaggcgcgtatagatattgccgagctgcctcagcccgaacagatcggcagcatgggcggtatcatcgaactgataggatgtcgtctgatagatcgggacggcaaccgcacgggttgccggatcacggcgccagcccgcatgcaaggcgagtgtagccggatgaagctgttcgtcttttccgctcattttacaccattttatggttaatattttatatcaccatacatcatggtttatccgttgcaatgcttaacagcctcatgagtcaaaagcttgtgttgcgcaggtgcaacacaagtcatcggtcgggttatttatttgtgcggtgcagcaaaaaacaaggtttgggccacggtcttacatcacttcagcacaatgtgttgtgcaaaaatgccacagtaacgtgattaccgcagaatgaccttctgttaatcttgacgatgcctaagcggtatggtcggatcacgaaataataataaaccgaaatttggggggtctttaaatgtcgataaagttctcgacatggctcaaagtgagcactgttattgccgtgggcgctggttttgcagttaccccggccttcgcagatgattataccgatctgctgaacattctgcgtgccaagggcagcctgacccagaacgagtatggcgccctgatggccaagcatggcacaggctcccgcgctgtaaagggccgtacatcccgcgccgcccaggcggatggagcttctgatgcgcaggctgctgccgccagcgccgccgccagcgctgctgctgctcaggccgccgcccagtctgcccagtcctccctgcaggcatcgaacatcatccgcagcaagccttatgtgccgggcaaggggatcaccatccgtgccggtgacatcgacctgaacttctccggctttgtgaacgggtactatacctacagcgccggcgcgacaggcagcggcaaggtgggtggcggtcttgcagcccccaatggcgactcctctgccatccgtgacggcctgctgcccgcagctctgatcttcaaggccagcaccactcaggccggtatcgatatgtctgccgtgtttggtatttacccgggcattaacagctccaataccggcacgatcttcggtgccaatggtggtgggtctgcctatggcctcagcacagccggtattgatttccgtcaggtctatgtcaccgctggcacgaagaaattcggcacggtcaaagttggtcgtgacctgggcatcttcggttctgatgcgatcttgagcgatgcgacgctgctcggtgtcggtgccgccggtggcaacacgatgcctggcaataccgcgctgggccgtatcggtatcggttatgtgtatgccgactggctgccgcagatcagctacgcctccccgactttcggtggtgtgcagatcaccgtgggtgccatgtccccctactccgttaccaacgctttcagcggcgaaccgggtgtaaccaagacatccagcgatacgctgatgttccagggcaaagtcacctatgactatgccttcggtgcgctcaatggccgtctatggagcagcttcctggtgcagccgcagcagaagatgcagggcattgtcggtgccaacgcgcgtgacagcgtgctgtctgccgcaattgatggcggtatcaaggccaattatggcccgttcggtatggtcggctactactaccgtgggtcaggcctcggcacgaccggtctgttcttcgacgcgattgccgccaatggccgcaagcgtgattccgaaggctactatgtgcagggcacctacagtgtgaccaagaagctccgtctggtcgccagctatggtcagagcaatctgaatcaggctccgggtgaagtgaacccggatctggttcgcaccaacgaagccgcgatcggtggcgtgtattacagcctgaccgactggatgacactggttggcgaatatgcctatgtgcaggcgaagtcgcatggcgataccgccctgcattccaacaacttcaccgccggcacgatgctgttcttctaatcgacagcgtttcggatctacaaaaaaggggaggggaacgctcctccccttttccatgtctgggtcagtcttattgcgcgttgggcgttttttctttcacggcaccgggcacattcgtttgaaggccggctttgtcatctttggttgtgccggtgcccatggcaccatccgatgtgttggatgaagtgccggtttttgcgtccggacgtgctttatgatgtttatgatgcgtttgttggtgattgctttcagtgaccgtgtcctcggcatgcactgacaagggcacagtgagaccgaggcacagaacaagagcggtaccaagggtggcagggcgtttcatggccattccttcctgatgatccggccgggatggtgccgggttttcatcaggctcaacgatcatggccccgctgcgttcccccgccgatgggggcgattcaggtgagtgtcgagattttcttcacgattccagtggttgaacggcccggtaccagatcaatcaactccactttcccacccgctgcgcggacgacatcgccgccgaccacatcttcctcgcgataatcagcacccttgaacagccggtcaggaagcagaacggagatcacggagaggggcgtgtcttcctgaaatccgacgacacaatccacgctcctcagcccagccaaaacagtgcagcgatcttcaaatccattaatgggacgggttggtcccttgaggcgcgaaacgctcgcatccgtattgacagcgacgataagccggtcacaacgcgtgcgggcctcattcaacaggctgacatggcccgcgtgcaggatatcaaagcatccattggtaaagccgacggtcagaccaagctgcttccatttcttgacgagagaccgtgcttcaccaagactacgggcagagccggtgctgccattggagatggcggattcatccagttctgcgcgcagttcgtccacattgagcgtggcagttcccgccttgctgaccacaacgcctgcggcggcattggagattcgcatggcactttcaagggtgaggccgctggcatgcgccagggcgagggtggcgatcacggtgtcgccagccccggagacgtcgaatacttcccgcgcacgggcgggcacggtgtgaatggcgatgtcgtcccgcccttccgcaggggcttctatcagcatcatgcccttttcggaacgtgtcgcgagaatcgatgcgccctcagcctgctgcatgacaatccgggccgcggcaataacggatgcctcgtcatcggcacgctgatgggcggcggcggacagctccttgacgttcggtgtgatgcaggtcgcaccggcataaaccgaaaaatccagtcttttgggatcgacgaaaaccggaataccggcctgtcgagccagtccgatcacatgcttgatcacggcaggcgacagtacgcccttgccgtaatccgataaaatgaccgcgccacactctgtgatatgcgtggcgaccatggtctgtagcagcatttcttctgcgggttgggttggcaggtggctttcatcatcagtgcgaacaacctgctgctgcgcggccagaaagcgggttttgcagatggtcggccgatgggggctttccaccagggcgttgacgataccggggacacgctccagatgagttctgagtgcgatggcggtgtcatcatggccgatcagcccgaccagaatggctgtgccgcccagatcggcaatgttatgggccacattgcctgcgccgccgagcatggaatgggtgctggtgatacgcaggaccggcacaggcgcttccggggagatgcgttccacgctgccatgcataaatctgtccagcatgacatcaccgatgcaaaggacgcgcgtgctcgaaaaatccataaaaattccgctcgtatgaaaaaccgttttctcttccgaccgtgtcggccagagatgaaaacgaagagaaaacggcccgcctgaaaaatcaagcgggccgcttgctcatcaggcacaaaagcgtgcgtgtggctgcaaatatatccgccgttctttattcgacgtgagacccattcgctggcattgctgtgggagatgccgtcggagtggctttctccatatgggtattatcggagcccgggcggggtgttttcatcatcgcgccggtcatcgggataaagaacacaccgacatcgcgccgggaatggaccttgccctcggcatccttggtgtagatgtagagaatctgcccgcgcttgaagggctgcccgatgggaatgatcatccggccattgggcttcaactgcttcagcagatccggcggagcatattgggcggcacaggtgacgatgatgacatcgaatcctccctcgacctccggccagccgaaatagccgtcaccgacccggctggagatattgtcatagcccagcggcctgaagattttcccgaccgccttacccagcggctcgataatctcgatcgaatagctgtgtttgacgatgcgggacagaagagagctctggaacccgctgcccgtgccaatttccagcgtcacatgctcgggcttcgcctcgcagacctgagacatgtaggcctgtccaagatagtcggacagcgccgatccgtagccgagcgcccagggtttcggatcggcctcataagccgcgcttggggtcggcgtatgggtgtcatagtgatagtggtaatactcgcgcggtaactggcggaaagcttccatcaccgccggatcggcatggccgagcctttccttcagataggattcaatccgttgcagggccgcaggtttacgggcctgaatggcatcgaacgtcttctgatcgatcttgcagggacggccggactcggccatcgccttctcaaaccgttcgagcgtccatggctgggctgcggcggcatcggctgcacgggcctgagcaaacaggcgcggccctttactggagaagggcagagcagcaccggtggcggctcctgcaacaatcagggagcggcgggaaaacatgcgggtcaatatccttgcctgaattccgcccgggtggcggaaggcgtgtggaacagaagggcagccagcccatacagcatagcggccccgatcagcagcacggaataacctttctgcaaagccaacaaattcgcgaggggcgttgcaacaaccgaaaaagcgccattcacgccccaggcccaaggtagcagccccggcggcgtaccatgcaggcccagcggaaaaaacagaccaagcaggatggaaaccggcgccagcacgacacccagcagtagcagtcgcaacatgatcggccagtccagcgtgttcagcaccagcgcgggcaggccatacaggatagcggcacaccacactatggtcagtccggccgcaatgcgcagggtgcgagccgcctccgtggtaaagcgcccggacagcatcgcgccgatcccggaaaaaatcagcatcatgctgagcacggcggcaaaggcggtggcccgatcattcaaccagaaagcggccttgtcgatcagaacgatttcaataaacagaaagccaagacccagaactgcaaaataggcaacggcgcgggcggtgcctccggcgctcatcccgatccggcggggacggatcattggcagcaccagcacgatcatggcaagcaaggcggcctgggccagtacggcgagattgaccagaggaccgatctcttgttgcggcagcatttccagacgctggagaatggttccgagatgcgacaggcgcagcaccgaataaaagaagggccgatcctccgtgataggcgagaggttgaaggcacgttgcgatccggttcgcagatcggcatcatcccgctctgacaggacgggcaaggcttcctctgccacggcatcggccgggccgcttccactgcccaccgacccatcctcgaatgaaaccggtggcagatcattgtaaatcgaggctttggcggcctgtagatcaatgccggggaaataggggacgtcgaaagaacgctgatcggcaaagtggcgcgcagtggtaatcgtgcctgcggagaatggttgattactgaccaggatgcgcaggttccatgccgagcggtacacgatcacccgcgtcatgggatcgaccccgcgtgcacgcagcgcatcccgtactgtggccagcaatcgcacggcataggcaggaaattcacggatcgaaacaggcagggacagcaccccgcccggtgccagggctccgatcagggtatcgagcgattcacgggtaaagacatgggcattggcttcctgttcgtcgagaaaatccgacgagacatcgatcattgcaaaggtcgccggatggcggcgtgccacgccgacgggattggcgccggagagttcgaaacctccgggcatcagcttgcgcaggatcgggtccggttccagtgccgtgacatgggcggctccgagagctttggcctcggcgatcctgaatcctccgccactgccgatcagcaacacctgtccgcctgctttcagggctgcgctttccagtatgtagggcaatgcattcagggcagcaggagcatagcgtgcatcaagcccgggctgccccgggccactcagcggcagggcggcgatccggttgccgtcgcgatagacgccgagggtcctgggcggtccgggcagattgagcatgccggcatcattggagatatcggtatcgacccgttccgtaaaatccgccagcacattgtaaagaccacgcggggagtcgacttcctgcaccatccgtgcgccttcgacatgcaggggggcatagatcggcttgaaatcgttaaacgccgcgctgtcgtaatgcagcgctcctatacctgttgcaaacaacagcagcgccagcgcggtatgggcagcgcgtagccgtgggggcaaacgtgatccggccagccagcaggccagcagcaataaaggcagcatgcagggcatcagctgaaatggatgcacatattgcatcagcaccagcaccagcagtgccccgccgcccgctccggcaagatcatagccatatgtcttgccaagcctggccgagccgaggatgaaagacaggctgatatacaacccggtcagaaagaaaaacggcagcaaggccgcataatacagcccgatcagccagagctgtggtccgtacgtggccgggttctgcaactggagcggattgaacggattggccgtcacacacagataaccgcctactgctgcgggcagcagcagcagcggcaagatggcttgcaaggcagtcccgtatttcgtcagagtctgtcgagccagcgcggtcgcaaccccggacagggccagaccggccatgacgatggaaatgacccagtacccatattccgaccatttcgcgacggcaaaatagcgggtcagggcggtttcatacccgaccgccgccccggaaatcagggccagtgccaacagcggtgctggtcttaatcctgtgttgtgatcggaggagagagggacactcatttcaggactgtccgcggccagacttttcgagtgataaatgattccatcagcctgttgaatcggtcggcctcatcgatgaacagcgcgtgacctgcggtgcggaagatgctgatttccgcattggggtggcgggcggcaagattcatggcctgtccttcgaaagccgggcgcacggcatacagaaccggtttggcagtcgcatacacggcttctttccagtaggtgcggggaacgggatagcgcagcagggccgccgcgacatcgggaggggtatggagtgcatcctgggtcagctgttccagaaaagcagttgattgcggcttatggaacatgctgcgcacaaaagcctgcattgaagcctgccgattgagagggtgcgctttcctgcctcctcgtcgcttgccggagactgctccgggggctgggttctcgccaatggaattgtcgatcagtaccagcccggcaatatgcgaatctccatgctcatgcagataggccagcacgtccagcacaccgagcgaccagcccaccagcaacacgcccgcgcctgtgtctccgccgagttgggcaatggcatcggcaatatcctgcccgcgtcgccatggatcatagccggtggagggaatgtcgctttccccctgtccgcgcgggtccagagcggcaacgtgaaagcgtctgctgaagaaggtgagctgccggtcccagatccaggcgggcatgcaccagcccggcacaaacaggatcgatggtgcggaggcagagcctgcctcaatcatgtgcagacggatgccatcactggccgaaatgaaccggttataatcagccgcccggacagcgcggggtgcgcagaggctgatcgcacctgctccgagcaacgcgttcagaaacggtctgcgtgacaggaaagccatgccggatgccttttcatgtccataccggacagcagaggcgccaaaggaaagtcttgcgcatgaggcgatcaggcaagaccgggcggcccggtgtgtcaacctgtgctgctgtctgccggctattgtggaagtctacagaaagtttggttacgcggtggcgcaaggattgcttccatcttacaaccggaagcacggcacttcacgccgcctattccgccggtgaaacagttggacaccccatgtcgatccatgtcgctcttacccaccgcacttcctaccggtatgaaaagcccgcggctctggggccacagatcatcaggctgcgccccgcaccacatgcccgcaccccggtgctgtcctatgcgctgaaggtcgagcctcagccgcatttcatcaactggcagcaggacccccaaggcaattttcaggcgcgggtcgtgtttccggaaaaagtcactcatttcgatgtgacggtcgatctggttgccgatatggcaacgatcaatccgttcgacttctttctggaaccggaagcggaaatctggcccttcgcctatgatccggtgctggagcatgagctggctcccttccgtcgccaggaagaagccggccctctgctgaaggcgtttctggatgaactgcctaagccggatggggagggcgatggactgcccaccatcaacatgctggtcgatctgaaccgccgggtgcaggagcgtgtcaattacgtcgtccgcctggaacccggcgtgtttacgccggaggaaacgcttgaaaagcagcttggctcctgccgtgacagcgcgtggttgctggtgcaagtgctgcggcatctcggtttcgcggcgcggttcgtctccggctatctgatccagttgacggcggatgtgaagccgctggatggcccggctggcccggatgaggatttcaccgatctgcatgcctgggccgaggtgtacctgcccggcgcgggctggatcgggctggatgcgacctccggccttatggcgggggaggggcatatcccgctggccgcgacgccggaaccggcttcggcagccccgatctccggcctgatcgaaaaggtggaaaccgaattcgactttgctatgggcgtgacgcggatcaaggaaacaccgcgcaccaccaaaccttatatcgagaaaacctggcaggatattctggccgctggtgcccggaccgaccgtgcgctgaacgccggtgatgtgcgcctgaccatggggggcgagccgactttcgtctctgcgaccgatttcgagtctgcggagtggaaaacggatgcgctgggggagaccaagcgcgcttatgccggtcgtctgatgcgtcgcctgacggccctctggtcaccgggggctgcgatgcatctggcgctcggcaagcattatccgggtgagcaattgccgcgttgggccctgtatgcgcactggcgggtggatggggagccggtctggaccgatccggccctgctggcggatgacgacacggtcgatcacgcgaccccggaggatgcgcgtcgttttgcccgggcgctggcagagcggctggaggtcgatgccggtctggtcgcacctgcttatgaggatatccattactatctgtggcgcgaatcccgtctgcccgccaatgttctggcggaaggcagcaaactgcgtgatgcggcggagcgggcaaggctggcgcgtgtgttcgggcaggggctggatgcggaagtcggcagtatcctgccgctgcgccgcgccattctcgatgggcgccgtatctggcagtccgggcgctggttcttccggggggatacgctgttcctgatccccggcgatgccccgatcggcttccgtctgccgttgcaaagtctgccatgggccgatccgtccagtctggataccgattttccgctggacccgtttgcgcccagaaatccattcgcgccccgtgccgcctacagttggggacatggtggtccatcccgtgagggcggtccgtcacgggatggtatggaagccgcctatgcgacccgcagcgggcagggtgccctttatcggcagggcgcgacggcctatgtctctcccggtgcatggctggaacgtccggtccggcaggaagcgccggtcatcgggcgcgatgaacccgatgtggtccgcaccgcgctggcggttgaggcgcgtggtggtgtgctgcatgtcttcctgccaccgctctacgatgcggaggattggctggaactggtcgctcgggtggaggacacggcccgcgccgaaggccgtcccgtggtgctggaaggctatgcgccgccggaagatccgcgtctgctgtctttctccatcacccctgaccctggcgtgctggaagtgaacgtgcatccctcggaaaactgggcggtgcatgtggagcggaccgaacagctctacgaagaagcgcgcgcggtcgggctggcgaccgaaaaattcatgcttgacggcacccatgtcggcacgggtggcggcaatcacgtggtgatgggtgcggcccatgctgccgacagtccgttcctgcggcggcccgacctgctgaagtcgatgctgggtttctggcataaccatcccagcctgtcctacctgttcagcggattgttcatcggcccgttcagccagcatccccgcatcgacgaggcgcgggaggacagcgtgcgggagctggagatcgcgtgcgaacgggtctcccccttcagccccactccgccctggctgaccgaccggattttccgcaacattctggcggatgtgaccggcaacacgcatcgtaccgagttctgcatcgacaagatgtatgcgccggagagcagctccggccgtcgtggtctggtcgagttccgggcgttcgagatgccgcctcatgcgcgtatgtccgcggcgcaggctttgctgatgcgggcggctgtggcggcattctggcagttcccttatgagcgccgtctgatcaggtggggtacgcgcctgcatgatgatttcatgctgccgcattacgtcgcgcaggatctgaaggatgcgctggaacatctggcgggtgccgggcagcgtctggatccggactggttcctgccgcatcaggagttccgcttcccgttggtcggtgaaatcgccgtgcgcgacatggtggtggaactgcggcatgccctggagccatggcacattctgggcgaggagcctgctgccggcggcaccgtacgctatgtggacagcgcggtcgagcgtttgcaggcacgggtcaccggatggtcagcggaacgttacgtcctgtcctgcaatggcgcagaggtgccgttgcagaaaaccgaaacgcagggcgaatacgtggcaggtgtccggttcaaggcctggtcaccgccaagctccctgcaccccaccattccggcgcatgggcccttggtattcgatgtgtatgacagctggaccgggcgttcgctgggcggcatgacctatcacgtgtctcatccgggcggacggaactatgatcgtttccctgtaaatgcgaacgaggccgaggcgaggcgtcgcgcccgtttcttcccgttcggccatacatccgggccgatggagcgtcctcgccttctgcctaacccggaacagccgcggacgctcgatctgcggcggggacactgaacagggtgggattgtttgacagagggggtgggtgcatgccgaactgtgcatgtgctgtcgaaagaaggtggacaccccctgatgcgccgctaaaaccagtgttcatggcagatggacaaggcatgtgagcgtcgtcgaagggctggatgagatggtcgatggccaggggagcatacgcccccactggcgctccatccttggaaccctgaccgcgctgggggatggaggcatcgctcagcgcgcccgccggctggaccgcatgttcgagcaggagggcgtctccagcttgattcccggcacggtcgagcgtgaggggtggcggtgcgatccggtgcctttgcccatcacggcgcgggagttctcgaccctggcgcgggggctggcacagcgtgcctccctgctgtcggccatggtgcaggacgtctatggaccgcaacgggttttgtcggaaggctggctgcctcccgcactgatttatggaaaccgggcttttctgcgcgcctgtcgcagtcaaatggatcgtccttccgacgggcataatggcactgcctcgggtcagaggctcgatttctactccgccgatctgatccgggcgccggatgggcgatggcatgtgctggcagaccggacatgcggctgtgcggggctgggctatgcgctggaaaaccggcgcattctggcccgtgtgatgccggaatcgttccgcgtcgcgcatgtgcgcaggttgcggcctttcttcgatttctggcttgaccggttgcaggaaattgcgccgcacagcgaggatgggcagccgcagcataatccgatgatcgtgctgctgacacccggttatcgctcgccgcaatggttcgagcatatgtttctgtcgcgggaattgtcctgtgcgctggttgagggcggcgatctgaccgttcgcaatggtcgggtttttctgaaaaccctgcgtgggttgcagccggtggatgtcgtcatccgccggacagacgggatggcggtagatccgctggagctcgcaccggggccgggaacggtcggtctgctggaagcggcgcgcagcggcagtgtcaccatcaccaattcccccggcacggatatggcggaggccccgggccttgccgcgttcataccgttgctggccgaaaaaatgctgggcgaggcattgcatattccccaggtgccttcgctctggctgggggaggaaacggcgtgggcggaggtccggcaggatctgtcccgctgggtgcttcgttcggccatggatagcagtgagacccccattattgccggtgctttgtcggaggatgagcgggctgcactggaaaagaccattgccgtgaatcccggccgctggtccgccttcgcgcatatggtaccttcccgggcaccttgcgccgggcctgatgggctgacgccacggcccatcacgctgcgtgtctttctggcctgggatggcacagcatggcgtgccatgcagggtgggcttgcttatgtcgtgcaggaggggcaggcgggaggtgcgcgtctggcttcccatggcatgagcaaggatgtctgggttctggcggatgatcatcaggatctggccggtcctgctttgcgcgttgtcacgcgactggcaccccgccgcacggcggctgccgtgccgagccgggtggctgataatctttattggctggggcgttatgtggagcggctggacagtgatgcgaggctggcccgtgccgtattgatccggttgaatcgtggccttctgctgccgcatgagatggtggagctggatacgctcggtcaatgtctggcgacctccggcctgctttcatcgccggtgggggcgggggcgcatggtctgttggccagcggattgctctcggcaacacgggatgatggcgcgctggggattctgctgggtcgggttgcccggttgacggagctggtgcgggatcgcctgaccgatgaaatgtatgccaccttcaccaccaccctgcgcagtgcgcgggcagagacgttgatcaccggcaaaagtctggatcagatggcgcaggccatggcggaaatatcccgcttctgcacggccgtttccggtgctgcggcggaaaatatggtgcgcggtggcggctggatgtttctggagcttgggcgtcggatcgaacgggcatggacatccgccggtatgctcgcaacagttctggatacgcgcccgtcctggctggagacaggtctgcgcatcgcactggaattatgcgacagcgccataacctaccggaatcggtatctgacggcgatccagcctgatccggcgctggatctggtgattgccgatcccgacaatccacgcagcctgttttttcagctcgttgcgatcaaggagcggttgatgcaggtcgccgaggccgcacagcagccggacgaggcagccggtttgattgcggccgcaaacgcgttgggtgaggacgctgtcgccattgccggagatgtggtcaaggcggatgatccatatgctgccacgttgacggcggcgaagcgtttgcgggggctggaaacaggtgtggccgctctttccgaccagattacccgtcagtatttcaccctgctgcccagccagtccgtcggacagccgcggctggcggaggaagatggggtggtatcgtgaaattccgtgtccgccatctgacccgctatcactatgaagatccggtcgatcttgccagccatatcctgcatctgacgccgcgtgattgtcgcgggcaacaggttctgacaacagggttggacatcgaacctgccccttcccgtcgcgtggatgggcgggaccatttcggcaaccatctctcatggctttcactggatcagtcgcatcaggttttttccgtcatggcggaaagtatagtggaagcctttttcccgcctcctccacccgatgaagagacgcctgcctgggaagaggtcgcggccttggcccgtgcgggcagtggtacggctatggaggcggcggaatatgtatttcccagtgtgatggccccggctgatcccgatgcaggccgctatgtcgctgtcagctttcctcctggacggcctgttctggctgcgctgcgcgatctgctggcgcggatcaggggagaattcaaatttcgggccggcattaccgatctgcacacgccggtttcgcgggtggtagcccaaaaggcgggtgtctgtcaggatttcagccatatggtgattgctggcttgcgttggctcggcctgccggcccgctatgtctccggatatatccgtacctatcctccgccgggacagaaacggcgggagggaacggatgcatcccatgcctgggtcggatgctggcttggtcctgcgcatggctgggtggatatcgaccccacgaataacctgatcgtgtccgatgaacatgtggtggtcggctggggccgtgattatgatgatgtcagcccggtacgtggcatcattcttggcggcggccgccatgatatgctggtcagtgttgacctggcaccgctggaggaggaggtcacctgacttctttgtcctcctgtcagcaggagcaggatacgcttggaacagttcgagtttctgattcttctgctggcagccattgtcgggttggaggtgctggcccgtaggctgcatctgcccgccgccgcggctttcattctgggtggtggtgcgctggcactcatacccgggatagggatgccggatgttgatcccgacctgattctggtgatttttctgccgcctctgctgatgagcggcgcatatatgactgtgtggcgtgatttccggcagaatctgcggggtattttgctcctggctgtgggagccgtaattttcaccactatggtggtgggtatcggcgtcaaatggttgctgcccgacctgccatgggcggtgtgttttgcgcttggcgccattgtgtcgcccccggatgcggttgcggccaacgcggtactggaacgggtgagtctgccgagccgcatcaccgtgctgttgcagggcgaaagcctgctgaatgatgccgccgggctggtgctgttccgttttgcgattgtcgcggcattgacgggaacgttcagcctgtctggcgcactgacctcgttttgtgttctctcggtgggtggtgtggcgctgggggctgtgattgcgtacgccggattgctggcgatccgctggctgcatggccatggtgaggccgtcgtgacggtcacgctgttgatggccgccatatcctatatcggcggagagaaactccatgtttccggcgttctgtcgaccgtgacaactggccttatcgtcggctggcgacagcatgaggtgttttcggccgatacgcggatgcgtgcccatgccgtgtggggcagtctggtgtttctgctggaatctgtcctgttcatgtttatcggcctttccctgcgaggcgtgctgggaaggctggaagatcaggggaacgccgttcaagcctttctgctcccctcccttctggtagtgtcccttgttgttgtctcccggtttgtctggctatatgcggcggacggattttattctctgatgcgggttattggcgtcagacatgggccggcgccttctctggcagcgtctaccatcatgggttgggcgggaatgaggggggtggtgagtctggtcgcggcattatccgtcccggaaaccatgccgggccgtgatttcatcctgatcgctaccttcctggttattctggtgacggtcctggtgcagggtaccacactggaaccgcttatccggctgctgcgtctgagtggcgccgaggaactggaaatgaagcgtcactcggaagaccgggcatgggcttctatgacagcggcgcaataccgggccatccagagggcttctcacacccctgatggcaaggaacgtcatccccgtctgctggagcaatatgcccatcgggcaagtgtcgcgtctatctatgcgaaaaatccggacgagcatcgcccgcatgaaattgaccatttcatggcgatactggaagccatcaaggcagggcggcatgaggttctgcgcctgcaccgcgccggagaaattactgacgccgtgctccacgacatggagcaggagcttgatttacagcaattggttgctgaggcccgggtcactaaggacggggaggaattgatcctccccgcataggtgtcgttgcagtagtcagaccaggatatttttgaagcgatagggctcgctgcggtcaagatcttccgggaacagcgtttcccggccatcaagcggcgtccagtcggagtaggcacctgccatttcgcccagataagggcgcatgatatccagggcgcgcacatggtcgatttcgtcggcttcgaccacgccgcgggccggattttcgatcgcccagacgatcgcggccagcaccgcggccgtcacctgcaggctggtggcgttgttatggggggcgagcttgcgggcttcctcaatggtcaggcgggagccgaaccagtagacgccgcgctcatgacccatcagcaggacgccgagttcgtccataccgctttcgatttcgttcatcatcagacgctggcggggctgcatctgccagtttttgcccgccagttcatgcaccgacagaactgcgtcatcgcagggatggtaggcataatgaacggtcgggcgatagcgaacggagctgccttcccgcacggtaaagtaatcggcgatcgagatcgcttcgttatgcgtgatcaggaagccatgatacgggccttccagcggcgtccagctacgcacccgggtggaagcgccggggcgcatcaggtagatcgccgcaccgcagccgaaatcgtgatggcgcccgccggacggcaactccgcctcatgcgtgccccagcccagctcggcaggctggcagccttcaccgacgaaaccgtcaatggaccaggtattgacgaactcgccgactgctttgggacggttgctgacctgggtatcgcgctcggcgatatggatcgcctgaatgttcagtgtctgcgccagggccgcccagccttcgcgcgtggtcggggcggtgatttcgtggccggtatcgcgggcaatggttaacaaagcgtccttgaccagatgggaaacgaaaccgggattggcaccatgggcgatcagcgcggtcggggcgtcttccggacagccttcacgcagcgccagagcactttcacgcaacgcatagttggaacgctgggagggtgtcagatcgggatcggtatatccgcccggccatggctcaatgcaggtatcggtataaagcgcccccagttcacggcagagcaggatcagggcgacggaagaaacctctaccgacagattgaccagaaaatcccctttgccgagtagtggcaacaggatatcccggtagttttcacgggtcagctgtataacatgatgagcgatcccatattcagccgcgatagccgcaccgcgatcatcggcggtgacaatggtgatccgatctgagggcatcgcgacatgacgcaggatcaagggcagtacgccctggccgatactgccgaagccaagaatgaccatccgaccgtcgaagctgagagagaccataaataagaaaatccccggatactatgatgcgggccatacctgaacagccagagtcatcaggctgtattttgtccaggcacaaaggcaccgttggggaacgtctgccagcctgctttttccctcaagagaaatattaaagacatttgcattctggagccttttccccctgcagaagactggcccggaccgctatagccacatgacgactcaagggagcctggaatggaatacggacgccgcttcaaatttctggtctgcgcaccgacctttaacccggacgatctggaaggtatccgccttcaacagattctggaggagatcgagcaggacggatatttcgtgctgcgcgcccgccgggatgacgatgcggagctggccatccgtaccgacgccgccattggttgcgtcatcgttgactggggcaagaaaggggcggctggtaaggcggccgggctgattgaactgatccgcaagcgcggtctggatgtgccgatcatcgtgctggtacgtcgccacaggctggaagatatcccggtcgctgtgctggacaatatcgacagctttatcttcctggctgacgaaacgcctgactttatcgcgaaaaacctagtcgcacgcctgcggcaatatgccgatacgctgaagacgccttttttcggccagttggtcgactatgccgagcagggcaacatgttgtggacctgtccggggcataatggcggcgtgttctatcgccgcagcccgatcggccgcattttcgttgagcatttgggcgaggcgatctttcgtgacgatctggacaattccgtgcttcagctgggtgatctgctgacccatgaaggtccggccctgaaagcccagcgggaagccgccacgattttcggagccgagcggacgtatttcgtgctgaatggcacctcgacctccaacaagatcgcgctgaatgctctgttagcggaaggcgatctggtgctgttcgaccgtaacaaccacaaggcggcgcatcatggcgctttgctgttgagtggggctgtgccggtttatattgataccgcccgcaacccgcatggcatgatcggtccgatgcggcgggatgcgttgaatgaagaggcgctgagagaagcgatccgcactcatccgctggtgcgcgatccggaagcgtggcgcaagcctcgcccgttccgcgtggcgatgatcgagcagtgcacctatgacggcactatccattcggctgaggaagtgctggcgacgatcggccatctgtgtgactatatcctgttcgatgaagcatgggccggtttcatgaagttccacccgctgttccgggggcgcttcggcatgggtctgcgcaatctgggtgagaacgatcccggtatcatcgtgacacagagcacgcacaagcagctcgcttctttctctcaggcatcacagatccatgtgaaggacagtcatctgaaagggcaggaccgtcagatcggtcacaaccgtttcaacgagatgttcctgctgcacgcctccaccagcccgttctatccgctgttcgcctcccttgatgtcggtgcgcagatgatgaaaggccgctccggcgaggtattgtgggacgatacggtccggttggggatcgaactgcgcaaaaagatcaggctgacgcggaaagaatacaaacaggcgcagaccagccccgatctgcagtggttttttgagccgttcgtccccaagcgtgtgcagccctcggaaaaggcggaggccttcgccggattacgttgggaagatgcgccgacggatctgctggcttcggatccggaacagtggatgttgcgccccggtgatgactggcacggcttccccgacctgcatcctggctgggttatgaccgatccgaacaaactgaccttgctgacacccggttttgatggacgcaacgaggacaactacgccgatcatggcgtgccggcgccggtggtggcggaatatctgcgtcagaaccgcatcgtgccggaaaagaacgatctgaattctctgctgtttcttctgacgcccggtattgaaagcagcaaggcgggaacgttgctgtcctatcttgtcacgttcaaaaacctgcatgatcagaacgtgctgttgtccgacgccattccggatttcgtggcacgtcgacgggagcgctataagaacgtgcgtttgcgtgatctctgcgcggaaatgcacgctttctatcgagaccggcaggtcagccggttacaggcggaacagttcatggcgcagcacctgcccgagatggccatgctgccgcacgaggccatgcgcgaactggtgcgcaacaatgtcgattacctgcccctggaagaagcgcagggaagaatcgccgcgacattgtggctggtttatccgccgggtatcgcgaccatcgttcccggtgaaaggctcggtcccaatgcggagcctatggtcgcctatctgaaagcttttgaagatgcggcaaatcagttccccggatttgaaaatgagattcagggcttatatcgagaaaataaagatggcaggattcgtttttatacatattttgtaagggagcgctgactgatcatggcctgacatctgatgtcaggccttctcctgatggacattttgaaaaataagtttgaggccgcattgaatatttgatttccatatttttttctgcgttaattttcctaaatttttattcaggaaaattgaaatgattacgaataaattataccgatcctttgttttagcaggtttgtttctggcaacgaccccgctggcatatacccagtttgcacatgcccagtcttggcaggcttcctcatctgtcaaagtaagtcgctctgtctctgttaccagatcttcctctcctatgccgaagagtgtcggcattcctcttttcccgatcagggcaggcaatgttcctgttatggtccatatttctatcggtggcggaccgacaacatctgtttcggtggatacaggctcggcaggtctttacgtcatgcagaaggatgccgggcctgatctcgtggcacttccgacacgggtccggcagggttatacggatggcaccagattcgatggatactgggccaagacaaccattgcatttccggattctcaaggaccggtgacaacaaggcagccgattgtcgtcggtgtgatcacgcgggtttactgcgcggctacccaacccaattgcccgggcagtatcaacaagcccggcattatgggaatcagcatgaacacaagcaccagtctggtcagccccttggcgcagctgcctactccattatcgaatgggtatattattgatgtccgggacagaaaaacaccgactctgacagtcgggctgacccaggaaaatacggcaaaattcagctttgcagcgcttaaacctactaaagcaggcccatctggtgcgccgtcatggacgggaacatctttaacaggctgttataccgtcaatggggaggctgcctcatgcacaccgattttgtttgataccggtgcttcctatggggttttcaatataggaaatgcaaatccgaaactgagcaggacaggctgcctgtcacaggggcagaaattcgagattgatttcaaggatgtttttcatctggctttgatgacgaccgcgaacacggttttttgtgtctctaaaacggccacatcttccaatattggttctgcgccgttccgctatatggcggttgcctatgacgcacagaatggccgattgggatttatgcagtaagagagagattataaaaaacgccgcatgctttgttaccgggcatgcggcgcttgctatgatcgggatagagaatcagattttcccgtccagtcccatctgatgatatttgtgaatgatcttgtcctggttttcgagcagccagtcgattgacggttcgttctgcatggccttgcggatggcttccgttgtgcctttgcgctggatttcgaacagcgccttatgatccagattgtcgtcattgatcacagacggcgccagccacacggaacagatgatgccaagatcattgacctgatctttcggcagatagccttcccgtacggcatccagaacaccgttggcgatggcgaattgaaccgtgcccatcaggatattggtgtagcgctggcttttcacggttactttggacacgcacagagtcactgggcgaacctgtatcccggtgttcagaatggcgaaaacacgactgtgaccggcaacctgatcgcctaccagagtggcgagagcagtgccgaccggcccgtccagcgcaccgatgacgacttccggttctgccgcggtgccgggtggtccgccagcgaccagagcctcaccggtacgcaggataatacgttcgctcatggaggggtctccttatcggatgaggggaaggaaatgagggggctgacagattggccgtatcgaattctgcccgcctcagagatatcacgcgccagaatgatcggggagtatggcccgggcaatgcgcatagcagcatttgccgccggtatgcccgcataacacgcgacatgcatcagtgtttctgcgacatcgccgggggaggccccggtattccttgtggcgcggcaatggcctttgaactcctcctcagcacgcagagtggccaggacggccagagtgatcagactgcgggtgcgacgatccaggccggggcgtgaccatggcccgccccaggcggcctccgtcatccatgtctggaaatcccgctcgaagggggaggcatggtcgaaggcaccctgaacgaattcctcccccatgacagcgcggcgcgtggccagtcctcgcgtcagtgcatcggcctgtgcctgtgcaccgataaagcggtggatcgcctccacaacctgtccgggctgttcggtgcagatcatatgggcagcattttcaatgatggtgaaggccgctccgagccgatcgcgaagcgcttcagccatggggatcggggtggatcggtcctgatcccccaccagtacaagcgacggtgccagaatggcttcggcatgatccgacagatcggcgacggagagggcctcgcacgccgcggcatatccttccggatcggtccggcagagcattgtatacaggccgtgcgaggcgggatcagtcagaaactcctccgtcacccagccgggcagcacctgatctgccagcaatgccatcccttccgctctcgccagcgcggcgcggtccagaaaacgggacggttctgccatcgccagaccggtatcgcagagaatcagcgaacgcacccgggccggagcgatggctgcgagcatctgtgcgaccatcccgcccagagaaatgcccgcaacatgcgcttcatccacgcccagcgcatccagcaccgccagcgcatcccgtgccagcatgtcgatgctgtatggtccctgcgtcacctccgtcagcccatgtccgcgcagatcggggcggatgacgcgatagcttcgggccagttccgctgccatgccgtcccaggctgctccggtcgcaccgagcgcatggaggagcaggaaagcgggtgctccctccggaccatcaaccgtcagatggatgttcagatctccagccaattccccggtgcgtagaaacatccgtctttatcctcttccatgctgaagccgttctggacttgccgcgatgcttcatgcaacgcatgggccaataaaatgacgcggcgacagagtcgtgaaggctggtcacccatgctgaaagaggaagtcggatatcatgagcgatacaggacaagatacagtgctgacactgaacaaggcgcaggcaatcgttacggccagcctcgaaaaggcggcctctgccgggatgaagccgctggcgattgcggtgctggatgcacgcggagcgctgaaggctttcggggcgtcggatggtaccagcctgcgccggggtgaggttgcgattggcaaggcacatggcgcggtggcgctgggtatgggcagccgggcaattgctgatcgtgccgcaacggatccgagttttgtggcggcggtgactcatgccgttggcggctccctgattcccgtaccgggcggggtgctgatcatggcgggcgacaccctgctgggtgcggttggtgcgtcgggcgatacatccgacaatgacgaggcggctgtggtcgcggggatcgaggccgcaggatacaccgcgcgcatccgttaacagtgatgcggacagggaggccataagcggcgttcatggcggggcataagaccggatcatctctgccggggcgtcggatggcgcttgcgtgggcggcatccctgttgacgggtgctcacaatgcatgggggcgggaggaagggcattccggtattcggcatgctcttccccggacaccttctgccccggctgctgttgcgcctgatgcgaccgccagcctgctgcaccgtgtggtcatgggatgcagcggtgaggattatgccagcgccgtgcaggcggtggcagggcagaggctggggcgtcttcagacgaggttggtggtcgatgtcaccgatacgctgccgaggatggaaagtatccggcaggcccgcattctggcacggccggcgccttgcgatgtgctgctgctggacgacatcgccatgtataccctgtccctgatccagccctttcgccccgccacaccgcaatttcttccggctctgatcggtgtcgaaccggatcttcggctgccctatgctgctccgcagatgcagagcggtctggtcatcgtccgccgtgcgtccctgacaaaggacatggtgctgttgcgctatggtgatctggcttcaccgcggctgcatgggcgggtcggattttcggatgcgcagtatcttcaggtcatgggcgctgccaccttggccatgggtgggagcatgacatattacgcgcccggtctgacctggctgcgccgcctgcgtcaccatggagcgcggagctatccgagcgatgaagcattgggcaatgccctccgtaccggagagatcgttgccgccctgaccttgcaggccaatgcagtgatctggcagcagatggtaggcgacctggcctggcatgcggcagaggagggggtcattcccgttatcatgcaggcagccatgctgcgcaatgatgccgaccctgccgctgccgccctggcctgtaatatgttgctggaaccgccggtgcagaccgatctgatgcaccgtaccggtttcctgccgaccgtaacctccctgcttgaagatcacgaaacgatccgggcctatggtttttccacctatcagcgggaccggttccagtggccggcttattcctatctggcaggagagatgatggcgctgtggaaacagtggattgccatttttgatgcccggcccgtgcgttcgccccaccgtccggcggggcatccgaaaccggtgaccagaccgtgatgaggagggcgggaaaatttgacttttggatgaacgctctctatagggccgccctcatggccgggaacgcggacggaccttcggggttcgcgcccgccggatgcagctgcatccggactaccggtgcaacaaaagactcaaggcgcatgccgggtcacataaagaaggctgtcctgcgatgaccaaacgcgcagaatcgaaattcaagatcaatcgccgcctcggcgtcaacctgtggggccgcgccaagtctccgctgaacaagcgtgactacgcacccggccagcatggtcagcgccgtaaaggcaagccgagcgatttcggcattcagctgatggcgaagcagaagctgaagggctattacggcaatatcagcgagaagcagttccgcaagtattatgaggaagcggtccgtcgcaagggtgatacctccgagaacctcattgagctgctggaacgccgcctggatgccgtcatttatcgtatgaagttcgcgctgaccccgttcgcggcgcgtcagttcgtgaaccacggccatgtgctggtgaacggcaagcgcgtgaacatcccgtcctatctggtgaaggtcggtgacgtggtggaagtgcgtgagaagtcgaagcagctcgccatggtgctggacgccacccagagcggtgagcgcgatgtgccggaatatctgcacgtcgatcatcgcctgatgaagggcacctatgcccgctatccgaaactgtccgatgtgccgtacccggtgcagatggaaccgaatctggtcatcgaatactattctcgctgatccggtttttatcggtacgtttttcaacgccgggcatggcagcatgtccggcgttgccgtttctgccgctgcttgtcctgatggggtgcgcttcgcgttatgaccgcgcttgccaatgaaatccgccgccgtcgcacctttgcgatcatttcccaccctgacgcgggtaaaaccaccctgaccgagcggttgctggtcgctggtggggccattcagcttgcaggaaatgtccgcgccaaaggggagcggcgccgcacccggtcggactggatggccattgagcgggatcgcggcatttccgtcgtcacctcggtgatgacgttcgaatacaaggattgcgtgttcaatctgctggatacgccgggccacgaggacttttcggaagatacctaccgcacactgacggcggtggactcggcggtgatggtgattgacgctgcgaaaggtatcgaggcccgcacacgcaagctgttcgagatctgccgtctacgcgatattcccatcatcaccttcatcaacaagatggatcgtgaggcgcaggacccgtttgcgttgctggacgaggtcgcgaatacgctcgcgctggataccgcgccggttacctggccggtgggcagggcggcggatttcatcggcacctatgacctgcgtttgcaggaataccgtctgacgcagcaggttccggaatccgatcctcgcatgcagggggtggcggaggagctggagctggtccgtgccgccctgccggaattcgaggttgaaggtttcatggagggccatttgaccccggttttcttcggtgcggcgatcaaggatatcggcgtgaccgatctgctcgatgcgctgtccgccttcgggccgccgccccgggcgcaaccggcggatacccgtatcgtctcggcggaagaagaaacagccactgcgctggtgttcaagattcaggcgaatatggatcccaatcatcgggaccggattgcctttgcccgcgtgtgctccggcaagatcgtgcgcggcatgcggatgaagcaggcccgcaccggcaaacagattccgctgcatgcaccgcaattcttcttcgcgcgcgaccgtcaactggccgaagaagcctttgccggtgacgtggtgggaattcccaatcacggcacgctacgcatcggcgatacgctgacggaggaagaagggctgaacttcaccggtgtcccttatttcgccccggaaatcctccgccgcgtgcagatcaaggacgccatgaaagccaaaaagctcaagcaggctttgcaggaactggccgaagaaggcgtcgtacagctgttccgcccgcgcgatggctcccagccgattgtcggtgtggtcggggtgttgcagctggatgtgctgatggcgcggctggccaatgagtacggggtgccgattactttcgatcagacaccgttttcgctggcgcgctgggtgtccggggagaaagcggcactggaaaaattcattgatgcgcaacgcagcgccatggcggatgatgtcgacggcgatccggtctttctggcaagctccgcctttatgatgcggcgtacggcggaactgagtcccgatattacgttccgggacgtcaaggacatgcatgcggatgctgtttctgcataagcacatgtgctgatctgatgaatgagaatgctggtggttcttcaagctagggccctgcctgattatgtaggtgtttcagactccgccgggtaaggacgatgcagatgcaggatgccgcgctggaaaagcagttacaggatgatgctacggctgctcgggaggcctcgttgcatccggtgacggaggcggtttcagtccctcatggcgcgggcctgccgttgttgcgtcaggccatcatggaagaattcgccggtcgcattgccgtggtctcatccttcggggccgaatccgccctgctgctcgcgctggtggcggagatagaccctgcgacaccgattgtctttctggaaacggagcgccattttccggagactctcgcctatcggcagcaattggccaacctgcttggtctgaccggcatccgcgatatccacccggatccggaagaggcagcggctcaggaccctgatgccgagttatggtatttcgatgccgatgcatgttgcgccctgcgtaaggtgcgtccgctggaaaaggctttatccggtttcgatgcctggatcagtgggcgcaaacgccatcaggccagcacgcgcgcggcgctgcccttccgggaggtcgagggcaagtttaccaaattcaatccgctggccgactggggggctgccgatatcgaggcggaaatgacgcggcgccagttgccgcgtcatcctttggtggcaaaaggatacccgtcaattggttgtgccccctgcacccagccggtggcacccggagccgatccgagatcaggtcgatggagaggccgcgccaaaactgaatgcggtattcatcggccaacgggctgacagtgcagcccgttgcatccaggaggtatcagccgacagggaaggggttacgctctgagaagtgggcttgatgccagtagggatagattttcggtacctcgctggctgcatccagtctggcaacctgatcctccgtcaaatgccagccgatggcgccaagattatcgcgtagctgctgctcattgcgggcaccgatgatcacattggcgacccccgggcgttgcagcagccagttcagggcgatctgcgggacggtttttccggtttcctgagcgatttcgtccagcgcatcgacaactttatacagataattgtcatcgacctgcggccccggatcggcagcacgatgcagccggctggtttcaggcagaggttgaccgcgtctgattttacccgtcagccgtccccaaccgagtggactccacaccatgcagcccactccttgatcgagaccgagcggcatcaattcccactcatattcccgaccgacgaggctgtaataggcctgatgcgaaatatagcgtggcagattataggcctgcgcataggccagtgatttcatcagatgccagccggagaaattggagcacccgacatagcggatttttcctgcccggatcagatcatccagcgtgttcagcacttcctcgaccggggttttcgcgtcgaaaccgtgcagatggaacaggtcgatgtaatcggttcccagacgcttcagggatgcttcgaccgagcggatcagatgcaggcgtgatgacccgacatcgttatagccactcccggcacgaaaagtggctttggtggaaataagaacctgatcccgtcgcccggcaatggcaccgcccagtacttcttcagcgataccggctgaataaatatcggcgctgtcaaaaaaattcagaccggcctccaggcagatatcgaccagccgcgttgctgcctgaacatctgtatcgccccattccttgaaaagcgctcccttgccgccgaaagtgccggtaccaaggctgagcacgggaacaaaaagccctgatcggccaagctgtctggtttccacacgcattctcctgtcgataagagatcatcgggatcatataataacgtaagttattatatagtcaccttctaaaattcagctatttgcagcgccacggcatgattgctttccttttttgggcaaaatgcgtctaggcttgggtttcctgtcgataagcggaatcgaggtctcgatgagtcctgataaaatcgctgtcatcggcgcgggtttcagcgggacgttactggccctgcatgccctccgacgatgtccccataataccaccgtcacattgatcgaacgcaaccgccagttcgggcggggtcaggcttacgccactggcaatccgagccatctgctcaatgtccctgccggacgcatgagcgcctttcacgataatccccatcattttgttgcctggttgcgggagcatccgcaggaggccgcagccttgggtgtggcaccgggcaccgaagaaggcgcttttgtgccgcgctccctgttcggtagttatgtccgctccctgctcaatgccgagcttaaggaggatgagcggctcgaactggtgaggggcgatgcgcatgatctgtgctgtggtcctgacggcaggttgcagatcatgctcgggcagggcgcaaccgagcgcgtggtcgaggcggatcgtgtcgttctcgccaccggtaatttcccgccggcaccaccgccggtcgaggatccttcttttttcgatacgccgttctacagtcctgatccgtgggccacggatgcactgacagggctggagccggaagctccggttttcctgatcggcaccggcctgaccatggtggatgtcgcagtttccctgctggatcagggccatcatggtccgatcatggctgtgtccagacgagggctggttccgctgcgtcatggtggaggggcgttgccgcctctgcgctccagcgcccggcagagccatccggatactgaattgtcaccggatgacgctgcctttccgaccaccatcaacgatttgctccgctttttacgtcaggaagccgcccgttccatcgcgtcgggggaaagctggcagccggtggtggacagcctgcgtccttttacgatcgatgtgtggcaaaccatgccgatgcgggacagggccagatttctgcgccatctgcgaccatggtgggatattcaccgtcatcgcgtaccgcctgccacggctgaccggattaccgatgccagggcacgggggcagttgaggattgcggccggacgaatcagggctttcgatatcacagatcaaggcgaggttctgatccgctggcggaagcggggggaggccgatctgacgtcgacccgtgcggtacgagtcatcaactgctccggcccctgtgccgattatgcccggatcggccatccactgattcgtgccctgctcgatcggggatcggtcaggccggacccgctcgggttggggctggaagtcactgggaactgtgccttgctggacaaggccgggcgtatttcacggcggctgtttgccgtgggaccgatcaccaaaggggcattctgggaaatgaccgctgtgccagatatccggcgacaggccgagtttgtggccgggcatctcgccgcccttatcaaggcctccccctgccgcgctgcgtagctgcaacgggaaatgggatcagcgccgctggagaatataattgccggtataggtgatggtgatggaatcctccttggtgccgggggggaaaggcggcacgcgggagccgcgccagacggaggtccaggccatatccagcgcttgcgatcccgagctttccagcatctgcacgtccgtcaccacgccgaagcggttgattgtcagctgaagcgtcacaggcccgtcctccccgcgcatagccgcgtcacgcgggtagtagccgtgttcctgcacccagcggcggagcgcggctttccagtcatttccaagggccagattattcggcatcgaggcgaacggattattatgccgcaaaccgcgtgcggctccccccagtgaatagttcaagggagaggaaagcgaactgccgggtgcttcccggaccttgcccggcggacgcgatgatgttcggggcgtcgctttgggcgcgcgcaccgggggttgcggcatggtccggggctgtggcggggaggggggcgccggaggggactcggtcgttggcggcggtggggcgagcggcacggcatcgggcgccggctctggcggcaaggggatatcaggcacgggtgcaggcggctgttgcgccggtgttgttgatggcgcctgagactgcggagcgggcggcacgggagcgacctgcggcggagcctcctgcggttgaggaggtgcaggcgggttgggcggggctgatgatggagagggttgggaggtatcaggcttgtcctccggcgtggggggaggcgttcccggcttgtcggacaaggcagccgaatcggtcttgctgtcagggctggtattggacggggctttctctcctccggcctcgaacaccatggcgacatcgctgggggctgacagatcctgtgggggccgcccgacatgcaggaacagcagcgccgccagaagcagggcgtgaacggcaatcgacaggacgagcgtaaccgacaggcggtctcgccccatccgttccccttctccccagggaccacatgcggtgagctgccgttctgtcatgtcgggcgacggtgttgtccggtcagacgccacgcaagatccttatcgttcctgcgattatgggcgaattcaggcggcaggaaaacctgccatgccgccggattggcagggaaatcggctttctccctcgggtgagagggagaaagcctccatcctgtcagctacggctggttttcttgcggctgctgctgccacccggtcccgcggtccgaccacggggagcggtgtgacgaccggagggtgcggtggaagaggacttgccgtaggacggcttgtctttcgacgcgccacgccggggggcgtcacctgcataggcggatgagccgctgcgggcggtccggggtttaccgccggctttcgaatcgtaggacttcgcctcatagggcttgtcatatgctttacgttcgccggagcggggagcagttttggaagtgcggcgtggacggccggtctcgtcacccccgtgatcggcttcgcgcatggcacggtcgaagccgcctttgccgcgttccgcggttgaggggcgcggtgtgtagccacctgaaacgcctgcggggggagccgaagcggcggaaatggccacttcatcggcctcacggccctcaatggcgctgctgaacgtgtcggcacgggcagagtctatctcgaagaaggtctccgtctccatgatgcgaatcgcaccgatatccggcttgcggatgtgaccggcgcggcacagcagcggtacgatccatttcggatcggcattgtcgttgcgaccgacgctcagcttgaaccagcgtgtggaacgtgcttcgccgtcattgtcccggcgcggcgcgcgggccgggcggtcctgatcgctgcggtctctgtcacggacccgctcacgctgcggacggtctccacgctcgctgttgctggggcgctcatgcacgacctgaacgtcttccggttccggcaggcgtccgcgatgcaggcgcagcacggcgaccgccagagcctccgcatcgcggccttccatcaggatacgcgccgcttcacgctcatcgtcagagatgggggcactcagggccgggctttccagcatgcgctcccggtcacggatggagatttcctcgaccgttggaaccggggtccattcagcgcgaatgccagccgtgtgcagaagctgatcggccttgcgctgacggttgacgggggcgatcagcacgctgacccccttgcgtccggcgcggccggtgcgaccgctgcgatgcagcagggtggcggaattggtcggcagatcggcatggatcaccagatccagcgcgggcagatcgaggccgcgggccgccacatccgtggcgacacagacgcgggcctgtccctcgcgcagcagatgcagggcgcggctgcgttcggtctggctcaactcgccggacagcgcgacagaggagaagccgcgctccatcagactggcctgaaaatggcggacttcctcacgcgtgccgcagaacaccatggcgatgggagcgtcgtagaaacgcagcacgttcaccaccgaatgacgcgcctcatgcggcagcacccgcacgacgcgatagtcgatatcggcatgcggcttgttgcgggaaacggtgtcgatgcgcagcgcattggtctggtaacgcttggccagcgcggcgatttcacgggcgatggtggcggagaacagcagggtacggcgttctgcgggggtggcgtcgaggatttcctccagctcatcccggaagccgagatcgagcatttcgtcggcttcgtccagcaccacggcgcggaggcgggaaagattcaggcgcccgcgtcccagatggtcgcaaagacggcccggcgtgccgacgacgatatggcagccgcgctccagcgcctgcgcttcccgtctggcatccatgccaccgatacaggagacgacacgggcgccggcgggaccatacagccacagcaattcctgctgcacctgcatggccagttcgcgggtcggggccacgatcagcgccagcggtgcaccggcctggccgagccgttcgtcagcgcccagcagcgtgtcggccagagccagaccataggcaacggtcttgccggaaccggtctgggcggagaccagcagatcgcgctcggcggcatcagcggtcagaacagcatcctgcacaggggtcaggctcgtatagcccttggcatccagcgctgccttcagggttggatgcagcgcgggaaacagggccggggctgatgcctcggcatgggtgttcatgtcggcatccgcgtgcgtcgcggcggtatcggaaaacatcaatgcataaaatccggtcggggagatgatggagggcatttcttcaacgggccgcacgcccatccgtcatcagcggccgagagccgatcctatagcaacattcttcacgctgatcccagtataaagcgcgctgcccagccccgcgtgaatggcggttatggccgggtgttgcggattagtcctgacccggttccagccgtctggtccaggcggcgaacgctgccaaagtctcgtcactggcatggtgttccataccttccgcatcctgtagcgcaacttcgggtgagatgccgagtatccgcaggaagcggaacacaatctgatgccggtggcgtgcacgttgtgccagcgcttctcccgccggggtcagcagaatggagcggtacggtatgctattgaccagaccatcccgcgccagacgggcaatggtgcggttcacggtgacatgggtcacccccagtgcgcgggcaatatcgatggcgcgggcctgtccatggtgggcgatcaggtcggcgatcagctccacataatcttcggcaatctcggtctgccgcgcttcacgcgcacgtgtgaagcgattctcgggcgcctccaagtcagcagaaacgggtggggcaggctcaacactcatgggccggagtgtctccgaacccgtcttgtgccgcaagggtaaggttaaagatagcaatagacatcaaagggtcgctatcattgcccttatcttgccacaaagatgagatgatagcggtagccagacccgatgcagccagcatcgccgcaagctatatttcattccgccagcgtgccagacagagccagggatcataatcgtccatgaagatcgcgcagatttcacctttgtatgagcgcgttccccccaggctgtacgggggtacggaaagaatcgtttccttcctgacggaggagctggtggcgcagggccacgaagtcacgctgtttgccagcggtgattcgattaccaaggcccgccttgtttccccctgcgatgttgcattgcggctgaacccggaggtcaagcttgatctgccctggcatacgatgcagctggagcaggtgcggcagatggcgcacgagttcgacgtgctgcattttcataccgatctgatccatttcccggtggtgcgtcccttttccagccggacactgacgacattgcatggacggctggatctgaaggatctgcccggcttctatcgcatgttcagtgaaatcccggtcgtctccatctccgataatcagcgggcgccgatgccaccggtcaattgggcgggaacagtcctgcatggcctgcccgccgatctcctgcctttctcggctaatccaaaaggcggatatttcgccttcctgggccgtatctccccggaaaaaggcccggatcgggccatcgagatcgccacccgcgccggagtgcgactgaagattgcggccaaggtcgacaaggccgatcagcattactgggatacggtcatcaagccgatggtcgatgccaatccgctggctgaatatatcggtgagatcaatgagcagcagaaggccgagttcctcggcaatgccaccgctctgctgttcccgatcgactggccggaaccgttcggtctggtgatgatcgaggccatggcctgtggaacaccggtgatcgcctggcgcaatggctctgtgccggaagtcatgcagcacggaaaaagcggtatgatcatcagcagcatggatgaagccgttgccgcggtgcgccatgtggaaagcatggatcgcgctggtgtgcgcgcctgcttcgatgatcgttttaccgctgcccgtatggcgcgtgattatgtacacttgtacgagctggcggcgcagggggcacccctcgcgcgggttgcctaaatctttctatcgggttgaacccggcgcagatcatgatggtctgcgccgtaggtccgatgacggatcaaacgccggaatgctcgtttcgccacagggcaatgccgccggtaatgcctgcatcgtttgaaacgatatgaacattgcccggcagatctaaagtgacttcttttgcgttgccgccgccgatatagagtgtgtcgtagcagaccagctcgtacagaatatcgatcactttttgcacatgccggttccagcgcttcttgccggatttttccagtgcgacgtgcccaacgtaatcattgtaggttttcttccggtgaaccggatggtgagccagttcgagatgcggagtaagcctgccattgataaacagggcggttccggcgccggtgccgagggtcagcaccatttcaagcccgtgtccctgaatgacgcccagcccctgaatatcggcatcattggccagccttgctggagcatgcagcgctgatcccagtttttcggcaagcgggaaatgcttccatgtcccggtgtcgaaatggggggcggttagaaccttgccgtcacgtaccatgccgggaaatccgatggaaatacgctggtaagcgggcaaaggctgcaccagtttttccagtgtttccagcatgatgtcgggtgggcagggatagggcgtcttgacccagacacgcggcacgaccatctggccgtcgctgtccagtactgacgctttcagccctgtcccgccaatatcgatggccagcgtgtaaggagcttttcccccagcttttttcccctgtgccatgccctgaaggggattggcatgggctttatcgtgactgtcgtctggcatgattgtcctgccgctttctattgtagcggacaatcatgaaagcactcagagcatgatggcaactcacgctgccgccagagcttccctgacgcccagcaatcccagcaattccaggcgcaggcttgcaaatgccgcatcgccggggcggcgggggcggggaattgagatcgttcgttcggcggcaatccgcccgtgctccagtaccacgacacggtccgcgagcaacagcgcttcgtcgacatcatgtgtcaccagcagtaccgccgtacggtgaacctcccacaaccgtgccaccaggctctgcatccgcaatctggtcagggcatcaagcgccgcgaaaggttcatcaagcagcaggagctccggcgagcggaccagtgcacgcgccagcccagcccgttgcgcttctccgcccgacagggtcaagggccaggcgtcagcccggtgcgccagttcaacttcgcgcagggcctccacggcatggtcgcgggtggggcgatcctttacgcccagcacgacattgcgccacacattcttccagggcagcagccggggttcctgaaacaccacagccctgcgttccggcaggcgcagatggccctgtgatggtgtatccagtccggcaagaaggcgtagcaaagtcgttttgccagagccgctgcggcccagcagagccacgaattctcccggtgcgatatcaagactcaacccggataagatggttgtgctgccgaattgctggtggacctggtgcagggaaacgacgggtgtttgtgtcatggcttatgctccaagccctactggacgccagcgcagggcgcgggcctcaatccatcgtacagcctgatcggcaatcagccccagcagcgcataaaccagcagccccacgataatgatgtcggtacgcaggaattcccgggcatcaatcatcatgaagccgatcccgctgtcggcattgacctgctcggccaccaccagactcagccagccaatgcccacggcatagcgtagaccggtcagaaaatgcggaagcgcccccggcaggacgatagcagtgatggtttcacggcggctcagccccagcgtgcgtccagcttccagtaacttgcgatccacactccggatgccggcgaacagattcagatagaccggaaacaccgcccccagcgcgaccagaagcaccttgggcgtttccccgattccaaaccagaggatgaacagcggcaccagcgccagatgtggcagcacccgcaccatctgcatcggggtatcgacaatttcttcccccagccgggacaggccagccactagggccagcactgtgccggcaccgatcccgatcaccagacctgcactgacgcgcagcagggaaaccgacatatggccgattagctcgccatcaagcagcagatcccggaaagttgccagaatggtgaatggcgccgcgatggtccgggtggagatcaatccgaaacttgaacccgcctgccaaaccgccagaagcagaagaagagaaacatatcgccgtcccccctgaaggcgtcggctcaatgtgtccctcacgctggaccaggacggaaatgaggacattgctctggctggtcttgtgaaaacggactcagacatgaagtctcccgcctattgtccggctgattgttttctgaatgtacaaacagatgtgatttctgatcaaatatcacatatcatgcgtgtgtcaacattaataactatttaagatagtattttatgtatgatttgatgaatagggtatccgtgagttccattgctcactgggagcaggaggcactggtatctccggtttttttcgttagaacgcgcctcttgcccgatgcgttcgggtcattgccgcggtggtgcgggcggagagaacaagcatgagccaacacaacgaagtcttttgctctgatcctgacatgctggaaggaatcgagcgggagtcaatggatttcgacgtggtgattgtcggtgccggtcctgcgggcctttcagcggcgatccggctgaagcagctatcctctgatctcaccgtatgcgtggtggaaaagggcagcgaagtcggggctcatatcctgtccggtgcggtgattgagccgcgggcactggacgagctgatcccggactggcgcgaaaaaggggctccgctgcacacggccgcttcggaagaccggatgatgtatctgaccgaaacggggggattccggctgccaaccccaccgcagatgcataatgaaggaaattacatcgtcagtctgggtaattttgtgcgctggctcggagagcaggccgaggcgttgggggtggagatttaccctggcttcgcagcggcagggctgattgaggaagaaggccgcattgccggtgtgataaccggtgacatgggtgtgggacgtgatggtcagcccggtccgaatttccagccggggatggagttgcgcgccacctacacgattttcgcggaaggctgccgcgggtcactcagcaagaagctgatgcagcgtttcaatctgcgggagggggtggacccgcagacctacgggatcggcatcaaggagctgtgggaaattcctaaagaaaaccatcgtcccgggcttatcgtgcatacgatgggctggccgatggacagcgccacctatggcggctcattcctgtatcatttcggcgataatctggtctcctacggttttgtcgtcggtctggattacgccaacccatggctttctccgtttgatgagatgcagcggctgaaagcccatcccaaaatgcgggcgcatttcgaaggggggcgtcgcatcgcctatggtgcgcgtgcactcagtgaaggcggtctccaatcgatcccgaagctgacttttccgggcggattgctggtcggggatgcggcaggtttcctgaacgtgcccaagatcaagggcacgcatacggcgatgaaatcaggtgtgttggcagcggaggcgattgccgatgccttcattgccgaccgtgtggcagagccggtcagctacaccggcaagatcagggaaagctgggtgtgggaagagctgtcggcatcccggaatatccgccccagcttctcgcgtttcggcaatattggcggttttttgtactcggcggtggatactgtgcttttcaagggacgcgcgccatggacgctgcatcatccgcatccggaccacaagacattgcgcccggcggagcaagtgcagaagatcgactaccccaaacctgatggcgtactgacattcgaccgcctgtcttcagtttaccttagcggtactaatcatgaggaacagcagccggttcatctgcgcctgcgtgatcccggactctggaagtcgcttaactgggatattttccgtgcaccagagagccgttattgtccggctggtgtctatgaggtggaggaggcggaggacgggcaaccggctctgagaatcaatgcgcagaactgcgtgcactgcaaaacatgcgatatcaaggatccagatcagaatatagactgggccgtgccagagggtggtggaggccccaattatcccggtgggatgtaatggaaaagcaaaagcggcccgactgaaaatcgggccgctttttttaatggctgataaaagcagaatacaaaaaggcgttaaccaaaggcgcttctttcaatggttgtcacgtccagaagcgtgattgtgctttgatcggatagggtaaataccctgcctgcggatgtattgatggcgttggtaaaggcagcatcaatatctgctgacccgtaaccgttcagcacaatgcgatcttcccaggtatggaagttctggattgtgtaatgcgcaccggcctgacccgcattcagaacaaacagatcaacagctgaattagcctggcttgcattgccgatcagcgtgttatcgcctgttccggcatacatgattgttccggaaccttgtgatccgtccagtgtctcctgaccactgccggcaatcaggatattgttttggccccgtgatgtcagaacatccccgttgccgccaccagtgactgttgagttattgcctgcctggataagattgttacctgcggcacctcctttgaaatatccattctggccactccatacagttacattacctgtgccgccttcgatggtatcggacgtattggggtaacctgtattgccaaaataaagcacgtgcccactgccattaaagacagttgtgttggcacttcccgtggcaacagttgcattgccggaatccagaatgaccagaccacgggcattaccggcataatatgtcagatcaccggctccgccgaacagtgtgggtgagcctgattccgtgatgctgccaacaacagtgctggcacctgttccattgatgaaagtcgtggagttccccgtcgtcatatagacgccggcattgctgccaacgacggtattggcagcaccggccgcgtaaattgtatccgcgccctggctccaggtcagattgccatcgccgacaagctgtacttggctccccgcctgaccagtcaggattttgctgcctgctcccacggcttcaatcgtatcgtgtccctggccgccataaattgtagtattaccaacatgatcaacaaaatttgtacttccgcctccaccaacaagctgcgacccgcggccgtatgcattcagtgtaccgccattcggcccgctgaccagcgtatccgctccactgcctcccataataagatcacgggatgagccccctaccagcaggcggggagtggatgagttgttctgaattgtaataggcgcggacgcagatgtctgaacctggggagaaagcgaaacgctttcaggatggagaggcgagaaggcaagctgttgaagggctgtcgagacctgactgacggtcccggtaacagtataggtttttccatcagcgctcagcgtgccgttgccaagatgactataggttccttcagcattggcccccagtgttgctgtggccgtgataatggtattgggatcaaccgcgctgaaaacctgatctgcaaacgggagtaacgcggatctcagggctatgattccgctgcgggatgttgtgcctgcgttattcgtcacagtcaggttaattgctgaggttgtaacctgcccggttgcagcctgccctgcggtctgtgtgaatgtaagtgtattcagaacgttggtgacgtgggcggggctgccggaaatagtgaaagtttttccgtcagcgctgacagttccataaaggcttgggtcggtaaatgtgccactggcaccggtgatggtgaccgcggctgttataccttctccactctgctgggagacggccacacccgacagaatggacagcggaacctgatctgtgccggactggttggaattgaagccagtgattgttggtgtcagtgaatcctcgatagcaagtttggaggagccatcggaatcctggatcacggcaacccgtttggcagcgtagttgcctgtcagctgcagagtatacgatgtcgtgccatcggtgaccgtcaaacgatctgttgcgctatcaatcgttgctgacacggcgctggtataggacagggtgttgaggtcaatgtaatcaccattggaaaaaccctggatgattgcattctgactggctgccggatcattgatttgaagcaggccgcctgtaccctccagatcaattgttccggacagatggccgcctgaagagacgatcagggttccgttgccggacacaatcgtattggccgctgtgccaccggaggagattatctgcatgcctccgctattgacagtggtcccgctggcgatccctccgttcataaccagcatcgatgaaaccgtgcttgtatcaagcaacacgctgctggaggtgatccccgacgatacaatgatactttcctgacggccggtgatcagggtgcttccatctccgctatcctgtgtctcgctgaaggcccagccgctgtaatcaccctgtaatttgaggtgataagcttggcctgatccggaaatagtcagtaaatgactggtattatcataagaaaccgttctgctgccctgcatgtatcgaagtgcattcaggtcaataatgtcgccattgctgaagccattgatctgtgcgcctgatgccagggctgtgggtgatgcaatctcaagcctcgcccctgttccgctcatggtcagggttccagaaagtgtgccgccattctggacggtcagcgtaccagctccatcgatgaccgaattcgatgcaacgccaccttgatagacatattgcagcccaccactatgaataatggaggcagaggctcttccgcctgcggaaacacgttgcgttcctccgctggaaatagctgtctggccggcataaccaagaacaagctgtacaccattggctccaacagtgctgctggttgcaaagcctgtgtactgtgtattgccgctccagctctgtcccataacccacatataattctgtgggttgctgcccccgatagacaggctgtcagcggcagacgtcacgataattccaagacgacgggccgtcagcaaaagagactggtcctgagcatcggaggatgatgatacaccccagcctgtataatcaccggacaggcgcagccggtacgtatcctgaccgctggtgacggacagataactgatattatcgttgttggcggatgtagaatcgatagaaacgagtgttccggccgcagtcgcattgatagagccaaggtcgagcctgtccccttcatcaaacccgctaatgagcggattggcggctagagaggaaggcgcatctattttcagcaggctgcctgagcctgccatatagaccatatcgcttaacagaccgccgctggcgacttcaagggttccgctgcctgatattgtcgtggttgaagccagtccacctgaagagataatcagatggccgccatcgcttattgttgtaaagaatgatgagccaccggaaagaacagtctggctgcctccatccatgatggaaacgctggtagcggttcccccttctgatagggtctggagcccaccactttgaacaagagtgttttctacggagccaccgttggcaacgatttgtacaccaccattgaaaatagcagcatccactgaagagccggagaccgtttccgctccatagagctgtgtattagaggcgattccggtaacactctgtataccgccggcagaaaccagggacgatattgcatatgctccggattcaataatctggctgccaccagaaagaataacgttgctatacgtagatgcgccactgcttatatgggcaatgccaccgctggaaatatagctggactgaaccatactatattgtacagcaaaaagttgcgtggcagacgtggacagatcggcgcctagagtaaaattgctcaatacttcgccggagcttgtataataataacggttcagagctttgatcagtgtgctgccatctgtctggtccgcataagaaacgaattgccagccgggatctgtctgcggctgggatagaagcagggtgtattgaatgccggaagcggaaacaatcaactcacctgagttgtaactgatctgagcattggaagagtaggaaatattattgaaatcaatgctgtctccctcggagaatccgtatatgctcaggaaggaagaatagctgtctgtactgttcagaacgattttggatccggttccagaaaggccgatcgctccctttatcttggctcctgaatcaacaatcagagttcctgccccgctgatcacggtgcccgatactatgccgcctacacgccagctggaatcatacatgacgtgctgcaccccaccatccaaaacggtggtgttaaaagccgtgcctccgccacgaacttcctgaatgccgccactgctgacggttgttgcgtaggcaccgtaagaggcagggattgacgtgctgtaaggtccgtaaatgcgttctatgccgccattcagaacctgtgttccgctggtaatgcctccgctggaccatatggcaactccgccggcctgaagaatgccgccactgctgataatggtgttttgtgcaatggccgatggccctatgacgctttggctgcctccgttttcaatctgagtgccggacgcagtgccatgaacaatctgggaaccacctgattggaccatcgtgctgatggcaatcgggctgtagagcgaatgaaagcctggcccttcaatggtttctgtgctgctgtcagagacaattgtgccggatgtagcaccgtaattgtccagcgcgcctccttgcgtcagaacggtgctgatcgcttgtccgccatattggacagtcagcaggcttccactttggacctgtgtggcggaggcgatgccgcctcccataacgataccgttgagataatcggcgctagcgtcatttttcagcaacaatccgcttgagaccgtattgttgccaacagaaacggtattcccccgtatgacgagaagtgttgaaccgtcggaatccgcaattgttttcagcttttctgtgccgctcagagtggcccttagggcgagcgtaaagcgatctgtgccattcgttatggtggcggttggattgttgccggatgtataagtaaccgatgtattgcccgatgagaattgcagattattgatgtcgatgacgtcggaagagtcaaaatctgaaatataaaacccgcttgccagagcagcctgattgttaagggtcagttgtccgctgacgatgctggttgcaccatcaatagtaccacctgaatcaatcaccagggaaccgccacgactgatgactgcgcttaccgctgttccacccgtgtaaacatgctccaatgcaccgttatgaatgacggtggaggtggcaattccaccgctggaaacattgacagtgcctgcaatcaagtcggcaccgtccaggctgccgccttggctgacattgacggtgccagaaactatgcttgcctcagaggcgtagccatagacatccattctggcgcctccatcaatgatggttctattcgctgcgcccccctccaagacacctaatgctgctgcaaaaccggatacggttgcattgcggtcaatgccaccactgaaaatcaggctggcaccccatgttccaatctgactgtttgatgtgatgccacccgattctgtgtaaatggtaacgcgtggttggacgattgtgccaatcgcaatgcctccatttataacagcaagctgattaatgctgccggattggtcaacgacaatgcccgatgaggtctggcctgaactgataattaattgcgacaatggcttaatccatgtaattaatttatatgtaaatatactttgaagtagttatgcggtgcgatgtcgataaaatcaaaagatttaatcgtatatttggaagtgaattggcatatatgagagcaatttggatgaatgatttaaatttatgaaatttataatttataaaaagataatttatttttgttactttaatttatttgggctggtagtggcattgggggagcctcccatcgaacgcggggcgggtgcgcgtgtctggcgtgttatgatgctggacaggccggatgtgatccgctaaaggcgcctgctcaatcggaacgtgggagaccggttcacccgctcgctggccctgatcggggctggtgggttcttcgtgctttggtgcggagtgaagcggtcgtgcgaaccacggtcctggatgactaacaggagccaggattatggcaaaaaagatcgtcggctacgtcaagctgcagatccctgcgggcaaggcgaatccctctccgccggttggtccggcgctgggtcagcgcggcctgaacatcatgcagttctgcaaggaattcaatgcggccacgcaggctatggaacccggtatgccggttccggtggtgatcaccgcctatgcggaccgcacgttcagctttatcaccaaaactccgccgaacacctatttcctgctgaaggcggcaaaggtgcagaaagggtctcccacggtcggcaagagcgctgctgtgggccgtgtgaccatgtcccagctgcgtgaaatcgcggaaaccaagttccaggacatgaacgcgaacgatattgacggtgccgtccggatgctggcgggttccgccaaatccatgggcctgaccgtggtggagggctgatccgatggcacataacaagcgtctgaaagcggcccgcgcgtccgtcgacagcacaaaattctatccgttgaccgaggctgtggcgctggcgaagaccaacgcccgtgcgaagttcgacgagacgatcgaaatctccctgaacctcggcattgatccgcgtcatgcggaccagatggtgcgtggtctggtctcgctgccgaatggcacaggcaagaccctgcgcgtcggcgtgtttgcccgtggcccgaaggccgaggaagcgaaagctgccggtgccgatgtggtcggcgctgaggatctggcggagctggtgcagaacggcaccattgagttcgatcgctgcattgcgacccccgatatgatggctctggttggtcgtctgggcaaaatccttggtccgcgcggcctgatgccgaacccgaagctcggcactgtgaccatggacgtcaagggtgcggtgactgcggccaagtccggtcagatcgagttccgtgccgaaaaggccggtattatccatgccggtatcggcaaggcgagctttgatgccgataagctggtcgagaacatccgcgctctggtcgatgctatccaaaaggcgaagccgaccggtgcgaagggaacctatcttcagaaagcagcgctcagctcctccatggggcctggcatgcgtctggatgtatcgtccctgacggtctgaccggatagagcatccggttgaatggaatacgctccgcctggcatttgccgggcggagcgggcagggaagctcaggcttcccgatatcctgtccaagaccacacgtgccgcgtcggatcatgatccgggctggcttaaaggggaaagccgtaggcaatccccgcgcgtggaagacgggtcggtcattgggtaggactatgtcctgcccctgatgtcggttccggataaaggacaggcgaatgcatcgccgttgatgcggggatgcatgggtaactgatccggccgggtggtcctgccggattgaacaggagtgagtgcgttggagcgtacggagaagcgagaattcgttgcctccctcgccgccgtgttcgcggaaacctcgattgttgtcgtcacccagaacaagggtctgacggtggcagaggtgaccgagctgcgtcggcgggtcagggcggcaggtgcgaattacaaggtcgccaagaaccgtctggccaacctcgccctggaagggtcccagttcgaaggcatcaagccgctgctgaaaggtccgaccgcgctcgcgtggtctgaggatccggtcgctgcggcaaaggttgtcgtcgacttcgccaagaccaatgacaagctggctattctcggtggttctcttggcagccagacgcttgatgcgtccggcgtcaaggcgcttgccgatctgccgtctctggacacgctgcgcgcgcagctggtgggtctcatctcgacccccgcgacgcgtatcgctggcgtcctccaggcaccggctggccagctggcacgggtcttcggggcttattccaagaaggaagaggcggcctgatcggcccgattctcatcggaaaagtgatcaactgttcaggcagaggcttgaacggaccggaacaacgactaaactaaaggcataaacaaatggctgatctgtcaaacctggttgagcagctgtccagcctgaccgtcctcgaggcggctgagctgtccaagctgttggaagaaaagtggggcgtctccgccgccgctccggtcgccgtggctgctgccccggctgctggcgctgctgctgccccggctgaagagcagaccgagttcactgtcatcctggcgaaggccggcgacaagaagatcaacgtcatcaaggaaatccgcaccatcaccggcctgggcctgaaggaagccaaggatctggtcgaaggcgcgccgaagaccgtgaaggaaggcgtgaacaaggacgaggccgagaagatcaagaaggtgctggaagagcagggcgccgctgtcgagatcaaataaggcagtttccggggcttgccctggatgttgaatacggtgtgggcggaaatgtatatcgtttccgccccatcagtcgttgcagccggatagtccggctgtttctgtcgcatcggggttcggcagagctctgtttgcaaacgcctcttcccgggcggccatgggaagattcagggcgacgttattggccgggcttgacgccggactatcgggcgaaggtatcctccttcgctgcggacccggcggagtgagatttcgggatctaagggcagggcatgaacgcaatcacccagcgggacagcaaatctttcaccggccgcaagcgcatacgcaaaagtttcgcccgtattggcgatgttgtgccgatgcccaatctgattgatgtgcagcgcgccagttatgaagcgttcctccagatgaacgtgcatccggataaccggacgccgacgggcttgcaggaagtttttcgttccgtctttccgattgacgatttcgcgggtcgtggccgtctggaattcgtcaattacgagttggaagagccgaaatacgatgttgaggaatgcattcagcgcggcatgacctttgccgctcccctgaaggtcattctccgtctgatcgtgtgggatgtggacgaagataccggttcccgctctatccgcgacatcaaggaacagccggtttatatgggcgatatgccgctcatgaccgataacggcaccttcatcatcaatggcaccgagcgcgtcatcgtgagccagatgcatcgctctcccggcgtgttcttcgatcacgacaagggcaagacccattcaagcggcaagttcctgtttgctgcgcgcgttattccctatcgcggctcgtggctcgatttcgaattcgacagcaaagatctggtctatgtccgcatcgaccgtcgtcgtaagctgcctgtcacgacgctgctctatgcgctggaaggccagcggaccgaagcggcgatcgcatccggtaccgatccgcaggatctgcccgaaatccacggcatgaccgccgaggaaatcctgtcttatttctatacgcaggttgtgttcaccagcacgccgaagggttgggcgcgtcctttcgatccggaagcgttccgtggcattactctggccgaagccctgatcgacgccgataccggcactgtcgtggccgaggccggcaccaagctgaccgcccgtagcgcccgtaagatcgccgagcaggccaagactgttctggttggccgcgccgatctgctgggccgttatatggccgaggatctggttaacgaccagaccggtgagatttatgccgaagccggcgaagaactgaccgaggcccgtctggccgctctggagactctgggcgtcaccagcctgccgactttggcggtcgaccagaccaccggtccatggattcgcaatactctggcgatcgacaaaaactctactcgtgatgatgcgctgatcgacatctatcgtgtgatgcgccccggtgagccgccgaccccggaaacggcggaagccctgttccgtggcctgttcttcgatatggaccggtatgacctgtcttcggtcggtcgtgtgaagatgaacatgcgtctgggcgtggatgccccggatactgtccgcaccctgcgcaaggaagatattcttcgcaccgtcaagattctgtgtgatctgaaggatggtcgtggcgcgatcgacgatatcgacaatctcggcaatcgtcgcgtgcgttctgtcggcgagctgatggaaaatcagtatcgtcttggcctgctgcgtatggagcgggcgatccgcgagcgcatgggctcggtcgatatcgacacggtcatgccgcatgatctgatcaatgcgaagccggctgccgctgcggtgcgtgagttcttcggctcctcacagctcagccagttcatggaccagaccaatccgctctctgaagtgacgcataagcgtcgcctctccgcgcttggtccgggcggtctgacccgtgagcgtgcaggcttcgaggtccgtgacgttcatccgacccattatggccgtatctgcccgattgaaacgccggaaggcccgaatatcggtctgatcaactcgctggccacctatgccaaggtcaacaagtacggcttcatcgaaacgccgtaccgcatggtcgaggatggcaaggtcagcgatcagtggcgctatctttcagctatggaagaagaccgtctggttgtggcgcaggccgatgcgccgcgtgacagcacaggcaagctgaccgaggaactgatctccgtgcgtcgccagggcgatttccgtctggtgaagccggaagacgttacctcgatggacgtttcgccgaagcagctcgtttcagtggctgcggcgctgatcccgttccttgagaacgatgacgccaaccgcgcgctgatgggatcgaacatgcagcgtcaggccgtgcctctgatccgcgccgatgcacctctggtcggtaccggcatggaagctgctgtggcgcgtgactctggcgctaccatcgttgcccgccgtgccggtgtggtcgatcagatcgacggtgcccgcattgtggtccgtgccagcggtgaggatggagccactcagggcgtcgatatttatcgtctgcgcaagtttatgcgctccaaccagagcacctgcatcaaccagcgtccgctggtgaaggttggtgaccatgtgatttccggcgatatcatcgctgatggtccgtcgacggagctgggtgaactggcgctgggccgtaatgtgctctgcgcgtttatgccatggaatggctacaacttcgaagactccatcctgatcagcgagcggattgcgcgggatgacgtctttacctcgatccatatcgaggaattcgaagtgatggcccgtgacaccaagctgggtcaggaagaaatcacccgcgacattccgaatgtgggtgaagaagctctgcgcaacctcgacgaagccggtatcgtctatattggtgccgaggtgaatccgggtgacattctcgtcggtaaggtcacgccgaagggcgaaagcccgatgacgccggaagaaaaactgctgcgcgccattttcggcgagaaggcgagtgacgtacgcgacacctcgttgaagctgccacccggcacgaccggcaccatcgtagatgtgcgtgtgttcagccgtcgaggcgtcgataaggatgagcgcgccatggcgatcgagcgcgccgagatcgaacgtctggccaaggaccgtgatgacgagcggggcattcaggagcgcgcattcctgaaccgtctgcgtgagaaactgatgggccatccggcttctggtggcttcaagggcatcaaggctggcacaatcatcaccgatgaggtcctggccgagcatccgcgtggcgcatggcgcaacatctccgtgcaggatgatgcggtggtcgccgacatcgaattgctgaagcgtgagttcgacgccgccgtggccaagattcaggctcgttttgaaggcaaggtcgagaagcttcagcgtggtgatgaactgccgccgggcgtgatgaagatggtcaaggtcttcgtggccgtgaagcgcaagcttcagccgggcgacaagatggcgggccgtcacggcaacaaaggtgtggtcagccgcgtggttccggtcgaggatatgccgttcctagaggatggcaccccggtcgatctcgtgctgaacccgctgggcgtgccgagccgtatgaatgtgggtcagattctggagacccatctgggctgggcctgcgccaatctcggtcgtcagatcggtgagctggtggaggactatcgccgcaatggtcagcagcgggatgagctgttgtcccgcctgcgggagatctacggcgaaaacgtctataacgacgtcattgccgatatgaacaacgaccagttgatcgaactggcggagaacctgcgcaagggcgtgccgatcgcaacgcctgttttcgatggcgcccgtccgtcagatattgaaaacatgctgagccgggctggtcttgatacctccggtcaggtggtcctgaccgatggccgcaccggcgagccgttcgaacgtaaggtgacggtcggttatatctatatgctgaagctgcaccacctggttgacgacaagatccatgcccgctcgatcggtccttacagccttgtgacccagcagccgctgggtggtaaggcgcagttcggtggccagcgcttcggtgaaatggaagtgtgggcgctggaagcctacggcgccgcctacaccctgcaggaaatgctgacggtgaagtccgatgacgtgtcgggccgcaccaaggtgtatgaggcgatcgtgcgtgaccaggatagcttcgaggccggcattcctgaaagcttcaacgttctgatgaaggagttgaagtcactgggtctgaatgtcgaccttgaaaaccgctctgcctgattaatggatgttccggaggggcttccgcctctccggaccaggatgcggggattgatccctgtctatcctctctcatgaggtgaccgtatgaacgagctgatgaagatcctgggtcagggcggccagtcgctgagcttcgaccagatcaagattcagatggccagcccggagcagattcgctcctggtcctatggcgaaatcaagaagccggaaacgatcaactaccgcaccttcaagccggagcgggacggtctgttctgtgcacgtattttcggtccgatcaaggactatgaatgcctgtgcggcaagtacaagcggatgaagttccgcggcatcgtgtgcgagaagtgcggcgttgaagtgacgctcgccaaggtgcgccgcgagcgtatgggccatatcgagctggcctccccggttgcccatatctggttcctcaaaagcctgcccagccgtattggcctgatggtcgatctgactctgaaagagctggaaaaaatcctgtatttcgagaactacgttgttctcgaacccggtttgaccgatctgaagctgcatcagcttctgaccgaagagcagttgctgaacaaacaggatgagttcggcgacgatgcgttccgcgccgggatcggggcggaggcgatcaagtcggttctggaagggatcgatatcgacgaggacaaggtccgcctgcgcgccgagctgaaagagacgacctccgaaaccaagcgcaagaagctggtcaagcgcctcaagctgatcgaggcgtttgcggaaagcggtgccaagccggaatggatgattctggatgtagtgccggttattccgccggagctgcgtccgctggtgccactggatggaggccgtttcgcgacctctgacctgaacgatctgtatcgccgtgtcatcaaccgtaataaccgcctgaagcgcctgatcgagctgcgcgcgccggacattatcgtccgcaatgaaaagcgcatgttgcaggaaagcgtggatgcgctgttcgataacggtcgccgtggtcgcgccattaccggtgccaacaagcgtccgctgaagtcgctgtccgatatgctgaagggcaagcagggccggttccgtcagaacctgctcggcaagcgcgtcgactattccggtcgttcggtgatcgtcgtggggccggagatgaagctccatcagtgcggcctgccgaagaagatggctctggaactgttcaagccgttcatctactcgaagctggaaaaatacggtcacgccaccaccatcaaggctgccaagcgcatggtggaaaaagagcgtccggaagtgtgggatatcctcgaagaggtgatccgcgagcatccggtcatgttgaaccgtgcgccgaccctgcatcgtcttggtattcaagcgttcgagccggtgctgatcgaaggcaaggcgatccagctgcaccctctggtgaccaccgcgttcaatgccgacttcgacggtgaccagatggctgtgcacgtgccgctgagccttgaggctcagctggaagcgcgcgtgctgatgatgtccaccaacaacatcctcagccccgccaacggcaagccgatcatcgtgccgagtcaggatatcgtgctgggtctgtactatctgtcgctggaaacgccggagttccgcaatacgccggatgacaaggcgcaggctttcggcacgctgggcgagatcgaggcggcgctgcatgccagaaccgtgaccctgcacaccaagatccgtgcgcgtctgcatacagtagacgatcagggcagcccgatccgcgtgcgcgtggtgaccactccgggccgcatgttgatcgcccagattctgccgcgccatcccaacgtgcctttcgcgctgatcaacaagcagttgaccaagaagaacgtctccgacgtgatcgacgcggtctatcgccattgcggccagaaagagtgcgtgatcttcgccgatcgtctgatgggactcggtttcggccaggccgcgaaggccggcatttccttcggcaaggatgatctgatcatcccggcggaaaagcaggagatgatcgaaaagaccgccggagaggtgaaggaattcgaacagcagtatcaggatggtctgattaccgctggcgaacgctataacaaggtggtcgatgcctggtcgcgctgcaccgatgaggtggcgggcgcgatgatgaaagagatttccaagcaggaactcggtcgtcccatcaattccgtgtggatgatgagccattccggtgcgcgtgggtctccggcccagatgcgtcagcttgccggtatgcgtggcctgatggcgaagccgtccggtgaaatcatcgagcagccgattatcgcgaacttcaaggaaggcctgtcggttctggagtatttcaactccacccacggtgcccgtaaggggttggccgatacggcgctgaagaccgcgaactccggctatctgacccgccgtctggtggacgtggcgcaggactgcatcatcgtcgagaacgattgcggcactgaacgcggcctgaccgtgcgtgcggtgatggatggcggtgaggtggtctccagcctgtccgagcgtattctcggtcgcaccctcagcgaggatgtgctcgatccgaccaccaacaagatcctgtatccgcgcaatacgctgatcgaggaagaacacgccgagaagatcgagaaggccgggatcgaggtggtgaaaatccgctcggttctgacctgcgagagtacggtcggcgtctgtggtcactgctatggccgcgatctggcccgtggcacgccggtgaatatcggtgaggcggtcggcgtgattgccgcccagtccatcggtgaacctggtacgcagctgacgatgcgcaccttccatatcggtggcgccgcgcagcgtggtgccgagcagtccagcgtcgaagccagccatgatggcatcgtgacggtgaagaaccggaacgtggtgctgaacagccagaacgtcgccatcgtgatgtcgcgtaactgcgaaatcgtgctggcggatgaaaaaggccgtgaacgggcgcgttaccgtgtgccgtatggtgcccgtctgctgacggatgaaggcgcccaggtgacccgtgcccagaagctggcggaatgggatccctacactctgccgatcattacggagcgtgctggtaaggtcgaatatctggacctgctggatggcgtgacgctggttgagcggatggacgaagtaaccggcctgacttccaaggtggtggtggactacaagcagaacgcgcgtggtgttgatctgcgtccgcgactccagttgaaggacgagagcggcgatgtcgtgcgtctctccaacaatacggatgctcgttacttcctctctcctgactcgattctgtcggtggagaacggtgccgaggtgaatgccggcgatgtgctggcccgtattccgcgtgaaggcagcaagacccgcgacattacgggtggtctgccgcgcgtggcggagctgttcgaagcccgtcgtcccaaggatcacgcggtcatcgccgagaccgatggtcgggttgaattcggcaaggattacaaggccaagcgccgtatcatcgtgaagaacgacgaaaccggcgaggaaaccgagtatctgatcccgaagggcaagcacgtctcggtgcaggagggcgacttcgtgcgtcttggcgatccgctggtggacggtccgcgcgtgccccatgatatcctgaaggtgctgggtgtcgaggcgctgtcggattatctggtgaacgaaatccaggacgtctatcgactccagggtgtgaagatcaacgacaagcacattgaggtgatcgttcgccagatgctgcagaaggtcgaaattctcgatccgggcgatacgatgtatctgatcggcgagcaggtggaccggctggagttcgaggcagagaatcgcaagcgtgagcgtgagggcgagcgtcctgcggtggccatgccggttcttcagggaatcaccaaagcgtccttgcagacgcagagcttcatcagcgcagcctccttccaggagaccacacgcgtgctgaccgaggctgcgacggcaggcaaggtcgataccctgaatggtctgaaggaaaacgtgattgtcgggcgtctgatcccggccggcacggggtccgtaatgaaccgtctgcgccggattgcctccggtcaggacgaggccaagggagtcgggcaggaaacgccccgactctctggtcaggaagcggctgaataaggctgtttctgttgaggaatgggaacgctggccttgaaaagggccggcgtttctttttggctggtgaaaaccggcgtctgacaggctgccgactccaccggaatcactgtcgagtctttcgatggggtcggttatgggaggcagctacgcggggaatgcagcactcatttgctggaatctggccctgcatgtcgctgtgacgcttgacttgagggcgtaccccacgtaggttccgcgccctcggccgacccccaccgacagggcagggaaggcctcgttttcgctagccacgtctttggtgccgccgatgatagccgggttactggcttaggcttaggccaatgacacggttataccctgcaggccgaatctgattcggcccgtcgcggggttatggcgttgacggtggctcgcccatccgggtgaggtggatagacagagagttcggaaagaggcccgatgccgaccattaaccagctgatcgccaaggggcgtgagcccaacaaggcgcgcaacaaggtcccggcgctgcaggggtgcccgcagaagcgtggcgtttgcacccgcgtgtacacaaccactccgaagaagccgaactcggctcttcgtaaggtggccaaggtgcgcctgacgaacggctatgaggtggtgagctacatcccaggtgagggccacaacctgcaagaacatagcgtcgttctgatccgtggcggacgcgtgaaggatcttcctggcgtgcgttatcacattctgcgcggcgtgctcgacacgcagggtattgcgaagcggcgtcagcgccgttcgctctacggcgcgaagcgtccgaagtaaggagagggctgatatgagccgccgccgccgcgccgttaagcgcgagatcctgccggaccccaagttcggcgatatcgtcatcacacgtttcatgaacgcgctgatgtatgatggtaagaaatccgttgccgagggcattgtttatggtgcactcgacgtgttgaaaaagcgtggtggaaatcaggccgatccggtccgtatgttccatgaagcgctggacaacgtgaaaccggccgtggaagtccggtctcgccgcgtaggcggtgcgacctatcaggtgccggtggaagtgcgcgcggaccgtcggcaggcgctggcgatccgctggatcatcgatgcctcccgcaagcgcggcgagcacacgatggaagagcggctttcaaacgagttgcttgacgccgttcataaccgcggttccgcggtgaagaagcgcgaagatacccaccggatggcagaggccaacaaggccttcagccattaccgttggtaatattcagtagaaacaccggaccgaaaagcgggcacggagaagaccatggccaaggcgaaatttgagcggaacaaaccgcactgcaacatcggcacgatcggacatgttgatcatggcaagacgtcgctgacagcagctatcacgaaggtgcttgccgaaaccggcggcgcaactttcaccgcgtatgaccagatcgacaaggcgccggaagaacgcgcccgtggtatcacgatttccacggcgcacgtggaatatgaaaccggcaaccgtcactacgcgcacgtggattgccccggtcacgccgactatgtgaagaacatgatcaccggcgcggcccagatggatggcggcattctcgtcgtctccgctgctgacggtccgatgccgcagacccgtgagcacattctgctcgcccgtcaggttggcgttccggccctggtcgtgttcctgaacaaggtcgatatggtcgacgatccggagctgctggatctggtcgaaatggaagtgcgcgagctgctttcttcctaccagttcccgggcgacgatattccgatcatcaagggttccgctctgtgcgcccttgaagacaagaacccggaaatcggccgtgatgcgatcctgaagctgatggaagcggtggatgcctacatcccgcagccggagcgtccgctggaccgtccgttcctgatgccgatcgaagacgtgttctcgatctccggccgtggcaccgtggtgaccggtcgtatcgagcgcggtgaagtcaaggttggtgacgaagtcgaaatcgtcggcctgaaggcgacctccaagacgaccgtgaccggcgttgaaatgttccgcaagctgctcgatcgcggtgaagctggcgacaacatcggtgcgctgctgcgtggcaccaagcgtgaagacgtcgagcgtggtcaggttctggccaagccgggctccatcaccccgcatacgaagttcgccgctgaggcgtacatcctcacgaaagaagagggtggccgtcatacgccgttcttcaccaattaccgtccgcagttctacttccgcacgaccgacgtcactggcgttgtgagcctgccggaaggcacggaaatggtgatgccgggcgacaacgtgtccatgcaggttgagctgattgcgccgatcgcgatggatgaaggtctgcgttttgctattcgtgaaggcggccgcaccgttggtgcaggcgtcgtcgcgaagatttcgcagtaatcaacggccccgaattcggacttagtacaaatggataaccagaacatccgcattcgcctcaaggcgtacgatcatcgagtgctcgataacagcacgaaggagatcgtgaatacggcgaagcgtacgggtgcgcgggttcggggccctatcccgctgccgacgcatatcgaacggttcacagtgaaccgttctccgcacgtggataagaaaagccgcgagcagttcgaaatccggacgcatcgccggctcctcgatatcgtcgagccgacaccccagaccgtggacgcgctgatgaagctcgacctggctgccggtgtcgacgtcgagattaagctgtaagagccagccatgcgcacaggattaattgcacgtaagctgggtatgacccggctgttcaaggaagacgggactcatgttcccgtcaccgttctgcatctggaccaggtccaggtcgtggacacccgcaccaaggagcgggatggttacacggcggtgcagctcgggttcggtcaggcaaagccgaagcatgtgtcgaaggccaataaaggtcatttcgcccgtgttaaggtggaaccgaagaagaagctcgtggaattccgggtggcggaagacgccattctggagcccggtgcgactttgtcggccgagcactttctggttggccagaaggtcgacgtgaccggtacgtccaagggtaagggctttgccggtgcgatgaagcgttggaatttcgccggtctggaagccagccacggcgtgtccatcagccatcgtagccacggttcgaccggtaatcgccaggatccgggtaagacttttaaaaacaagaaaatggctggccatctcggtgacgagcgggtgaccactcagaatgtggaagtcgcgcatgtcgatgcggcgcgcggactgctcatgatccgtggctccattcccggtgccaaaggtggttatgtgctggtgcgtgacgccgtgaagcgcaagcgtccggaaggcgttgcctatccggcggcgctgcaggcagacgccgcggcgagcgagggctaagacatgcagatcgagatcaagaccctcgataacggcagtgccggtacggccgagctgccggacgagatttttgcggccaccccgcgtgccgatattatggcgcgcgtggttcactggcagctcgcctgccgccgtgccggcacccacaaggtgaagggcatgggcgaggtaagcggcacgaccaagaagccgtatcgccagaaaggcacaggtaacgctcgtcagggcagcctgcgcgctccgcagtttcgcaccggtggtgccgttcatggtccggtcgttcgcgaccatggctatgatctgccgaagaaggtgcgtcgtctcggcctgatttccgctctgtcccagaagcaggcggaaggcaagctcgtcgtcatcgacacggccgctggtatggaaaagacgcgcgaccttgctgcgaagctgcgcgcccttggctggcgctccgcgttgatcgtcgatggtgccagcgttgacgagggctttgcccgcgcaagccgctcgctgcttgcggttgacgttctgccgaccatcggtgccaacgtatatgacattctgaaccacgacgtgctggcgattacggttgccggtgtcgaggctctcaaggcccgcctcggtttcggtgcggctgaagaaaggagcgcggcatgagctctccgcagaaaacatcgctcgctgcgcgtcgtcgcgctgagcgtatgtcccgcgaggcgatgtatgaagtcatccgtagcccgctgatcaccgaaaaggcgacgctgctcagcgagcgcagccaggttgtgttccgcgtggcgatcgatgcgaccaagccggagatcaaggccgctgttgaaggcctgttcggggtgaaggtgattggcgtcaataccttggtgaacaagggcaagacgaaacgttttcgcggccgccccggccagcggagcgatgtgaagaaggcgtatgtccagctggtcgccggtcaggctatcgacctgaccgccaagctggcctgaggcacggaccatggcactgaagcatttcaatcccgtgactgcgtctttgcgcggcacggttctggtagatcgcagcgaattgtggaagggcaagccggtcaagactttgaccgaaggcaagcactccacgggcggtcgtaataaccatggccggattaccagccggttccgtggcggcggacataagcagacctatcgttatgtggacttcaagcgccgtaaggccgatgttcccgcgacggttgagcgtctggaatatgatccgaaccgcaccgctttcatcgctctgatcaagtatcaggacggcgagttgtcctacatccttgcacctcagcgtttgaaggctggcgatgtcgtggtcagcggcgcgcgggctgatatcaagccgggcaatgcgatgccgctgggagcaatcccggtcggaacgattatccacaatatcgagatgaagccgggtgcgggtggcaagattgcacgctccgctggcacctatgcgcagctggtcggcaaggatgccggttatgcgcagatcaagctgatgtccggcgaactgcgcgtcgtccgcgcggaatgctatgcgacggttggcgcggtgtcgaacccggataactcgaacattcatatcggcaaggcaggccgcagccgctggctgggtcgccgtccgcataaccgcggcgtcgtgatgaaccctgtcgaccatccgcatggtggtggtgaaggccgtacttcgggtggccgtcatccggttaccccgtggggcaagccgaccaagggctacaagacgcgtaccaacaagcgcacggatagcctgattatccgccgtcggaacaagggcaagtaagatggcacgctctgtctggaaaggtccgtttgtcgacggatacctcctgaacaaggccgacgcggcgcgcgcgtcgggccgcaacgagatcatcaagatctggtcgcgtcgctcgacgattctgccgcagttcgttggcctgactttcggtgtttacaacggtcacaaattcctgccggtgcaggtgacggagaacatggtcggacacaagttcggcgaattctcccccacccgtaccttcccgggtcatgcggccgataagaaggcgaagcggggttaagatgagcaagccgaaaacccctcgttccatcgctgagaacgaagcacaagcgatcgtcagcaatttgcgtgtcagcccacgcaagctcaatctggtcgctcagctgatccggaaccgcaaggcatctgatgctgtcgcgactctgactttcagcaagcgccgcatcgcccaagcggtgaagaaggcgcttgagagcgccatcgccaatgccgagaacaatcatcagctcgatgtcgatcgcctggtcgtctcgcgcgctgaagtgggtcgctccatcgtgatgcgccgcttccatgcgcgtggccgtggccgtgcggcgcgggtcgagaagtggttcagccacctcaagatcgtcgttgccgaacggtcccaggaaaccgagacgaaagcggaggccgcgtaatatgggtcacaaagtaaaccccatcggattgcggctgggcatcaaccgcacctgggatagccgttggtatgccggtggggattattcccgtctgctgcatgacgatctgaagctgcgtggccatttgcgcaagaagctctccggcgctggcgtgtcccgcgttgtgatcgagcgtccggcgaagaagccccgcgtgacaatctatgccgcccgtccgggtgtggtgatcggcaagaagggccaggacatcgaggcgctgcgcaagggtctgaccggcatggccgggaccgatgtggccctgaacattgttgaaatccgcaagccggaaatcgatgcgactctggtggccgagaacatcgcccagcagctggaacgtcgcgttgcattccgtcgtgcgatgaagcgcgctgtgcagtctgccatgcgtctgggcgcccagggcatccggatcaattgcagcggccgcctcggcggtgctgaaattgcgcgtatcgagtggtatcgtgaaggccgcgtgcctctgcacacgcttcgcgcagacattgattatggtgttgctaccgccaagacgacctatggcacatgcggcgtcaaggtttggatcttcaaaggtgagatcctggcccaggacccgatggcgcaggatcgtcgcgcggccgagcaggccccgcagcggtaaggaatcacgaatatgctgtccccgaagcgcacaaaataccgcaaggcgcataaaggccggatccacggcaacgccaaaggcggaacaacgctgaatttcggaacatttggcttgaaagcgctcgaacctgagcgtattacagcccgccaaatcgaagccgcccgtcgtgcgattacccgtgcgatgaagcgtgccgggcgcgtgtggatccgcatcttccctgacctgccggtcagcacgaagcctgcggaagtccgcatgggttccggtaagggtagccccgaatactgggtggcccgggttcatcccggccgtgttatgtttgaaatcgacggcgttgcgccggagctggcccgtgaggcgctggcactgggtgcagcgaagttgccgatcaagacgaagtttatcgtccgctcggttgacgcgtgagggtgtgatgacgaagccagccgatatccgtgtgaaaagcgcggacgaactgggtgcgctgctgatcgatctgcggaaggagcagtttaatctgcgctttcagcaggcgacgggtcagcttgaaaagacgggccgcgctgtgcaggtccgtcgtgacatcgcacgcgtgaagacgattctggcggagcgtcagcgcgctgccgctcccaaggcctgaaaggagtagggcaatgcccaggcgggtcctgaccgggcgggtgaccagcgacaagatggacaagaccgttacggttcttgttgatcggcgcattattcatccgctgtacaagaagtttattcgtaaatccaagaagtatgccgcgcatgacgaggcgaatgagtgccgtgaaggcgatatcgttcgtatcgttgagtgcccgccgatcagcaagcgcaagacctgggaagtggtctggcgtaatgggcatgtgctgagcaccgcccataaggaagccattgacgctgccgcgacccagatcgcgcatgctgaggcctccggtgaggcagccgctgcggcggccgagcatcagggagcctgatcgatgattcatcccgagaccaacctggaagtcgccgataacagcggcgcgcgccgggtgcagtgcatcaaggtgctgggcggttccaagcggaagaccgcctcggtcggcgatgttatcgtcgtctccgtcaaggaagccattccccgtggcaaggtgaagaagggcgacgttcatcaggcggtgatcgttcgtaccagctttcccgtgcgccgcgctgatggcagcgcgatccgtttcgaccggaacgcggccgtgctgatcaacaagcagcaggagccgatcggcacccgtatctttgggccggttgtgcgcgagctgcgcggtcgtaagttcatgaagatcatctcgctcgcgcctgaggtgctataatggctgcgaaaattcgcaagggcgaccaggtggtcgtcatctctggcgaggacaagggcaagcgcggcgaagtgctgcgcgtcattcctcgcgagaatcgggccgttgtgcgtggtgttgcggttgccaagcggcatctgaagccgcgcggtatggggcagcccggtggtattcaggaacaggaagcgccggtggcgatttccaacctgatgctggtcgacccgaagagcgacaaacccacccgcgtgggtttccgcattctggataatggtaacaaggttcgtgtggcgaaagtcaccggccaggtcatcgagagctgagggagggagcggtgagcgaaaaccagtccaagccgctgccgcggatgcagcagcgctacaatgatgtagtgcgtgaggctctgctgaaagagttcggctataacaaccggatgcgggtgccccggcttcagaagatcgtcatcaatatgggtgtcggtgaagccgcggcagatcagaagaagcttgattccgctgttgctgatctgacccttattgctggtcagaagccggtcaagacggtggcgaagaaggcgattgccggcttcaagatccgtaaaggcctgccgatcggtgcgaaggtcacactgcgtaaggcgcgtatgtacgagttccttgatcgtcttgtgacgattgctctgccgcgtgtccgcgacttccgcggaatcacgggtaagggcttcgacgggcgtgggaacttcgccatgggcctgaaggaacagatcgtgtttccggaaatcgtctacgacaaggtagacgcggtgcgtggtatggacatcgtcttcgtgacgaccgccgagactgatgcggaagccaaagcactgctgaaggcgttcgatctgccgttcgcggcgtgagcggctggcactctgcggggtgccggtcatctaaaagtttgttggaaaaccgtcggggaagcccgacaggttccggagggtgaaacaaggcatggccaagacgtctgcggtcaaccggaataaaatgcgggagcgtatggcttcccgcgacaaggcgaagcgtgctgcgctgaaagcgatcgtcatggatcgctcgctgccggtggaagatcggttcgaggcaactctgcggctggctcagctgccgcgcaatggcgccgctaatcgcgtgcgtttgcgctgcgagctgacgggccgtccccgtgcgaactatcgcaagttcaagctgtgccgcgtggcgctgcgtgacctggccagctccgggcagatccccggcctggtcaaggcgagctggtaaggagccggatcatgcagctttctgatccgttgggcgatctgctcacacgtatccgcaacgcgcagcgtagccgtcacgccacctgcgtgtcccccgcttccaagcttcgtgccaatgtgctcgaagccctgaagcgtgagggttacatccgtggttatacctcggaagaacttcgcccgggtatttcccagctccgcgttgagctgaaatacaatgatggcgaaccggtgatcaaggagatcacgcgcgtgtccaagcctggccgccgtgtgtattccaagatcaaggaattgccgcgcgtctatgcagggctgggtgtttccatcctgtccacaccgcgtggtgtgttgagcgacaatgaggcccgcgctgccaatgttggcggcgaagtcctctgccgcgtgttctaagggggagggcgagacatgtcacgcgttggcaaatatcccgtcgagatcccgcagggcgtgcaggtggcaatcgccaacaacgttctgacggcgaagggcaagctgggggaactctccctgcctctgaccgatctggtggataccaccgtcgaaggcaatcaggtgaaagtcgccccccggggtaatgatcgccgtgcccgtatgatgtggggcaccacccgtgcgctggtcgcgaatatggtgaagggggtttccacgggctatgtccgttccctggaaatcaacggcaccggttatcgcgccgccgttcagggcaatgcactggttctgaatctgggttactcgcacgacatcacttatccggttccggccggtatcaagatcaccacgccgcgtccaacggccgtgacgatcgagggtgtcgacaagcgtctggttggacaggtcgcttctgagcttcgtcagctgcgtctgcctgagccgtataagggcaagggcgtccgctacgacaatgaagagatccgtcgcaaggaaggtaagaagaagtaagatgccgagcatcgatcttcaggagcgtcggaaacagcgtttgcgtttccagctccgcgccaaggccaatggccgcccgcgcttgtccgtgttccgttctggccggcatatttatgctcaggtgatcgacgatgctgccggccgtacgctggccgctgcgtcttccctggagaagccgctgcgtgagcagctgcgcaccggtgccgaccgtgaggccgcgtccgccgttggcaagctgatcgccgagcgtgcccaggccgccggggtgtctgccgtggtcttcgaccgtggctcctatctgtatcacggtcgcgtcaaggcgctggccgaagccgcccgcgaaggcgggctggccttctaaggggaccaactatggcacgtgaacccagggaaggtcgtggcggtcgcgagcgcgaggccgacgatatcattgataaactggtgacgatcaaccgcgtcgccaaagtggtgaagggcggccgtcgtttcgctttcgccgctctggttgtcgtgggtgaccagaaaggccgggtcggttatggggcgggcaaggcacgtgaagtgccggaagccatccgtaaggcgaccgagcgcgcgaagcgcagcatgatccgcgttccgatgaaggaaggccgcacgctgcatcatgacgtgtatggtcattttggcgcgggtaaggtggtgcttcgcagcgccacagccggtaccggcatcatcgcaggcggcccgatgcgtgccgtcttcgaaagcctcggcatcggcgacgtcgtggccaagagcctcggcagccgtaacccgcataacatggtaaaggcgacgtttgccgccctggaacgctgctcgagcccgcgctctgttgcgtcccgtcgtggcaagaaagtctccgatatcctcggtcgccgtgaaccggtcgccgggcaggaaggggaagaggctcatgcctaagctccgcgttacgcagatcgcctccgtggccgggcgcaagccgggccagaaggagacattgatcggtctcggcctgaacaagatcgggcgcacccgcgttctggaggatactccctccatccgtggtatgacccgcaaggtggcccaccttatccaggtggaggaaaccaatgaagctgaatgaactgcgcgataaccatggcgcacgtccgaaatccaagcgtcttggccgtggtatcggctccggtaagggtaaaacctccggtaaaggcgtgaagggtcagaaggcacgtgaaggcgtttcgctgaacgggttcgagggcggtcagctcccgatctatcgtcgtttgccgaagcgtggcttcgtcaacatcttccgcaaggaatatgcgccgctgaatatcggcaccctgaatgatgcgatcgaagccggtcgcgtcgatgccagccaggaaatcaccgaggacgccctgcgcgccgccggtctggttcgtggtggcaaggttgcgggtgttcgtctgctggcccgtggtgagatcacccgtgcggtgaagatcactgtggccggtgcctctgctgcggcgcgcgccgcggtggagcaggcaggcggcagcatcaccacaaccgtggtggcggaagctgcggaagcctgatcaggatcggtctcctctttttcccccagccaacgggaatggtaaaagaggagatatctctgatggatgactcgcttgtcagcaaacgctgatcgaacgatatatgtggcgccttccgccctgcggttggcgccacagtcctgaaaaggggcctgttacagcgcgctggagccaggaactgatcagccagcgtgcttattgatcgcctgaccacagggggaaagtctcatggcctcggcggccgagcagctcgcttctaatttcaatctcagcaccttctccaaggcgaccgagcttaaaaagcggatatggtttacccttgcggcgctgatcgtctatcgcatcggcacctatgttccagtgccgggggtcgatgcctctgtcatcggtgatatgttcaaccagcaaggcggcggcatcctgggcatgttcgacatgttctcgggtggtgcgctcagccgcatgaccgtgtttgcgctgaacatcatgccttatatcagcgccagcatcatcgttcagttgctgacagcggcggtcccttcgcttgaggccctcaagaaagagggtgagagcggtcggcgcaagatgaacgaatatacccgttacctcactgttctgatcgcattgctgcaatcctatggcattgccgcggggttggagggaatgcaggggccacatggcgctgccgtgatcgatccaggctggtttttccgcctgtcatgtgtggtgacgctggtcggtggaacaatgttcctgatgtggctgggcgagcagattacggctcgcggcgtggggaatggtatttcgctgattatttttgcgggtatcgtcgccaatctgccgcatgctctgggcaatctgcttcagatgagccgcaataatgcgctgtctctgccgtctttgctggccgtgatggtcattgccgtcgcagtgattgcctttgttgtctttatggagcgtgcccagcggcgtgtggtggtgcagtaccccaagcgtcaggtcggaaatcgcatgttcggtggcgacagcacgcatatgccgctgaaggtcaataccgcgaatgtgatacccccgattttcgccagttccctgctgctgattccagcgacaattgccggtttctcaaagaattcgggcaatagctggctgagctggctgtccggtcagctgggacatgggcagcccatctatatgctgctctatgccgggctgatcatcttcttctcctatttctatacggcggttgtgttcaatccgcaggagacggcagataatctgaagaaaaatggcggcttcattcctggtatccgtccgggtaaggcgacggccgattatttcgatcgtattctgaccaggctgacgacggtgggtgcgatttatctggtgattgtttgtctgctgccggaatttctaatcagcaagtttggtgtaccgttctatttcggcggcaccagcctgatgatcgtggtgtccgttacaatggatacagtgacccaggttcaatctcatttgctggcgcatcagtacgaaggtctgattcgtcgcgcacgtacaaaaggaaaaggccgatgagcaaacgtctcaacctgatcctgctcggtccgccgggtgccggcaaagggacgcaggcaaagcgtttgcaggataagcacggcattgcgcagatcagcacaggggacatgctccgtgctgaggttgcggctggcagtgagatcggccagcgtgccaaggctattatggaaagcggtgccctgatgccggacgatgtcatcatcgacatgttggccggacggatcggccagtctgattgcgcgaacggctttattctggacggttttccgcgcacggttccgcaggcggaagcgcttgatgagatgttgacccgtaaagcgcttgagttgtcagccgtcattgaactcgcggtggatgacgcggctctggtcgatcgcatcgccgggcgcttcacatgcagcaaatgcggcactggttaccacgatacgttcaagccgacggcggaagcgggcgtgtgcgatcagtgtgggagcacagagttcgttcgtcgggcggatgataacagggagacggttgtcgcccgtcttgaagcatatcaccgtcagacagcaccgattctcccttattataaggcacagggtcgcctgcgttctgttgatggcatggcggatatggacactgtcaccaaggatatcgaatcgattcttgatgatgtggcgcagcctgcgcgcgcctgatccctgcattttttgatactgcaacaggagcgttagccccttgagaggtggggctggcgctcttattatatgcacagcaatgcctggagtgattggatcaggctttgtccgacggcatgcagaatgcgcatagttgccgcttgacatatgagcatgcggctcacgcgaagttgatctgttatcgttgactcattcggcagggtcgctataagtcccgcctctggccgtgctcgagggatcgggcgcgcctaatcgaatcatttcatgacgcgacgcggcccgcatggcggatcacccggcgcatcgttcactgttccttcctgactatccgtggaaggggcggcggctaacatggagaggcgtagcgtggcgcgtattgccggcgtaaacattccgaccaacaagcgcgtggcgatcagcctgcgttatatctatggcattggtcctgctcaggcgcagaaaatctgcaccgagctgtcgatcccggacgagcgccgggtgaaccagttgagcgatgacgagatcctgcgtatccgcgagctgattgatcgtgaatatcgcgtggagggtgacctccgtcgcgaagttgcgatgaacatcaagcggctgatggatctgggctgctatcgtggcctgcgtcatcgtcgtggcctgccggtgcgcggtcagcgcacgcacacgaatgcccgtacccgtaagggcaaggccgtggcgattgccggcaagaagaaggtcacccgttaaggcttcggcctttccggcgcgttcccgttcgacagacagctcaggatcacctcattatggctcgtaatgccacctcttcgcgtccccgtaaaaaggaacgcaagaatatctcttccggcgtggcgcatgttgccgcgaccttcaacaacacgatgatcacgatcagcgatgcccagggcaacgcgatcgcctggtcctcggccggtgcgcagggcttcaagggaagccgtaagtccaccccgtatgcggcgcaggtcgcggcggaagacgcaggccgcaaagcgcgcgaacacggcatggaaacgctggagatcgaggtgagtggtcctggctccggacgtgaaagcgctctccgtgcgctgcaggcggtcggtttcgcgatcaccgcgatccgcgataccacgccgatcccgcataacggttgccgtcctcggaagcgtcgccgcgtctgagacgcgagcgacaattgtcccggacaatacgatccggggtggatccagccggcattggcgtgagggacgatgttcccgtcagtgtcggcctaaccttttgacaagaggcgaagcgtggtcatccagaggaactggcagtctctgatcaagccggaaaagctcgatgtggagcccggcaacgagccgtcgcgcattgcgaccattgtggcggagccgctggagcgcggcttcggcatgacgctcggcaacgccatccgtcgtatattgctgtcatccctgcagggtgctgcggtgacagcggtgcagatcgacggcgtgctgcatgaattctcgtctgtcgccggtgtgcgtgaagacgtgacggatatcgtcctgaacatcaagcagctggcccttcgcatgcatggcgaaggcccgaagcgcatgatgctgacggcaactggaccgggtgaagtcacggctggccagattcaggccggtcatgacattgagatcatgaaccccgatctcgtcctctgcacgctggatgacggcgtgaagctgggcatggagttcacggtcaatctcggcaagggctatgtccccgccagccagaaccggcaggaagacagcccgatcggtctgatcccgatcgacgctatctattcccccgttcgccgcgtgtcctacaaggtggagccgacacgcgtcggtcaggtcaccgattatgacaagctgctgctgacggttgaaaccaatggtgcggtgactccggaagattcggtggctttggccgctcgtattcttcaggatcagcttcaactcttcatcaacttcgaagagccgcagcaggtccgccacgatgaaccgcaagacgatctgccgttcaaccgcaatcttctgcggaaggtggatgagctggaactctcggttcgcagcgctaactgcctgaagaacgacaatatcgtctatatcggcgatctggtgcagaaatccgaacaggaaatgctgcgcaccccgaatttcgggcgcaagtcgctgaacgagatcaaggaagtcctcgccaatatggggctttccctcggcatgagtgtgtcgggctggccgccggaaaatattgaggacctggccaagcggttggaagaacccttctgataaccgccttttgacaagaccgcgtccggttccggttttctgccctgcaaaaacaggggtcaaaaaacaggtgcgccgaggcgcccaacagagatatagggcgtcccccgtagccgcgatgagcggtagcggggagcgttctcaggagatcgaagactatgcgccatggtattgccggccggaagctcggcgttacgtccagccacaggcaggccatgttccgcaacatggccgttgcccttatcaagcacgagcagatcacgacgacgctgccgaaggcgaaggaacttcgtccggtcgccgaaaagctgatcactcttggcaagcgcggcggtctgcatgcacgccgtcaggcttatgcccagctgcgtgacgaagtgatcgttaccaagctcttcagcgcgatcgctgagcgctacaaggcccgtcagggtggttacacccgtgttctgaaggccggcgttcgctatggcgatgccgcttccatggcggtcattgagctggttgatcgtgatgtttccgccaaagggcaggatagcggcccccgcccggaacgcgacgaaaccgaggaataagcctttcgttttttagaaacgatgcgctgatctggatagacgacaggcccctggagcaatccgggggtttttcgttttgttgatccctgtcatgaaagcttaagccgggcagccgatgataaacatgattgtcaacgcggtatgtccggtcgtggcgttgatcggcgcggggtatctgagtggcaggcgtcagttgctgggggtgggtgcgctggatgcgctcaacctgtatgtggtctggctggcattgcccgcgatgctgtttctggtgatggcgcatctgaccggcaaggatctctcccatttgccgtttgtgctcagctttctcggcgcgcagatgctgcctttcctggcaatttatttttgggccagacgggccggacggggaatcggacaggctacggtggattccctgaccggcagctacgccaacacctcctatatggggattccggtgttgatggcggtgctggggccgcgctccatgatgcctatggcaattgctacggtgatgacggtcggtatccagttcgcaggttccattctgctgatggaaaaggaacgggcgttgaagggtggggcgctgctttcccggtggcgtctgatatggaccgtgttgtgcaatccgctggttgcctcgcccttggccgggggcgcttttgcactggctggaaatataggtggctttcatttgccgcagatggccgagacaaccttgaccatgcttggcaattcctccagcccctgtgcactggtggtgatcggcctgtttctggcgtctcgtcagggcgatgctgcgtcggcacgctcaggggatgggctgttgctggcggtgctgacctttatcaaactgatcctgcagccgctgattgctttcgtgctggcgttctgggtgttccgggccgatccgctctgggcgagagcctgtgtgctgctggcggcaacaccgaatggaaccggtgcgtttatgctggcgcggctgtatgatcgggaggccgggatgatttcacgcgccattctgatttcgaccatcctgtcggccgtcaccctgccgctgttcatcctgctgttgtcctgataaccggaaagggcgagagtctgatcatggtatcacgcgccaatacctcatcatcctccgatctgttcgggggcggggcagcacagtttttgccggaagcggatgatccggcgcgtcctctggccgacaggttgcgtcctgcttctctcgatgatgtcgtggggcaggatcatctgctgggggcagaggggccgttacggcgcatgaccgagagcagggtcttgtcctcgattattttgtgggggcctccgggtaccggaaagacgaccatcgcccgcctgctggcgcgctccaccgatctgcatttcgaggctatttcggcaattcagagtggtgtggccgatctgcgcaaggtgttcgaggcggcccgtcagcgccgtgccgccggaaagggcacgctgctgttctgtgatgaaattcatcgcttcaatcgtggtcagcaggacgctttcctgccagtggtggaggatggaacggttacactggtcggggcgaccaccgagaatccgtctttcgaactgaacagcgctttgctgtcacgttgccgggtgatggtgctgcgtcggctggatgaggccgcgctggagaggctgcttgtgcgggctgaggaaaggatggaacgccccctcccggtttccgcggaagcgcgggaggctctggttgccatggccagtggtgatgggcggtatatgctcaatctggtcgagcaggtttatacttttgccggtggcgatcaggttctggacatgcagacactggggcatgcgctgcaacgccgcccgccggtccatgacaaggccggagacggtcattacgatctgctgagctgtttccataaatccctgcgcggttccgacccgcaggcggcgctgtattatgcggcgcggatgatggtggcgggcgaggcggctgaaaccgtgttccggcggctggcctgtgcggcctcggaggatgtcggcatggccgatcctcaggccatggtgcaggtggtcagcgcctggcaggctttcgagcggatcggctggccggaggggcggttgtttctggcgcaggccatcaattacgtggcgacggccccgaaatccaatgcgtcctatgcctcgttcaatgaggctctggcactggcggaaaagacggcgcatatgccgccgcccctgcatattctcaatgcgccgacgcggatgatgaaggaactgggctaccatgccgggtatcagtatgatcacgatgcaccggatgcgttttcagggcaggagttcttccccgagcctctttccggggcgcgccgccctgaactctatcgtccgcatcagcgtggattcgaacgcgatattcgcaagcggctggaatactgggccggtttgcgaattcagcgcggcggctgatagcaggttcatgaacagagcatgttgcgggaacaggtgctccgggggcacaaccgcttatgcgcgctgcgccgtgtttccgcggtcgtcagcccgatcaggaatacgacgatcatgagtgtgacgacacggcaggtaacggatgatgaagcggatatccgccttgatcgctggtttcgccgccattatccgagcctgacgcaggttgcgatccagaaaatgtgccgtactggccagatcagggtcgatggggcacgggccgaagcggccacgagactacagcccggccagtcggtgcggattccgccgctgaaagtgccctccgctgccgagcaggagggggaagggccacgcgccctcgatccgatccagcagaaggaactggagtcctggattctatataaggacgaccatctgattgtcctgaacaagccctccggcctgcccagtcagggtggccccggcattacccgccatctggatggtttgctcgacgggctgcgtttcgggcgagatgaccggccgcgtctggtgcatcggctggatcgtgacacgtctggtgtcatcgtcattgcccgttcccccggcgtggcggccaagctcgcggctttgttccgcacgcgcgagacggagaaggtctattgggccgtggtggcaggccgcccggtgccggtagaggggcgtatcgaccgtcctttgctgcgccagaacgaccgcaacgagccggttgtgctggccgatcgcaaagaccgcgacaaggtaacggcgatcaccgattaccgcacgcttgaccatgccgcccggaaactggcctggctggagttgcgtcctttgacggggaggatgcatcaactgcgtgtgcattgcgcggcgatggatgcgcctattctgggcgatgagcgctatggcagctggcgtaacaccgatgagcgcggggttcgcaacaccgcgctggtggaaggactgtcccgccggctgcacctgcatgcgcggcggttgagcctgccgcatccggcgggtggcatgctctcggtggaggccgatctgtcgccgcatatggcggagacattcgaaacactgggctttaccgcaccgaaagccagagagggccggctacggtgaccgggccgggcgtgagcatggtgccgcccggagaatcgaagcctccgctccggcgtcgggtgctgagacggctgctttatgccgggattgcggtctccggtctggtcgtcctgtccatcgtggcggcaggtgcggtctggttgatgctcgatcaggccgtgatccgtcatcggatagaggccagcctttacaaggtatccggacatcccgcccatatcgaaggaccgcttggcctggcttttaatccctggcctgtcctgtttgtcagagaggtgtcgctggcccagccggaggagccgtcaggcgccgccctccggcatgactggcccgatccatggtttctgagggcgcaggacatcacagccgggatagcgttatggcctctgctgcatggccatatcacggtttccagcctttctctggcaaggcttgatatccgcatgacccgcaatcatgcgggtgaagagaactggattatcaagcggatcaaggccccctccgcttctgccgcgccgccacccgtgtcagccgctggagaggcggttgcacctcgcccgaagcgggctgtgccgcctgttcgcgtgctcagaatcggtgaagccagcgtggtttatcatgacctgcgcaatggcagcgtctgggcagctgagaagctcaggctccatgccactgaccaacagggcacgatagcactcatgctgtccggtctggtgcagggtatccccatgcgtgccttggtggaaggcggatcagtggatgccctgcttgaccccgatgagcagcatagctggccgctacagatcaatgcgcagcttctcccgactcttcatggcaggctggacaggaataatcctcatctatccgtgagcggggtggttgatcacccgcgtcacggtcgcggctttcatctgatggtcgtgtctcgggttctggatggggcacgtttgctgccattgaggcaggctattcccgcgcttgaccagctggttgggaaaaacgtcccgcccccggaaatctggtcggcaattgccgctctgcatgatgtcagtctgacattccggcttgatgatgatgctacggtgcaacagggcctgtcaccggttttctccgtcgtcagactccatgtgggggacgtgctgccggggcattgggcgcggctgcagaggctggatgcggactggccgggggccgaggccgcactgcgtttctcggcgcagggtctgtaccggaatgccacgctgtccttatcggggcaggtggggcaggttcaggcactctcctcctctttgctggccgggcatgggatagagggtgagtcggttccagtgaggctgtcgctgcgtgccgcctcccctgagaagcctgcgatagtgggtgatctggattttctgggcgatgtggtcgcgcatcccggctggcaggggacgtctttctccgtgaccgctcgtgtgccggatgtctccctgctggccaggctgacccgaacggcgttgccggaaattggcccggttggtttccggggacatgtgacggcggaggcgggggcatggcggctggaggatgccagcctgaccagtgctgccggagatatctcgggtgcggccacatggtctgcccccgcacacggggcagaaggcaaaaccagtggttcaggcccggtgctgggggcgaaactgcattccgcgcgtctggatgtagacaggctgcgccagccttttcccgccattccatccattcagccggagggagagcccgtccgcgttgatcggcctgccatactgccttctgcgcccgtctctgccccttctgtacccccttctatatcctctggggttgctccatcgcgggcatctgagccgccttcaccgtttttccctgtctggctgaagcagtggggagggcagatcgactgggatgtggagatgcttcatgcaggtggcatggactggagcaaagccacaatcggcctgagtcttggtaccgcaggaatccgtgttcagccgctgcatatgcaggcgccgggccagcgcggcccggtctcggctatgctggactggagacgggatggcacgctttctgcggcgctggatgcgggtgcgctcccgcttgaggcacttgtggccctgatgaaacagcctggtatggcccgcggagatatcgggattgatgccgctgtgcaggcgcatatgcagcaggcaggctggcctcatgatctcactggccatgccagtctctggtcggtgggcagcgtggtcagtgggactgcgattgatccggtgctgtcccgattggtcaggcaggctggtctgccattgcatccccgtctgggtgctgatgcgggcattgcctgctttgccgcccgtgccgaggcacgggatggaatcgccgtgctgagggcattcgccctggaaaccgatccgctgcgtctgtctgctgcggggtatgtggatcttcgtgaccagacattgaaactgtttctgcatcctctgctgcgctcggggggaagcgggctgctgttgccgctgatactggaggggccgtttgatcggccctctgcaaaaatgcgcgggtcagatacggcggcgatcaaggcggcaattcagacatccctgacggcgctgggtgttcccgcgttggctggagccgcggatgcggggtcggagatcatgaaccgtgccgatcagggcgattgcgcgccggcactggctgcggcacgggggcagcatgccggtcctccggcgccaatcccttctcagggtggaaaaggaaaattatcggtgcaggatctgctgaaagggctgctgcggtgaagcgtttctggaaagaagcagcggtggttcaggaagcggcggggctggcggtgacccttgatggccgcccgatgcggttgccgggcggtgtctcgcttcgtttcgccaatcgggctttggcagaggcgattgccgtggaatgggggcaggcgggtgcaccgggggagccgttcagcttcgacatggtgccgatgacccgtctggcaggaaccgcgcaggagcgtgtggcggttgatccggcagcgtcggtggaggcgctggtctcttatggcggcagtgatctgctttgttaccgtgccgatgggccggaggaattgacaacccggcaggaacggctttggcagcctctgctcgactgggcagagcagcgctatggtgcgcgcctgcatgtgacgacggggattatccatgtgtcccagccagaggcatcgctgatggcattgcgagccgctctgacggctttggccccggctgctctggcagcgctcgggattgtggtcccggctctgggcagtctcgtcatcggcctcgccctggcggaggggcggcttgatccgccggaggcactcgaaatagcattgctggatgacctctatcaggaagagaaatggggtgcggatgccgaggccgccaaacgccgcacccatctcgccgcggatgttgaaaccgcgatccgcttcctgcgcttgagcgcaggtgcggtatagcacgatggagaaatggcacagtgagcgcaaagcatgtgctgatctccggtgtggtgcagggtgtcggctatcgtgcgtggctgcgatcccgtgcggaggcgcttggtctgtcgggatgggtccgcaatcgccttgatggccgggtagaggccctgattgccggggatatcgcggcggtcgaggaactgattcgtgcttgccgcaccggcccgtctgccgcaagggtggataggatcgaggaacatctcgatactgaccccatcacaccgggttttgagcagtatccgactgtctgatgaaaagtctcttttattccggaggcgcgatgtcgcccgctgagcatgctccaaagcattctgtgccgctgtttcgagacgggcttatcgggcgtcgccagatactgggcggtatcctggcctctctggccggtgccgtcgttgtaccggcccgggcggaggaaagtgatgatgcattgctggcccggattgcagcctatctgaatggtattcatacgctgcgggcgcgtttccgtcagacggcgccggatgggcaggtgacgcagggaacggtctggctggaacgcccggggcatatccggttccagtatgatccgccgacaccgcttctgctggtggccacgaatggggaggtgatttttcaggattttcaggtgcatcaggtcagccgtattccactggaccgcaccccgctgagcattttgctatcagaccatattgattttaacggcgccgctgccgtgcgggaaatttcgcgtacgcccggcgtgattcagctttccgtggtacgacggaccgatccgggggccgggctgctggcaatcgtcttttccgctgatccgctcaagctgatccagtggaccgtggttgatccccagcacaagattaccagagtggaattgtccaatatccagacggggattcccgtcgatccgaccctgttcagcccgaccctcatcaagccgccgggttagacttgataggggccgccgccgaatacagatggccagcttgttctgagtgcggcatcaaggctgcccatatccgcctgaactccgagatcggcgaggctggtaacgccatgctcgctgatcccgcagggaacgatgccggtgaaatgctccagatccggcgcgacattgatggcgatgccgtgccatgagacccagcgtgtgatgcgcacaccgattgcggcgatcttgtcctctctctggccgcgttgcacccagataccaaccctgccggcgcgtctttccccgaggatgccgaatctggccagcgtgatgatgatccaatcctccagcgcggcgatataggcccgcagatcgcgggccgggacgaagccgtgcgggtggttgaggtccagcatcacataggcgatccgctgtccggggccgtgataggtccactgtcccccgcgccctgcctcgaaagtagggaagcgggtggcatcacgcaaatcttcgattttggccgatgttccggcagtgtagagcggcggatgttcgaccagccagaccagactgcgtgcttccccccgctggatggcctcggcgcgggtgcgcatggcggtcagggcttcctcgtaaggggtaaagcccggtgtcacgcaccactccacagtatctgattgtggggaaacggcggaaagattttcgccggatgatgaaaagagtcggggatcagacattgaagtgctcacgggcatcagttatacccccgccgctgcatgacgaaacagtttcttcgtcggtggccgatgcggtcgtggcggaatggtagacgcgcaagcttgaggtgcttgtgggggaaaccccgtggaagttcgagtcttctcgaccgcaccattcaaaaccgggcaatggcccggtttttgtttgttgagcctttgcgttgaagaagtggtcgggcatcttttggtgctgctgcgcgggtttgctatatccgtcagccacatgccgtgccggagtctccatgcgttcccgtttctttttgcgcgtgcttctggccgtgatttttctggccgccacggattcattttttccggcctgcgcaggggatgggatgactgcccatgtgccgctttttgcgctgcggccagaccatttgcccatgatcgccagcgtctccgtcgggggagggccgtcctcaccggtctcgcttgatacaggctcggccggtctttacgtgcctgagcgggatatcggccccggcaccgttgcgacgggggaggtcgttcatcagggctatgctgacggcacgaggctggagggatatgtggccctcgccacggttcgttttacgaatgcggatcgcacgctttccactccggccccgatcagggtgggggtcattacccgtgtttattgtgcacaggacagaccgaactgccccggctccatcgataagccgggggtaatgggtatcagcctggccacacgacgtcatgtggtcagcccgttggcacaaatggggccttactccaccgggtatattatcgattccagactcgggcataacccggtcctgaccgtagggctgacggagaataatatacgcggcttcaccttcgccccccttcgctcgtttcagagcgggcccgatcaccttccttcgtgggacggagaatctgtctcggcatgtttcgcgattgatggcatcagggtggggtgtcaggaaaccgtttttgactccggcagtacagtgactcttttcagccccggttcaagcgatattcccttgacccggcatcatcgtctgccgccggatcatgtctttgttctcgacgtgccggatgtgttgcatttcgcagtgcgtactgaccgcactacggtcatcgtccccaaagatgttgagcacgcgaatagtggaacgctgctgtatcgttattttgctgttgcattcgattccctacgtgggcgggtgggcttcttcggacatcaggagaaccgctgattgcttgtcgcggaaggatgttgcgtcgaagggcagctgatgagaggtattttaatgcaaccctcttccatcagacacacttcataaggttgtgccttatccttgccctctttttggggcatgtggaagctgtcacgaacgcagcgtgaaatgcgtctataaagaagggacatgccatgaataaaccgttgcgcaaggcggttttaccggtggccggattaggcacccggtttttgcccgccacaaaggcaacggcgaaggaaatgctgcccgttgtcgacaaaccgctgattcaatatgcggtggacgaggcgagggccgccgggatcgagcagttctgcatggtcaccggccgtggcaagacagccatcgttgagcatttcgatgtcgcatatgagcttgagtctacattgcgggagcgcaacaaggatgatgcgctgaaattgctggaagatacccagcttctgcccggctccatcgtcacggtgcgccagcaggagccgttgggtctgggccatgcgatctggtgtgcgcgtgccttcatcggggaggatccgttcgctatccttttgcccgatgatctggtcctgtccgagacgccctgcctgaagcagttggccgacgcctatcaggaaaccggcggtaacgtggttgccgtggcggaagtgccgagagagcagaccaaccgctacggtattctcaagactggcgaggatgatggccgcatggtcgaggtgaccggcctggtcgagaagccgaagccggaggaagcgccatccaacctctccatcatcggtcgctatgtgctgcgcccggaggtaattgccgagctggcgcggatggagcgcggggctggtaatgaggtgcaattgactgatgctatggcgcgtctgatcggccggatgccgttccatggcctgcgttatgagggacgccgtttcgattgcggcgacaaggcaggattcctggaagcacagatcgcttttgcgttgaagcgcccagaccttgcgccggcagtcagggcgttcctgaaagactacgtgtaatctggatgttgcccggctggtccgctgataggccagccggttttttctgcggtgctttctgatcacgcctctggacgatcatgcgttcatggcgaagaattaccggcctacacagccagcagatacggtgtcctgtcacacagcgtgctgcaccgtatcagggagaatgagcggaccatggcctttacgcaccaattcgatccgacctctttgcgtgaatacgatattcgcggcatcgtgggccgcacgttgcaccccgctgacgctttcgccatcgggcgggtcttcggaaccatcgtcgcgcgtgcgggcggcagcacggtggcggtcggctatgatggtcgtctctcctcgccggagctggagcctgctctggtggaggggctgaagaaaagcggcatggatgtcatccgcatcggtcgtggtccgaccccgatgttgtatttcgcagcgacgacgctggaaaccgacggtgccatcatggtgaccggcagccataatccgccggactataacggcttcaagatgatgctgggccgcaagccgtttttcggcaagcagattgccgaactgggggccatggcggcctgtggcgatgtggtcggagaagccagcggcaccgatcgggcggaggatgtgtccgccgcctatgtggcccgcctgatttccgattgggatggcggtgatcacctgctgaatgtggtgtgggataacggcaatggtgccgcgggcgaggtgctgcaaaagcttgtacccagcctgccgggccatcatgagatccttaatggcgagattgatggcaccttcccggcccaccatcccgaccccaccgtgccgaagaatcttcagcagctgatcagtgcggttcgcagcaagggggccgatcttggtatcgccttcgatggggatgcggaccgtatcggcgtggtggatgataccggtgagatcctgttcggcgatcagcttctggtggtgttggcaagggatgtgctgaagcagcatcctggcggcaccatcatcgccgatgtgaaggcgagtcaggttctgttcgacgaggtggccaaggctggcggcatgccgctgatgtggaaaacaggccattccctgatcaaggcgaaaatggcggaaaccggtgctcctctggcgggtgagatgtccggccatattttctttgccgaccggtggtatgggtttgacgacgcgctgtatgccgctgtgcgtctgctgggtattatcgcgcggatggatggcaagttgtctgccgtccgcagtgcattgccacaggtgatcaacacgccggagctgcgcttcaactgcgacgatacccgcaaattcggcgtgatcgaggaagtcgctgcccgtctgcgtcaggacggcgccaatgtcgcggaaaccgatggtgtgcgggtgctgacggaggatggctggtggctgctgcgtgcctccaacacccaggcagtgctggtggcgcgtgcagaggcaaccagcgaggatgggctggaacggctgaaggccgctcttgtttcccagcttgagcagagcggactcgcggcaccggatttttccggtgagaatgccggtcattgagttgaacacaggccgggctgcatgatgagcagagcgttttcctcctatctggagcctggccagtatgtccgtcatccgcagcagcctgattgggggctggggcaggtccagtccgccattggggagcgggtgacggtgcatttcgaacatgcgggcaaagtgctgatcaatgcccgcatcatctcgcttctggtggtggatgacccttccgccgcatcatgacagagcatctttgtgacaggcttctcttgacgcttgtatggggacggtcgatctagagagggtgatgaacactgcatcgcccatccagcgccggaccatgctgccatgatcgatccgttcggacgcgctattacctatctgcgggtttccgttaccgaccgctgtgacctgcgctgtacctattgcatggcagaggacatgaccttcctccccaagcgggatgtgctgacgctggaggagctggaccggctgtgccgtgtgttcattgaactcggggtgcggaaactgcggctgaccgggggggaacctctggtgcgtcgggatgtcatgcagttgatttcccgcctcggccagcatctggagcatcgtggcgggcaggggctggaggagctgaccctgaccaccaacgggacacagctggcccgtcatgcggaggctctggcggcggcggggatgcggcgtatcaatgtcagccttgatacgctcgacccggagatcttccgctcgattacaaggcggggacagctggaaacggtgctggacgggattttcgctgctcgggctgcgggtctcgcagtgaagatcaacgcggtcgcgctcaagggtctgaacgatcatgaattcgaccgcatgctgggatggtgcggtgagcatggcttcgatctctgcctgatcgaaaccatgccgatgggcgaaatcgacgaggatcgcaccgatcgctatctgccgctttctctgctacgcgcccggctgcgggagcattggacgcttcaggaaaccgattatcgcaccggtggcccggcccgatatttcacggtacgggaaaccgggcgtagaatcggctttattacgccgatgacccataatttctgcgaaagctgcaatcgggtgcggctgacctgcaccggtacgctctatatgtgccttggtcaggatgatgcggctgatctgcgccgtcccttgcgggagggggcggatgatgccgccctgcgtcaggcggtgcaggaggcgatcacccgcaaaccgaaaggccatgatttcatcattgaccgccgtacgcatacgccctctgtcgggcggcatatgagtgtgacgggcggctgaaaccggggtgttcagcccggttctatcgggggtgtgccgagaatatcggccagactgatctgaccgctgccgcgccgtgccggtttcggctgactgtcggcgggtgcccagccggtcagcattgccagacgcagcctcgcctgcatatgaggctgcccttcctgcgtcagatgcgacaaagcgagcggaaacagtgaaggcggcggtatgctgcgatcacgcagcctcaccgcattggtctccccggcggcgcgcagatcgcgcagcagcgccatcggggtcttgtagaggagtgtcacctcatcctgatcggcgacaggcagggcaaaccccgctcgctgcaacagggcggcaccgtcctgcagggtggcgaaaggggcgacgcgcggcgatgcgccgccagtcaggctgtcttccgaacggctcagtgcctcccgcagcgtatcgagcgtgccgagcaccggcatgctggccaaaaacagcccatccggtttcagggcctgcctgatctgcaccagcgctccgggaagatcatttatccagtgcagcgacatgctcgcgacaatcagatcgaacgaggccggggcgaaaggcagccattcttcatctgccgcgacgcagggcgtgccggacagggacgccatggagggtgacaggtcgcagctgacggtatggatcccgcgtgcccgcaacagaggggcgatgcggccccgcccgcctatgtccagcgcatggctgaacgggcgagtgacatcgtccagccggtccagcagacgaccggccagctcatccagtacaccggcgactgacgtgatgccatgccgtgcggcccgatcacggtgcagccggacggcatggcggtcgaatataaggacgtcatcggacatggcgcccagcataagccgagttggccgttcaggaaacgctgtctcagaatgttgaaacggttccctgaatcaggcccccgatagctccaaccgttgtgcgggcaatggcggagaccagattgaaaacgcttctgatcagaccgggctgatccggtgcgcgcgtaatctgttcctgagtctgggtcagcagattgccccagctatcaatatagcggttgaaatcctctggattggccgaggagccatcgagaccaacgacatgaagcccggtattatcggggatgaccatcagcagaaacggtccgttaccctgcaaatgaccctctgtcagcttcagggcgctgatgatgcgggctgcacgggcatagtcataggttcctgtcaggaaatcgcagtcggtggcgcggtcggctggaacctccggcatctgtatcagccagcgtgtcagaatcaggttgggggctacgacagaggcggcattggcggcctgggccgtcggcaggcggctggtaaaagcctggcagaagctgcggttacggttgagatcacctggtttcaaaatcaccactgcggtcggcatcggcacaagaaaggtcgaaggtccggcgagttgtgttgcaaaaaccgtattggcggatgtcggtcgctcagcgctggagggggatgagccgtggaccccgtttgctcccggcgcagaacaggcagccagaaaggtgaccagcagaagagagggaatagaccttacatatcgcattggttttgtgctcataaacacatgataaaaataataacgatttcgttataatgtacttttttcaggataaaaatcccttaaaataatttttaaaatcaacaggatagtgccgttttcgaatgttttgatcattcggtttgtgcggtactatgacggtggtctacgcctgtccttaaatgcccggagaaatggacgattggcagcgtatttccttccacgcggcaggccattcgtcggtggcagacgatgaccgcttttatcgcccaaaacgacgaatcggaacgattattcctggagcgatcgttctgacgtgggcttctgtgcggcatggacctgaaagaggtcatggcggtcaatgtgcgtcgggtgcgtcatgccagagagatgacgcaggaagagctggcagaccgtgctggcctgagtacccggtatattggcgcgatcgagcgcgcggacgtgtcggtgagcatcacggtgttgggtcggatcgctgaggcgctgggtgtcgagccgggcacattgctgacggcatcactgtgccttggctgatttttccatccatgccgcgagagcgagcaggtttctgaccgctatgccaatcctgatccgttcggcagggttgcatctgctgaactggctgatccctccgacatgcccggtctgtcatgccgaaacttccatgacggggccggatggcctgtccggtctgctttgcgcttcctgcttcgccacgctgaatttcatcgtgccgccggtctgccagtgttgtggacgtccgatggatgcggcggagggcattgcaccggatggcgtgtgcgaggtttgccggatcaaacctccgcggttccgtcatgcgcgtgcggcgctgctgtatgatgatggatcacgccggatcattctgccgttcaagcatgctgatcgcatggcgcatgcctccttgctggcacgttggatggcggattccgggggcgatctgctgcggcaggccgactggctggtaccggttccgctgcatccttcccgcctgcggcaaaggcgctacaaccagtcggctctgttgtgccgggcgctgtcgcgtctgaccggcgtgcctgtgatgctggacggattgcagcgtattcgccgcacgccgagcctcggcacactgaccgccaggcaaaggcaacagatgatgcggggagccattcagacacgcgccgccagaagacagaagctgcgtgcagcccgaatcgtcgtcgtggatgatgtgatgaccagcggtgcgaccatttctgcctgtgtcagggcgctctatgcggcaggggctgcttccgttgatgttctgactgcggcgcgggtggagttgccggatgaaatacccttgtcaggacaggtcaaaaccccgatgtgatgaagcctgttcctgtttcccctgatccagtcaaggaagacaataccgttgatcgaaatctatacgcagccttactgcccatattgctcgcgtgcgcttgccttgctggagaggaagcaggtgcctttcaaggaaattcaggcccttcccggctctcccgcacgggcggaggccaggcagcgctctggcggtcgtaccagcgtgccacagatcttcataggggggcgccatatcggcggctgtgatgacatgatggcgctggaagcggccggagagctggacccgttattgcaagctgcctgaggttgcataaactggtttttcatacccctggtccagtttgatggctgcctctgggaaccgggaagaatgcaggcggtggccgggttacaacgcggaatgatacattatagcgtccggtgccggcatgggcacagcttcgacggatggttcgccagcagcggcgcctttgaccgtcaggttgaggctggtctgattgaatgtcctgtctgcggtgatacgcaggtggagcgtggcctgatgacgccttccttgggtcgtaaaggcaatacgctatccgaacatgcgcctgtcgccctgccccctgattcagcctctgatgatccgttgcaggctgtgtccgtgcccacgcctgcaacggcttctgccgcaggcgttcctgcccagttgcgggcggccttgcaggcgctgcgggcgcaggtggaaaagcattgcgacccggtgggggagaaattcgccgcagaagctctgcgtatccatcgtggcgaggcagaggcacgcggcatttacggtcaggccacggccgaggaagccgagatgcttcaggatgaaggtgtttcctttgccgccattccctgggttccccgctccgacagctgagctaacgatctctttgcgcggcgatgatgtagttgatggacagatcccggctgatcgtccagcacccccgcaatggctggaagctcagcccggcactgtcgaggggacgcagacccgcctgacgcagcaggccggtcagcttgtgtggagcaatgaagcgctgccagtcatgcgtgccgaccggcagccagcgcagcagatattccgccccgagcttcgccaccgcccatgatcgtgcggtacggttcagggtggagatgaagacccgcccgcccggttccagcagatcatgcagcagtgacaggaaggcggcaggatccggcacatgctcgatcacttccagcgcggtgatggcacggaaatgctgcccctcggacagtaattcctcagcggttccggcgcggtaggacaggatcagcccggaagaaagggcggcatgttcctgtgccgccgcaacggcttccgccgcggcatccagtcctaaaaccctgtagccctgatgggccagcgcttcggcggcgaggcctgcgccacaccccacatccagaatggtggcatcctgcatggtggccctatccggcaggtgcctggtcacccagccgatccgcgccgggttcatcatatgcagtggtcgcatcgggccgtacggatcccaccagcgggaagccagcgcatcgaagcgggagacctcttcctccgagacattcgctgccggagcatgagcggcatgtctgtcatgcgaatcgacctcggccatcactctctccttcgtgcgggacaggttgcccccgctgcgtgtcctcgttatgtgtctgcccgcgcgccgggaggcaacccgcctgtgacgggattgccctccgccgcagcgggaaaggggcattcccacccgttggtcgcttgttcctggaagtaacatggcccgcattgtcatgaaattcggcggcacatccgtcggtgatctcgaccgcatccgcaatgtcgcgcgtctggtcaaacgcgaggtggatgccgggaatgaagtttcggtcgtcgtctccgccatgtctggtgtgaccaaccagctggtcggctactgccagtccctgtcgccgctgcatgatgcgcgggaatacgacacggtcgtagccaccggggagcaggtcaccaccgggttgctgtcgatcgcgttgcaggaggcaggggtggatgcccgctcctggcttggctggcagttgccgatccgcaccgacaatgcccatggcaaggcccgtatcgaaagcattgagggcggagaactgatcaaccgcatgcaggccggtcaggtgccggtcgtggcgggctttcaggggattggccccgatcaccgtatcaccacgctcggccgtggcggctccgacacgtcggcggtggcggtggcggcggcagtgcgggcggatcgctgcgatatttataccgacgtggatggggtctataccaccgatccgcgtatcgttgcccgcgccagaaagctggatcgtatttcgtatgaggaaatgctggagctggcttctgtcggctccaaggtgctgcaaacccgcagtgtcgagctggcgatgaaggaacgggtacgcgtcagggttctatccagtttcgcggatcctgaaggcgagaatgtcggcacattggtagtggatgaggacgagatcgtggaaaaggaaatcgtgtccggcattgcgtattcgcgggacgaggcaaagatcactgtccggcgtgtgccggaccggccaggcgtggcggcccatgtgctgggaccgctgacggaagccaatgtgaatgtggacatgatcgtccagaacgtggcggaagacggcaccaccgacatgaccttcaccgttggcacttcagatctgccgcgcgcgcaggccgcactgtcggcggcacaggtggagattggctttgcggaaatgagtgctgatccgcaggtgtgcaaaatcagcgtggtgggtgtcggcatgcgcagccatgtcggcgtggcaaccaccatgttccgcacgctggcggaaaaagggatcaacattcaggtgatctccaccagcgagatcaaggtcagtgtgctgatcgccgaggaatatgcggagcttgcagtgcgtgccctgcatactgcgtatggtctggatgcggcctgatcgcatgacggatatcactcaggccagtaacgcagccgctctcgatcctcgcagtctggctgccgccaatgtcaggctggaagaattatggtcctgcgggacggaatttcttggttcccggtacgccattctcggcggcgcaatgagctgggtgagcgagcggcaccttgtctccgccatttccaatgcgggcggtttcggcgtgatcgcttgcggctccatgatgccggatcagcttgcggcggagattgccgccacgcaggcgctgaccgaccagccttttggcgtcaacctcattaccatgcatccggcgctggatgatctgatccgcgtgtgtctggaggcgaaagtcggccatatcgtgctggcgggcggattgccgccgggcggcgccgtgcgagcggtcaaggatggcggcgcgaagctgatctgctttgcgcctgccctggtgctggcgaagcgtctggtccgctctggtgccgatgcgctggtgatcgagggggcagaggccgggggacatatcggtcccgtttcgctgaccgttctggcgcaggaaattctgcctcatctgcgggatgttccggtgtttgtcgcgggtggtctgggacggggtgaagcgatcctgtcctatctggaaatgggggcctctggagcacagctaggcacccgctttgccgccacgcgtgaaagcatcgcgcacgataatttcaagcgggctttctaccgcgccaatgcccgtgatgccctgccgagcgtacagctggatgagcgcttcccggtcattccggtgcgggggctgatcaatgaaggtacccgccagttcatgcgccatcagttggaaacccgtgatcgcttcctgtccggggaactgacgcgggatcaggcccagcttgaaatcgagcatttctgggccggggcgctgcgtcgcgccgtcattgatggcgatgtggagcatggctcggtcatggccgggcagtctgtcggtatggtgacgggtgagcaggccattcccgaggtcatcgcagaactggtggagcaggctgtttccgccatcgcgctgcgcagcctgtaatccaggcggggcttttcaccagatacgggctattcggcagcatcttctcctgtgagagactgccatatggctttcgttgaccgatcggtcatgcaacattgtctttcgtgattcgcgacaggacgcggcgatggacgggacagggcggcagtggatgcgctgggcggagccggggagcgacagcttcctgttcctcctgctgcacgcccggcgcctttatgggcctttggggccgggcctgatattgcccctgatattgccatggtgatgcgccctcctgccgcaccgcgccgcctgctggcccggttgcgggcgcttatggctggtgatgaagcaccgttggcagagctggtgcgtcttgtcgcgtcagaactcgtcagcgaagtctgttcgatttacgcactgcggcccggcgaaattctggaactggtggcgactgagggattgtatcccgatgcggtcgggcgcacccggctgcggctgggcgaaggcattgtcggcatcgtggccgcgtccggtcacttgctcaatctgcccgatgcgcagaatcatccggcctttgcctatcggcctgaaacgggggaggagctttatgcctccctgctggcggttccggtgcgtcggggaggccgggttctgggcgtgcttgccgtgcagaacagggcggtccggcgttacaccgaggatgaggtggaggtgctggaaaccgtcgccatggtgctggcggaattgtttgccgccaccacgcaggatggtgcggagacgattttcaccacgacggtccagcgtcgctttgtcggtacccgcctgatggggggaattgcggtcgggccggtgattttgcacggcgccgggcctccgccgcgtaatcttctggcgtctgatccgcaggctgagatggaacggctgatggcagccgctcgtcgtatgcaaagcggccttgatgagctgatcgagcaatccctgtcctcggtcagtgaggcggaaagtgctgaagatggcgtatccctggatgaaggcgctctttccgagggtgcgaaagcggcctcgcgggaggtactggaagcctatcggctgctggctgcggatagcggctggctgcgcagggtgcgggatgcagttggcagcggcctgaccgcagaggcggcggtacatcgggtcagcggtgaaatccgtgagaaaatgcgcaagatcgccgacccgtatatgcgggagcgtctggccgatatggaggatctggccctgcgtctgctggcggtgctggatggggcggagcatggcccggtaccacccggtgccattctggtggcacggcgtcttgggccagcggaacttctcaactggcacggcaggggtattgcgggggtcgcgattgaggaaggcacgacaggcggtcatgccgcgatcatcgcccgtgcgcttggcctgcctgcgctgggtgatctgcccaatctgatggatgcggtggacgagggcgatacggccattgtcgatgccgagcaggggctgctgatcttccggcccgaggaggaaatgcggatcgcctatttgcgggcaagggaggcatcacaggcgaaactggcgcattgggcggagctgcgggagcgcccttcccgcagcaaggacggtacgccgttcaccctgatgttgaatatgggactgacgctggagctggatcagcttgaccttaccggcgctgctggtatcggcctgtttcggaccgaaatcgcgatgctggcccatggccgtatgctggatgcgcgggaacaggcggagatttacgatcgcgtcctgacacaggcgggggatcgtcccgtcatgttccgtactctggatctgggcggtgacaagatgctggccgagtctggtgtgtcggttgaggaaaacccggccatgggctggcgctccctgcgtgtcgggctggatcgtccggcggtgatgcggcgtcagttgcgtgctttgattcaggcggctcgcgggcggcctttatcggtcatgttcccgatggtggcgacactggctgaattccgcgccgcgcgagccttgctgcaagccgaaatagagcgggccgatagtccgcctgcaacgctggaagtcggttccatgctggaagtgccatccctgctgtggcagctttctgatcttctggcagaggtcgattttctgtccattggcaccaacgatctgcttcagtttctgtttgcggcggatcgcggtactccggcgctggccggacgatatgattttctgtctcctgccatgcttgatctgctggaagaagtcagtattgctgcccataatacaggctgccgcctctctgtctgtggtgaggcgtcatcacgacctcttgaggtgctggtcatggcagcgctgggtatatcaacattttccatggctgcttctgctttccccgcggtgaaggaagccgtatcgctgtgtgatcttccggccttgcggcgcgttctgatgtctattcgcgggggagagaagggggcatcctcctatcgcgaacctctggtttcatggtgtcgggaacaggggctggatatttgattgttggtgatatctgctcgcgataatgggaaagaccgggcatgcccgatattatgacagcctgttggcaagcatcgcggactgggattagatgcagcgcctgtggaaggtggtctctccgccatcagtatccacgaggggatatccaggagaggcgtcgttttacgtgctggctctactctccccgttccctcatgctgggcctgatccggatgccaagtttttcaaagccgtgcgagcgatcatatcgggtatcatcggggctggctgtttccatgcctgaggtcggaggctctgcgacatgggtatgagaggaccgtccagtggcgccataaccgggaatgcccagactattggcggcgaactgcgcgctgtgcgtgaacatctgggttgggcgctggaagacatagcggcttcactgcgtatacggacagcctatcttctggccattgaggaaggccggataggggatctgcccggcaccacctatgcgatgggcttcgtgcgcacctatgccgccagtctcgggctcgatcctgatgagacggtacagcgcttcaagaccgaggcgggggcgggccatcatcagcaggagcttcattttcccgcgcccgtgccggaacggggtgttcccgccggagcggttgtgctgcttggggccgtgatcgctgtcgcaggttacatcggctggtacaaactatcggccaatcatcctgtgccggatgcggtgcaggaagttcccgagcatctcgcgccgctggcccgcaaagaggaagcaaagacgccggtcgccagccccccagtggcgtctgcgacttcgcaggcgcagccttctgcaccgctctcggcgtcctctgcgtctcctgccccggtgcctggcgcagagacgcatgcggcccagataccatcgaacggaccggcatcgaatggaccggccggcgcacaggctgaaacggctggtgcatcaccgccatcccgcccggctgagcatcaggcacccgggcaccagacatcggagcgggcagcggatgctcccattatgtctccgtctgctatgccccctgcttcatcgcagccctctcttgctgcgggccaaaccaccccatcccctgggcaatcctctgggccggacggggtaaagcctgtcgcgtcgggggcggataaaacgctgcatggcattgtgctgaaagccagtgccgatgcatggatgcaggtaaaatcccagaatggcacgatcctgttgaacaaggttatgcatgccggcgaaagctgggccgtgccggaggctcaggccgggcagggaccgcttctgctgaccaccggcaatgccgggggcactcagattgtgatggatgggcatgatctgcctcctctgggtaacaatggtgccgtccgccgcaacgtgccgctggaaaccgaggcgcttcagaaagcggcaccgtcagccataccgggccagtctcgttcttccgtcagatcctccggcagatcctctgttcctcctgaacctgcccatgatccatcatccactgtgtcttctccggcaccacaaggtcaggatcaggataattcagcggattaggggcagccatgacgtggcttttgtggcacaatccatggaagtgacccattttaagggggtgcgtccactggggcgccatcctgtcgtattggcgtgaattggagcaggctcaatgagctatcgtccctatcagcagattgagcggcgtaaatcccggcagatccatgtcggcaaggtagccgtgggtggagatgcgcccatcagcgtgcagaccatgaccaatacgctgacgaccgatgcggaagcgacgattgcccagattcgccgtgccgaactcgcgggcgtcgatatcgtccgggtctcctgccccgatcaggaaagcaccattgcgctgaaggaaatcgtgcgcgaggtgaatgtgcccatcgtggcggatatccatttccattatcgccgcgccattgaggcggccgaagccggtgcagcctgtctgcgtatcaatcccggcaatatcggcagtgccgagcgtgttcgggaagtggtgaaagccgcccgcgatcatggctgcgccatccgtatcggggtgaatgccggttcgctggagcggcatctgctggagaaatacggcgaacccaatccggatgcgctggtggaaagcgcgctggaacatgccaagattcttcaggatcacgatttccacgaattcaagatcagcgtgaaagcctctgacgtgtttctggcggtggcggcttatcagcaactggccgaagtctgtgaccatcccttgcatatcggcattaccgaggccggtggccgccgtaccggcacggttaaatccgccattggactcggcaatctgctctgggcgggcgtgggcgatacgatgcgtgtctctctctccgccgagccggaggaagaggtgcatgtcggctgggaaattctaaagggcctcggcctgcgccatcgtggcgtgaagatcatctcctgtccgtcctgtgcccgtcagggtttcaacgtgatcgagaccgtggctgcgctggaggaacgtctggcgcatatccagacgccgctgacgctctcgatcattggttgtgtggtcaatggtcccggtgaggcgctgatgacggatatcggcctgaccggcggcggcggtggccgccacatgatctacaatgcgggtaagaccgatcataccattgctgctgacggtatggtcgatcacatcgtcacgctggtggaagaaaaagccgcccgcattgttgaagaagaggctgccgccaaggccgcggccgagcaagccgctcaggaagccgcgcttcagcacgaaaccgtttagtccggctccgttctgtttccggcgcggggcgcaggctccgcgcctttttcgtgtctatccatcacccgagtgtatcgagaccgcatatggccgccttgcaaccccccagaggcactcatgatctgatcggagaagatcagcgtcgttatcgccatgtcgtggagaccgcccgccggatcgtagggctgtatggttttgacgaatgggccacgccggttttcgaagatacgaaagtcttcagccgcactcttggtgaaacgtctgacgtggtgacgaaggagatgtacacctttaccgatcgcggcggagaagggctgaccctgcggccggagggcacggcggctatctgccgtgctctggtcaccaatggcttgacccagtccctgccgcagaaagtgttctatgccgggccgatgttccgctatgaacggccccagaaagggcgctatcgccagtttcatcaaatcgggctggaactgatcggtgcggccgaaccgctggcggatgcggaggcgattgcctgcggttggcagatcctgaacgcgctgggcattggtggcagcgtggcgctggaactgaacacgctgggcgataaagccagccgcgatgcctatcgcgaggcgctggtggcctatttctcggcgcatcgggaggctctgtcggaagagagccgcacccggctggagcgtaacccgctgcggattctggacagcaagaatgagggagaccgtgcgctgattgctgatgcgccggtgatttacgatcatctgacggaagaggccgctacgttttatgtcgggctgaagcgccatctgacgcagcttggcgtgccgttccgggaaaatccgcgcatcgtgcgagggctggattactacaatcatacggcctttgaattcgtcacggatgcgctgggatcacagggcactgtgctggctggtggccgttatgacggtctggtggcggagatgggtggccctgctacccccgccgtgggctgggctgccgggatcgagcgtctgtccatgctgctggctgagccgcctgctgcaccggcaccggtggcagtggtgccggtgggtgaggaagaagaagcggcgctggatgttgtgcagagcttgcgggcggctggattgcgggcggaaatggcctatcgcggcaatctgaagcgccgcatggaacgcgccaacaaggcaggttcctgggccgcggttatcctcggcacggaggagcgggcgcggggcgtggcgcaggtcaaggacctgcgcagcggtgaacagcaggaagtggcgctggatggtctcgccacatggctgctggcgcgtggggtggcatgagttttacagcaaatctcgaccggattgttgcgcgggccgaggagttgcgggcttccctgtccgaagggctgaatggcgacagcttcgcagcggcctcgcgggaactggcggagctggagccggttgtggcccggatcgaggagctgtgggcggcggaacgcggtctggctgaggcggaggccatgctggccgatcccgatatgcgggaactggccgagagcgaagccgaaatcctgcgtgaaaaattgccgtccctgacaagggaaatccggatcgccctgctgccgaaggacgaggcggatgagcgttcggccattctggaaattcgtcctgcggcggggggggatgaggcaagcctgttcgcggcacagcttttttccatgtatcagcgttatgcggaaatccgaggctggcgcttcgagattctcgaatatgacgataccggtctgggtggattgaagggcggtatggcggaaatcaccggccggtcggtttttgcgcggctgaaatatgaaagcggtgtgcatcgtgttcagcgtgttccggccacggaatcacagggacgtatccacacctccaccgtgaccgtcgcggtgctgccggaggcggaggatgtggatgtgcaggtggatgaaggcgatctgcgcatcgacgtgtatcgtgcatccggcgcgggcggccagcacgtcaataaaaccgaaagcgccgtgcggattacccatcttccctccggtatcgtcgtggcgatgcaggaggaaaagagccagcataaaaaccgcgccaaggcgatgaagattctgaaagcacgtctttatgaacagcagcgtgccgccctgcatgccagccgggccgctgatcgccgtgcccaggtgggaacgggggatcgcagcgagcgcatccgcacctataattttccgcaggggcgcgtgtcggatcatcgcatcaatctgacgctgtacaagattgatcgtgtcatgctcggcgagcttgatgatttcgtcgatgccctgacagcagaggatcaggccgcccgtctttccgcacaggaattatgatgacacagacgcatgctgcccaggccgcacatatcgaacagcagttcggcagtcgtgctgatgcctatgtgaggagtgatgtgcatgcgaagggtgctgatctgcatcgtctggtcgatgtgcttgaaccgtaccggggcggtgtgatgctcgatctcggctgtggcggtgggcatgtttcctttacggcagccccgttgatgcagcatgtggtggcgtgtgacctgtctccccgtatgctggaggcggcaggggcggaggcagcccggcgggggctgcatcatattgaaacagtgtccggcacggcggaggctttgccatttgcggatcatcatttcgatgtcgtggccagccgttacagtgcccatcactggcccgatttcgaggccggattacggcaggcctacagggttctgaagccgggtggcctcgcggtgttcatggatacggcgggatttcccgatgctgcggccgatacggtcttgcagagcattgaattgctgcgtgatccctcccatgtccgtaatcgcactttgggcgaatgggtggcggggctggaaagggccggtttcctgattgaggaagcacgcagcgacactctgatcatggattttgcagcatggttggcgcgcatggcgacgccgtctgtgcatgaagcctccatccgcgcattactgatgggggtgccgcaatccatccgtgtgcgattgggggtgcaggatgaagccatctcaagctgggctgtgccgcttgtttttctgaccgcccaccggacagcgtgacaccatgtccgagacgatccgaggagcattgaaccgggccgcctcggctctggctgcggcggaggtggagtctccccgggcggaggcacggttgatgctgggggcgctgctcgggctggatgcgaccggactgctgcgcgacagtgagcgggaggtgacgctgcccttactcgacgaatggatcacgcgcagggcgaagcgggagccgctggcttatattctgggcgcgcgggagttctggggtctgtcttttgcggtgacgcctgacacgctgatcccgcggccggatacggaaacgctgattgagtatgcgctggcgttgcgtcctccgacacaggggatggtgcggcgtgtgcttgatctgggaaccggcacgggatgcctgctgctggcggcgttgcatgaatatcgacaggccacgggtctgggtatcgaccgtatgcagggggctgcggcgttggcccgtcgcaatgcggtttctctgggcatggcggatcgggcagcattctgtgcaggggactgggccttctgctgtgcggacaggtttgatctggtcctgtccaatccgccctatattcccgatcgggatatggaggggttgatggcagatgttcgtgattatgaacctgcctccgcccttgctgccggggaaggcggtatggaggcctatcgcaggatcattccctctttgccggatctgctgacaccagccggtgtcgcgattctggagctggggatcgggcaggaggacggggtaggagccttggcggcaccggcggggttacgcgttatcgggtgccgcgttgatctgggtggtattgccagagcgctggcgcttggccttgatacggtcggcctctcgcaagaatgacgtgtggtgaaaaagtgtcgtcaggcggtcttccgcaaggctgcacgataggtttgcgtggtatgcattgacttgacggataaaattgccccagaacaagtctgcgggcagcttcgcagcggtcgaggcggcaggattggattgattgatccagcttttgcagactctatgatccggtgaagttctggatgagccgaaaggcagtcatctgattctccgggcaacggtgtgaaaagtgcttttggcagcccgcccatgaactggaatgcagaagcggcccggacggaggagctagctccgtcagggcgtataaagcgcggtcgagcgtcagaggacactggcttgcgcagcctggcaaaagcaaagcgaacgggaatcgcgacggcaaacgcatgaatatgaaacgtatgcgcggacggaaccatcgcggcggcggtgggggcggcggcggtggcggaatgcgccaccataataatggcaatattccgctgaaccggaaccatgttttcgacagtaatggccccgatgtccgcgtacgtggcacggcacagcagctgttcgagaaatatctgcaactgggtcgcgatgcgaccagcagcggggaccgtgtgacggcagaaggatatttccagcatgccgagcattatttccgcatcatgaatgcgatgctgcaggcgcagcagcagaatcagcagaataatggcggccaccataacggcaaccagtcctataatggtcagaacggcaatggcggaggccattcaggctacggccagtatacgtcttcccagcagcaggatggtcaggagcgttcgttcgatcgtcaaaacgagcggttcgatcgctcccgggatgaaacgtcacagggcgagggcggtaacaccgcgcatactgcaccggaacggcagactctggacctgtcggtccagcagccggagaccacggtgtctgccgttaccgagacacagcccgatgtgctgccggtcgatcagcatgcccgtccgtctcatcagagtgaagaagagtctgcggtggctcctcgtcctcggggccgtcgaccgggccgtccacgcacccggcatatcgcgccggaaggcgtgggtgatcagcctgaactctctgccacccccgtggatgccggggaagtctgagagcgtttttgatctgttatgaatcagcggaaaagctgtcagcccaggctggcagctttttttttgtcgcggtaacaggcctccaaaatcataagcggccttatgttgcgtgatgcggttcatcatacagggcgcgtgaaacaagctccgcttccgcgccatggatcagaccgagacgcaggaacaggtcgatcagtaccagattgacattgaatttgaactcatccgtctcggcgacgatctccatggcgcgtttgaccggcatcagctcgaacccggcggattccccgtctccggcgtgaggtatgaagctttccggcaggtccagatcgaagcagtgcagcacgtcacgccgcagcccttccggtcgttccaaccggtaggtcagcacagcgaccttgcgcgcctgacgcaccagtgtctcgggaatcgaagcttcttccgcggcttccttgatcagggcatcgaaaggggtatgcccggcgggaataccgcctgccgcgaggtgatcaagtttgccggggtcgagcggacgggtggcactgcggcgggagacccataaatgcagcccatccggacgatataccagcccgttcgcatgtacaccttgcgccagcacgccgagcatgggcaggactccgcgatcaagctggaacagaaccggcccgtcaatcgtttccctgatgtcgaaaggttcatcccgccatagaaaaccggtgcttcgatggagtgccttttccagcagtgcaggcaggtccgggttgtcaccgctcagtgtcaccccatctttgtcgagctgcagagcatgggtgggtaattcttgctgtgctttctttaatgcaggcagcagatggggggacacccatccgatctgccgttctcccagcctgaagggtagaaaatggcccggcagtataagagagcgacaggcggcgacagggcgtaaaaagggactcatgaacggcgctctgctgctgacatgtgtttctgatggatggaggcgcggggcagggtatgtcaatgaccgggttggcaggatcgggctgccaggccgcgctatgagactttaaacaagggaaggagcaggaccatttccacgataccgagagcgccggcatctgctcaggattctgtaccgccggccgggcagttaccgccgccacgcaatgtctgggcgacgatccgctcgttgctgccctttctttggccgaaagataatctcgcggcccggatgcagctggttgcggcaatggcggctctgatcctgtcgaaagtggcaatggtgtatgtgccggtcgtctacagtcaggcggtggacgcgctcacaccgcacggaccgcaggggctgatttatctgcctctggctctggtagcgggttatacgctgctgcgggtgacaggggctttgttcggggagcttcgtgacgcgctgttcgcgcagacacaggcgcaggcctcccgcatgctggggctggagacgtttcgccatctgcataccctgtcgatgcggttccacctggaccggcaaaccggcgggttgggtcgcaacatctcccgcggggtgacggcggtcgagcaggtgttgcgtttcgcggtgttcaacatcctgccgacactgatcgaaatcctgctggtgatcgggattttgtgggtgctgttcgactggcgtttcgcgctggtcgccttcgcggcagtggggatctacatcctgttcacggtcggcttcgccagttggcgcatccgtttccggcgcacaatgaacgatatggacacggaaacgcagaaccgtaccgtggacagcctgctgaatttcgaaacagtcaaatatttcggcaatgaggcgctggaagcggagcgtgtggatgaaagtctgcgccgttatgcccgctccatggtgaaaacgcagatttccttgaacctgctcaatattggacaggcggtgatcatttccattgggctgggggccatcatgctgatggcagcgcagggcgtggtggaagggcgttactcggtgggccgcttcgtgctggtcaacacctatctgatgcagctttatctgccgctgaactttctgggcttcgtctacaacaccatccgtcaggggctggtggatatggagcagatgttccgcctgatggaggtggagcaggaggtcaaggaccgtcccggcgcgctcacccttccagccacgctcgacggaggtgcgccagcctcactggtgtttgatgatgtctggttcggctatcatgaggagcgcccgattttgcgcggtgtttcctttgcggtgccgccaggggggacgctggcgattgtcgggccgaccggagccggcaaatcgaccatcagtcggttgctgttccgtttctatgatccgggacagggcagggtgatgattgatggacatgacattcgcgatcttacccagcaaagcctgagagccgccatcggcgtggtgccgcaggatacggtgctgttcaacgacacgattcgctacaacatcgcttatggccgccctggtgcgtcgcaggcagagatcgagcatgctgcacggctggcgcaggtgcatgacttcgtgctgcgcctgccggaaggctatgataccagagttggagaacgtggtctgaagctctccggaggagaaaagcagcgtgtcgccattgcccgtacgatcctcaagaatccccgtatcctgattctggatgaggcgaccagtgcactcgatacccgcacagagcaggagatcggtgcggctctgcgggctgtttcacaggcgcggacgacactgatcattgcccatcgtctttccacggtggtcgatgcggatagcatcatcgtgctgtcggaggggacagtgatcgagcagggaacccatgccgagctgctggcaaaagctggtgtctacgcgcatatgtgggacgcccagcaggaacagcctgccgatctggtcccggtttgaacctgaagccgcttcggccgataagaagcgccattatgaacgaggaacgcatcatggctacagagcaaacacagcatgagcacgacgcacaggatgacatgctgccgcaggatctgagccatgcgggtgcggtggtcgatcaggccattgccttcatgaccgacaagcagctcaattcgctgtcgattgcatcggccttgctgagcggctccctgtcgatgcttggccgttccctggatgattccagcgtgattgcggtgcttgagaatgctattgccagcgtccgttccggtgagttgaagcgtctgcgggaggcagcggccaattcttccggccgtgcctgatcatcgagtcgtctgggtgcaaaggtccggcactgtgtgagactgatggctgcccggcgcttttaaggggcgccccgatgacagtttgcttgacgcagaggcttcgcttcgccataaggcgccttccgaaagaacctggtcggcgcaagctgaccctttccgcatgggatttgatcatgtcgcgtcgctgccagatcacgggcaaaggcgtgctgaccggcaataatgtcagccacgccaacaacaagacccgtcgtcgttttctgccgaatctgcaggtcgctggcctgctgtccgacacgctgggtacctccgtccgccttcgtctctccacccgtgcgatccgcaccgtggaaaagaacggcggcattgatgccttcctgctgggcaccccggaccgccagctgccgaccgaggctctggaactgaagcgtcgtatcacgcgcgctcaggccaagaaggctgaggttgccgcctgacctattcaggatggttaggctgactgcataaaaaaccgccgcggcatttgcccggcggttttttaatgtcttgagcatgatgtctggcaaaggcgaaattggctcgcggcctgctcttgaattggcaatcagcaatagaaagtttattcttttaagagagcgcctttatttttcagacgcaggaattttacagatggttgcgatcacaggctcatccaccgtgttgtctgcctatggtcaggctgtcgccaatgttctggataatagcggcgtaaccacagcctatgtttatccgaccatccttcaggatgggacgctctctgttatatccgcgactcccattatcgacctgacatctgcgacaccttacggatatgcggattgctccagctgggttcattatgtcatgaacactctggcgccggtacaggatgcctatgtgcaggcgctgagaaatgctccgctctataatcagacggtaacagcctatggtggtcaaacagtcgtactgaacggctcattccagccatgggcgcaggccaatgttctgcaggatgccttcgcttcggccagtgcgggcacaaacgggcttcagacaattgacgtcaataatgcctcggttggtttgacggcattacaggcgggggatctgattgcttattccaccggaatctataccgaccctgatgctgccaacgcatcgaccaatccggaactgaacgcaacgggcgataccgggcatgtcatggtggtcagggatatgccgacgaccgtgcctatttcctcattgccttctgaccagcaaacagcccttgccgctgccggcgtagtgacggtgtatgccgttaatgtgattgatagcagcgatgttccacatgccaatgattcccgcccggaaaacagcggcaatcactatgtgcagcgggttcaggacggtattctccccgctgctgcttttatccgtgctggtggcatcggcatgggaacgctgtatttcggtgcaactgccagcggacagatgactcatctgatgttccgtgatgattttggatggcatccaaccagcagtgctccgtctgcattgaaactctctgccgcgcgtctcaccggcaatgccgatctggatgtgattctggccaatctgcggagtgcgggggtgacggtcgcggataaccgcctgaccgtcacggttgaccccaacgcggccacgacgattgcaggtaatacctatgccatgaccaccagtctgacgggatccgccgggttgctggtgcagggtggcgggacgctgacgctgaatggtaacagtacctatagcggtggcactgtgctgaatggggtgacgctgaatgtcaccacggcaaccggtgcgggcaccgggggtatttctacccgggccggcagcagcaacacaatctggctgcatagcgggaaggaagccattaccgccaatggtgccgacaccattcatgctggtgccgctgaagtcgcgttgaatggcactggtacatttctgttcatgggaggaagtggagcctcgacggtttccggtggttcaggtgcgtccaccctgctcggtggtagtggcggaggtgtttatagtgctgctgcatcaggtattgttgcggcgagcggcaatacgactttggtgggcgcgggccataacagtctgctgttcggcggagagtccggcactgtcatgttcggttccggcacggacacgctcgttggcggatcagggcagggtgtgctggtcagtaccggtggcaatgcgattgtaaccggcagcgggcagtccagcgtgtttggcggacagtccggtcaggatacggtggtggcggctcagggaagcaacactgtcattgccggggccgggaatatggcgctggttggtggaggcaacacaaccttgtggggtggttccggtaacacagaactctggacgggcgccgggtcgatgcaggctgcgttgggcagcggacagaatgcgatctttttcggcagtggcgcggccactattttcgccgggaccggtcaggacgtgtttcaggtgaccaagggacagactggcggcaacacccagatctacggcttcaatgcggcagccgatacgctccggctcagcggttatgcggcaggcgatgtttccgtggctgtgcagggcggaagtagcgtgatggcgctggcaggtggtgcgacagtcacttttgtcggcgtgaccgggctgaactggcaatcttcctgagcagccggaaggctgcgaggcttaagcctcgcagccagcttcccttaacacttcgctgactgcatcctgtggtacgtcgcggcttgtgaaggcctgaccgataccccgtgccagcacaaaagcaagcttgccgtcccgcattttcttgtcgcgctgcatatggccgatcaactgcttggcggaaaagcggcggttgagcatggacaactcggcaggcagcccgaccgaagcgacatgggcgatgacccggtctgcatcctggctccggcaatggccgagtttggcggagaggcggaatgccagccccagccccaccgccacgccttccccatgcaggatggtgccgtagcctagatcggcctcaagtgcatggccgaatgtatgacccagattgagcagggcgcggccgtcattcggcttttcctcccgctcatcatcccccacaacctgcgctttgaaggcgcaggcgcgcatgatggcttcagcctgtctgtcgcgttcccctgtggtaacggcatggccatgggtttcgcaccattcgtagaaggcggcatcgccgatcagcccggctttcacgatctccgcatagccggccaggacttcccgatgcggcagtgtgccgagcgtcgtcgtatccgccagcaccagacggggctgatggaatgcgccgagcagatttttaccatacgcggtgttgatcccggtcttgcctcccacactggaatcgacctgtgacagcagggtggtgggaatctgtacgaaaggcaggccacgcagggttgcggcagcggcaaaacccgccagatcgccgacgacgccgccaccgaaggcgatcacggtcgttcggcgctccacccccgcagccagcagcccgtcggtcacacggccaaagacctccagagatttcgaagtctctcccggcggtacgatgatgctgtctgctatgatcccggtttcctccagacctttcaacagggtcggcagatgaagggcggcgacggtctcatcggtgacgatcatcgcccgtttctgcggaatatgcgggatcagcaacgctccggcacgggagagcagggattcgccgatcaccacatcatagcgattggcggtcaggctgacggtcagcctgcgtggaggctgatattcctgaagatgacgcaagacgttatcagtggtgccgtcctgactgtcatcgccgcaatccacgatcagatcagcctccgcatagacgggatgccgctcattcatcagccgttgcaggatatccgctggatcgccctgattaagcagcggccgatgcgtgcggccggagacacgtttcagcagcaccggcaggcgacagcgtagccagatgctgacagcgccctccctgatgacgcgccgggtttcggggtccatgaaggcgcctccgccagtggccagcacgaggggttcctctgacaggagtctgcgtacgacgcggcgctccccttgacggaatcctgattcaccatggcgggcaaaaatttccgcgacgctgcagcccgctgcgcgttcaatctccgcatccgcatcgcggaacggcattccgagtcgggcggccagacggcgtccaatggaggtttttcctgctcccatcagaccaaccagcacgatactgcggccttgcagccaggccgggggtgtcacggaatcacggagagaaggggcaagggcagagttgcgtgtcatggtggcggaggctagcacagacacacggttttgtccgcctctctcccttttttccatgattggaagtgatagagaggatgacatgcaccggctgacgaaattcaggacaggttgaggccaagacgtatgcggactgcattattgattgttgtcgcacttggattggtggcggccggaggcatcttcatggggttgggcatgtttccgccgcaaccgcatgtggcggcggtgcagaagacgctgcccaatgatcgtttcgatcatcactgaccgcgtctcctgacgctttgtctcgtaggctgcggccatggagcggcatatcgagagttttctggagatgctcgcggcggagcgtggggcagcacggaacacattgctggcttacgggactgatctgcgcgactggtctggctatgccgcccgtcacagggtagatccgttacatgctgatgaggctgccttgcgtggctacctcgccgcgcagagcggggccggaaacgggcctcgcacccagtcgcgccgcctttctgcgctacggcagttttaccgtttcctgctggagcaggggacaaggtctgatgaccccactgccctgctggatgcgccgaaattgccgcgctctctgccgaaatatctggatgaggcggaggtcgatgcactgttgcaggcggctccggccgagccggcagcccatgcggcgctggaaatattgtacagcacaggcctccgtgtctccgaagtgctggcgctccctgcccgcgccttccgtggcgatgcgcccatgatgacggtgcggggcaaaggcgggcgggagcggatggtgccggtctccgccgctgccatttctgcggtcgcggcgatgcggagcggggcggagcaatcacgctggttgttccccggccgtgatccggcaaaaccaatgacccgccagggttttgcactcatgctgaaacgggtcgcgttgcaggcgggtctcgatcctgcccgggtgtctccccatgtgctgcggcattgcttcgcatcgcatctgctggcgcggggcgctgatctgcgcagcctgcaaatgctgctggggcatgtcgatatcgccaccacgcagatctatactcatgtgctgtcggagcggctgcgtgcgctgttggacacctgccacccgctatccatcacggcagaggattgagttctgccgcggggcgtcatgtgcatcagatgggtagcgcgctgcccgtatggctgctaaagcccctgctatgacccggcatttccttgaattcgaaaaacccatcgcggagctcgagggcaagatcgaagagcttcgccgcatgtcggagcctgacggcatcaatattgccgatgaggtttcccggctgaccgacaaggctgacaagctgctgcgcacaacgtacgcgaagctgacgccctggcagaaggtgcaggtagcccgacacccggagcggccgaaggcaaaggattacatcaccacgctgatcagcgattatacggagctgtcaggcgaccgggcctttgccgatgatgctgccattatcggtggtctgggccgttttcagggccatcccgtcatggtgctgggaacggagaaaggcaccgatctggaaacccggatcaaacataatttcggctccccccggccggaaggttatcgcaaggcgcggcgtctggtggagctggccggtcgtttcaggctgcctgtgctgacattcgtggatacggcgggtgcctatcccggtgtggatgccgaggcccgtggtcaggcggaagccatcgcacgttctgtcgaagccctgctggacagtccttcccccgtgattgcgacggtgattggtgaaggtggttccggtggcgcgattgcgctggcctcggcggatcgggtgctgatgctggaacacgcctggtattcggtgatttcaccggaagcctgcggttcgatcctgtggcgtgatgcggctcaggcttctctcgcggcggagaccatgaaaatcaccgccgatgatctgctgaaattcgggctgatcgatcaggtcgtgcatgagccactgggcggtgcgcatcgtgcaccggacaaggccattgccctgaccggggaggcgattgctgctcagttgcagcctttgctggggcttgaagcggcggcgttgaaggcaaagcggcgcgaaaagtttctgcggatggggcgcgatacagtcacgcactgatccgatcgcgcttccattgttatctgatgcgcccggtcagaatgctctggccgggcgtatctgtttcagaaggtgatctttaggccgccatagccaccgatcggtgcggccgggctgtaggcacggggattggtcgcgttgggcgcctgtgacagatagacagatgaggtgggtgagaacgtgccgtaagtgtaatatttctgattggtcacgttcatgatcacgccgaacagctggacatgcggcgtaatctgataggatgtgttcagattgacgacgaagaacgcaggcagcttcgcattggtattggcggggtctccgaacagataggttccactctgaccaatacccaccgcaccgacgatccatttcgatgtcacgttgtatgtaacgcctaccttgacggtattctgcggcacgccgggcatccggttgccgggattgacggtaatattgccattcgcatccgtcacgggattgctgccgccatcctcgatgaaggtgctctgataggtcgcatccacataggagtagttgaggtaggccatcaggcgcttggtggtgtagtcaacatggaaatcgacaccttgacgccgcgtctgcccgacattctggaaaaagcctcgatccagtgtcacgctgttgacgaacgcaatgtcgtcatcgacgttggtgtggaatagaccgagcttatagcccagctttgcatcggccgtcagatgcgtgctgccgcgcagaccggattcccaggtatgggcaacgacctgcttgaggtccggatcaccggtaaagaagttcgccagactgcaggattgcgccggattgacgcaggaaagctctgcctgtgtcggtgcccggttcgcttccgcatagctgccgtagaaggtcagccatggcatgatcttgtaggtcaggccagctgagggattgaagcgattatagacatgattacccgtcacatcgccgccgccaatctggttgatgtcgatctgggcggagttgaagcgccctgcgacggtcaatgacagacgatccgtcacgtcgaacgtatcggtcacgaacaggccgaagaaattgttggtcagaccgacgcggaccggaacattctgacccggttcatccagcaggacacccggtccgataaagtcgcgtgagacgggcgtgatgccaccaatataggaggagcctccgaacatggtggtggcaccgtcatagctgccaccggcgacgaagtgattctgatggccgaacagatcgtccgtattggtgacctgggcggaggtgccatagctgttggtgttggtcgtctgcgcatccagctcggaataggaataaggattattgccgagataggctgcgatcggtgagccgcctcgggtcgtgctgggcaaaccggtatcggaattgcacatcagcccggagccatcattgcagggaaagtcattggctgaattgccgttcatcactctctgttggaaataggagtaataggcgttgctctgaagcgatgtgttgcgaccaacgtctacgttaccgttcactgtcgcgaggatgtagcggttggatatctggttgggcgccgtgaactgcgctgctggatcggcttgcaaaagctggacaggcgaggtaccgggaccattcaggaccgaattggccatagtcaggttgaagtgcacttcggcacggtcattacggatgccgacatcaccgtagaaattctggatatcggttgattgctggtcacgccagccatcctgatgcagcacactgccggcaagataagtggaaacgttgccgatacgcttgccgtattgcagattggctcccatccgcccgaacgatccgccatacagatcgatttctccgccctgataggtaaagccatttttcatcttgacgctcagggcgccgccgatggcattcaggccaaacgccgggttcgagccctccaggttcagtgtgtcgatcgccaggttggggatcagatcccaattaacggtatcgccaaaagcctgattgaaccgtacgccattgagataaacggccagaccttgctccgttccttgtagaggggacgccgtaaaaccatgatataacagggcaggttgctgtggatttcctgaagaatcgaccagattgacgcctgcaacctgctgattcagtgctcggagcatgtttggtgccccgcgtaaggcgatgtcttttgaatccagcaccgttgagtcggccggtactttgtttttgtcgattccggatcccagcaagggggtgctgccgatgacgtccagttccggaagagcaacggtgcttgtgtctgtcgtatcctgtaaaccggatgacgcaggccgcacagtctttggtgatgctgactgagcaaagccaaggtgcggagcaaggcagacaaaaaccgcagcatagcctgaaagattttttgatattttcatggacccttcccttctttttttcgttttttggaagacatccgggtggggtcaattgcgtaaaatgctgcttcgattgcataaaatgatggatatcattttggaatcgataagtaattcaattgccacattttttgccgatggttgtgcggcaggaataattttaaataatgctttaagaaggctttatgagaacagaggggtgccttgttgcatggtcattgattgctggtcagcatcccgccagacataagttggtcgattatcatgctggctgctaagcaatcaggcgtttccgccaaaccggcagtttccgggtgtaggcagccgcttttataaaaacgcagattatattttataattaaattataaatatataactacaatataagccgttaaaaatgtcttttaagtaaaaagttgatttcactttatataatgaactgtaatatctttattcaaatatttaatggcttgacatgaaggtaggccatctctgtctctaataatgattatcaattaacttgagtgaggagatattcatttaagtaaatttatattgaatgatcattcaatataaataaaacaagcaattgtttgacgcaattgttgggtttattcagtgtccttgtcgtttttgtccaagcaagtagacactttcttaaggttacatccacagatcgatgccggaataaaatatcggctatgctgaaaaacgaagcggcatccaacggcgaaacagactctcactttaagagagccgccgaagtcaagcaggggaaagtcaacgcacggccgtgagtgggtgagtttggccggcttcacgctgccgggcgatgcgcggggaaacgtgcactatgtggactgttttaaagagaatatcggtgaattcgatattcggccatgcttggactgtcagcggattggtctgcggtatggcggttatttcggcaccggtgaaaggctggactgatcagcttctgtatgattcgcatggtacgcgcattcaggcttttatggagctgggtggcgtcatcatgaatggtgctaatataaactttggtgcagggtcgattgtctatcatgatggtcgtccggttgccaatcgtggccctgtgacggctgagctatatttcaaaccgggtgtcatggcctcccaccatttcaatattgggacgttgtacggggcggtcaatgctattggcaccaaaacggtcgggcatggcgattttgaacaattttcgcagaccgggcatgagcctttttatatgggcttggaagaagcctatctgggattcgaaaccaaccttgcttccggtggtggcaaggatgtggtggctattcagggtggaaggcaggttttcaaaatcgatgacggttttctcgtcggtcgcggaacgtacaatacgggcggacgtgcggcatggtggtatgcgccccgcatggcgttctcaggtccgggtgtgatcaagtttgatgggcatcctgtgcgtgccgatatcttcgccctggaagtcaattccgatgccggactgacatatggtttcgatcggcctcgaagcagttttgccggcttcgatgtcacattgttccgcagcaagccgggccttgacggtgcgccaacctatgccaatcgcgaggcatatgtgacgttgacctacttcaatatttatgactccgacaaatccagcacttataattacaccagccgcgccaatcgcgatggcatgaatgtttattcgctgagtttcggtggctcattcgttcccatcaaggcattgggaatcagaaagaattttacgctctatggccaatatgtcggtgaacagaacagcaatgccagccaagggtaccagagggttgatgcatatgcctattatatagagccaggctacagtttttctgatcttccgtgggcgccctccgtttattaccgtcgcaccacctacagcggcgagaataatcctaaaggaaccgtcaagcgctcctatgatccgctgtttctctataatggttcccgtaaactctatggcggatatttttcgggtgaggttgttggtgaatatctgatgggatattcaggatatgatgttaatcaggtcggcatcacccttaatccgccttttcacgttttcaagcatgatgacaagacggcttttaacatcatctactataatgttcttatgaatcatccttcgcagtatggcctgaataccggcagtaacaagtatagcgatgaggtggatgtctcggtcaactatcagtatagcccgactatctccggtgccatgctggcaggtgttgcattccccggccgtaatggtcttgccaatgtcgcgagttatcagcccgcaaccggtaaccagcctgtcgtcggcggcaacgcctatgtgcttgaggcttttatctacacgcggttctgagtaggcaacgtgccggtagaactgaaaaaacggggcaatgaaggccccgtttttcatttcttattcagaaaaaatgagcgtttttagccaagtctgccatggcagtgcttgtatttttgcccggacccgcacgggcagggagcattgcgaggaacattgatccatgtggaaggatcattgaagtcaatcccctctacatctgcataggcagcggaaaacatcgcagggggaggggggggcagggggatatcctccccattcgggccgacagccatacggatgctgacgggttcgggatggctttccacaaactggctggagccgctgacgaagggatcggcgctggccgggggcggtgcaccgaattccacctgcgccagaatagcggtgacgcgctgtttcagctcatccagcattgcattgaacagagaaaaagcctcgctcttgtattcattgagcggatcgcgctggccgtaggcgcgcaggccgatgccctgacgaagctggtcaagcagcagcagatgttctttccacacctgatccagtgtttgtagcagcagggccttctcgatatagcgcatggcatcggccccggcatgggcggccttcacatccatcagctctgtggcggcagcctgaacgcggcggcgcatttccgcctcgtcaacaccttcttcacgcccccattgctcgaccggaatatcggcattcagcagcgcgcgcaggccagcggccaggccggctgtatcccattgctcctgaaacgcacgctcggggatatggcgggtgatcagggtgtcgatcacttcttcccgcatgtcggcgacggtttcgctcacatcatcggcgttcatgaattcgcggcgctgggcgtagacttccttgcgctggtcattcatcacgtcgtcgtatttcagcacgttcttgcgcatatcgaagttgcgggcctcgactttcttctgcgctttttccagagccttgttgatccagggatggatgatcgcctcgccatccttcagcccgaggcgttgcagcatcgcgcccatgcggtcactgccgaagatgcgcatcagatcatcttccagcgacaggaagaagcgggattcgcccggatcgccctgccggccggagcggccacgaagctgattatcaatgcggcgactttcatggcgttccgtgccgatcacgaacaggccaccggccttgcgcacggcttcatgcgcttcctgcacttcctgttcgatccgggcgatcgcggcgtcgcgttccggtccttccggcatatccgcaagctcggtctggatccgtgcctcggcattgccgccgagtttgatgtcggtgccgcgcccggccatgttggtggcgatagtgacacggcccggcgcaccggcttcggcaacaatgatggcctcacgctcgtgctgcttggcgttcagcaattcggcagggatgcgcttctgatccagcaactgcttgatcacttcgctcttttcgatggaggtcgtgcctaccagaacaggctgtccgcgggtgcggatttcctcgatcagattggcgacggcctcatatttctcacgtgcggtgcgatagacttcatcatcgccatccttgcgctggaccggcaggttggtaggaaccgccagtacgtcgagcttgtagatctcggcgaattcatccgcttcggtcagtgcggtgcctgtcatgcccgccagtttcggatacatgcggaagtagttctgaaaggtgatggaggccagcgtctggttttcctgctggacggttacatgttccttggcttccagcgcctggtgcaacccttccgagtaacgacggccatccatcatacggccagtgaattcgtcgatgatgatcactttgtcgtcgcggacaatatattcgacgttccgctcgaacagggtatgtgcccgcagcgattgctgcacatggtgcagcacggtgatgttgaaggtgtcgtaaagattgccgtcggtcaggatgccgcttgcatgcagcatctcctcgaccttttccgatccggcttcggtcaggtgtacgctgcgctgcttttcgtctttttcgaaagcagccgggtcttttaccagctccctgaccactgcgtcgaccgagcgatagaggttggagctgtcttccgccgggccggagatgatcagcggggtacgggcctcatcaatcaggatgctgtcgacttcgtcgacgatggcgtaagtgaagtcgcgctggaccatatcctccagccggtacttcatgttgtcgcgcaggtaatcgaacccgaattcgttattggtgccataggtgatgtcggcatgataagcggcacggcgttcaagctcttcctgcccatggaccacgatgccggtagacagcccgaggaagctgtacagctgtcccattgtttccgcatcgcggcgggcgaggtagtcattcaccgtcaccacatgcacgccctttccggtcagggcgttgagatagacaggcagggtggccaccagcgtcttgccttcgccggtccgcatttccgcgatcttgccgtcatgcaggaccatgccgccgatcagctggacgtcgaaatgacgcataccgaaaacacgtttcgatgcctcccgcactatggcgaaggcctcggggaggatgccatccagcgtggcaccatccgcgagcttctgcttcagcaggatggtgcgggcctgtagttctgcatccgtcagcgcggcgagttcgggttccagggcattgatctgctgcacccgccgctgatacccgcgcagggagcgatcattgctggagccgaagatggagcggacgagtctcgcgaacatcgaagtgctttccggatgagaattccacaccggccccgagtccggcacggagtgggagcctagtggataatgagcctgacagacccatcatcagccgcttcagataggacccgtcgcgggccgggtcaacgcagcggccctttcggggggtgggataaaatggaaaacagccttccgaagcgtgatggtacggttatcttgcaaggtttctcccatccccccgcttgagtgaagctgcggcattcgtcatgatccagccgcaagcttgcggggtgtatggccgagaggcgatatcctcgccgcccgtcaagaaccaaggaacgtccatgactttttatcccacggtgtcccgttgcttcagcagcacgcggagtcggactttaatggccgccgccctgctggccgggagtgccgggctttccgtcaccgcagcgcaggctgatgacgcagcctccgcccagaaggcggcaccgcccccgagcacggtcgtcggccgtgtcaatggcgccgacattcatctgggggatctggaggatgccgcccgcaatctgccggaacagatgcgtcaggccccgccgcaggtcatctacccgatcctgctgaaccagatgcttcagcgtgaggcgctggttcaggcggcccgcaaggaaggtctggacaagaagccggatgtcgcggccgatatgaagcgggctgccaatcagacgcttcagaacgattatatccgtgagcatgtcggcccgctgctgaccgatgaggcgctgcggaagaaattcgacaaggaactggctggcaagccgggtgaggaagaagtccatgcccgccacatcctggttccgaccgaggatgaggcgaagcgcatcatcgccgagctgaaggcgggcggcgattttgccaagatcgccaaggaacgcagcaaggatccgggagccgcgaatggtggggatctggggttcttcaagcaggccgatatggtgccggaattcagcaaggccgccttcgcgctgaagaataatgaagtttcacccacgccggtgcacacccagttcggctggcacgtgatccagacgctggaacatcgtcgcgctccggcccagacctttgaacaggcgcgtgatcagctccgtcagcaggttattcaggatggtgtgaaagatcttgtcacgaacgccatgaagggtgcgaaggttgaacgcttcaaccccgacggttccgtgccgaagccggaggctgcccctgcggcccctgctcccgcgaagaactgagccatgactcatccggtttctcctttggccgtcacgctgcctgagatgccgcctctgccgggtgtcaggctcggcgcggcggcggctggtatccgctataagggccgcaccgatctggtcatggtggagctggcacaaggcacaactgttgcgggggtgtttacccgcaacaaatgtcccggcgcaccgatcggctggtgccgggaggcactgaagggcggccaggcgcgagggctggtggtcaacgccggcaacgccaatgttttcaccggtcgcgccggggaagaagcggcccgccgcagcgctgaagcggcggcgaagttgctcggctgtgcggaggaggaggtttttctggcctccaccggcgtgattggcgagcagctgccttatgagcggatcgtctccgctcttcccgctctccataacgcgctgaccgaagacacatggcatgatgccgcgcgtggcatcatgaccaccgatacctttcccaagggagcggtccgtaccgcgaagatcggcggacagacggtgcgcattcaggggatcgccaagggcagcggtatgatcgccccggatatggcgaccatgctgtgcttcgtgtttacggacgcggccattcccgcggcggctttgcagtccatgctgggcaaggcagtcaaaaccagtttcaaccgcatcacggtggacagtgatacctccaccagcgacacggtgctgctattcgcgactggtcaggccgatcatcctgacgtcccggaaacaggtggtccggccctgcgcgattttgcgcgtgccttgtcggaagtcttgctcgatcttgcgcttcaggtggtacgggacggcgaaggcgcgcagaagctgatccggatcgatgtcgaaggtgccgtcagccatggttcggcggagaaaatcgccatgtccatcgccaattccccgctggtgaaaacagccgttgccggggaagatgcgaactggggtcgcatcgtgatggcggtcggcaaggcgggtgaaccggcggatcgcgacaagcttggtgttgcggttggcggcgtgtggatggcccgcaatggcggtgtgatcgacggatatgatgaggctccggtcgtggcccatatgaaaggccgggagatcaatatcgctgtcgatcttggcctcggcaaaggccgggcgactgcctggacctgtgatctgacgcacggttatatcgacattaacggctcctacaggagctgacagggtggcggatgaagcacggccggaaaggcctccgttcagttttcgggcgcggagcagcggtgcggagatagcccgtccgccatcgggtcggacttcatccgaaacacctgccttcaagccgctccgtacggagcggcttattctacgtccattttcccccgaggatgcgccggccctgcaccggttgatcaatgattgggaaatcagtcgcactctggcagaggttccgtttccttatccacgcagtctggccgatgagtggatcggttccaccttgcggggtctccgggatgggacggcatggcatctcggcattaccggccatgaaggctatgagccagctcccaaggaaaccctgatcggcggtgtcggcctgcgtctgctgccggaagggcgcggcagtttccggcaggctggacgggcggcgagcatcggctactgggtcggacggcgtttctgggggcatggggtggcgaccgaggcggtcggaaggttgtgtcgctgggccatggccaatctgccgatcaaccggctggaagcgacggctgaccgcgataatctggcttcgatcgctgtgttgaagcggattggttttcgggaggtcggggcaggcgtgaaaacctttcgctcccgggccggagaagtgccggtgcttcatttcgaggcgctgagggatgatttgttcggagcacccgatgcggggctgccgcgcgggcgggaacaggcagcaccgccacaaccgggcatcatgccgggcacggcgcctgcccatctgccggtcctgctggtggttgcggcggcgctggtgaatgctcagggagagatcctgctggcccggcgtccggaagggcgcagcatggcggggctgtgggagttcccaggtggcaaggtggaacccggggagacccctgaacaggccctgatccgtgaattgcgggaggagctgggggtagatgcctccgccggatgtctggcccctctcgcctttgccagccatgcgtatgaaaaatttcatcttttgatgccgctttacgcatgccgtcgctggcagggtgtgccgagaccaagagaggagcaggctctggcatgggtgctgccggatcaactcgaccgttacccgatgccggcggccgatataccgctcatccctatattgcgggatctgctctaagcctgcactctggctgtatgagtcatatatcttctgcgcaaggcgcgtgtctgctggtgatcggcaacgagattctctcgggccgtacgcaggacaggaatatccagtttctggcgcgtgcactgggcgagcatggattgccgctgcgggaggtcagggtcattccggatgtgcgggaaaccattatcgccactgtgaatgaaacccgtgcccgttttgcccatgtgctgaccacaggtggtatcggccccactcatgacgatatcaccagcgaatgtgtggcggcggctttcggtgttccgtgggagcctcatccggaagcatgggccttgatggaggcgcattatccgccgggcggcttcaacccggcgcgtcaacgcatggcgacaatgccgagaggggcgacgctgatcgccaatccggtctctctcgcgccaggattcagtattgggaatgtgcatgtcatggccggtatcccaaccgttatgcaggcgatgttccaggatctggtaaagcgtctgcctgcgggattgcccgtcttgtctcgcactgttcatgcctggaacattgcagagggtactattgctgccgatctggcgactttacagcttcgttggccggatgtggaaataggaagctatccgttccagaaagaggaaaacggaaagcggatttatggcattgcgattgttgcgaagggaaccgatgcccgtaaactggatgaagtcgcagactctgtaatggaactgtttgaaacatttaatgtctctcctgttttaggagaattggatcgaacatcttgaaaaatgatatgaatactttgtttttattggttgtaatttactgtgctgatttttcataaaaatcataatatatatacaaatatctgcgtatttatttcaggggctgaatcggatgtctaattcttccaatggggtgccaagctggaatatttattccggctctgctgaatcagtgacgatcccgcttctttttcattccaacggccaatatgtcacgccggacttcagtcagtttacggcaactggcacgctgaatgtcagggtttgggtggttggattggccgggcaggcagccaacggggcattaaccgcagccctcgtgcccactgtgtcctcgcaggcgatcagcaatatgacatcgacctttgtggtcgataccggcgctttcccgactgtcatgccactgagtttagttcaggctgcattgcccggttttacagaggcgcagttgcagacctacccccccccggttccctcacctatagcagcgataacgtcagtattactggctactatgtgccgctaactctggcttttgccgatgcaaccgatagcagtgggcagccactgacgacgaccttcaaggttctcgtctccgacaacagccatgcgcatatgatgggcttgcgcttcgattatgatgcgacgacgcagcaaaactatactactgcctacagcgctctcatgaatcttgctccgatgcagtcgggggctatgtcgcgtggctatatcatcagtcaggctggtctgactgtcgggctgaatcaggcgaacgcgggcagcggatgggctttcaccaaacttgctccggcatcgcaatccggtgattggctggcaccgccggtgactgttaccgtgaatggcaaggtactgccggcaggctcagtgttgattgataccggcctgaatgaaatgttcctgaaatatgagggcggaagcaggctgcctgccaacagcaccattactctttccatgttgggaacgggcggcgctgtacaatattcattcaataccggaacccccacgggtgtggcgccttcttttgtcagcgcaggcaattcatcgactggtacttttgtgaataccggcctgcatgctctggcaggcttcgatgttctttacgatgaagcgaacgggctgtttggattaagggccaatggtcactcgccccaatcatcggtctcgttcgatccggttttctcactgtccggaaatatgagcgttcaagctggttttcaatcttcccaatccattcttttgacagggccggcaaccttgcagggggccggaagcatatccctggatggcacgatctccggcaacgggctcctgacggtgaaagcccccgggactgtgaccttgtcgggcagtaacacatatactggcggaacggttctgcagggcgccgccatcgctgtaagttcggcttccggactgggaacgggtggcgttgcaatggctgcggggtcggcaaacacactgtccctgaccagcggtagcgccacggtatggagcgcaggcgctgatacgatcagcgctggtatggcatcggttcgggttgccgccagcggggccgggacgctgacattcgtaggaggaaaggaagcatcccaggtttacgggggtggcggtaccatgacagtgttcggtggtgcgggagacggggtgttcgctgctggtggtgcagggagcgtgatcgtcaacggtgcgggcaatgccacggtgatcggaggcggcgggaacgccatttatggcggcagcggagcgaccctggttttcggcggtgcgcagggtgccaatagcatccttggaggaagtggcagcagcaccgtcgttgggcagtcaggagatcatgtggtcgggcaggccggcaatatgctggtctttgggagcagcaacgctacagatacgattatcggtggcaatgcaacgaccgtgatgggcggcaatgcgggcacccagcttctttccaatggaaacactgtgttctggggtggttctggaaatgacatgctctggggtggcgcgggtattacaatcgcgacgctgggaagcggcaacgataccacctatatcggcagtggtgccatgagcattgccggaggctcaggccaagatatttacaccgtcattgccgggcaggccggtggatcggcggtgatctttgatttcaatccgggtcaggattcgttggtgctggaaggctatgataccgcgagcatcgtcaagactgtccaagcgggttatgtgacactcagcctgcccgatcagacgatgctgacattcgtgggtgcggacccatccagccttcctggccggtcgataagctgatccgctccggatgctggttcaggcggcgttgatcgccgcctgttcttccggagtgcgcagactcaggaccagagcatgcagcccgcctgcgaattcagcctccagagcctcatgcacggcgcgggagcgctggacacgggatatgccgtggaaagtgtcagagatcagtgtcactttgaaatgtgtttcgcccgtgctggctgggcctcggctctgatgacggagtccggcatggcctgcatggcgagcactgtcatcctgcacatcgagatgtaccggggtaaagcgggcgcgtaaaacgtcttcgatccgttgcgcgcggctgcctatgaggggagcatgttcctgtgtcatgccgccagtatcgctttttttgctgttctgagaaagagtctcgggcgatattgatccagataggcacgggatgggttgcgtttcgtgtctcccgttgcacataagaggacatgatggccagacgcgctccgcgaacgagggcctacgcgcccgatccggacgcgccgacccgtgactgtgacatggctggctgtgagatgccggccgcttatcgtgcaccaaaatcgaggaccgaactacgccattactggtggttctgcctggagcacgtccgcgcctacaatgcgtcgtgggatttttataagggaatgagcccgggccagattgaggcgcatctgcgggctgataccgcatggcagcggcccagctggcctttgggccaaaacggtgctcccgttgcgccggaagatttattgcgtgatccgctgggcgtgctgcgcgatggcgcggctgctgccacccgccgtaaaaaaccggaggaggagcgccccccaaaagaattacgggagccgctgatgatcatgagtctgccctggcctgtgacctgggaagatatcagaagccgctacaaggagctggccaagaggtatcacccggatgccaacggaggcagccgtgaggccgaggagcggctgaaagtcatcaaccaggcctatgccacgctgcggcggggtctggccggggaacccgcccggaatggaaacgcttccgagcaggctgcctgattcgtgctacgccattctaccggttttgcctctctttccttatgacgttaccgtgcttccttcttgagacaggacgagttcgctgatgaccaaggttgccgccatctccgaaacaagggatccggaggaagggattgccccaacttctgcattgaccgtccccgacattactctccgtgtgagagaggtgttcggtattgattccgatatggaggtgcccgccttctcgatccggaccgaacatgtgccggaggcggacccgacctatcgcttcgatccggagacgacgctggccctgctggcaggctatgctcataatcgccgggtgatggttcagggctatcacggcactggcaagtccacccatatcgagcaggtggcggcgcggctcaactggccctgtatccgcgtcaatctggacagccatatcagccgtatcgacctgatcggcaaggatgccatcgtgctgaaggatggtcgtcaggtcacggaatttcgcgaaggaattcttccctgggcgttgcagcatgcctgtgcgctggtgttcgacgaatacgatgcaggccgcccggatgtgatgttcgtgatccagcgcgtgctggaggtcgagggcaagctcaccctgctggaccagaatcgcgtcatccgcccgcatccttccttccgtctgttcgcgacggcgaatacagtcgggttgggcgatacgaccgggctgtatcatggcacgcagcagatcaatcaggggcagatggaccgttggaacatcgtcaccactctgaattatctgccgcatgcgcaggagacggagatcgtgctggccaaaatgggtgtggatggagcgaaaaatccgcaagcccgtaaggaggtcgaaagcatggtggctctggcggagctgacccgggcaggtttcatcaatggcgatatttctacagtgatgtcaccacggacggtcattacctgggcccagaatgcccggattttcaaggatctaggctttgcgttccgtgtcacctttctgaacaaatgcgatgaggcggagcgcacgaccgtggccgaatattatcagcgctgcttcaacgaggatattccgaccggtctgttcaaccggaaagccttctgatcgcgggcaggcagacgggaatgagcggcagcaggcataacggccccccttcgaaggatggcggcgtgcaagacgctgccaaccgggttgatgagttcaagaaggccacctcctcggtctttcgctccatagcgggaacggcagaggctcaggtggcattccagcccggcccatcggcgctggtgggccgccgtgcgcggctgccgatgccgacacgtgccctgccgcctgccgaaatggccaaattgcgcggggctgccgatagtctggccctgcgcctgcgccaccatgacgaggtcgtacatcagagtcgtctgccaacccagccggaggcgcgggaagtttacgacgcgctggaacagatgcgggtggaatccgtcggtagccgtcatatggcgggggttgccgcaaatctgcacgcccgtttgtctgatgaatgcgagacggctggctgtgatcgcatgaccaagcgggatcaactcccgctttcccgtgccctgtcgcttctggcgcgggaaaagatgaccggtgaggtgtccccagcttcagtgcggcatgtgctggatctgtggcgaccgcagcttggtccggcggtgcaggatgcgctggccgatctggtgttgcatcaggatgatcagaccgcttttgcgcgggtgacacggcggcttctctcgacgctcgatctggagccatcttcctttgatgaaagccagccggactcgcaggagctggaagaaggcgaggacgaggatcagggcgagcagtccggtgcgcaggataatgcgccggatggtgagggcgaaagccgcaaggagcaggatagtatgctcggcgccagcccgcaggagctggaagaaaccgactcccgcgaggaaaccgccgatatcggctcggacgaagccgctggagatggggaggacagcccgggtggccctcagcagcggcgggacatacaggatgatccgaacaatacggtctatcgcgctttcacgcaggcttatgacgaggaagtggcggccgaggatctgtgcgattccgatgagctgacgcgcctgcggcagatgctggatcagcagttgcagcatcttcagggtgtggtttcgaaactcgccaatcgtctccaacgtcgcctgctggcacagcagacgcgctcatggacgttcgatctggaagacgggttgctggatgtcagccgtctggcgcgtgttgtggccaatcccaccgtgccgctctcctacaagcgggagcgggagacggagtttcgcgatacggtcgtcacccttttgctcgataattcaggctccatgcgcgggcggcccatcacggttgcggcgatgtgtggcgatattctggcgcgcaccctggaacgttgtgcagtgaaggtcgaggtgctgggcttcacgacccgcgcctggaaaggcggccagagccgggaggcctgggttgccgctggcaaaccgcgtctccccggtcgcctgaacgatctgcgtcatatcatctacaaggcggctgatacgccatggcgtcgtgcccgccgcaatctcggcctgatgctgcgggaagggctgctgaaggaaaatatcgacggcgaggctctgcaatgggcctatcgtcgcctgctggcccggccggagcatcgccgtatcctgatggtgatcagcgatggcgcgccggtggatgacagcacgctttccgtcaatccggggaactatctggaacggcatctgcgtgatgtgatccgcgagatcgaggggcgcaatgcggtcgaactggtggcgatcggcatcggccacgatgtcacacgctattatcgccgcgcggtcacgattgtggatgcggaagaactcggcggcacgatgatgcggaaattgtcggaattgttcgaggaaaatacccggcgggggtaatgccgcccacccaagcttgatccttctctgttatccgcctggaattgtctcgattcgtttcgccagcctgacggcggtatgtccggcgctggcccgcaggcttggcatcaccagcagacagtcatcatagggtgtccgaacagtctcatcgccatcatgggcgatcagggttccagcatgtggaataatgtggccgccgacgaaagcctgtgtaaaggcgaagcgggcggtacgcgctatgatcgtatgcgtgacgctccagcacggcactggcggcggaacgttctgttgtgacgggatcatctccagtgccgccagtagattgagtacaatctgccgcagagttgtcaccgtctcggcatgccagtgctgtccgccttccaccagtaaggcggtacgtttgcttccagcctcggagaacggggtatagtcgatcagtcggcggccagttgcatgtccgtcatcggcaataggaagtgccgggtctcccgccttgcgccccagcgccagaccccgttgattccgaccgcacaggatcagggggcgggatggccacagcatggagtgcaggtcgatcaggacatccgccgtgtcgatcagcggtttgatttctctggcacggaacagttcatagccttctcgcaatccggtacaggctttatcaggggcagaggttagcaaatcgctttgccaaacccgattgagatcctcatctacaaagcggctggcgataggttgccgggggtcgaagcgtgcgaaagcggccagattggcaaagccgaaggtcaggcaaccccgtaacggcctgatgcactgtctcagcagctgatccagcacgatggccccggcaatttcattgccatgagtcagagcgaccagaacaacatgaggtccaggtctaggcccggtgatgctggtaaaaccctgtatgctggtattgccggtgatccacggatcaaggtcgggtgtctccagccggacggtcaattcagggatcatggcagaggtggtctgcatcatggttatggtctgaatcggcggaggatcggtcgggaagagtccatgattgaaaatccaacaggatcgaaatgattgcaatcaaggtggtgattttttgcgccaaaaaacactgcttttgcactggccttgatccagtgcattgacgcgttgatccacgcaccggataggaaggacatggttgcttcgtctgttgctacaacccccgttacgttgcctgccacgcaccgctgctcctcccctgtggggcatgtggggtctgccgtgtatcctgctgcctgggccatctcggagccttatgcaggtttacaggcccagatcagaggtatcgcggaggcggtggggttggcccccgagatacgctccctgaaggcccggggcgtctggaaaaacctttccccctcgctatggccgatgccgttgcgtgcgatagagccgcaggcgctggcgggtgcgatcccggagatcatcatcggcggtggcggcatggcggcccggatcggtgcggcgcttaaatcccggcataggacagggcttcgtgtggtgcaggtccagcatccacgcatgaacccggcccggttcgatgtcgtgctggtggcggaacatgatgggctgaccggtcccaatgttctggtgacccgcaatgcgctgcatggcgtgacaccccagcgtctggccgaggcggcggcgctatgggcgccgcggttcgcgcatctgcctcgcccgctggtggccgttctggtgggaggctccaatggtcgctaccggctggatcgtgatgtggctgtggcgttgggggctgatctggcggccatgatgcaggctgaccatgtggggatcgcgctgactccgtcgcgccgcaccgccccggatgctgtctccgccctgcggcaggcgcttgaaccgcgaggtggatgggtctggaatggcgagggagacaatccttatttcggattgctggcctgcgctgacgctatcgtgacgaccgaggacagtgtctccatggtgtcggaggcggtggcgacctcagtgccggttctgctggcgcggttgccgggtcgttcgcgcagaatcggtcagttcaatgatcggatgatggcctgcggccgggtcaggccgtttcgcggacggctggagcaatgggcgacggagccgctggatgatacgcctgcggtggcggcagagctgcgccatcgtctgaatatctgagtcaaggattggaagacgggtatgctggatatcagaaccttcgataaccgccagggtggcaacgttctttacaaggcgctggcgcatcctctggcggcggaggcagcctcacgtctgacccgtcagttggtgggcaaggggaaagtcgccgtcttcgatcccgagggaatcgcccggaccctgttcgtcatgctgcccgaattgccgccggtggaagcgctctacgtgcaggatacggaacgcctgcaggagccggatgtgcgtccggtgaccgatttacctcgcagtgatgcgaagatcgtgctggcggcgaccttcgatacgatgcggctggccgaccgtctggactctcttatgcctgagggggcggagctggtcacgctggcggatatccgtatcccggaggcattgcagaccgcgccgcgctatctcgacaggctgaattttgcgaccaattttgcgtttttccgagagcagaatggcctttcgacccgattggtcaccgccaattactgggccggatacggtgcaaactcggtccggctgtggctgcgtctgtttgcacaggatggatcagtgctggcaacgtgggaacagaaggtgcctgccggtcccggtggtatcgtcattgacagccgcgaggtgagggcacgctttgatctgcctgaattcaccggtcagcttttcatccatgccatcggcgttgccgggcatgatgtggtgaaatacgcagtggatacctatggtggcaactcattatcctgcacgcacgatgccaatgcatggccgtctgaacgctatgccggcctgcccgccccgcgtgaggatgagcgtgtgatcctgtgggtgcagaacagtcatgccgtgccgattccggcgggagccatcgcgctggatcgcatgggtgcggaaaaaccggtggtgctggataaggtcattccccctttcgcgaccgaggctttggatgtcgctacgctgctgcccgggatatattggcccgcacaggtggaaattcttgcgggccgtcatgtggtcagaccgcgctatgaggtgagccgcggtgcattgacccgcattgcgcatccgaatgtggagcgtgccgatctacggcccgatccgggtatccgtaccctgtccccattgctggggcggggctatctgctgccattcccgatcctgccgcgtcggtatttccgcagtatcgcccagccgaccccgatggcgcatgagcagaactccctgccactgcggctcgatttgttcgccccggatggccggaaagtggcggagcattttctggggaacttgccgcgtcagcatgatctggcgctcgatctggacactcttctgccggaagacgcactgccggagggcggccatggcgagctggtctatgatttccgtgatggcggagatgccgatggctggctgcacggcttgttccgttatgagcatcgcgtctccggtcatgcggcggagaccagcttcggcgcgcatatctacaacacggcgatgacctatcgcggggagccgcaatcctattccgggccgccgccgggcctgtctacgcggttattcctgaaactgggggcggacgggctggagagcttcgcgcatctgatctacccggcttccgcgtcctggcgtgcattgtcctgcacatccctgctgctgcatgatgcggagggcaagatgattgccgaggaatcacttgcgattccctgctccggcagccatgtggtgcggccacaccgggttttcggtccggagctgatggatgcagcgggaaggggcgggtatgtgctgatccgtgaccgtacatgtcgactgttcggatatcatggtctggaacgggcggatgctttctcgctggatcacatgttcggattctgaagctccccctgttgctccctggtgaagtctggccggagcggtccggttacaaagaggaacggatattgcctgccaacggaaattctccggtcgcggttgagctgatcgcggtgctggcggcggtctccgatggcgatccgcaggtgctgacggtgcaggaggggcatgcccttccttccggcccgtttgaggaagggcatcgttcccttcaggccggcacacgctcctgggtggaacggcagaccggccatccgctgggatatatcgagcagctttacactttcgccgatcatgaccgcgcgggggatgggcgccgtgcgatttccatttcctatctcgggctgacccgtatgacggaacggcaggtgggccggcgcaactggtatgcctattttccatgggaggatcggcgcgagatgggcggggtcgcgctgggggcagagattgcccgccgtctggaaacctggatcgccggggcggatggtatgctccgccagcagcggacattgcggcgcgatgccgctttcggcaccggtggagagaaatggaacgaagaactcgttctgcaacgctacgaactgttatacgaagccgggctggtggctgaatcccgcgcgcccactgccgggcgcgtgccgggaatgtctatgctgtatgaccatcgccgtattctggcgacggcaattgccaggctgcgggcaaagatcaagtatcgtccggtggtgtttgaactgatgccggatgcttttacccttggtcagcttcaggtggcgatggaggctttggccggacaccgcttgcacaagcagaattttcgtcgccagatggagcagcaggaactggtcgaggaaaccggcgctatggcagcgcagacgggtggccgtcctgcgaaactgtaccgcttccggggtgctgtgatgcgggagcggagtatggctggttccaaactgcccttggcccgggtgccctgactgtttcagcttgtcgggtatcgggatcggagcagaaataaaaaagggagcatatgaatggccggaaaaatgctggattgggctgcttatcgcggtcagttgggcggcgagctgggaaagctggcgaaggttaaccccgatgtcctgaaaggccacgacattcttgcggcggcggcaccgtctccgaatgtgctggatgccaaaacgagggaactgatcgcccttgccgttgctgtcacgacacgctgcgatgggtgtctggcgttccataccgaggcggcccgtaaggcgggcgcaacgaaggaggaagtggccgaggctttgggggttgccattgccctgaataccggcgcagctttggtctattctgcccgtgccatggatgcgtttggtgatcagtccgcggactgatcctgcgtgaaaagcttgccgccgctcgcatgtggagccggtggcaagccgtccattgacccgccttgtgttacacaggcagattggttttcgcgcagggtgtgacgctgggcgaggcgagcagactgcgacgatctgtaacgaggctggctataatgagggctggagcgtatgcaattattcaaagccggactgatcatgggaattctgctggtctccagccatgcccatgcccagctcaatccattttacaccagcgttgacggttcggccctcaacaagagcgacctggccactcttggtaaggcagcgggcccgctcttaggaaacgagcctctgttcaacggctcaacccaaccgtggtccaatcctaagaccggtaacagcggcacgttgaccctggttgagcagtaccaaaaggacggaatgtcctgccgaaaaatcagatatgatgtgatgctgaaaaggcgcaatgccccaaatgtctatacgctggactggtgcaagacagcgcaaggtgtgtggaaaacacgctgattttcagtcttgcaagcctggataaagggggcagcgaccggattggtcctgccccttttctgtctgtcatgggcgggtcaatttttcgaccatggcataatcctgccggtaataatgacggataatccggcgggcttcgggggtaatctcgacccttgtagcctgggacgggttgaagggcttgcggaatatggctgcttcttctgtcccgaccagatcggccatcgcatcatgtaactgactgagttcaatggcgtgcgaatagcggatcggatgtagatggcgatactgcggcacgacatgcggatcgccgttcaacgacgcaaaaacagcaaatttctcaaatgttgacggctcttcacgcataatgcgttgatatcgtgcgatcagatcctctgcattatgccggtcaagaattttattgcgaaacaggctgacgaggcgtgcttcaggatcgcgccacacaaagatacgggcgtcgtaatggccgaatggccagattttgtatttccgcgggatatgcccaatgcgtgtttcgggatggagacccatcgcagccttgaagctgctgcatccgtttttgcgaatataggcatatagaatacgctttccgcccagcatgaaggtcaaatgctgcctgccaggacggaagcgtccgcgattgtcgaagggcattgtggcggtcgaaggggtcgggcgcgtcgtcaggaggatgctccggtgctcagacgaaagagccccaagctatacgcgcgcagggtgtaagctattgatatgaattgaaacgatatgttgctggatcgggttcgcctcatttttatcggcaaatatggaaaacaacttgacagcattatgctcatttacagcataatgctgtcaacgaaggccgatcttttatcttaatatgctcaaaaagagcataataggaggcgtgcttgctggattcgatcgaaaacgtttcatcgctttacgaccgtgtaaagcgcgtcattcccccgatggaatggcctgctttcgaaggcgatatcgaggcgattctacggctgaagcgggaacgcaacgcagtgattctggcgcataactaccagacaccggaaatctttcactgcgtatccgacattgtcggcgacagcctgaaactggcacgcgaagcgcagttcgtcgacgccgatgtcatcgtgctggcaggcgtgcatttcatggccgagacggcaaaactgcttaacccgtccaagaccgtgctgattcccgatatggcggctggctgttcgctggccgacagcatcacggcggctgatgtgcggctgatgcgggagcgttatcccggtgttccggtggtgacttatgtgaatacctcggcggcggtgaaggcggagagtgatctgtgctgcacgtccggcaatgcacggaaaatcgtggagcggctggtgcaggaaggtcatgagcgcgtcatgatgatcccggacgagtatctggcacagaacatagccaacgaaaccggtgtcaacatcattacctgggctgggcattgcgaggtgcatgagcgcttcacgcccgaacagatcagggagttgcgggcggaaaaccccggtatcgtcgtgctggcgcatccggaatgcccgccggacgtggtggcggaggccgattatgcaggctcgaccgcgggcatgtcggattatgtggcgcaaaacaagccgggccgcgtcgtcctgatcacggagtgctcgatgagcgataatgttgccgtgcatcacccggatgtggaattcgtgcgtccgtgcaatctgtgcccgcacatgaaacgggtcacgctggccaatatccggcacagtctggaaacgatgacccatgaagtgaccatcgatgcctccgtcgctgacagggcgcgccaggcagtggagcgcatgctggcgatctgaaccgcttcgatcctgttgccgtttcgccatgccggcactgttggagtccagacatatggatcactcatccctcgatgggcgggttgtcatcataggggcgggcctggccgggctgatgacggccctgcggctggcgcctgttccctctgtggtgctgagcgttgctccgtttggggagcaggcggcaagcggctgggcgcaggggggaatcgcatctgcgctcggtccggatgattctccggtattgcatgctcaggatactctggcggccggggatggcctctgtgaccctgatgtggtggcccggatcaccgctgctgctccggcagcggtggaggcgctggcgaagttgggggcgcggttcgatcgggatgagtctggcgccttcaggctggggcttgaagccgcgcatagtcgtcgtcgcatcgtccacgcgcaaggcgatggcagcggacgagaaattcttcgggccgtgctcgcggcagccagaaatgaatcgtcgataacgctgctggattgtgcgcgggcggtgcggctgatcaccgtcaatggtgccgtggccggtttgctgtttgcgcggaaaggatcatttcactgtatccgcaccggccgcgtggtgattgccaccggcggcgtcggcggtctgtatgcccataccaccaatccgaaaggagctacgggagcggggctggcccttgcggctcgggccggagcgttgctgggggatatggagttcgtgcagtttcatcctactgcctttgatgccggatgcgatccgatgccgttgatcagtgaggccgtccgcggtgaaggggcggctttgatcgacgagacaggagagaggtttctccctgacgatctggcgcccagggatgtggtatcgcgtggcgttttccggcatctcgctgaaggtcatcgcgtttatcttgacgcaacaaaggcggtcggtgcccgtttcccggttcgctttccggctattgatgccatttgccggggggcgggcctcaatccgtcagtgcagccaataccgatccgtcccgctgcgcattaccacatgggtggtatcgtggtggacaaggagggcagaagttccgttcccgggctgtgggcttgcggggaggcggcatgcacaggtctgcatggagccaatcggctggcgagcaattcgttgctggaggccgccgtcaccggtggctgggttgcggagagcatcgcggcgcagacggctccgcctgttgtgccactgttgccagcgcctgccatgcctgacgcgattacatgtggtgccggcgatgctgtgcgtgccgtgatgagtcgtgatgtcggcgtcctgcgtgatcatgcagggctgagccgggctattgcagcgctgcgcccccttgcggagcaagatgatgcggcgttgatcgggctgatgattgccgatgctgcgctggcccggaaagaaagccgcggaggtcatgcgagggatgattatccctctactctactcccgcttcggcgcagcgaatcggcgatatctgtgctggcccgtaccgcctgttcgatgaacgctcaggccagaccggatagtccagcagtgctgaaacaggaggcatcatgacccctttgcccgatctgctgctggaaccactggtccgtgccgcattgctggaggatcttggccgggcaggggatattaccacggatgccgtcataccggcgacgcagaccgcgcgcgtggctttgcaagcacgccagcctggggtcattgccgggcttgaccttgccaggctcgcttttcatctggtggagccacggatccatttttctatccacgttcccgatggcggtcgggtgatgcctggggatgccattgccaccattgatggccctgcacgcgggttgctgaccggggagcgtgtcgcccttaattttctgggacatctgagtggtatcgcgacggcaacggccggaattgccgatgcaatcgcccataccaaggcgcgtatatgctgcacgcgaaagacgacaccgggattgcgtgctgtcgagaaatatgcagtgcgtgccggtggcggcagcaatcatcgcttcggtctcgatgatgcggtgttgatcaaggacaatcatatcgccattgccggaggtgtggcgacagccatcaagcgggcgcgttccagcatcggccatctggtcaaaattgaggtcgaggtggatacactgacgcagctgcatcaggtgctggaatacgatatcgatgccgtcctgctggacaatatggatccggccacgctgaggcaggcagtagggatcatcaatggccgcgccattgctgaggcatcggggcggattacgccgcagacagcaccagccatcgctgaaagcggggtagatctgatttcagccggatggctgactcacagctctgcggtactggatatcgggctggattttctggattgacgaccggttttcagtcatcaggaaggtcgtttgtggcggatgcgttcatccgccacaggatcgatatcaggcggctattttctgtccgttttccaaggcacgcaccagggggatgacctcctccccgaatgcctttagctcctcctggaaatgaaggaagccggtcaggacaaggtctataccaagcgatttcagagtaaggatgcgttctgcaatctgttgcggcgtgccgatcagattggtgcggaagccgtcattatactgcaccagatcttcaaatttgctgtcctgccacatgccttttccatccggagaggactgaccggcctgtttgacggcagtgccgaaggcctccaccgcttccttgtccgcagcgccaacgatgcgggcaagctcctggcgtgcttcctgttcgctgctgcgtgcaatgacgaaagcattgacggcaaattttacagttcggccgttttccgctgccagagcacggaccttggtgatctgctcttttaagccatccaggctgttgccgttcatgaaataccaatcggaaaccgcgcccgcgttccgctgtgccgcactggaatttccgccctgaaaaatctccggatgcggtttgctgagtggtttcggattaagcgtaaaatcgttgatcttgtagaattcaccatcatagctgaaatggtcggtggtccatattcccttgagaatatcaataaattcacgggagcggcgatagcgcgcctcatgatccggccagccaagccccatggcttcctgttcgccctgaaaccatccgctgacaatgttgaccgaccagcggctattaaaaagatgatcggctgtggctccgattttggcgaccaccgccggatgccatggtccgggcagaatggcagtgatcacgcgcagcttttttgtcgcccccagcaaagcggctgaaaacgtcgtgctttcatgctgggattcagcaccatagctgccgatgaagcgaatctgtgtcaaagcgtaatcgaaaccgacctcttctgccgtgcgggcaagctcgacattgtagtcaattccccaatgtgtgcgctggggaattttactgacgaccagaccgccgctgacattcggtacccaataggcaaatcgtaactggctcatggtcgtactctcagctccaggcgtgcaggggagggttgatgccattcaggtagtaattgccgatggccgcatatttccagcgcacagggtcatgcagcgtatgagtccgcgcattccgccagtggcgatcaaaattgtatttgccatccgtggaggaggttccccccaattcgaacagtttattggtggcttcgatagcgatttctgttgtcaaaaccttggattcggcggtgatgatctgcgcacgggccacggtatccgtggtcggattggcgacagcctcatcaatggcgtggcctgctttctccagtatggccaatgcggcattcagacgaatctgaagggaggcaatcgtctgaatggtgtagggatcttcccaggcattgtcctgtccggcatcaatccagggacgtgctttctcccggacgaaccggatggtgtccttgatggcggcttcggcgataccggcatcaacggcagcctgaatgatctggaagatagcgctttccgcctgcaccgtggccggatcataggctttgaaaccggcgatcagatgggttttgggcaccctgacatgatcaatcaagactgtcccgctggccgtgccacgctggccgaaagccgaccagtcattgatgaccgtcaggcccggtgcattgcgatcggcgatcgcgtaccaggcgcggttctgttcatccagtgctacaatcggcaccagatgcgccagcaatgccccgctggaataatatttttgcccggtaacgataacatgatcaccctgatcggtaaaacgcgtgataaattcagcgacattcttggtgcctcgttccgagaatgcattgccgagacgtgtgccgcgcaggatctccccgaacaggatcgattgttgttccggtgttccgttggcgcggatggagaaaacaatgccgagatgattttgcgtgatctgtccaatggagggatcggctgcggaaatgatcctgatcacttccgccacggtggcataggaaacatctgcgccaccgaaagcgcgtggcacattgatcgcccacagaccggactgggagtatgcatccaattcatcccggggaatggccgaatggcggtctcgttccgatgcaccttctgcaaagcgtgccgcaagacggtgagcgacttcgaccgcctcctcatcgctggtaatgacatgggcaggctgagctggccgtgatacgccgggaacgccccgctcgccgcttcctacccgatgcggtgtagaggatgtgtctggggtcgatgctgtccgcaggcttgcaggatcgagttccgtcacgctcatgatcggctccagtatttacttaatttgatcgtttaattttttaagatgtgtcattaaaagtgtataatggttggctatgcaagagggaattcacaaattatgattattttgcataaataactaattataatagtgaaatttatctggaatttgcaaacgatgttcgtgcagtctcaacccgtaaaagaatcacaaccgatcagcggccaggggttctacaggcatattgtcctgatcggttgtggtctgtccggggctgcttttctggctcatcttatccgcgatcatcctgatttttcaggcaggatcacggtgctggagccttcagaaaagcttggggccgggttggcatatggcacatccgatcctgtgcatcgtaccaatgtggcggcagcccgtatgtcgctttttcccgatctgcccgatcattttgatgcatggctcaggcagagaaatataccccatagcgatgcgcattccactctggaggatggacggatatacgccagaaggtcggtatttggggattatgtcgatgacacggtccgctcggttatcgaagccgcgtctggaatggttatggtccgtcatcttcggctgcgtgctgtttcggcctcccggaatcatgctggcaagtctggctgggggattacgctggaagatggatcgctcattgcggcggatattctggtattgggcgtcagtcacaccgcgcccgacttgcctgcaacgctgcgtggatgggcgggggaaaagggactggtcgccgatccgtggcagcccgacgcactggccgatattgcgctggatgcgccggtttgcattatcggcaccgggctgactgcatgcgacgtaatcgcctcgttgcgagcgcgagggcatcgtgcccccatgacggctttgtcccgacgcggattactgccccggccacggactctgctgccggtcgaggctgctggagatttcagcactgagccagcccgaacggcatcagctctgctgcgccgtatccgccgcaccattgccgctggtgaagtacagggacgcccatgggaggatgtgattgatgccctgcgtgttcaggctcccattgtatggggcgctctgaagacagaggaaaaacgacgcctgttacgacatgcgcggccattctgggatgtgcaccgtttccagtgcgctcctcagatcgatgcagtggtcagacaagggctggaagagggctggttgacagtacgggcggcctcattggtttcagcggatagggaggcatccggtgacattgttatgaccttccgtgcacgggggcagtcagataccagccgtacgaccgtacgggccgtggtgaactgcaccggccccggccatcgctcggtggtagaagcccatccggttctgcatgcgttggaggagcaaggcgtattacgctccgacccttgccgtctgggtattgatgtggattgggaaagccgggtgctggatcgtgacggtacggcatggcccgatgcttttgtcgtaggaccgctggcccgtggcacacatggagagctgatgggattgccgcaggtcacaacccagccgaaggctgtagcggctacggttgccgcgctcgcagcaaagagtattgcccctgctgatataaaggtatgatgcgtagaaggaggaaagacgggacttgtcatccgtttttttcctcccgcttggggaagagatttattcgtgtttggtatctaccgtcatcgtatgcagtagaattgcgacattgcgatcatcagccgaatacatgacggatgatggtttcaccgcatcaggcagcgcaaatttcaggacaacgacgccgttttttcccttgtcctctgacggagccgggataatggcttcgaaccggtcatcccagctgcttgttgtgaaccagccgatgaaatgctgattggcgaataatccgatgtgctgcctgtcatgatgtctggcagtgaaagcagccagactgaaggagagatggaggggataggtggctccttcgggcaggcggaaacggatccatgcattggctccgtcgctccatgtgcctgttgcttccggattggaccatcctttgccgagcagatggaggccctctccctgcgcaccgaatgagattgctttcccgagggcgatcggtggcagatttgcggcgattgccgccgggtctgtccagatggagtaaggccagaccatgatggtattgtctttataatgcaggatacgggccggtggcccgaactgctgcacagccgtttcctcgcaatgtcctgctttgccgcagtcgaaccaatgatgcggcatgatcagaaatatatcctttgtgttcggcgggatatcgctggcctcgtaccaggtatcggaggtttgagcgcctccttctgtaatatggccgcttatggcttccgcatgcacggaacggagcgtgactttgccgtggctgacccagtgcactgcattggcgctgtcttctccataaggaccatatccataagacagcccgttttccaccaggaagctgctcagtccatccatagactgcgtgtctgcttttaagggatgagaccagctttctcgtccgctgagcaagccggctatgacgataaggaccgcataggttgtcagtccgtattgttgccatgccgccatatcggcccggcgccgggcggcaaggctgaccccggcaataatccataatgcgaaaggggcaatgaaaaagcgcagggactcaaaagccggatcagagaagaccagcaggaacaacaccagaatcgccggataggacagcagcgcggtcgcggtgataaatcgcagctggggagatgtccgatccatcaaactgcgccgcagagggagcagcaggatgatggttgcgatcgcaaaagcgatacaggcaatgatggcgggcagagagagtctgtctgtcagcgcactatgccccagcggaaccggattgaaccatgcggggacaatcagcagggcggttttgagtgccggccatgcccgctcgggagaaaagctcatttgcggagcggaggaagcgagaaacgtcgcctgaccgaaaattctggtgcggtccagctcaagggcaccggcaagggctatagccagtgcgacagagacaactctttcccgtattcccgaaccggtgatcagaacccatccgcaggcggcgatggcgggcagcagcatggccccgttcagccaggggtccgaaagtcctccgatcatgaaggccagaactgaaagaagaatatagcccgcatgtccccatctgttgcggggtgtcaaggcacagcaggctgccagcaatccagccagtccccagaacagtgaaatattatggctgacgggatgagcaagatatccgggatgagccaccgcagagcaatcggcggccagcatcagtgcggcggttgtcagcccggcgagggggcctgccaatctggctgtcagtatgccgcccatggcgcagagtgccacaaagacggcccatcctgcccatgccgggctcagtgctgccgggcctatggtttcgaacgcggcataataaaaaggatagagagaaaacagccagttatcctgggtcgcatgccatgaactgataaaggatagcccgttctgacgaataccctgccagacaacgtagggggctgcgttatcgctgtcgaacccgaacgcatcaaagcttgtatgcaggctcgaccagagtgccgcgaggatggcaatgatcaggccgcccagtaatactttatggcgaaaagagcgattcaaaacagaacctcgatagggataaggatcagggcaaggacggaaacggaatgcagccgactactatcgtataatccagctccaagatattctcttctgcggcagatcaggacgcaggagactcgatgccgcaacgatcccgtttatcgccccggccattatcctcttggacatccccagtcttgcggcgtgtcatattgcggcagggcatggcagccggactggcgtcgctgggattgtcattacgaccttcgcttgccgggcaggtaacgcagcctacatcctttgatgtcgaaacgctggaagagatggcacgcactctggccagcctgccttatgttcccccgtcgcaacaactgcccgaaacgctggcaggccttgattacgagcgatatggcaaaatcagatttctccccgatcatgccttgtggcatgggcgtggtgagcggtttgaagcagagtttttccatcgtggctatctgttcaaggatcgtgtagccatcaatgagatcgtgaacggcatcagccatccgatccgctatgatcctgcatggtttgatttgggcgatatctcgccgccggaggatgatatcgggctggccggtttccgtattctggcccgcttccccggcgcttcccctcgggaccgaaaggagatcgcggtttttctgggggcgagttactttcgagccgtagcgccaggacagaattttggtctgtcagcacgtggactggctttgggcagcggtgagaacggtgcggaggaatttccggttttccgggaattctggctggagcgtccgcaacaggatgctgatcatctggtgatttatgcgctgctggacagtccttccctcacgggcgccttccgcttcgtgctgcgttccgatgtcgagacggtgatggatgtcgattccgtcctgtttccgcggcgcgatatcgccaatatcggcattgcgccgctgaccagcatgttctggttcgaccccagctatcgggtgggggtggatgactatcggcaggcggtccatgattcggatggtctgctgatccataccggtgccggagagacaatctggcgcagccttgcggatccggcgcaggtacagttttcgtcttttgccgaccactctccccgtggtttcggacttatgcagcgtcagcggggctttgatgcttatgaagatatcggtgcccgctatgatttacgcccctctgcctgggtggagcctgatgaggattggggggagggggctgtgcatcttgccgaattgccgaccggtacggaatttcaggataatattgtcgctttctggcgtccgaccgcaccgttgaagggtgggcagcagtatcgctacgcctatcgtttgcgctggtgcgatgatatttcggcacgcactctggcaagagtggttgcattcagggccggtgccagcgccgatcccaaacggcggtttttcatgctcgatctggcggggggcgatttaagagcggatgagaggatgctggatgcgatggcgcctcccgcatccccccgtcagcttgccgccatgctggtgccggaggtgatatgttcagcggggcagctcaaatgggccgagatcaagcgtatccctgcctatccggtggcatcgatgcacggcatgagacgctccggcgtggcactttatcgtgtggggttcgaacttgagcccggtgatgcatctttggtcgatctgacggttcgggtcaggcgaggtagaaaagtggtttcggagacctggatgtatcgctggacagcgaaagatcatcccaggccttgatcctggaatggccaggtgcctcctcccccaacaaaaaagttcggataatattctggaaaagactgtgcaggccactgaacatgaccttgcaactgcattctgtattgaggccgggacagtcttttcttgctgcattggcaggcttaacggcactcccatcaatcgccagggaacagctggcatgacaatcatgaccgaatagcgggcagctgccagcaaacagttttgcagaccatctgccaatcgcagagtgttgaaaactgactaatgcattgaaataatggcgcgcccggaaggactcgaacctccaacccccagattcgtagtctggtgctctatccagttgagctacgggcgccgcgctgacgggggcgatgtagcctgactgtcataagggcgcaagagccagcccgatatttttttcgatcccgaagacaatgcagcatcgtgcaaaggatatggctatttttaaagcatattgccaatattatggcctgtaaaaaatatatttttatcttctttcatgtatttgaaaggtcaagaacgcttttgactgattcgatgatccgtgaaatatcgctttcgcgtgacagacgatggttgccatcccggatcagcgtcacgacaagatcaggaacgcttccgtcagggcgggtgatggtctgggaaaggagggtcgcagtttcccatggaacctcgtgatcttcctgcccttgcagcagcctgatggggcaggacagaggcagaggcgcattcagcagcagatgtgtgcgcccatcctcgatcagacgtcgtgtgatcggcacaggcggtccgtagggattgggggccatcaagacgccctcgcgaagcagggtttcgcgttcctctgccggcatgacatcccacatcaggcgctcggtaaaatccggagccgcagcaataccgaccagcccgacaacacgatcaccaagctgccgggccgccagtaacgcgatccaccctcccatggaggagccaacgaggatcagtttccctcgcacggttttctcaatcacagtcagggcatcgttcagccatgtgccgatgcagccatcttcgaatcgtccttcgctctgaccgtggccgctgtaatccagccggagcatggcctgtccctcagcctcgcaccatgcagcaagccgcagggctttttctccctccatatcacttcggaatcccggcagaaaaaccacagtgggactgcgtcctgcatggcaatgtgctgccagcctgatgccatcggggcggacgatctggcttgctgtcataagaggcttcctcttctccaatggagggcacggacttatacccggtttattgcgtttcgcctgacgaccgcaaacgggagagagaatgccggattctgatcgggcggaccggattcataccgcgccatgcgttttacaggtgctgcctgccctggatgtaggcggcgtggagcggggtacgctggaaatggcacaggcgattacggaggccggaggacgggcgctggtcgccagtgcgggtggccggatggtgccggggctggagcgtaggggggggaaacatgttctgatcccggatatgcctgccaagcagccattcaggattctgcgcaatgcccgcacgctggagcggctgatccatctggaagatgttcggttggtccatgcacgttcccgtgcaccagcctgggcggcttatcgtgcggcgcggcgcatgaatgtcccgtttgtcacgacctatcacggtgtgtatagcgagtcctttcccttcaaacggcattataatgcagtgatggcaaagggggatcgcgtcattgcgatcagccagcatgtggcggcgctggtggcgcagcgtcacggggtggggcctgaccggctgcgtattatcccccgcggtgtcgatccgttgttgttcgacccggccatgatcaccggccctcgtattcagcgtctggttcagcaatggcaattgccggaaggggatattttttcccttgttctgatgccggcgcgtttcagccgttggaagggtcagcacattctgcttgatgctttggcccgacttcagcgcgcggatgtgatctgcgttttcattgggggagataaagggcagcaggattatgcccgttccctgatggagcgcgcgaaagaaaacggtattgccggccagatccggttgggcggtatttgtgatgatatgccggccgcactgagcctcgctgattgcgttgtacatgcatcgctggaagcggaaccgttcgggcgaacagtcattgaggcgcaggcgatggggcggctggttatcgccagcgatctcggagggccacgggaaacggtggagcatggggtcagtggtttgctggtgccgccggcggatgtggaagcgttggcagttgctttggccgaaacactggctttgccgccggatgtacgggccgaggcgggatggcgggcacgacagaaagtgctggagcgctacaccacggatgcgatgcagagagcgacattggatgtttacaatgaattgctcggctgaggggctattcggccattacgcgctttttgctgcactgcgacaataaaaatcgcccctttttgtgcatcgcacaataatcgtttctcggattatgcggatattattttgcagttaatgcaaaagcatgttgacttagtcccaaaagctgaaataacaattctctcaggaaagagatttcctctatcgccggtcaggtgaagtctcatggcatcgcgccgaggcgtgatgggtagggatcggagcagcagccactttcctggctgtattgtcttcggtggtcctgcgtcgacggagttttcgactgctccggtttcacgactcaaggagacgatggaatatgcatcgctgaaatttccattgctttcaaatggcctgatcctgaatggcaaacagcctgtcagataaggcccatcaccaaaaatccaagaataatccagaataaaattaaaatcaggggaaaggtctcttatgaaacagcaaacgctgtcccgtgtttgtgccatgatgctgggcatcggcgctctggcggtttctttccaggctcaggcaaatgatgagctggtgaaactgtccaaggattctgcaaactggtcgatgcctgctggtgattatgcaaaccagcgccacagcgccctgaagcagattacggttgccaatgccagcaagctgcgtccggtatggagcttctccaccggcgttctgcgtggccatgaaggtggtccgctgatcatcggcgatgtcatgtatgtgcatacgccgttcccgaacaaggttttcgccctcgatctgaacgacaatggtcgtatcatctgggtgtacgagccgaagcaggatccggatgtcattccggtcatgtgctgtgatacagtgaatcgtggcgttgcttatggtgatggcaagatcattcttcaccaggcggataacggactggtcgcgctgaatgccaagaccggcaaagaagtgtggaaggttatgacgggcgacgccaagaaaggcgaaaccggtacctctgcaccgctggtcatcaaagataaggtgatggtcggcatctccggcggtgaattcggtattcagggccgcctgatgtccttcaatctgaaggatggttccaaggcctggacggcgtattccgtcggcacggatgatcagatcctgttcgatgacaagaccacggcaatgggcaagcctgtcggtaaggacagctccatcaagacctggcagggcgatcagtggaaaacgggtggcggttccacatggggctggatttcctatgatccggacaccaatcttgtctattacggctctggtaaccccagcacctggaacccggttcagcgccctggcgataacaagtggtccatgaccgttttcgcgcgtgatgcggataccggcgtcgcgaaatgggtctatcagatgaccccgcacgacgaatgggactatgacggtatcaacgaaatgattcttgccaacaccaaggtgaacggcaaggaaaccaaggcgctggtgcatttcgaccgtaacggcttcgcctatgtgcttgatcgtgtgacgggtgagctgctgcaggcgaacaagttcgatccggcggtgaactgggccacgggtgtgaatctgaagaccggtctgcctgatcgtgtgaagaaatactccaccgaagccggtggtgaagatcacaacacgaagggtatctgcccggccgcattgggctcgaaggacgaacagcctgcttcgttcgatccgaagactcatatgttctacgtgccgaccaatcatgtctgcatggattacgagccgttcaaggtgtcctacaccgcgggtcagcctttcgtgggtgcgacgctctccatgttcccgcctgcgggtgaggatcatctgggcaacttcatcgcttatgatgtggacaagggtaagatcaactggtcgatcccggaaaccttctccgtctgggctggtgctttgtcgacggatagcggtgtcgtgttctatggcacgctggatggcttcctgaaggcagtcgatgccaagaacggcaagctgctctacaaatacaagaccccgtccggcatcattggtaatgtcacaccttacgaacataagggtaaggaatacatcgccgttctgtccggcgtcggtggctgggccggtatcggtatggccgctggtcttgcgggtgacaccgaaggtctgggtgcggtcggtgcctataaggctctgtccagctacacgcagcttggcggtgtgctcacggtgtttgccgtcgagtaaatcgtcgaggcatgtcctccctgggacatgatatttccaaccacttcccggtgccttcgggcaccgggctttttatttcttttgattttatctttattttagctcaatgcgtgatcaagcctgttccagtcgcggttgctcttgggcaacccgaaacggaacaggcgatcatcccaatcaaagcgccttgtcataatacctgctttattcagtcggtcatgaatcatcatgttgtccgggtgacaggtcagtctgaacaggctggttcccccgagaatctcgaacccttttgaaatcagcaacctatccagacgttctgccgctgcctcaagacgcgccatggttgcttgctgccacgcatgatccgtcagggctgcccgggcaatagtgatcgcagcaccggagaccggccacggccccaaaatacgccgcagaaaatcagcatggtctggtggtaaaatcgcaaagccaagcctcagccccgccaggccataggcttttccaaaagaacgaagagcaatggcggcagaatgctgtatcgtgccaatgctttggattcctttttcgaaatcggcaaaggcctcatcgacgatcagccatcctttctggtctgccatgcgatcagacaggatgcgcagatcggatagcgtgtagcgtgtaccatcggggttattgggattgcagacgatgctgatgctggcttccgatttttgatccggatcggggaagcggcatgtctggacgacgcgatgcccatgcagcacccaggatgctgcatgttctgcataggtagggccaacgacattcacgatccggtttcgaccgcccaggcagagcggcagcaagccgatcaggcactgtgatcctggggcggccacgacccgggatgcatcggcgacaccgtattgctcggccgcgatccgttccagtgtggcaaggtcatcgggatcgggcagggcgctccatacatgggcgggcaatgcggggacagggtaggcgaagggattgatccccgtggagagatccagcaccggggtcggcgcatcggggttggaatggcgaaaggcggagatccggccaccatgagacggagggcttgcttttccgatgctcacgcggcaccccatcccggatgatgcatttcgacggctcttccttctggcatgtcctgtttccggcgcatgcgctgatcctgctggtggcgctctgtcttgatgcgggcttcggatatccagccttgcttcagcgtcggcttggccacccggtgcagtggattggcgctctgatcacgctgttggagcgatgtggcaaccgacctgcttttcccccgctcttgcagagagtgttcgggattgtgagcctgattctgctgctggcagtcacagtgctgcccgctatcggcatgacgtatctggctctgcgctggtttccgctctggagcgtcatgctgctgtctgccctgccggtttcggctttgatcgcacagaaaagcctgtatcagcatgtcgctgccgtggcggaggggctgcatcggcatggcctgtccggtggcagggaggctgttgcgatgatcgtggggcgtgatgtcgcggtgctggatgaggccggcatttcccgtgcggccatcgaaagcctggccgagaatttctccgatggagtggtggcacctgcactctggtgtctgctggcggggctgccgggcattgttgcgtacaaggccatcaacacggcggatagcatgatcggccatctgtcgccccgctatgccatgttcggatgggcggcagcgcgtctggatgatctggtgaatctgcctgcctcccggcttgcggctttgtgtcttgcccttgcagcacgccagcggcgggcggaggctttcaccgcgataaggagggacgccggattgcaccgttcccccaatgcgggttggccggaggccgccatggctggtgcgctcgggctgcgtctggcaggtccccggctgtatcatggtgtcgcggttgaggatgcctggatggggcatggccgcaaggacgctgatgtgggggatatcctgcgcgcactcgggctgtttcgtcgcgcctgcctgctgctctggctgcttgtgctgctgaccctgatcgctgccgtggcgtttggctgaaccgcatctcatgctgacagggccagcagccggtcgatagcgacatgcgcctccatatggtcggccagagcatcgagagcatgctcgacagcatcctcgtgatcgccgccatggctgctcacatcaagggtcgcgagcaggtgacgcctgaaagcccccccatgaaacaggccatggagataggttcccatcaccaccccatcggctgaaacacatccttccggtgcatcgggaccgagcgacagcaagggccgccgcaatcctgagccggttgtgatccccatatgcatttcatagccgctgaccggcacatcatgattgaagagatgaccgctgcgggaggtcaggattttatgcggttccagcacggtctcgatctccagcagccccagcccggcggcgctgccggcgggaccttcaaacccttgaggatcgtgaatggcacgccccagcatctgatagcctccgcacagaccgatgatgctccgtcctctgcgccggtgcgccagaatatcgatgtcccatccatggtgacggagagctgccagatcggcgatcactgttttcgatcccggaatgataatcgcgtccgccactggcaggggctgtcccggcggcaccatgaccagtgtcacgctgtcttcggcggccagaggatcgagatcatcgaaattggcaatatgcggcagcatcggcacggcaatgacggtgtttcccgatcgtgtcggtgctgataggccgcgcaggagatcggcggcatcttcggccggcagggcgcgggcggcctcgcaatgcggcaccagtccgagcgcttcccagccggtctgctgttcgatcagtcgcattccttctgcgaacagcgatggatcgccgcgcatacgattgaccagaaacccccgcaccatcgcagcatcgtccgggtccaacacggttttggtgccgaccagcgcggcaatgacgccgccgcgatctatgtcacccgcaatgaccaccggaacattggcggcgcgggcaaagcccatattggcgatgtcgcctgcacgcagattgatttcagaggcgctgccggccccttccaccagtacgatgtcggcctgtttccgcaagatgccgaaactttccagcacggtccccagaagctgtggcttcatggcctgataggcccgggctgtggcctgaccatggacttttccctgcaccacgatctgtgcgccgatctcgctttgcggcttcagcaggacgggattcatgtgatgggaagggctgatccggcaggcgcgggcctggagagcctgtgcccgcccgatttcaccaccgtcagcggcaatggcggcattgttggacatgttctgcggcttgaaagggcgcacgaccagcccacgccgtgtgagtgcacggctcaccccggccaccagcagggacttcccgaccgaggagccggttccctgtatcatgagggtccggctcagaactcgattccttcctgcgcctttaccccggcggagaaatgatgcttcacagcggtcatttcggtgacgaggtcggcggcctcgatcagaccgggttttgcattgcgcccggtaatgacgacatgctgcatgtgtgggcgtgtggaaagcccctgtaacacttcttccagcgtgagatagtcgtagcgcagggcgatattcagctcatccaggaccagcaggtcgatgtcggggcgttgcaacaggctgagtgcctgatcccaggcccggcggcaggcggcgatgtcgcgcgccttgtcctgcgtttcccacgtaaagccctcgcccatggtgtgccattcgatgcggtctccgaacacggtcagggcgtcgcgctctccggttgaccaggcccccttgatgaactgcacaacggcacatcgtttgcctcggcccaggctgcgcagcatcagaccgaaggcggcggtcgatttgcccttgccaggcccggtatggacgatcagcagccctttttcctgtgtcttggaagcaacttcggcatcctgcaccgccttgcgatgggccatcttgtcgcggtggcggcgttcttcttccgtcccggttcccggtgcttccgtcatcgcaggcttcccccctcaggctgtttgagcggcagggcgcaccctgccgcgatcagcagcacgcggcccgcgcctgccgcgatcctctggttcagcaatccggcctcatcgcgaaagcggcgtgccagcgcattgtcggggactatgcccagcccgacctcattggcaaccagaatggtgcaggcgctgcggcgtgccagcgcgttttcaagtgcttccatagcggctggcagatcatgttcgcccagaatgagattgctcagccacagggtcaggcagtccaccagcacagggcgtgccggatgctcgatcagggctgtggcgatatccagcggggcctcgacggtttcccagccagcgacccgtgcggcgcgatgtgcctcaatccgggtccgcatctccgcatcgaaggcctgtgcggtggcgatatagcgccagggagaaggcagagaggtgatcagcgcctcggcatgacggctttttccggatcgtgcgccgccgatgatcagggttgcgtgcggccagcgcgttgttgccgccgcattcggcatgatcatgtttgacttcatcaggcggcggctcctaaatccctgcacgatggtttttccgtgcggatcgatctccgtgccggaaaatgaaaagggaacgcgatccagcacatgcgccggccagtccgttggttgtgcgatgtcgcggctgcccccgcaactgtaggcggagagtattttgcccggtctgctccggagaataaacccggagcaccgtatcgccactgatcccggatccgggactgggaaggcaggtggaatacgtctgatccgtgagccaggagacctgccatcgtccggatcgcgaaaccgcgcggggtgcgccgggatcgtctttccgcttcaggccggtggtctggaggcgattatctgttcgcgcaccctgaccggtctctggacgaccgtattctgtgcgaggaagaacagccatggccattgcctcccccgttcccgcgaccatcgtgaccggatttctcggcgcgggcaaaacgactttggtgcggcatgtgctgagtgctgcgcgcgggcgtcgtattgccatcatcgtcaatgagttcggttctctcggaattgatggtgatctcctgaaaagctgcggcatcgagggctgcacggaggataatatcgtcgaactggccaatggctgtctgtgctgcacggtcgccgatgatttcctgccgaccattgaggcgttgctgggccgcgcccagccacccgagcatatcctgatcgagacctccggccttgctctgccgaagcctctgctgaaagcgttcaactggccgggtgtaaaaggccgggtgacggtggatggggtggtgacggtgctggacgcccctgccgtggcatcaggccgctttgccgatgatccggatgaagtggcgcggcagcgtgcggaggatccgaacctcgatcacgacaatccgctggccgaggtgttcgaggatcagctttccgccgctgatctcgtgctgctgaacaaggctgaccaattggatgatgcggcgctcgcttcagtgcgggaagaggtggaacggcatctgccgcgtgcggtcaaggtgatcgcgaccagagaggggcagctggaccccgccgtgctgctgggtctgcatgccgcggctgagaacgatctttcagcacggccatcgcatcatgacagcgtggatggcgaacatgaacacgatgatttcgagagcttcgtcgttcctttgaaggaacaggacgatctggatcatgtggccgtcctgctgcgtccgttggcggaggcgcatgacatcctgcgtatgaaaggcttcgtcccggtgcagggcaggcccatgcgcggcgtggtgcagggggttggcacacggttccgccagtctttcgatcgtctgtggaagccggatgaggtgcggcaggggcagcttgtcatcatcggtcgtactggtctggaccgtgctgctatcgaagcatcgctgatcaatagcggtctgggcgctccggtgcctgcctgatgcatctgctggtccgggaaacgcggtcgctggagcaggcggatcaggcgcaggagctgggccagagtccgggcgatgtcgtgtttctgtccttctccgacagtgatctcggcgcggcccggaccggatgggcggatgcctctgcggaagggatgacgctgcgcctcgccaatctggcccggctgcgtcatccgatgtcggttgatctctatctggagcagaccgtagccgggtcgggtgccgtgctgctgcgtctgctgggcggggcggaatactggcgctacgggctggaggaactggctgcgctgtgccggaaccgcgcgattccgtttgcagtcattccgggcgatggcaggccggcggaccgggaggcgaaagccgtatggcttgctctcagcaccgtgccggaagaggtctggacccgtctggacatgtattgccggcatggtggtccggagaatctcggctcggccctgcgcgtgatggcgtcgctggcgggcaagggagttgatgaggcatggccggtccggcaggtaccgtccttcggcatctggcgggaggaccgggatcatgtggccgatgggctgagggcggttctggtgttctaccgctcctactggctggcgggagacatggcgccggtcgaagccatgatggaagccctgcatgcacgaggcttcagcgtcagcgcggtgtttatcgacagcctgaaaaatcccgcttgcgcccgttccgtagcggagcatctgcggctgtggcgtcctcatgtcgtgttgaatgcaaccggtttctcagcccggatcggggaggacgggacatcgccactcgacgcagccgatgtgccggtgattcagctggttctgtccgcgtccacctgtccggcctggcaggaatcgacgcgggggttgagccagtccgatctggcgatgcaggtcgtgctgccggaatatgatggccgattgctgggcggcgtggtgtcattcaagcaggataccggcctgaccgtgccagaggatggcgcggctctggcggcgcatatgccttacgaggccggtatcgctatggcggcggaccgggcactgggctgggcgcgtctggcgcggacggggcggcaggatcgacgcatcgcggtggttctgtctgattatccgggggcggaggggcagtcggcgcatgcggtcggtctcgacagcattgccagcttgcgggctatgctcgatgacctgaagcaggccggatatcggacgggagaaacactgcccgacaaggtcatgctggcagagaggctctgtctggcactgcctgacccgatcatgagcctgtcagagtatcaatctctgttcatgacgctgcctgaggtgacccgccttcgtatggaacaggcatggggcgcaccggaggatgatccgtccgtcataaacgggcatttccatcttcgggtcatgcagtgcggccatatcctgatggcggtgcagccggatcgtggggagcggttggatcgcaaggccggttaccacgatccggatttaccgccgcgccatgcttatgcggccttctatctgtggctgcgcggccggatggatgtgcatgcgatgatccatctgggcgcgcatggcacgctggaatggctgccgggcaaggccgtggcgctgtcggaggcgtgctatcccgtggcgctgctgcgtgggctgccggtggtctacccgttcattgtcaataatcccggggaggcagcggcggcaaaacggcggctgggcgcggcgctgatcggccatctgacaccacctttgggccgggccggactgcatggagacgcacgcatgcttgagcgattgctcgatgaatatgcggcagctgatggtatggatcgcgcccgtacggctttgctgaagcgggagattctggatcgggccgctgcggcagggctgctggccgaaagcggtgtcagtgccggggaggatgaagagaccgcattggcgcgccttgatgcttttttgtgtgatgtgaaggacatgcagattcgcgacgggctgcatgtgttcgggcggccaccggatgaggcgcgtcgtgctgcgctgttcacctctattgccgatgcggcaggcgggcaggataaggacggtcttgccgtgcggctggatgcctgcgccggagcggagcggcatgctctgctggccgccctggacgggcgcttcatccctcccggtccggccggagcaccgagccggggacgcgccgatgtgctgcccacagggcgcaatctgacggcgattgatccgcgggccgttcccacgcgctccgcctgggtgctggcggagcggaatgcggctgctctgctggaacgccatatgcgggatcatgggctgtctccacgtactctggtgctggatctctggggcagcgccacgatgcgcacgggcggggaagatctggcgcttggactggtgctgatgggggtgcgcccggtctggcatgaaggctcggcacgggtctcgggggtcgagaccgtgccgctggccgtgctggaccgtccacgtgtggatgtgacgctgcgtgtctccggtttgttccgggatgttttcgccgatcagatgacgttgttcgatatggcggttggtctggtggcggcgctggaggagccggagggctggaatcctctggcggaaagcggggaggtgcgtccggtccgtatttatggggcccctccgggcagctatggcgcaggggcgacggctctgaccgaccggagcgcatggcagagccgggatgaactcggcgcggcctatctcgatgcctcttcctattcctatggccagcatgcggcggggctggatcgggatggtctcgccacccgtgtggcgggggccgatatcttcctgcaccagcaggacaatgccgaaaccgatttgctggataccaccgaagttgcggcgcatgagggcggcttcgcggcggcttctgccatgctgggggcttctccgactttatatcatgctgatctgtctaccgccggaactccgcgcatgcggttgttgagtgaggaactggcgcgcgtggtccggggccgtgccgccaatccggtatggctgcgcggcatgatgcggcacggttttcgcggcgccgcggaaattgcgaggggtgtggaagggctgttcgcctttgccgccatgctgccgcagcggctggatgcacagttcgaggcactgcatgccgccattatcgaggacaatcaggtcaatgccttcatggctcaggccaatgaatcggcccatgcggccatgaaagcacgctttgcggaagccatccggcgtgatctgtggcgtccgcgccgcaacagtctggctgctgacagcacggaggctctggagacgtgatgcggcgcggctggtgcccctccctttatcgaccgatggaatcgggagatggcctgttgctccgggtccgggtgccctatgcgcgtctggatgtagccgcggcgcgtgctctggcgcaggctgcccggctttgggggagtggcatcatccagttgacctcgcgggggaatgtgcaactgcgtggcttcaagccggagacggtaaaaccttttgccgatgccatggtggaggctggtctggcctctgccgatccgctgagggaggctgcgcggatcgtcacggtgcccccgctttgtggggaggcgttgcggcatctggcggatgcgatagaggccgctttgctaccgttggctccccgtttgccccccaaatacgggctttgtctggatgaggtgcaggctgcctatccgattgccgccatgccggccgatatacgtctgacatggcgggatgatgccgtcatggtggcgctggatggtggccgcatggccgcgctggtgtcggtcgatgctgtgccggagcgaatcgccgccctgacctcatggttgatgacacagactcacggccgtatgcgcacggctctgggcgggcacgattcgggggaaatactgcgtcgcgctggaatgacggagctcacactcgctccgcttgcgccacccgctcggggggcggggtacgataaagaaaacggcgtgctgtcactccaacctctgttcggacagatggatgcggagacgctggaacggatcgccgccatggctgccggggaaggggatgggctgctttacctttccccgttccgctgcctgctgctggctggaatcacgcgcatggaagctttggaacaggccaccgattccggtttaggcctgattgtctcggccggggatcagcggcgcaccctgctggcctgtccgggcgcgccatcctgtgccgccacgctggcgcgcacgcaggaagatgcgcttcgtctgttcggtgcgctcggcagggcggatatccatgtttccggttgtgccaaaggctgtgcggggcgggggccgcgcagcatcacgctggttggaaccatgcagggctatgatctcattcgggatggcggccctctggataagccggttgcgcgggggctgagcttgcggcaggtgttggccgcgttacagacgaaggccgagccatgacgtcccgctatcattatgagaaagagggcgctgcaatctatgcgcagtctttcgccaccattcgtgccgaggccgatctgtccggctttacgcaggatcaggcgcagatcgtggtgaggatgattcatgccagcggcatggtcgatgtcgcgaaggatgtcgtgtttggcggtgatcttgtccctgtggcgcgtcaggccttgcgggggggagcgcctatcctgtgcgatgccaagatggtggcacagggtgtgacccgctcgcgcctgccagcggagaatgaggtgctttgcctgctggatgcgccgggtattcctgaactggcgcggcggatcggcaatacacgttccgccgcggcgctggatttatgggttgagaagatgggtgggtcggtcgtcgccatcgggaatgcgccgaccgctttgttccggctgctggaattgctggatgcaggggcgccgaagcctgcagcgatcatcggtattccggtgggttttgtgggggccgtggaatccaagcaggcattggcagcgtatcgtttctcctctggagagaagattccttttgtgacggtccatgggcggcgcgggggcagcgccatgacggcagccgcgctcaatgcgctggcgagcgaaatcgaatgattcggctccatgatacggccagtgtggtaaccgggcatgtgggtacactctacaccgttggcatggggccgggcgacccggaactgattacgctcaaagcggcccggttgctgggatgcgtggatgcgattgcctttttcgcgaaacgcggacgcaacggccatgcacgcagcattgccgggccgcatctgcatcctgctattgaggaaatacggctcgactacccctacacgaccgagatcgcactgcgtgatccacgttatgcggaaggcatcacgcaattctatgatgagtctgctaggcgtgttgccaatgttctcgattccgggcgggatgttgcgctgctctgcgagggcgatccgtttttctatggttcttccatgtatctgttcgaccggttgggtggcgtgtatcccacacgggtgattcccggcgtgacgggaatgagcggctgctggacgcaggcaggcgtgccgatgctgcatggggatgacgtgctctctgtgctgcccggcacgctggatatggaaacgctcacggcacggctgcgcagttgcgatgcagcagtgatcatgaaagtaggccgtaacctgccgaaaatccggatggcgctagaacgggcgggcttgtctggacgtgccctctatgtcgagcgcggcacgatggaaggggagcggatttgtgcgctccacgccctgacgcaggaagaggctccgtatttttccatcgttctggtgccgggacggcagggaccgcgttaggaaaacgtcaatggcgggctggatcaggattatcgggctggggccaggcagtgacggactgttgacgcccgatgccctgcgatggctggaactggcgacagatgtcgttggctatcatccttatgtgtcgcgtgtgccggcaaggccgggcctgagccttcatcccagcgataaccgtgaagaactggtccgtgctcgtcatgcgctgagcatggcacaggcgggaagatatgtggcggtggtctccggcggtgatgcgggcgtattcggtatggccagcgcggtgttcgaggcggtggaaagtggcgatccggcctgggccggcctggatatcgaagttgtccccggtatttccgcctgtctcgccgcggcggcacgggccggtgctccgctcgggcatgatttttgcgtcctgtctttgtcggataatctgaagccgtgggatctgctgctgcaccgcctgcgtgcggcggcagaggcagggtttgccatggctctctacaacccggtatccgccgcgcgtccatggcaactggatgaagcgttcgatgtgctgcgggcgttattaccgggcgaggttccggtgatttttgcccgtgccgtcacgcgtcccgatgaaaaactgcttgtgtgccccttgcgggaagcgaaagcggcgttggccgatatgcgtacgctggtgctgatctgcacggaggcaacgcgcctgattgcgaaatcttctgatgagtgctgggtttatgccccacgttcggtcacgcgttcatgatgcagcatctccagccagcgcatggcttcctgcgcggtggtgacgatattggaagggagtgcaatcaccggcctgcgcaccatccagacgggcagaccgagcgcgcgacatgcggcgagttttgcttctgttgcgctgccaccggcgtttttggtcacgatgccgtcaatccgatgagagcgcagcagggcaatttcatcatccgttgcaaacgggccgcgcgccgtcagaaccgtggcctgtggcggcaggtgatgcggctccggcgcatcgacgctgcgaatgacgtagtgatgccaagggcaggcacgaaacggagccagttcctgccgaccaatggtcagaaaaatccggcgtggtctcatgccgagcgcagcggcggcttcttcaagggagtccaccatttgccagcgatcgcccgcaaccggctgccatgccggtctgacgatgccgagaaacggcaaaggccacatcgcgattgcctgagccgcattggtggagatgcgggcggcgaaaggatgggtcgcgtcgatcagcgcatgcattccttcctgttccagcatcgcggccagtccgctggcacccccgaatcctccggtgcggcaggggatcggtggcagaacaggggagcgtgtgcgtccggcgaaggaaagcaggggagcgaaccgctcatcgcctgccagcaagcgtgcgagggcggaggcttcgctggtgccacccagtatcaggcagcgtgtcggatcggatggtgtatgcatcaagagaattcgccgtgagtgcgcccgcaggcaggacagcatggctcggcatactgggcatcggcgagaatggtgtcgaggggttaagtcaacgggccaggcaatggctggtggaggctgatcatgtctatggtggcacccgtcatctgacattggcggcttcgctgatcggggaagccggtattccatggtccagcccgctatcctcttccctgcctgccttgatggagaaacggggacggaaggtggctgtgctggcctcgggggatccgttttcctacgggattggtccatggctaacggatactttgtcgcgggaggaatggttctgtattcccgtgccatcctgcctgtccttggcgcggtcagcgctcggctgggcagaggtggagacggaaacagtctctttatgcggacgtcctctggagacattgtatccgtttcttcagccggacgggcgggttctgattttgtctgcagacgcttcaacaccggcgctggtggccggggagatgacacggctcggctttggttccagcacactctggctgatggaggcgctggggggggaggcggagcgtattcgtcacagtgaagcgaagaccttcagcttttctgatatcatgccgctgaacatgctggcggttgaggtggtcgcagaccagacggcacgtatgcttccattgagtgccggattgccggatgcatgctttgcgcatgacgggcagattaccaagcaggatgtgcgtgcggcgacactggcggcattgtctccacatcggggagaattgctatgggatatcggatgcgggtccggctcgatcgcgattgagtggttgcggcatcatccatccatgcgggcgatcggtatcgaggctgatacggtgcgggcgcagcgtgggcggcagaatgcccatcagcttggcgtgccccgtctgaacatgatcgaagggcatgcgccggaggcattggatggtctgcctgtgccggatgcggttttcattggtggaggctgttccggggttatgatcagccgttgtcaggcagaactgcgcccaggcgggcggctggtggtcaatgccgtgacgctggagacggaggctttgctggccgggatatatcagacccatggcggcagattgacgcggctttcggttgcgacggtgagtgaggtgggacgcctgcatgcgttccgccccgccatgacggtgacgcaatgggcctggcggaagcccctttatgactgagggaaggctgattgtggcagggatcggctgccgccccctctgtgcagcagaggcggtggtcgcgctgctgcatcaggctgcacagagggcccctttcagtatcgtggcgatcccggaattccgcaccggagcagaaggattgatgaaagcgctgacgcgccttgcttatccggtacgggtgatgaccatggcggatttgcagaccgtgcagcatcgctgcgtaacgccctcggcggcggcattacgggcaaccggtctgacctcggtggcggaggcggccgcactggcggcagcgggaccacaggcacaattgatcctgccgcgtatcgcggctgagggcgtgtcctgtgcgctggcggcggcaccggcaatagagggccgacaatagaggatatgacatgacggttcatttcatcggtgcgggaccgggggcggctgatctgatgacagtgcgcgggcgtgatctgatcgctgcctgcccggtctgtctctatgccggatcgatcattcctcccgctttgttgcaacattgtccgcccggagcggagattattgatacggcagcgctcgatctggagggaatcatggcgcattgccgctccgcccatgagcgtgggctggatgttgcgcgtctgcattccggcgatctgtcgatctacagcgcggtggccgagcagcgcaggcgactggaagggatgggtattcccaccagtttcaccccgggcgttcctgcctttgccgctgtatcggcggcgatcgggcgggagctgactttgccggggatagcgcagagcgtggtgctgacccgtgtctctggccgtgcctccgccatgccgtctcgggaaacgctggaagcctttgctgcgacgggagcaacactggcgatccatctggccgtacatgctttgcgggatgtcgtcgcgcggttactgccgttttacggtgcggactgtccggtctgcgtggcggcgcgggcaagctggccggaggaagccctttatcgcggcacgctcgccgacatcgtggcgctggtggaggcgggggcggaggaacgtaccgccctgattctggtcgggccggcagtgggagaaggcgattttcagaacagcgcgctgtatgacaccgattatcgccggcgtttccggggcggacagccgtaacaggctcaactttcctgttcgtggcggcccatcaactggccgttacggctgaagataagcacatccagcatgatcccggtgccttgcaactgacgggccgcggtttcccatgcgcgacatgccatcgtatcgcccagcgggaagccttcacgggcggcgatggcaaatgcttcaggtgtggtgttcgcggcggcaagctgtgcggcgagtgcgggactgccacccatggtgctgaccagactgcccagcgcctccatatccacatgtcctcgccgggagtgcaggtcgagccttccctgtgccagcttggtgattttcgcgatccctcccgcaatggacagacggggcagaggatggcgacgcagatatttcagcataccaccgacgaaatctcccatttcgatcagcgcagtatcgggcagggcgtacaattttttcactgcctgttccgaggcatggcccgtgctgcccgcaatatgacggagaccgctggcacgggccacgtcgatgccgcgatggatgctgtcgatccaggccgagcaggaaaatggcaccacgatcccggtcgttcccaacactgataagccaccgacgatgccgagacgcccgttcaaggtgcgctctgcgagagtactgccgtggtcaatggaaatctcgatactggcggagggtgcgcatcccagcctcgcggcttcctcggtaatggcctgagccatcatctggcggggaaccggattgatggcgggttcgccggggggcagtggcagaccgggtcgggtgatggtgccgacgcccgctccggcgcggaacaccagcccggccttgtcgggcaggctgcgcacggtggcgcggatcatggcgccatgcgtcacatccggatcatctccggcatccttgatcaccccggccatggcggcgatgccatcgggggcttccgtcatgatccgatgatcggccagcgcaaaaagcggccgcgctcctcctggcagggctatttccaccggatcgggaaaatgcccggtatgaagcgccgagaaggccgcacgggctgccgcggtagcgcaggcgccggtggtccatccgcgccggagggaaggggatgaggtcacggcaccgattgtaacgcgaaacagcgccttgcacatcgtcatgacgtgtcagaaggtcggcgcgatgaaaaaggatcaggacgtgcaggacagaccgggccgggagcggctttcatgacggcggtgaaagcactgatggtgtccgctccgaaatcgggctccggcaagacgaccgtaacgctggcccttgctctggccttgcgtcagcgtggggtacgggtgcggatcgcgaagaacggtcccgactatatcgacccggcctttcatgccgaagcggtggggttgccctgctttaatctggatagctgggcgatgccgcctgctgcgctggatgcaatctggacggaactggccgcagagactgacctgatcctgatcgaggcctccatggggttgttcgatggcggcggcagtcagccgggacggatgggggcggcatctgatcttgctgaccgtttcggagtgccggttctgctggtgctggatgtcagcggtcagtcgcaaagtgctgcggcggtggcacggggatttgccacccacgatcccgcggtgcatctggcgggggtgattgccaataacctcgccagtgaccgccatgcagggggcgtggcccatgccatgcagcgtgccgggctgccgctgttgggaaccgtgaggcgcggggcagtgccctccctgcccgagcggcatctggggctggtgcaggcacgggagcatggcacattaccggctctgttcgaggcgctggccaatgttgcggaggcatcgtttgatcttgatgcgatcctgtccgcagccgttccggttgttttgcccccccgagaggattccgcccccctgcttccgcctccgggacagaggatcgcactggcctgggatgatgcgttcagctttgcctacccgcatatgctggccggttggcgcagggaaggggcagagatcgtttgtttctcaccgctggccgatcagcctccttctgaggattgtgatgcggtctggctgcccggcggctacccggagctgcatgccgcacggcttgcgactgcatcccgtttcaggtccggaatgctccgggcggcggagcagggtgcggtgcatggcgagtgtggcggctatatggcgctcggggccggtctggaagatgcggagggcgtcatccatcccatgctctccctgttgtcccatgtcaccagtttccggcaacggcgactcaatcttggatacaggcaggccattctggaggctgcttccgtgctgggggcgcagggagcgatactgcgcgggcatgaattccattatgcgcgggtgatcgaccccggcagcgatgcgcctctggcacgtttgtcagatgcggaagggtgtgcgctcggcctttcaggcggaatacgcgggcgggtcagcggcagcttttttcacgtgctggcccgcgaggccgcctgaccgggccgtgaggggcatccggcaatatatgtttccaccacggcacggtcatcgcccagaatttgcagggcgaacagacgatccgccagtgaatgtccgcccggtgagtggccttgcgtgcggcgggccagcagaggggttgcggcaggatcaagcaccacgaaatcggcctcctgcccttcttccagcgcaccaatcctgtcgcgcaggccgagaatggatgcaccgccagccgtcgccagataaagtgcagtgaaaggatcgagactggttccgcgcaactggccggtctgataggccgcacccatcgtatgcagcagggagaagctcgttcccgctccgatatccgtgccgagaccaatgccgacaccgtgctgttcagcctgttgcagatcgaacaggccggagccgagaaaactgttggatgtcgggcagaaggcaatgccggcctgtgcctcggccagcgcctgaaaggcgcgtgcatcaagttgtacaccatgcgcgaaaacggatcgggccgtcagcaggccgaaccgcgcatacacgtcgagatagtcccgataccctgcctgcggcggaaaccgctctgctacagcggagcattcggccacgctctcggccagatgcgtatgaaacagtgtatcgggataggcaccaagcaaatcggcagcaaggtgcaactgggcatccgtgcaggacaatgcataacgcggcacgatggcgtagccgagccgattgcagccatgccaccgtttgatcaacctgtgcgtgtcatcatgggcggtttcgaccgtatcatgcagatgctccgggccgagatccatcagaactttgccggaaatgatccgcatgttgcgtgtactggcggctgcaaacagggcgtcgactgaggtcgtatgcaccgtggcaaaaaccagtgccgtggtggtgccgttgcgcagaagctcatccagaaaaaattctgccgaggattgtgcgtaggcaggatctgaaaatttcatttcctctggaaaaacatagcggttgagccattccagaagctgcgatccatgggaagcaatgcaccctgtctgcgggtagtgaacatgggtgtcgatgagtcccggaataatgagctttcccggataatgcgtgaccggaacatcagaaaattgttctgcaacgatggcatagggaccacgtgcaatgatgataccgttctcaaacaccagcatgccatcaggatcatgtcggatggcggcattgccatggtgttgggggtgatgaggaacagagatgatctcaccacgaacggcgtgtaaaaatccttgtttcgacatgattttttcgatcatgccgtaaagaagtggctgaatccacgttcccgcagggcgcggcgataggcgatcgagctgcggtctgccatgacatgcgcttcgagcgtcggatcaagcggcaggcattccggtttctgggcttccacgatggctttgtcttcctcaaacacacggcggttgaaatcatagacttcctgaatgggccggtctgtatcgaaattccgtgcaatcggcacgaacagtcgggtgatgcgggccgaaacgggggaggctgcattcatgatcaccaacctgccatgatccgggaaatcaatgctgagtgttgcggtaaaaggcagatgaacgcggaaatgcctgagccatacaaagtcttccggcacaggctgatctgaaccatgcgggtaattgctgagagagctgcggtactcgacttcaaatccatcccgggttgggacgggaatataggaaggtactgtggtattctcgggatcgccgaatgtgccggtatgaacgaagccgaaatgggcgacatccagaaacccttccatctgacgtccggcaaagccgaaaatatcgatccacggacaggtgatctgctggaatccggcatcatcccaatgtggcataggcggaatagaggctgatcccgtttcatcaggccgcagacaggtccagatcagaccatagcgctctgtggctggataggtgcgcagatgcagttttccgggaatggcgctgcccggatgggcgggtaccttgatgcagcgtccttccgcaccgaaccggaatccgtgataggcacaggcgatcgactgtccatccccatgtcccatgctgagaggaacgccgcgatgcgggcagagatcaccagcgatgacgatctgttgcccggcgcggtagatcaccagttcctcatccagcaatcgggcagagagaggctgttcccctacgtcccgcgccagggccaccggataccagaaccgggccagtttctgccagtctgctgcctcaaaggtacagttgcggggcagtgggtcgccaaggggggagctatggggggaggagattgaaggggccggaactgccgtcatgccggttctgtatcctgctgtgctaacggaataactactcggggcatggttgcaaaggttcgcccccggcatcaaacactaaatggagtcttgcaggatgtggtatggttacccctctcctgtgggatggatctgttcaatctggtgtacgtccatgatgattgacagggcattcaaaaggaaagaaccgttgccgcagcaatcgaaaatcctgatcgatgaccttgatgccttcgtttctgatgcacgcgcttttcaggggggagatgctcaggccgagcgggatgtagccatcagaatggccgaactgaccaagccggagggcagtctcgggcggttggaagacgcggtgggatggctggcgcggtggcagggatcttccagaccaaggctggataatgtcgatattctggtttttgccggcaatcacggtgttgtgaatcagggggtgtcaccttacccggctgaggtgacggaacagatggtggcgaattttgccaatggtggcgctgcgatcaatcagctcgcccgggcgggacaggccggattgagggtgattgcgctggatatccatcgaccgacggcagatatcacgcaggcacccgccatggatgagtctgctcttctgaatgcaatgcgcgtgggcgcacaggccgtgaaggcttgtgaccttttgtgtctgggggagatgggaatcggtaacaccactattgctgcgaccctgtctgcgggtttgttcgggggagatggaacagactgggccgggaggggaaccggtcttgatgatgaggggctaagtgtgaaacgcagggtgatcgaccgtgccctgtcgctgcatcgtgatgcttctacgccgttggccgtgatggcggcactgggcggaagagaactggcggcgatactgggggctgtgtggcaggccagacggcttggtattccggtactgctggacggctttgtctgtacttccgcggctgctccgctggccgtgttggccgaaggtgggctggatcatactctggtcgggcatctgtcggccgaaccggggcatcggcgcattctggagcggctggggaaaaaaccattgctcgatctcggcatgaggctgggagaagcctccggtgctgccattgcactgcctgttctgagggccgcgctggcctgttataacggaatggccaccttcgccgaagccagtgtggcaagggcttcagcggctatccgttgatgggctggctgagtgaccgtttccgggagattgcggcggcagccatggtgctgacgcgcttacccatcctgcattttgaacattcttttcccgctatggcatcggcggcatgggcgtttccgctcgtgggggggatgctgggcctgttgatcggttgcttacagatcatgctgatcgacctgtgcgggatgccgccatggcctgccgcggttatctgtgtggcgctgggtgtcatcatgaccggtgccttgcatgaggatggtctggccgattttaccgatgctgcgggtggtcatacgacagaaaaaaagctgatgatcatgcgtgacagccggatcggaagttttggggctgtctcccttatgctgtccttgatgatacggacggcctgtatcgcttcattgcctcctgatggggatgcgatggtagcgatcatctcctcaatggcaatctcgcgcttctgtattctgttgatcccttgtttcatgcattctgcccgcccggaaggatcaggggcgatgatggcagggatcggtcttgtgcagctcgccatggctgcaattccgactgtggtgctggcttctttggcaggcatccatggctggctcgcctttctgacggctttgctgagcacatggctggtcgggcgccatgcacgaaggacgcttggtggcttcacaggggacgtgctgggcgcgacagagcaatgtgctgtctgtgctgcctttctgactatggtctgcggttgaacattggctgaaatgaaaaaggccgggggatgaacgccggcctttctgttttcagtgttgcagcttctccttgcgggagaagaggcttttgagtcgttcacgcaggctctggaacgtcacatacagcatcgggatcatgaagataccgatacagctggcggccagcatgccggccatgacggatgtgccgacatcccggcggctgatggcggcggcaccatgtgcgacgaccagaggcagcagaccgagaatgaaggcgatggatgtcatcatcacggcccggaatcgggttttcgcgccctgcatggcggcttccttgatgctgtcaccgtgttcgcgtctttccttggcgaactcgacaatcagaatgccgttcttggcggcaagagcgatcagcaccaccagcccgatctgagcgtaaatatccagcgagagatgcgcgatcagaataccggcaaaagaaccgagcacgccaacgctaacagacatcagcaccggaaccgggatcatccagctttcataaagtccgaccaggaacagatacgcaaacaacagggccagcccgaggatggcaccggtctgtcccgatgcagccacttcctgataggccgtgccggtccattcgaaatcatatcctggtggcagagtttttctcgatacctctgccatggtgttcagcgcggtaccggaggacacaccgggggcagggccgccattgatggtgatcgaacgatagttgttataccgcgtgatgacctgcggaccgaccacgaagtgtacggtcgcgatggagcgcagtggtacgctttcaccgttcttgttgcggacatagatctgccacagatcctgtacctcattacggttgacggcctcaccttcgatattgacctgccagactcgtccgaacaggttgaaatcgttcacgtaaagtccgcccagggttgcctgtagcgcagtgaacacatcactgattgacaatcccagtgctgttgccttgtcccggtcgatatccaggtacagggacggattggtgctggtgaaggtggtgaaaacacgggagagggccggattctggttggcggcagcgatcagcccccgtgccacactgccgagggaggccggatcctggccttccagaccttccagctgatattcaaacccgcctgttgtcgacaggccgatgatgggcggcaggttcaatggaaaaacgatggcttccctgatctgctgtgccgcgcctgcgatgcggccgataatcgcctgcgccgacatggaaggatcggtacgctgatcaaaatttttcagcttcacaaacatgaagccggcattcggttcctgtgcactgtccagaatggagcggccgatgatctgcactacgtcccggacgccgggaatgggatggatgatatcgttcagtttctccatcacggcggcggttcgattgacggaggctccatccggcaactggacgatgacgaagaagccaccctgatcttcttccggcaggaagccggtaggggtcatgcgggaaatcatgaagatcccgccgccgcacaccccgaccagcaagatcgacaggacggaaatacgcaacagacgcagcacgatggcggcatatccgtcccgcactttgtcgattccgcgcgatatgaagccgagaatgcctcgcttttcaccggtatgacgcagaaacactgcgcagagcgccggtgacagcgtcagcgcattgatcgctgaaatcagcatcgaaatactgatggtgacggcaaactgccggaacaactggccggaaatacccggaataaaggcgaccgggacgaacaccgacagcagcaccagtgtgatggcgatgatgggcgctgtgatctgttccatcgccttgatggtagcatcctgtggtgaaagctccggctcctcttccatcacgcgctcgacattctcgaccaccacaatggcgtcatcgacgacgataccgatcgccaacaccatcgcgagcagcgagaccgtgttagcggaatatcccatggccagcagaccggcgaaggcaccaatcaggctgacaggcaccgccacgctggggatgatggtggcgcgcaggctgccaaggaacagaaacaccaccagcacgaccagcacgaaagcttcggccaatgtgcgcaacacttcgtgaatcgtatcggtcacgaaggtcgtgctgtcatagctgacctgatatttcatgcctggcgggaaacgctccgccagcccggccagtcttttattgacggcctctgccgtgttcaccgcattggcaccgggggacagatagaccgcaacggtgacggatggctttccgttcagacgggtttcgctgtcctcattctgaccgccaagctcgacacgcgccacgtcccgaacccgcaggatcgagccgtcaggattggcacgaacaatgatattgccgaattgctccttggtgatcaggcggccctgagtctggacattgaactgaaactgctgatcaggcccgatcgggcgtgcgccgatgcgtcccaccggggcgacggtgttctgcgactgaatggctgcggcaatgtcggatggagaaagattgaggctggtcaggcggtgaatgtcgaaccacacccgcatggaatacatctgctggctgaacagcatcgcctgccccacgccgggggtgcgactgatcgcatccatgactgaaatctggagatagttggtgatgaacagaggattcttggtgccgtcactgctgtagaagctgatgaactccagaatggcggaggatcgcttctgcaccgtcagcccttgccgctgcacaatttccggcaggcgtgatgtggctgtctgaacacggttgttggtattgaccgtgtcgatatcggggttggtgcccagcgcgaaactgacggtcaggttatagctgccatcattgcccgcggtactcttcatgtagagcatctggtccacaccgacgacctgagcctcgatcggctgggcgacggagctttcgaccacggcggcagaggcacccggataagatgcggtaacctgaacctgtggcggcacgatatcggggaactgggccaccgagatccgcgtgagcgaaattaatcctgcaatcgtggtgacgatcgcgatgacaatcgccagtcgcgggcgtcggacaaatacggctgagatcatcggggcttacccgcgcgccggagggggaggagtggtcgccggattgggggaggccgggccgggtgccactttctggcccggtttcatgacgcgttgcacaccctccacaatcactgtctggccgggtgtcagccctttcagcaccacggcgtttttctgatcagaggcgccgagctcgacattggtgcggatggcctcgttctgggcattgacggtataaacgtaattgccctcctggtcggacagaacggcagcgcgcgggatggtcagggcctcgaccggctggacaccttccatgatgacctgcacgaattcaccatcaatcagctcccgtaccgcatgatcgccgtccttgctgatcatgggattggcaacggtggcgcgcagcaagatcgtatccgtcgtgctgctgatggtgttgtcggtgaagttcaaatcgcctgtctggtcgtagatacgcccatccggcaggcgtagcttgattttgacggctttcaggccgccttttttgtcgtagcggttccgcagctccagcgcctccggcactggcaccgggaacaggatccacatcggatcctgactgacgatggttgccagcgtgccggtattcggtgtgaccacgttaccgatggtcagactggtgcgaccgatcttgcctgcaatcggggcgcggatatccgtataggccagattgatctgggctgaacgcaattgggcctgattggccatgacctgtgcctcatcggccagcacagcggcgcggctgtcatcatagatcgagcgttggcctgccggcgtgttcaacagcgccttggcacggcccatggtcagctgggcattgttcagcgtggcctgcgcctgctgaaccgatgcggctttcgcctgcacatccgcctcgaaaggcggcttttccagcgtataaagcagatccccctttttgacctcggccccttccttgaacagctgctgctcaagaaaggccgtgacgcggggcaccagattaacgcggtcagtggcctgaatacgtccgacaaactcattggtctgggtgtagggaagcttctcggccttaatgaccccaaccggcggcggccctccacctggccgtccctgcgccagcgctgtttgagctgtgccggtcaggagtgcaacagccaggcaggcggccagagaagtcgctttcagaaaacttccccctgcatacgatgggcgcttcaccccatcggagcgatgcgtcgatgcggatgagggagggatatgaacgaagcgatcatgcatggaagtaggatcctgccttgccattgccggtcagcatgtcatctgaccgattggtcaaccaatagtgacgcaggtacggaacggtcaatcgttgatgacaaattatactgttctgtcttggtggcgtcatatttggccttccggccgacatgccgcatgttcatcgctgccatgaccgttcagacgcgctgtttcacactggttttatgttttatctccctcttcatcggagagccaaccttgagggctgcgtccgtggaggagccggtgcgggagcaaagggtatctcccgaaacatgggcgcgtgagcagtcgagactgtgccggaacgcgattgaggaggccgagcgccttttcccggtcaaaaaaggattattgctggccatttcccgggttgaaagcggtcgccctgtccagattgaggccagtagactcgcccagtcactggagccttggccatggaccatcaatgcggatgggcagggctatttttttgacagcaaggctgcggctgtcgcatgggcaaagcaggcgctcgctcagaaacgtgttcaatttatggatatcggatgcatgcaggtggatttgcagatgcatcctgctgccttcaaaaccgtggaggatgcgtttgatcctcacacaaatgtgacctacgctgcccggtttctgacagcactgtatgatggcccggccaatagcgattggggattggcggcgggactctatcattcctcgaccccggcgctggcggctgactatcgcaacagggtggcggctgtaggggcgggagtggtctcgacggtgattgcctttccgccgactttcctgtcggcgaagcgggccgggacactgcatatggcattggcggggggaggatcactggcgatcaatgtccgccgtcaacctgcccgcctccatcgcaggcagagcccctgtgcggtggcgcgtatgctcggcccctacctgccgcgccgcccgcgaggatgctgacggcgcaaacaggaagagtcgctcttcagccctgataggtggtctgtcgttgttcgccgagaccggagacgcccagcgtcatggtctggccggggcgcagatagatcggctccggttttttgcccatgccgacgcccggaggggtgccggtggcaatcagatccccaggatgcagggtgatgaactggctgacatagctgaccagggtccgcacgccgaagatcatggtgcgtgtattgccggtctgcatccgctcaccatccacatcggtccacagatcgaggttttgaggatcgggaatttcgtcctgtgtcaccagccatggaccgaccggtccgaacgtgtcgcagcccttgcccttgtcccaggtgcctgcgcgtttggtctggtattcgcgctcgctgacatcgttgatgatgcagtagccggcgacatgcttcatggcatcttcctcgctgacattccgggcgaggctgccgatgacgatccccaactccacttcccagtccgtgctggtcgagccgggaggaatgcggacatcgtcatagggaccgcagaatgcccccagcgatttcagaaacaggatcggctcgcgcgggattttaccaccggtttcggcggcatggtcggcataattgaggccgatacagataaaattgagcggcaacggcacgcatggtccgattctgggggaaccttcgaccagcggcagggtttccgggtccagacgaccgagtctggccagcccttccggcgacaatacgctgcctgcgaagtcattgacataatgcgagacatcgcgcggacgaccggcagaatccagaatggcaggtttttcttgcccggaagggccaagtctaagcaatttcatatcataatctcccctcattttcggcatatcatttcgcaatggcagagggaagccgtgaaaatgcatgaggctgatgcatctgactgatacatggcctgtgtggatgggtggttgagccggtcgggaatgccctccatcctgcacggcatcgcgccttttttgctgttgatgcccattccggatgaaagacacagacatcatgtccgcagatgccagctccgcaccgtcttccacccttgcttcggtgccggtccggctgagtgattacacgccgcccgcctacggggtagaacaggtcgatctggtgttccgtctggatcccgcccgaaccgtggtgcaatcgcggctgcatgtgatccgccagcccggtacgccggaaggggccgttttccacctggacggcgaggcgctggaactgctgtccctccgcatcgatggcagggaggtcggcgcagaagaatatcacctcacccggcatgggctggacatatccggcctgcctgccgaaagcgtgctggagatcgataccgccattgcaccggagcagaataccgaactcagcggactgtatgtctcacagggagcgttcttcacgcagtgcgaggcggaaggcttccggcggatcacctatttcccggatcgcccggatgtcatggcacgctataccaccaccatcgtcgcgccgcgtacggtgccggtgttgttgtcaaacggcaatccggttgatgcgggggaggctgaaggcggactgcactgggcgaagtgggaggatccgcacccgaagccctgttatctgtttgcgctggtggctggtgatctggctgccgtacgggacagtttcgtcacacgctcaggccggagagttgctctggcaatatgggtgagggagggggatcaggaccgctgtgcccatgcgatggacagcctgaaacgttcgatgcgctgggacgaggacgtgtttggcctcgaatatgaccttgatgtcttcaatatcgccgccgtcagcgatttcaatatgggggcgatggagaataaggggctgaatgtcttcaataccaaatatgtgctggcccgccccgatactgcgacggacagcgattatcagggtatcgagaccgtcatcgcccatgagtatttccataactggacaggcaatcgggtgacctgccgggactggtttcagctgaccctgaaggaggggctgacggttttccgggatcaggaattcagcgccgatatgggcagccgggcggtcaagcgcatctccgatgtgcgcaccttgcgggcagcgcaattccgggaggatgccgggccgctggctcatccggtgcgccctgaaacttatataaagatcgataatttctatacggcgactgtttatcagaaaggggccgagcttgtccgcatgatccgcaccctgatcgggcgggagaaattccggcaggggatggatctgtatttccagcgccacgacaaccatgccgtgacgctggaggatttcgctgctgccatgcaggatgcctccgggattgatttgtccctgttccggcgctggtacgggcaggcgggtacgccggtcctgcggatcacggatgagtatgatgcctcggcgcatcgttatgtactgcacgtgacccagtatacgccgccaacaccggggcaggaggaaaagcagcctttgctgattcccattgcggtcgggttgctggatgaaaccggcgcggccctgtcattccggttggagggggaggaaaaagcccattccgacacaagaattctccgtctggaacaggaaacacagagcttcgtattccatgatgttgcacgggcaccgcagccttccctgctgcgggatttctctgcaccggtaaaattggccgatacgcctgcggacaggctgcgttttctcgcggcctatgattccgatccgtttgtgcgctgggattccgggcagcaatacgccacgcagaaactgttgcagcaggtagcggcttcccgggatggcgcggctccatcgctggatgagggtattatggagagtgtggctgcctccatcgcccgtgcgccggaagacccggcattggcggcggaggcgatggcactgccggcggaaaccacattggcggatgcgatggaggtggtggatgtcgaaggtattcatgccgtgcgccgtaccgcgcgcgctgcgatcggccagcatctgcgggccgcgttacgggcaggatatgaggcatggagcacgggcgatgtgaccgcgctagatggcagggcaatgggcggccgggctttccgcaatgcctgtctcggctatctggccgcagccgatgatgggaaagccggtgagggtgtgacactggcctggaaacagtttcaggccaatcgctgcatgacggatgtactggctgccttgtcggtgctggcggataccgacgtgccggagcgggagcaagcgctggtgctgttctatgatcgctggcggggggatgcgttggtgctggataaatggtttgccatccaggccatgtcctctcgtccggacgcactggagcaggtgaggcggttgatcagtcatcctgagttcgactggcgtaacccgaaccgggtgcgggcggtgctgaccagttttgcgtccggtaatcaggtccgcttccatgatgcgtcgggggcaggctatgcgtttctggcggacgcgattctgcatctggatggcattaacggccagatcgcggcccggatgacggcgcctctgggggcatggcggcggcaggatcaggcccgtgcggagatgatgcaggcccagttgcggcgcattgcagccaggccgaacctgtccgggaatgtaagggagatcgttgatcgtagtcttcgctgacgcgcagtcaggttacaaattcgtatcaaacatatctatacgtattgatatattgataatgttggagtagggaatggttctgccgcagcggtcatcaaaattactccctgcggtcacatcaataatgatcgaggaatgaacccatgagcgccaccacccttaaatgtgcctgccccgattgtgtgtgcgaagtcgagcagggcaagggcatccagcgtgatggccagacctattgcgatgaagcctgtgcgtctcaccacaaggacggttctggctgccaccatgcgggttgtgcctgccacggctgattgaccacagattgatcaataaacgggcggcgttgtgcagggcatgacgccgcccgtttgtaatggggtaacacgctttagtgtcgttgtttctctattccccgtgtggcctcttgccggatcatcaggggggccgtacaccgcatgatcattgaatgatcatgggcaacgggcggtttctgttttggattggtttacacatatcgatcccgcttatgcgctttccggtcttggagtgggttgccttgtcggcatgaccggcgttggtggcggctccctgatgacacctttgctggttctggtgttgggagtgcatccgcaaacggcgattgggaccgatcttttatttgccgctattacgaaatcggttggcacgtcggttcacgggttctcccgtaatatcgactgggctgttgtaaggcgtctggcatccggcagcatcccggcttctgcgttgacgctgctatggctgcatggccatggtgggctggagcctgaaatatcccgtatcatgggaaatattctgggtggagcattattgctgaccgcaggcagcctctttttccgtccctggctgcacaggattgccggggccagaagaaagcctctgtcaccagcgcgcgtgtccagtctgaccgtgttgttcggcatatgccttggtgtgctggtgtcgctctcctccgtcggggccggtgccattggcgtgacggtgctgattgccctgtatcctgaactgtctatggcacggattgtcggatccgatgttgcccatgcagttccactgacgatgattgcgggcttgggacattggatgctgggatcagtgaacggaatactacttctatccctgctggccggctcactgccgggagtgatcgttggcagcttactgtcaccccgtatgcctgcagatattttgcgtgccctgttaggcagcatactgacgatcgtcggcctgcgcctcctgttctagcaggccggtcacaagccaatttttatcgggccgtgatcacaaaggatgatggaggaggtgagggaggaggcgattcggtttcctgcaggatttcaatcagcgcctcttcccagaattcctcgtttcgcccgtgaggacggcctgccttttcccatagaaggtacgcacgaacgcgtaccctttcatcctgccgggtaattgatccagccatggctaatcctcatgcgtagcaaccgtcgatggttcattccattctgacattcccaacgctcaagatagccagtggctgcatacaatctccattaaaaaaatgcaggcggccttcacatcctcttgctggaagcctttcttaggagagggcggcttcaccatccagggtagcggcaacggcatgcacagtggcggcaatacggattgctgcctgcacctgttcctgcgttaaaccgttctggcgcacgattttctcgtggctttccatgcacatgccgcatccgttgatggcagagacggccagagaccacagctcgaaatcgaccttgtcgacaccgggcttggccataacgttcatccgcaaccgggcaggcaggtttgcgtaatcaccacccaccagatgcacgaagcggtaatagacattgttcatgcccataatggcagcggccgccttggcagcggcaagggcttcggcactgagttgcggcccgaattcggccaggatggcgctggtcacgaggttgctgcgggaggcgagggcggaggcgatgaaagtgcctgctttctgctgctgattcagcacgtcttcattggccagcgagccgagattcagcttcagatccttggcgtattcgggcagtgcgtttttcagattttcgatggacatggtgtttgttcctgtcatgaaggggcaccagacgcagaaacggcccggcagggccgggccgctgctggagcaccggccttcatccctgccggaagcgttagatgaaggaggtgcagttctgggggctggttcagccgaccttgatgaactcgtcgcctttggaccagttgcacgggcaaagctcatcgctctgcaacgcatcaaggacgcgcagtacttccgccggattgcggccgacggacaggtcggtcacataggcaaagcggatgatgttctgcggatctacaatgaaggtcgcacgttgtgccacgccttccgcctgatccagaatgccgagggcttccgacagctcacgccggatgtcggagaccatggggatctgcagctcacgcagatcatcgtggtgcaggcgccagttgacatgaacgaactcattgtcggtggagacgccatacagcacggcgtcacgatcggcgaaatcgctgttcagcttggcgaaagcaacgatctcggtcgggcagacaaaggtaaaatccttcggccagaagaaaacgaccttccatttgccttcggcactgttctccgtcacctcgaagaacggatccttcagatccagaccttccttacccggcttgacggcggtcagcttgaaagacggaaatttatcgcccactgagagcatgcagaatatccttcatacgaagtcgttatgacaggcacgtcgcgcccctatataaggcgacgttgctgcgggagtaaggccacagcgataacgttgcacaaaaggggcgttttgatgctgcactgcacgataagcggccccggaatttcacgccaatgaataattcctgaatttttgatcgaatgaaacgatgacgcctctgcccactccccaacagctccggtatctgatggcattggccgaataccagcatttcggtcgggcggctcaggcttgtgcggtcacgcaatccactttgtcggctggtattctggcgctggagcggcagctggatgtgcagattctcgaccgtgtgggcgggaaacgtgtgatttttacggcgctgggacgggatctggtggagcgtgcccgggatgccatgcatgcgctggaagcgatgtcggaggcagcttccgccgcccgggcaccgatgagtggaccgctgagggtgggggtgattccaacgatcgggccgtttctgctgccgcgtttgatgccggccctgcggcgggaatatcccaatctcaggctctatctgagggaagataccactgaccgtcttatggcgaggctgcgggatggacggctggacctgctgttgctggcgatgccctgcgactgccggggaatggatacggtagtgatcgggagggattcgtttctggttgccctgccacaggggcacaggctggcggagcgggaggttattcctatcgaagccctcagcatggagaatttattgctgctggaagacggacattgcctgcgtgagcacgcgctggccgtctgcggactgctgatggcgtatgagaaaaatgccagtgaggaggaaagtgcccataaggaggaaagtgaggctggccctgtcaggaatgtcgcaacacgcagccgcgatatgcagaccggagatgggctggctgaccagtttgcagcgaccagcctgcatacgctggtgcagatggtggcaggcgggcttggcatcacattgctcccgcaaatcgcggtggatgccggggtgatggcgggtacgtcgctggtgctgcgaccgcttgaaggggatggcgcatggcgggaactggggcttgcctggcggcataatgcaccgcgcggtgccgattatctcggtatggcatcgctgctgcgggaggcggcggggttttgagtctgcagcaggctttgatcgccctgcggtcgggacaggccgctctatgcgaaaccatctgtcgccgcatactggccaacaggacggcccctgctgatcaggcccgtctattgctggggctggctctggcagtacgggaggaaaaagctgaatcgctggcgcttctgttgagcgtggcccgcactcatccacgggcggcgcatccctttcgtgatcttgccggattgatgcatggccgtgacgacgccatggaggcactgctgatcgccggaggggagcatgcgccggaggatgcaaaccttgccatttttcacgcggaatggctggaactgcgaggtcgtaagcaggcggctgaagcccgtctggtgcagtttctgacacaggagaccatcaaagaaccagccggagaagctgccatcctgcgtgcttatgccctgctgctggcagggcgtaacgctctgccggcagcaggggaggcgatgaagcgtgccaccagtctggagccgaaccatgccgccggatggaccaatctggcgaatattctgacagcgctgaaagactttccggctgctcagcaggctcatgaccgggcggccgcctgtgcccccaacgatccacgcatgcggatgaaccgggctttgaccctgttgaaagcaggccgttatgcggagggatgggcagattacgaagcccggctggcaatcggagatcgcctcatgtttccggtttcttctctgctgcggaaagaagaatgccgatccgggctgaatggtgtgcgcatcctggtcgtttctgagcagggttttggcgataccatccagtttctccgctatattcctctccttgcggcccgtggcgcacgggtgcggctgtttgtacctcctgaactggtgactgtggcggagacagtggcgggggtggaaagcgtggcgggtatggatggcattgcgcccgcttttgaccgtcatgtgccgatgatgagtttgccttatctgctggatgccgcttttgttccgatgcacgaaccatatcttgcggtttcggaatcgcgtgtccggcactggcaaacgctgctccctccccggccggcgcgtgggcggatcggtctggtctgggccggggcctcacgcaatcatcctgatgcaaccgccattgatcgacgtcgcagcatgtctttgcaggatatggcattgctggcagacattccggatatggttttcgtcaatctacagatggggcctccatctattcaggcgcaggagaagcacgcctttcgctttgctcccgacatgactggtcagatcagggattttgctgacagtgctgctattctgagtatgcttgatgcactggtgactgtggatacatccattgctcatcttgcaggtgcattgggggtgccggtgctgatgcttgatcggatggatcattgctggcgctggtcggacccctgtgaactgatgcccgccgagacggatactgaaaccggcgggttgaaaacgcgatggtatccgtcaatgcagctgttccgccaaaccaccccaatggactggcaggagcctgtcaggtgcctgcacaacacattgcgcgtgttatcgctgcaataatccttataaaatcgttatttattttttcactgatgctggcaaagcagaaaagctttgactagaagcgaaaagcgattctcgatcactataagcatgatcggcctcggggggcgttttgccaacgcttgcgacaaataaggggattttgatgtctaaggcttttattgcccaggttattcaggacagcgccgagctgactggggtggcggcaaaccgcacggcgaacgatcttatcacggcgatcgtgaaggaaatgaagaagaacggcaagtttacactaccgagcttcggcacctttactgtcagaaagaccaaggcgcgcaagggtttgaatccgcggacaggggagcagatcaaggtcaaggctggaaagacagttcgtttcaaggcctctccgaatctgaaaaaatctgtctgactgaagcaaaacggccgctgagacagcggccgtttttgttatatagtctggtgttgtgcttttttgttctgaggcctcaaatatccagatcgcctgcgcggggggcgttgtcctgaataaattgaaaccgcagctctggtttcttgcccatcaggctttccaccagttcccccgtccgtacccgatcttccggtggcgtcagaactttcagcagaacccggcgtgcgggatccatggtcgtgtccttcagaatggccggaggcatttcgccgagacccttgaagcggctgacttcgatttttccggttttcttgaagccggatttcatgagcctgtcgagttccgcatcatccattgcatagcgggaagtggcgccttgcgtcagacggtatagtggcggctgtgccagatagaggtgtccacgacggaccagttccggcaattcccggtagaaaaatgtcatcagcaggctggcgatatgcgcgccatcgacatccgcatccgtcatgatgatcacgcggccatagcggagcctcgcaatgtcaaaccgttccccgaccccacagccaagtgcctcgatcagatccttaagttcctgattctgtcgtaacttgtcggcagatgcgctggcgacgttgagaattttgccgcgcagaggcagcacagcctggttttcgcggcgccgcgcctgcttggctgatccacctgcgctgtcaccctcgaccagaaacagttcggtttcggcggcattttcgctggaacaatcggccagtttgccgggcagacgcagccgtcttgtagctgatttgcgaggcgtatctttctgttcacgtcggcggattcgctcttctgcccgttcgatgacgtaagcaagaagattatccgcaccggccggatcgcctgccatgaaatgatcgaagcggtcccgcatcgcggattcaaccagtcgtaccgcttccgggctggtcagtttttccttggtctggccctgaaactgtggctcccggacaaaggctgacagcttggccgccagagatcccataatatcttccgcggtaatggcggctgcgcgtttattgccgcgctgttctccccatgcacgtaatcctttcagcagtgccgcgcgaaatccctgctcatgggtgccgccaagcggggtcggaaccgtgttgcagtaggagtgaacaaagccatctgcgccatccagccaggccagcgcccattcgacccgcccgccggtctgggtttccttttggccgtctcccttcatatccgcttcaccggaccagatctgggggatggcgagggtggtctcgccaatatcatcagcgagactgtcacggaggccaccgggaaaatgcagggtcgcttcggcgggaatgtcttccttgccgctgtttttcagcagggatggatcgcacttccagcggatttgcacaccgcggaacagataggctttggagcgacacagcctgtaaagccgcgcgggtgagaagttgaggcgtccgaaaatctcttcgtccggggtaaagcgaatttgcgttcccctacggtttggggcggcgccgacctcgatcaacggcgtcatcggcttgccgcgtgcatagctttgccgccacagcacccggttacgggcgacctcgacttccatcgttgccgacagcgcattgactacggaactgccgaccccatgcaggccgccggaggtagcatatgccttgccggcgaattttccgccggagtgcaaggtcgtcagaatgacttccagagcactgagatttttgaatttcggatgcggatcgatcggaataccacgcccgttatcccggatggtgacggtgttgccgggatcgagcgtcagatcaatgaccgtggcatgtcctgctacggcttcgtccatcgcgttatccagaatttcggcaacaaggtggtgcagggcattttcatccgtgccaccgatatacatgccgggacggcgacgaactggctcaagaccctccagaacttcgatatccttggcggagtaatcatcctcgttcatctccgtccgctgctttgcaccgcgttgagatggagggggggatttcgcgccgccaaaaagatcgttcatggtgtgttcccgtgccgctgccccatgtcgtttaacggtccggggcaggtggggcaagcgtggtgcggtcatcaataacgccggggacgtttccacccccggcgttatgatcaggccgaaactgccttcagcgtcgactcgggatccgatcagaagccgtttggctcctgaatatgggcttccaggaaccacagagacttgtcgaaggcgcgcgatgcctcggtaaacaggtcggaggtgccggcatcaccggcttcatcggtatcgtcgatattcttgcggaccgcattggccaacagaccgaaccgttccaccagcgcgaccacgtggtctttgatcgtatagatatccgttggatagggcggcagggaggttgcggcgctgactgtctgaagggtgccaaaggcggtgccgccgagggctgcgacgcgttcagcgaatttgtctaccagatcatccacctgggtacgcagggtatcaagcagttcatgtacgccgatgaattgcgggcctttgatgttccaatgagcctgtttcaggatcagcgcggtatcaatggcatccgccagacgagcgttcagcagctcaatggagactttgcgcgcattggactgaaggtcgacgtgatttttgtgagttggggcggcgtggcttttcgccttcgtgatgttggaatccggcatgcctctctcctcaatgcttggtgcgggttacggccttccgtgctggaaggcgttttgtgcccaacgcgagggacaggataagcgtttccctttggtttcgacattcccgccctgcgtaaggctcctatgagaataaaggcataggaatacgggcgtctgctccgctgttctgacacccaggacgatgatggtgcgttgacagggcgggcatgccctgagcatggtccggcccggaacatgactgaatgacaagccggggagacgggaatgagcatcgacagcctgcgggacagtattgatcgtctttgggaaaaccgggagggtctgtcctccgccacgacaggtgaggcacgggacgcggttgaagaagctctgcgtttgctcgattccggccaggtgcgcgtcgcggaaccgaaggcagagggtggctggtcggtcaatcagtggctgaagaaggcggtactgttgtctttccgtctgaccgattctaccccggctccgggattcggtccggtggcctcctatgacaaggtgccgctgaagttcgaaggctgggatcaggctcgcttcgctcagggcggcttccgcgtcgtccctggcgcagtcgtgcgccgcagtgcgtatatcgcaccgggcgtcgtgctgatgccgagctttgtgaatgtcggcgcctatgtcgacagcggcacgatgatcgatacctgggcaacggtcggaagctgcgcccaggtgggtaaaaactgccatatcagcggtggcaccggtatcggcggcgtgctggagcctttgcaggccggtccggtggtgatcgaggacaacgtgttcatcggtgcacgctccgaggttgcggaaggcgtggttgtggagcagggcagcgtgatttcaatgggcgtgtttatcggcgcgtccaccaagatcatcgaccgtgcgaccggtgaggtgctgtatggccgtgttccggcctattccgtggttgttcccggctccctccctggcaagccgctgccggatggcacgcccggtccttctctggcctgtgcggtgatcgtgaagcgggtggatgagcggacccgttccaagacctcgatcaacgagctgctgcgcgcctgatacgtggttgttaaaggcgcttccggtcccgttgcgtctctctcgtaatgggaccggatgtggctttgtcatcatgtccaaagaagacgaagagagaggatgaagaaggataaccctgtgcccgctcctttgtccgatcctctgatgtctgatcctttggcgttggcgcaggcgctgctgcgttgtccttccgtcacgccgcttgatgcaggggcgcagtccgtgctggcagaggctctgacggcgcagggctttacggttacccagttgccattcggggatatcgccaatttctatgccaaacgggtcggcccacggtccggcccgcatctctgctttgccgggcatacggatgttgtgccgcccggtgatgcaccatggagcgtggatgccttcgccggtgaggtgcatgacggtgttctgatcggtcgtggcgcctgcgacatgaaaggtgcgatcgccagttttgtcgccgcttgcgctgcccgcccggatcatcccggcacgatcagcctgctgatcaccggggatgaggagggggttgccaccgatggcaccgtgcgtgtgctcgactggatgcggcaggccggagaaatcccggatttctgtgtggtgggggagccgaccaacccgggccgtcttggtgaggtcatcaagatcggccggcgcggcagtctgaatgccacgctgactgtgcgcggacggcagggtcatgtcgcctatccgcatcgggccgataatccgctgccccgtctggtggcggcactgcacgccctgaccaccacgcggctggatgacggcatggaggggtttgagccttcttcattgcaactgacgacggtggatgtcggtaatccggccaccaatgtcattccggagcaggcccaggcacgattaaatatccgcttcaatccgttgcatcgcggtgatgatctggcgagatggctgcgcggaatcgtgcaggatcatgcgccggatgcggtgatcgatatcgccatttccggtgaggctttcgtcacggacccagatcgtgatccccgcccaggcgccagccatggtatcgcggcgttacggatggcgattcagcgaatcaccggcctgtcgccccggctggatacggggggggggacatcggatgcgcggttcattactcatctgtgccctgtcgtggagttcggtctggtcggggccaccatgcatcagcgggatgaggcggttgcggtgcgggatctgcaggacctgaccggaatttatgaggccctgctggatttctatctcggaaaggacagcgcatgaacggcccgaaccgtttcaggcaaggtgacgcaccctccggagagtcgcgtcagcgtatcgtgctgcgtggtctggtgcgattggcgcgttttgaccggcgtggcttaagtgatttcggatcggggatcgaagccctgctcggtgctctggctcccgtcatcggctgcgctctggcggtatccctgctgctggtgttcaatcacgccagtcgggcaggacttgcctatatgctgcaaagcattgttctgctgctgacccctctgctggtgtcggacattctggcgcatttctggaacaggcggcaggaatgggggctgtatgcaaccgtgctgatctggagccagtggatcgcattattcgcgggcatgcttctgttgctcgcggcgcaggtgatggtcagtgccggattgcagcaggaagatgccgtggctgtgctggtggtgctgctggccgtttacggtatcgccctgcaatgttttctggcgcgggtgagcctgaatatctccgcgctccgtatcatcgtcctgatcgtgctgaccaatctgggaactgcggtgctggcgttcggtccggcgcagctggcccgcatgctgcaccctccgcattccacacctgctcatgcggagaaagcagggtgagcggctggaattgtctgcttcccgcccggatagcatgcgacatggcagtagggcatgctcctgacaagattaccggtccggtccgtcgggcggaactgttggtcagttttgcggtgttaccgctttgtctgatcattggtggattgctcagactgtatgatctgaggtcaggagccgtcacgcttccgccgggcatttcgacagggcatatgctggcggtgcatgcgctgctgctgacgctggcgtggctgggttatctggccctgtcctacgaactggcaggcgtggcggagcggcgggcacaatggccgcgtttcgttatggtcatcaactgggtgtttctgatccagtatgtcatgacagccatcagctatgtgccgcagcttctgcacggtccgtctttgctcatacagttggctcagctctgcttcagtggctgggcgctttggattgaatggttcgcgacccgcaatactctggccctgtcaggactggccgccgccgggcttgtggcgctggatacgatgctgtctctcggccttgtggctatggcgcccggctgatttacagaaacggatcctgttcataaatcactccggtcagggccagcccgtccggtggtgcggttggtccggctttggcgcggtcgcgggcggcgagcgcggcggcaacatgctctgctgtccagcgtccatcgccgaccagtttcagcgttcccaccatgttgcgtacctgatgatgcagaaagctgcgggcttctgcgatgattgtgatgagatcaccatcccggcgcacatccagccggtcgagagtgcgcagcggacttttggcctgacaggctgcggcacggaacgaggtgaaatcgtgacgccccagcagatgcttggctgctccatccatggtatcggcatccaacggctgggccacatgccagacgcgcccttccatcagggcaggccgcgcacgacggttgagaatcaaataacgataggaccggccaatcgctgaaaaacgggcattccagccgtccggtgcgtaagcagcctccagaatcgccaccggataaggcttcatgtggaagttcagagcttcccgcacgcgctcagggtggaaggcggtgggaaggtcgatctgtgcaacctgagcctgcgcatgcacccccgcatcggtgcggcccgccacaatactggaaacggcctccccccgcgccagtctggcagcggcctgttccagcacccattgcacggaaacagcccgcccctgagccgttgcgctgtcatccgtaccctgtcgctgccagccgataaagggggtgccgtcatactcgatccgcagcgcgtaacgggtccagccgggttgggggtcaggaaaacccatgctcatccagcctggtgcctgccggcagcttatggccccgcaggaacgcggcggcatccagtgccgggcggcccggtttctgcaccttgtccaggcaaagtgcaccatccccacaagcaatcaacagggtgtcatctccgatgccgatcacggtgccgggtataccggatgcctctgttactgcatgggccgcgagaatcttgaggctgccactgaatgttcccggccaaggattgagcgcccgcacgcgccttgccagcagggcggcaggctgggaccagtccagcaagccatcagcgcggctcagcttgggggcatagcaggcaagagcgtcatcctgattctcgccgtccggctgggtctccagcacatgcaggattgcttcggctcccgctgttgcaagggcatcatgcagctctggcgtggttgtggtttcagtgatcggtacggcacgcttcagcagcatcgggccggtatcgagaccttcttccatgcgcatgatggtaacgccgctttcggtgtcgcccgcgagaatagcgttctgtatcggggaagcgccacgccagcggggcagcaggctggcatgaatgttcaggcagccgcgctgcggcgtatccagcatcacccgcggcaggattaaaccataggctgctaccacggcagcgtcgaggttcagcgcccggaaagcctcatgctcatcagctgcgtttttcagcagggccgggtggcggacttccagcccgagcgcctccgccgcgcgatgaaccgggcagggggtcaaacggtggccccgccctgccggacgggggggctgggtatagacggcggcaatatggtgtccggcctgatgcagggcatgcaatgcggggaccgagaaatccggactgcccataaaggcgagggtcaggcgttccgccatggcgccggctcagcccccgctgttctggcgctgctccttggcaaggcggcgcattagcatgttgcgtttcagggtggagagatgatccacgaacaggatgccgtccagatggtcgatttcatgctggatgcaggtggcgaggaggtcgtcagcctccatttctcgtctgctgccatccagatcctcatagcgcagcttgatccgcgccgggcgggtgacatccgcatactggttgggcagggacaggcatccttcttcacgggtggccatttcctcgctgcgggcaatgatgtccggattaatcagcaccaggggtgctttctgatcatccggggacacatccaccactgccagccgtaacagactatcaatctgcggtgctgcaaggccgatgccgggagctttgtacatcgtcgcgaacatgcgtggcaccagatcacgtatgagcgaggcgtctccggccgtgacgggacgggcgcgtgttttcagcgtcttgtgcggggcaataaggatgggcagcagctctgccgtgcgggtctctgacatgaagatgatgtagcgatgccatgcccctctcggcaagcttggtcctgctggtaagccttggaaaaaagttgcctcttgcaagacggcctcatcctgccgacatactatcagcgggcagtgccgcaatgggctgcttttaatgcttcgctcacttcagaggaggccggtgtgtcaacccgactgtttacttcccccatgtttctggggttcgatcatctggaacaaatgctggaacgtgcgtccaaaaacacgtcagacggctatccaccttataatatcgagcagttcagccagtcagaactccgcatcactcttgcagtggccgggttcagcatggacgagttgcagattacccaggaagataatcagcttgttattcgcggacgtcaggctgatgacagtcagggccgggtttttcttcatcgcggcatcgcggccagacagttccagcgtgccttcgtcctcgccgagggaattgagattaaaggcgcgtggatggataacgggttgctgcatattgacattgcgagacctcagccggagacaaaaatccgcaccattcctatccgtagtcccagtgcacccgtcgcccctattgtcgagcgtatttcgaacggacaataaaggtgatccggaatgatcttgaaaaccagctattttattcactgtacagttggttgaaaaatgattccgtgcaaaatgtctttaaatcggattgactgatctgtctgctgtgttggcagaatattcaggagcattcaaatggctcatcccagttttcgtcccagccgcgatattccggcagattccatgatgtcggacgccactggcatgttcgatattcgccgtatttcacccaaggaattcgccatgcttggcgtttcccaggttgcctatatcaagcctgttattgtcgatggaaattctctctttgcgatccatgcggcggatggaaccgccatggcactggcagatgaatgcgcggccgctgttgaagccattcaggatcacgatatggtgccggcttacattcattgaccatactccatcggattgatttgcaatccgatttcaaaaaaaagggcgctcctgcaagggcgccctttttcacgcatgcacatggtgctgtggatttgatctggtgcgttgatgaaaaaagccccgcgccagacgcggggcatcttcatgagtgtaggaaataatatcttcagcccaggctgctgcccgactgcgtatcaatccagccgacatgcccatccgtacgtcggtagacaacgttgagagtaccagtggcgctgttacggaacatcataaccggctgatccgcaaggtccatatgcattacggcatcccgtaccgaaaggatattgatgtcggtgggggcctcagccaccactgtggcgtaggtttctgaaagagcgtcatcatgcttggccagagcttctggaacagtgctctcgtcttcctcgcgcagaatatattcacgcgccagctcgggttttttgcgatgagtcatatcccgcgcatgtgcgttcatacggcggcgataacggcgcaggcgtttggcaatatgttcggcggcatcatcgaaagcaccatttgcgtcagcggcttcgccttcgccacgcaggatcaagcctcgtcctgcatgcagattgatatcacagatgaaaaaactgcgcaggcgactgaaggtgacctgagcctccagtgcctgatcgaagtattttcggctgatggtatcgagctgactggcaacgcgctcctgcagggcgtcggatagatcgatctgcttgccggaaaccgtaatatgcatgtttctaacctcgatcagccagtgtctccagttccgtctccggaattggcgagctctggccaatgggctggcgaaaccgtggtcggttgtgttccgcctcaagaaatagcaatcaacccaatcaggccagtatcgctttctcccttttgcgctgcaccgaactggggatgcgcagcgcttcccggtatttggccactgttctgcgggcgatgtctataccctcctgtttcaaatgtgtgaccagggcgtcatcggagagaacatcgctggccggctcctgatcgatcagcgttctgatccggtggcgaatggcttccgcactgaaattctccccgtctgcgccgctgatggcggtggtaaagaaatatttcaattccagtgttccacgaggggtggcgatgtatttattcgcggtgacacggctgatggtgctttcatgcatgtccaccgcctctgcaatatcgcgcaggatcaggggcttgagatgactgacgccatggcggaaaaaagcttgctgctgtcggacgatctccgccgatacgcgcagaatggtctgcgacctttgttgcagagatttcaccagccagtgagccgtatttaatttttccttgataaaggagcgatcatcccggctcatcgaccggcgtgcgaatctggtaaggccgcccatattcaccagcacgcggggcatggtttccggattcagctcaatcagccattcgccggcaatcgccacatcaagcagcagcggggaggagagcggatcgtcatcttcgttgtgggcagtggcagggcggcgggacattagcacgtccgggatgatggtctgtggcagatcggagtcgaaaccagcacccggtttggggttacaacgcttgatatcgtcgatcatgcctgccagatcttccgcatctaccccgcacaggctcatcaatcgcctgtgattccgctgggccagcagatcgagatgctccagcagaatggccatggcagggtcatagcggttgaaggcctgcaattgtgttgtcagacattctttcagatccagacagaacagtcccggcggatcgaaatagcgcatcgccgtgcgaatgttttccagatgaggcagtgggcagttcagggccttggcaatcgcggcagggggcatggtcagtcggcccgccgcatcaagctgggctatcagatgggcaccgatcagacggtcctgtgggcttgcaaaacacaggcgtagttgttcggccagttgctccctcaggcttggccggtattcaagccgctggctgatgacgtcgaacgggctattatcgaaagaattcgcgtggttgccggttggctggctggaaagaaaagacgcggtttctcccggttcatcgtagagggagccgggatcgacatccaaggggccggcctctgatatcatgtggtctgaactggcggcgtcggcactatcgagaaaatccggttccggtccggtctgatcaggggctggtcgttcctgtatcagttccgtgctttcatcgcgctccagcaagggattgcgctccagctcctcctcgataaaagcggctacttccatattgttgaactggagcagcttgatggcttgacgcagctggggcgtcatcaccagcgattgggactggcgaaggtcaagccgagggccgatgcccgtaccgtaagctgagccaagcgccatgcggcgaatgccttttcccgaacagaacgatatcaaaatatcgcaagattgtccgggttgccaaggagatggcctgagatttgcattggaggcggcgaaaatgtcaccgtgccaaaaaggatctgttccggggtgaaggcgtgatcagatcagagagagaaactttcacccagatagacgcggcggacgccttcatgctgcaccacctcatggggggcgccttccatcagcaactgtcccccatgcaggatataggcgcgatcaatgacttccaaagtttcacgcacattgtggtccgtgatcaacacgccaatgccgcgttgcttcagatgaccgaccaggtcacggatttcacccactgcgatgggatcaatgcctgcaagcggctcatccagcaggatatagccgggctgggtcgccagggcacgggcaatttccagtcggcgtcgttctccgcccgacagggcgagggcgggggtacggcgcagatggccgatgccgaactcggacagcaactccgcgagcatgtgctcccgtgtcgtgcggttgctttcgacgacctccagagcggccatgatattctgctcaacattcagcccacgaaagatactggcttcctgcggaagatagccgatacccagacgggcacggcgatacatgggcaggccggtaatatcactgccgtcaagctggattgagccggtatcaggtcgcaccaggccgacaatcatataaaaggtggtcgttttgccggccccattcggtcccagcagccccacagcctcgccgcgctggacgaagaccgagacgttccgcacgacagggcgtttcttataggtcttgccaacgccgatggctgcaaggccatgcgtgattttagctggatcgatccggggtttgtatccgctcccctgcgccccgtgatcatgtccggaggcggaagtaggttctgcggcaaggctggaggcggaaggttgctcgttcatactcatcgcgtcttgtctttttttggcgctgctgaggatgcgggcttttcactgcccgtttcgctggggacgatcatgccttgcacgcggctgtcccgggcggagagcagggttgaaatgcccgtcttcaaattcacatccgcagcagctccattgacctgattctggccgcgggtaatgcgcacatggccgatcagacgggcaatgccggtatctggcacatagacaccgcgatcgccataagctgtctccgtaggggtgcggatctcgacattgccgtaggcctcggcgcgctggagcttgccggctgcggaagcgggatcggtgcttttttgcgcatccggggctgccggttttggctgtgaggccgttttcgcatccggggattgctctgtgctgtagcctaccagggtatcagccttgatgcgtttaccatcgttggttgtcagcacggcgtcgccgcgcgcaacggacatgcgcttttgcgcccaatattccagactatcgcgggcagtcagcacatcctgcggcgtcgtgagtttcagcttcttcccggtcaacagcagaatggcctggtccatgtcgtagatcgcacgatcgccccatgcctgatcagtgtcggtgtagatgtgaacattgccaaccgcttcaagccgatagatctcgttggcaccgctctcatcagccgcattggcagaggctttggcgggcgtaggggtcgcaggcttctgatcgggagtttctttttttctgtaatgggcgatcagcgtgtcggcgcggaccgtcacattgtcacggattgccacggcattgccgcgggctaccacttccttttcctgttgcctccagtcgattccgtcctgcgccgtgacctgcaccggcccgccatgagacaggtcaagactctgggccaaggcgatgacgggggccaaggcaatgcagggcaggccgattgccagcgcggtggtcagaagagccgcacgaatggtcatggggctgttttcgcctgcgttgtgccggatgatctggccgcattcagtaccatgcgggaagggccatgaaactgcatgatattgccccgatccagtaaggtgaagccatggctggcatcaagtgtgccgaacggcccttcgacgctgaccttgtcgctggaggaaacggcgccatgatgcatgttgagggaggcagtctgggatgtcatgactgtcccgtcatcccggtacaacgtgacgtcaccggtcatgtccagcatacccagatgttgcagataaacgccttttttcgactgcaccatcagccagttgccgttctgcaatgtggcgtctgcctttggctgggccagattgatccgctcctgatcaacctgttcggctgcatgagcggtcacggtataggggcggttctgctcatccacgccgcgataggtggcgccggtgagccgcgttccgctggaagcggtggccgtaaggcgtcgataggtgacgcgggcggcatcaacttcccggtctatttccggccagattgccagcatcgtcaacagcagggcggccgttgctgggagaagatatttgacagccatgaccatgcggtggcgttgcgcaatccttcggggggaaggcaccttggcccttttgagcggagcggtctgggtgaggcgaggtttgtcctgcatagtaaggggttggctggtattcattaagccactcctgcgcgtaacaggtcatgaatatgaacgaccccgatcggggtatgtgtttcgtcgacgacgaataaagtattgattggccgtgccgtctggccgctgttttggaggccttttccggccgggccggtcatggtgtgcagggcctcggcggccagaacggagggggcaatggtgcgcggatcgcgggtcatgatgtctgccaccggtcgttgccaaagatcgggggccatatgccggcgcagatcgccgtcggtgacgatgccgatcagcctgccttccttatctaccaccccaacgcaccccagacttttactgctgatcagcagaaccgcttcatccatccgcatgtcgggaaggacgagtggcatgtcatccccgctgcgcatgatatcgcctacggttcgtaattgcgcccccagacggccaccgggatgaaaggcgccgaaatcccgggcggtgaagccacgccgcttgagcagcgccacggccagcgcatccccgagcgccatttgcaaggtggtggaagtcgtgggagcaaggcccatcgggcatgcctctgccaccgggggaagcagcaacacaatatcggcggctcgcgccagggcactgccggagcgaccggtcacgccgatcaggggaaggccgaaacggcgtgtatgggccaccagatcagccagttccgatgtctcgccggaattggacagggccagtacgatatcaccattcacaatcatgccgagatccccatgagaggcctcggccggatgcacgaacagggcaggggtgccggtggaggacagggtggcggccatttttcgccccacatgcccggacttgccgattccgctgaccacgacccgtcctgtgctggcagcgatcatctccactgcgtgcaaaaactgctcgtccagcgcgtctgccagaaccttcagcgcgtctgcctctgtcagcagcacttcgcgtgccacggcaagcctggctttatctgtgtcggaaaaagcaggttttgaagcagactcgacggtcatggtgaccgtttgcgcagtcatgacaaggcgatcctcatatcagaatcatgttcatgccacggtggcatggcaccagcacggcagcagtggaatgaccgatcggtcatcttatgctcggaaacccgaatggtggcaaacataagtaaaagtccagagattggcgaaacagattatgtgacatatcgtcacgagaccggggattcacagagactgaccaacagccataccgcagttgctttgatccagggggcgtcgggctacaatccacaataggccattcagacatttcatgaaaatcggatcatagtttgtcagaaatacggcggccttgcctctgctatgatcctgttatctatccctgtttcattcagtgtgaaaaaatatccggctcatcataacccagatagtccagccgtgctctggcaggcagaaaggcaaaacatgcttcagccagagcaagcctgtcctcccggatcagtaatccttccagccggttccatagtgcatgcagatacagaacatcggaggcggcataggccatctgctctggcgtcagttcaggtgcgccccaatcggagctctgctgctgcttgctgatctctacccccagaagatcgcggcacagatctttcaggccatggcgatctgtaaaggtacggaccagcttggcggcgatcttggtacatttgacgttggacatcgcgatgcccagtgcgttctgcaaaatgccgacatcgaaccgtgcgtaatgcatcagctttacgcagccaggattgctgagcaaccgtttgagattggggcaatcggcgcctttgccgcccaatcgctccggcacaatctgcacaaggtgtgcatgaccatctccggcggaaatctggatcaggcacagccggtcccggtgatgattcagccccatcgtttcagtatcaatggcgataatggggccgatatccaatgaagggggaaggtcgtgccgatggagatgaatggttttatcggccatgaactgtgtgatcaccgggctgagacttacgaaagatgaaagatgggggataaaatccaagcatgctgcattggggttatcctgccagacagataagaataagcgaactgaaaagacggcaacggaaaacgttgcatcgggcaaactgtcatgtcagtgtatggagacaacgccggtgatttaatcacgactgcctccctcataaccgagggaagatggtgcccaggagaagactcgaacttccacgaccttgcggccacaggtacctgaaacctgcgcgtctaccaattccgccacctgggcatcggggcgttgtgtggagcggcatttagcgttcgcagcatggggcgtcaatgaccgccggacaggttttttaaaaaaacgtgacagacctcatctcgtgatatctgtcagtcatggaaaaaccctcgtcctgaagcgttaggcgcgttgcgaaacgctgaaaaatcacgaaccctgctccgccagacagccacaggtcgcccctgtcgtggttccggtgcgtgttacgggatgggaggcgcacgctcatcagggagaattcagtcatgaccaccacggaatcggtgccggtcacgcaatccactatggcgggccggatcgccacggttttcggaggttccggatttctggggcagtcgctgatccggctgctggcgcgggaggggtatcaggtaagggttccggtgcgtgatcctgagcaggttctgaagctgaagagcgcagggagtgtcgggcagatcgtgccgttgggtgtgtcgctgggaagccgggatgcagaggcgggcattgcccgggcagtgcagggggcatcactggtcgtcaacctggtggggctgctggcggaagcgcggaaaggagattttcagcgcgtccatgtacaggcggccgggttgattgcatccctgtctgcccaggcaggcgttttgtcctttatgcatatatcggctctgggggctgatcccgccagcccctccgcctatggacgcagcaaggcagagggtgaagaggctgtgcgctctgctgtgccacaggccgccattctgcgcccgtccgttgttttcggggccgaggatcattttttcaaccgctttgccgctatggcggtgagcttgccggttgtgccggtgatctatggcaacagtcggatgcagcccgtctatgtagaagatgtagcccgggcgattctggcggctgccacgcaggcggctggaaatgtcatcgaactgggcgggccagaggtcctgacgatgcgtgatattcagcaccgtatcctgaccatgattggtcggaaaaagccgttgatcgatattcccgacaaggtagcgatggcattggcgatgatcgcggagaaaatgccgggccgtccgctgaccaccgatcaacttgccatgctcgggtccggcagtgtcgtatcgccgcaggccttgacgctggagacgttggggattgtgccgaccccgattgatcttgtggtgccccactatctctcccgctttcgggcaggcgggctggtagcgccgcgggtgagaaaaacgaccacaccctgaataggcccgaaatggcccttttataggataggccctggaattttttttgattaaaatcaaatatccaaattatttggtcatatctattgacctatgactgaaaaataggctcgtcaaatgatgcagccttgtttataagcagctttcccgggtcgaatacccctttcggccgggatagtcgcgcttgcgcgtccggctccacaccgcccatgcaaaggctgtgccgtttccatccccatggtcggcctgccgccccttgaggagattgcttatggctgaacgcatgctccagttcgtccgtcgtgcgcaggcctatcccgacaaacgcgcggcagagcagcgtgtggaggatttcgacgagatctatgccgatttccagcctgaacaggcggcggcgcaggcatcgcggtgcagccagtgcggggttccgttctgctcaatccattgcccgctttccaacaacattcccgactggctgaaactcaccgctgaaggccggctggaagaagcttacgaagtcagcagcgccaccaacaacttccctgagatttgcggtcgtatctgcccgcaggatcgcctgtgtgaaggcaattgcgtgattgagaaggatttcaactcggtcactatcggctcggttgaacgctacatcacggacacggcatgggaaaaagggtgggtgaagccgccccgtccgtctcatgagcttgaacagtcagtggcgatcatcggtgccggcccggctggtctggccgcggcggagcaactgcgccggctgggttatcaggtgcatgtctatgatcgctatgaccgtgttggcggtctgctgatctacggcatccccggcttcaagctggaaaaggacatcgtgctgcgtcgctggaagctgctggaagacgctggtgtcgtgttccattgcggcgtggagatcggcaacggtgccggtgcggtctccatggcctcgttgcaggaaaagcatgatgcggttctggtggcgacaggtgtgtataagtcccgcgaactgggtggccccggctccggcctgccggggatcgtgcccgctctgactttccttaccgcttccaaccgcgttggccttggggacaaggtggaggatttcgacaacggtgttctgaatgcggctggcaaggatgtcgttgtcatcggcggcggtgatacggcgatggattgcgtccgcacctccatccggcagggtgcgaaatcggtaaaatgtctgtaccgccgcgataaagccaacatgccgggttcgatgcgggaagtgaaaaacgcggaagaggagggcgtcgaattcgtgtggctctccgcaccggaagcattcctcggtgaggatcgggtccatggtgtccgggccgtgcggatgcatctcggtctgccggatgcgtccggccgccagtcggtggagccgttggagggcagtcattacaccatcccggccgatctggtgatcaaggcactcggcttcgatccggaagatatgccggtgatgttcggcacgccggagctgggggtaacccgctggggcacgctgaaggtggatcccaaaaccttcatgaccagtttgccgggtgtctttgcggccggtgatattgtgcgtggtgcgagtcttgtcgtctgggcggtgcgcgatggccgtgatgcagcggcggagatgcaccgtttcctgcagggcaaggcacccgccaccctgaaagagcatgagagcgagccgcagggcgtcccggcggcggcggaatgaggcggcgtatgaacagcgagaacgcaaaggaaacccggcccatgaacgtcgtttccacgaattttgtcgcagagtgggatgcgaatgtcgccgctctgcgcgacacttattcttccgctcaggagcatgatgcctgcggcgtcggcatggtggccgcgctggacggcaagcgccgccgtgatgtcgtggaagcagggatcgaggcgttgcgggccgtgtggcatcgcggcgcggtggatgccgatggcaagaccggtgacggtgccggtatccatattgaaattccgcaggacttctttgccgaggcggtgcgccgcggcgggcatgatccgcatccgggcaagattgcggtcggtcaggtgttcctgccgaaatccgatctgaatgcgcaggaacgttgccgtcagatcgtggagaccgaaattcttgctttcggttatggcctgtatggctggcgtcaggtgccgatcaactatgcctgcatcggtgaaaaggccaaccagacccggccggaaatcgagcagatcatgatctggaacgcccgtggcgtgtcggagcaggagttcgagcgcgatctgtacgtaatccgtcgccgtattgaaaagcaggcggctgccgatggcatttccgagctgtatctgtgctcgctctccacgcgctcgatcatctacaagggcatgttcctggcggagaacctgacggatttctatcccgatctgctggatgcgcgtttcgtcagccgctttgcgatctatcatcagcgttacagcaccaataccttcccgacatggaagctggcgcagcctttccgcatgatcgcgcataatggcgagatcaacacggtgatcggcaacgtcaactggatgcgcagccatgaaacgcgcctcgcccatccggcgctggacggatatttcgaggatctgaagccgatcgtgcagcatggtggctccgataccgcttcgctggatgcggtgttcgagctgctggttcgtggtggtcgtgatgccccgatgacgaaggcgctgctgatcccggctgttcagaacgagaacatgccgaaggaacatcgcgacctttatcagtatgccaatgccgttatggagccgtgggacggccccgccgcggtgtgcggcactgatgggcgctggatgatcgccggtctggaccgtaacggcctgcgcccgctgcgttacaccatcaccaccgatcagcgcctgatcatcggtagcgaagccggtatggtgaagctcgacgaaagtcagatcctcgaaaaaggccatgtcggtcccggtgagaccattggtgtcgatctggataacggggaattctattcctccacccgtctgcgcgatgcactggcggcgcggcgtcctttcggcgaatggatcaagggcattacccagctcgatcacatcgtccgtgccgatgcgggtgagccgagtctgttccagggcgaggaactacgccgccgtcagctcggcgtcggtgtgacgatggaagagctggaagttatcctgcacccgatggtggaggatgcgattgaggcgacgggcagcatgggcgatgacacacccattgctgtgctgagtgagaaatatcgcggtctgcaccattatttccgccagactttcgcgcaggtgaccaatccgccgatcgacagcctgcgtgaaacgcaggtgatgtcgctgaaaacgcggttgggtaatctgggcaatatcctcgatgaggatcagtcccagtgcgatttgctgcaactggccagcccggtcctgtccaatgctgaatacaacgcgatgcgcgattacatgggcgcatcagcctgtgtggtggactgcaccttcgcggtcgaggaaggcgaggccggtctgcgcgccgccattgcccgggtgaagcgggaggccgaggaaggtgtgcgggccggatgcacgcatgtcatcctgaccgacgagaatacgtctgccacgcgtgtgccgatcccgatgattctggccacgggcggggtgcatacgcatctggtaggccagtctctgcgcactttcaccagcctgaacgtgcgcagcgctgaatgccttgatgtgcattatttcgcggtgctgatcggcgtgggcgcgaccacggtgaatgcctatctggcgcaggaaagcattgccgaccggcatcgtcgtggcctgttcggtgatctgtcgctgaaggattgcgtgacacgctatcgcaaggcgatcgacaagggcctgctgaaggtgatgtccaagatgggtatctccgtgctcagctcctatcgtggcggctataatttcgaggcgatcgggctttcccgttctctggtgggtgagttcttccccggcatgcagtcccgcatttccggcatcggtctgggcggtatcgcacacaaggcgctggaactgcaccggatggcatggtccagcgatgcggtgacgctgcccgtgggcggcttttacaagctgcgtcgtcgtggcgaggtccatgctttcgatggaccgctgatccataccctgcaggaagctgtggcaaccggcagctacaccacctatcggcgttataccgacatggtgcgtcgcctgccgccggtcgcgctgcgtgatctgctggatttccggatggaagggcgcacgcctgtctccaccgatgatgtcgaaagcattaccgagatccgcaagcgtctggtggcaccgggcatttcgctcggcgcactcagcccggaagcgcatgagacgctgtccatcgccatgaaccggatcggtgcgcgcagcgatagcggggaaggcggtgaagaccccggccgcgcaaagccgcgtccgaatggcgacaatgcgtcctctgccatcaagcagattgcctccggtcgcttcggtgtgacggcggaatatctgaacaactgccgtgaaatcgagatcaaggtcgcgcagggggcaaagcccggcgaaggcggtcagctgcctggcttcaaggtcacgggcctgattgccaaactgcgccattccacccccggtgtgatgctgatcagcccgccgccgcatcatgatatctactcgatcgaggatcttgcgcagctgatctacgatctgaagcagatcaatcccgatgcgacagtctgcgtgaagctggtggcgcgctccggtatcggcaccattgccgcgggtgttgccaaggccaaggcggatgcaattctggtcagcggccatgtcggcggcaccggcgccagcccgcagacctcggtgaaatatgcgggcctgccgtgggaaatggggctgtcggagacgcatcaggtgctgatgctcaaccgtctgcgtcaccgcgtgaagctgcgcaccgatggcggcatcaagaccggtcgcgatgtggtcatcgccgcgatgctgggtgccgaggaattcggcatcggcaccgcatcgctggtggcgatgggctgcatcatggtgcgtcagtgccattccaatacctgcccggtgggcgtgtgcacacaggatgaggcactgcgcgagaaatatgatggctcgccggagaaggtgatcaatctgttctccttcatcgcggaggaggtgcgggaaattcttgcgtctctgggcgtgcggacgctggcggaggtggtgggccggaccgatctgctgcatcaggtcagccgtggctctgaattcctcgatgacctcgatctcaatcccttgctggtgcaggccgatccgggatcgcatgcccgttactgcaccatcgagggcaggaacgaggtccccgaaacccttgatgcccgcatgattgccgacgcagccccgctgtttgagcgtggcgagaaaatgcagctgcaatacggggtgcggaatacgcatcgtgcggttggcacgaagatgtcttcgaagatcgtgcggaaattcggtatgacgggcctccagccgaaccatgtcaccgtgcgtctgcggggcaatgcgggtcagtcactgggggcttttgcggtgcaggggctgaagctggaagtgttcggcgatgccaatgactatgtcggcaagggcctctccggcgcgaccatcgtgatccggacctccccgtcttctccgttgcggaccgaggaaaacaccattatcggcaatacctgtctgtatggtgccaccagcggcaggctttttgcggcgggtcgggccggggagcgcttcgcggtgcgtaactccggcgccagcaccgtcgtcgagggctgcggctccaatggctgtgaatatatgacaggtggaaccgtcgttattctgggatcggtcggggataatttcggtgccggtttcaccggtggtgtggccttcatctatgatccgcatgaaagcttcgcggcgcgggccaatcccgataccatcgcctggcatcgtgacttctcacctgactgggccaatgctctcaaggaactggtgcgtgagcatgtggaggaaaccggcagccgctatgccgccaccttgctgcatgactgggacgagaatgtcggtgatttctggatggttgtgcccaaggactacgtgaaatatctgcctatgcccatcaaggaggatgcgagggcagatgcaatcagggcctgatcaagctcatcacggttgtgctgaagactgacgatcaaagcaggcgttccataatggagcgcctgctttttttcgggcgttgatggcaatttatgcccgtgtccgtcgcatggggcttatcgagccggtggaggatgagatagaagtttccgcatgcgcactttgtatcatcttcctctttgtccgttttccagaaaagtccgcgtcgttctggcggagagaaagcttcctttcgaactgaaagtcgaaaaagtctgggaacgccgcccggagtatctggagatgaatccggcggctacggtgccggtgctggtggagcagaatggtctgcccattccggattcatcggtcatctgtgaatatctggaggaagcctatcctgatatctccctgctcgggcgcagtttggccgagcgtgtggagacgcgccgtctggcagcgtggtttgatggcagattttatcaggaggtgacgaaaaatctggtgggcgaaaaatatctgaaacgcctgctagggcgtggcaatcccgatgcgacggcgatcaggaccgggttcaccagcctgcgctatcacatggaatatctcggctaccttgcagatacacggaaatggctggcgggtgcggccatcggtctggccgatttcgcggcggcggcgcatgtatcctgtctggatttcggcggcgatatcgactgggagaaatttcccgccgctcgtgactggtatgcgaggatcaaaagtcgccccagcttccgtggtattctcgctgatcgtgtgcctggcatcattccgccagcgcattacgccgatctcgatttttagaattttcagtgctggcttaagggggagcgttattttcgctccggcccagcttcctgcaaagcgaggttttgtgctgcgagatcgccggtggcggaatcgggggccagtgagatgatccgctcccaatcctgcctggcgccgtcttcattgccctgtcgttgccgcagaataccgcgttccagcagggcatcgacattatcagggtcctgatccagtgctctggcgatatcgtccgctgcctgatccggcttatccagtcgccggaggcaagccgcgcggtagaccagtgcatcggttcggcgcgaatcgatgtccagcgcgtgattaagatcggcgatggcttccttgaagtgctccagtgtcgcgaaggcaacagcccgatcgatcagcaggtcgggatcatcgggggccagagccaacgcatggctggcggcttccagagctttctgtgtattacccgcgataatccacgcctgatcggcttgaccgaaaatactggcccgcgcaatggcgggtgccttgctggtggtgcccagcgtttccagcatgcgggcgcccgtttcagcattgcccaatgcgatttccgccagcgcggcacaatgggccgcaccatctcctcctgttttccagttttccgccatctgataagcgccggagggatcggtggtgagcatggacaggcaacggtcgtaatccgcgccctgcgcaatccggggaggcactgggggtacgggaagatcctcggctgagtcggtggcgttttcatcattgatcggcgcagaaaagggcgactgatcctggctaagccaccagacaccgctgcctgcgcccgcaagcagcaggatcatcagcagaacatgcaggggcgctggtgatttcatgacgggtaacagtctagcctgctaatgtggcttgcggaaatggcgcgtttgcgtttcgcatggcggcccgtgtctgaaaccctgacaagagcgtgcgcgatggatcaaggcaaactcctgattttcggcctcggttacacgggaacggcaacggcgcgtctggcgctttccgatggctggtccgtgagcgggacgaaacggcaggcagattcctcggctttgccaggcggagaggttctggcttttgatgatccggccatcgccgagaggctgttttccgcgacccatctgctggtgacggccgcaccggatgaagcaggggatccggtgctggttcgatggggggaggctattcgcggtgctccccgactgcgatggattggatattattccagcacaggcgtctatggcgactgggacggagcatgggtggacgaagcaaccccgcctcggccggcgcatgcccgcagccaacggcgactggaggcggagcaggcatgggaggccctggccgatcatcatgccgttgatatcatccggctggccggcatttacgggccgggccgttctgcactggatgatgttcgcgccggtcgggcgcggcgcgtcattaaaccgggccatgctttcgggcgcatccatcgggacgatattgcccgggctacgctggtggcagcctcccgagcaggggctggcgtgaggatattgaattttgtggatgattgcccggctgaaagtgccgctgtggtggaggaggcagcgcggctgctgcatgcaccccttccgccgtctgtcctgtttaaggaggcagtcgccaccatgtcgcctatggcccgcagcttctgggacgataaccggcgtgtctcctgtgttgcgaccaaggcggaactggacatcgactggctttatccgtctttcagggagggactaaatgccatcttggcggcggagggaggcgcggctacagaaggtaacatctgacatcggccgatgccgtggctaaaaatattgatggcaggtcttgtcatggatgctgcggtgcagcaaaaaactgctcaagccagcatcccgatgcgccgtcccgttcgctctgcccgtgaattttggtgatcgccttgcatcttcccattctatctatccttatgggcctgccaatttttggctccttccttctgctgtttttgcgggggaccggaatttcacaggctgcgacagcccggggtatcgcgctgggtgtcagcctgattacttttctgttgtccctggtgctgtggatcgagttcgatccttcgatgacgggtcttcagtttgaggagcgggcaaactggatgccgggcttcggggtctcctatcatctcggggtagacggtttcagcctcctgctgcttctactgacaaccttgctgacgccgatttccattctggcggcatggcgggtcattcacgagcgtgtttctcattacatgctggctgtgctgatgttgcaggctgcaatgatcggcgtattcgttgcgcaggattttgtggttttctacatctcctatgaggcgacgctggttcccggttccctgttgatcggtctgtggggcggcccacgtcgcgctttcgcggccatgaagttctttcttctgactttcggcagctccctgctgatgctgctggtgctgctatatgcgtggtatgtgaccggctccaccgatatggatgtgctgctgcatacgcgcttccccatgaccgcacagagcctgattttcctggctttcgtgctggctttcggcaccaagcttccgatctggccactgcattcctggctgccggatgcttatggcgaagcgcccgcccctgcgactgcactgctctccggtgtgatggccaaggcgggggcctatggtctgctgcgcttcgccattggcatggcgcctgatgcggcccgccactatgcgccggtgatgatgatcctcggtgtcgtcggggtgatctacgcagccattatcgcctgtgcgcagaccgatatgaagaaaatggtcgcctattcctccttctcccatatggggctggtggtggtgggcctgttcagcctgaccacagagggtattgatggcgcgctgttccagatggtctcacacgggatcatcatcgcaggcctgtttttctgcgtcagcatggtcagcttccgcgccggttcccgtgatttcgcgaaagtcacgggtgtcgttaattacgccccgcggctggcggctctggcgatggccttttccatggcgagcatcggcttgccgggaacgggtggctttgtcggagaggtgctggtgattttcggtgccctgcatgtcaatgtctggctggccctgctggctggcaccagcatggtactgggcgcgatctacatgttgagcttttactggcgcgtcatgttcggcaagctgagcggagctgtctccgttctgcatgatatgacgcgtctggagatggcggtgctggtgccgcttgtcgtgttgacgctgtggatgggattctacccgaccagcttcaccagagtgttcaatgccagtgcccatgcgcaggttgtcactgtgaacgcgcatgagcatgcgctggcttctgctgctctgccggttgtgctcagccgcaattaaggtcgggatacagtttccgcctgcctgatgcgttccatgatgtcctgaggggaggctccgctttcccgcagggatcgcacggtcagggcagcatcacgtttcgccagcctctgtccatcagcccccttcaggaggccatgatgcgcataagcgggttccggccagccgaacagggtctgtagcaggcggtgcaggtcggtggccgccagcaaatcttccccccgggtcaccagcgtaacgccctggacggcatcgtcatgcgcggcacagaggtgatagctggcaggcacgtccttccgtgccagtactacatccccaaagcgttccgggtagcatggaaagcgaatgccatgttcgacccgctccagcggatgagacaggcggcgtaatgcggcctgcatgtcgagccgccatgcacaggcctctccggcagccagccgcgcgtcttgttcagccggtgacagggaacggcaggtgcccggataaagcggcacaccatcagggctgtgtggcgcactgccggcttcggcgatttcgcgggtgatgtcggcgcgggtgcagaaacacggatagagcaatccctctgaccggagatttttcagtgcctggctgtattccgccatgtgccgggactggatacgtacaggttgctgccattcaaagcccaaccagccgagatcctccagcagggccgcactccattccgggcggcaacgtgttgtatcgatatcctcaatccgcagcaggaaatagccttggctggcctgctttatggcctgccacgcagcataaacatggcccagatgcagatggccggtggggctgggggcaaaacgggtgatgacagtcatggagagcgtttatcatggcatgctgtggagacgaatgcatgatgctgcaacgacaaggatggataacctggtcttccgatgagggggttggtcctgcaaccgcaatcacggggtggatgaagccaccagtgaatagccgggtgcgatatttgatcgtgctgtgccacggccatggcaatgatgcgagcggtatgatgtggctggcggagcattgggcgccgcatttgcctgacgctgtctttttatccttgaacgggtgggaaccatgtgtgctgcatcccggcacacgccaatggtggtctttgcgtgatcggaccccggaaaccgaccgtgccggcgcggcgcgcctcggcccggttctggcggagacgatcaggattgccaccacggggctgggcttgacagcttgtgacgtggccctggtcggctttagccagggcgccatgagcgtactggctgccgggctgtttgcagaaagccggatagcgggcgaggtgggccgtgccatcgtcagtatcgccggcgccttgcatctggctgaggaagcttcgatcccgtcagcagacactatgccagccgtgctgctgctccatggtgatcaggatgatgtggtgccccttacgcgcagcatggtggccgattccaggctgaaagccatgcatgtgccggtcacactgactatcctgccgggggttgggcatgaggtcaccgctgaagaagccgattgcgcacttgcgtttatcatcagggttttacaggcggatgcttagacgctttccgtcatggtggttcatgacgaagtcatgacgtgtgcctgtatccgggttgctacaacacggcttgtctgcaataaaagtcaaagttctccgcggcgcacattatctggcagttcgtggctaggatttcttcaccagactgtgcgaccgcctgaataggaagcggcaatgcctgatggtgagcagttgcacagccttgtcagaacgggtggaccggcacagtttccggctctggttctcaatgcggatttccgcccgctctcatattttccgctctcgctatggtcgtggcaggatgcggtgaaagcggtttttctcgatcgtgtctccgtgctcagcgaatacgatcacgaagtccgttcccccagccgtacgctgagactgcccagcgtaattgcgctgaaggattatgttcccacggcaaggcgcccggctttcacccggtttaacgtgttcctgcgcgatgccttttcctgccagtattgcgggcaacgtatgccgacgccggaactgacctttgatcacgttattccacgctgccggggtgggcggacgacctgggaaaacgtcattacggcttgtggaagctgtaatctgcgcaaggggtcgcggttgccgcgtgaatgcaatatgctgcctttgacgacgccgcgtcagccttcaacgtgggaattgcaggataatgggcgggctttccctcccaactatctgcatgaaagctggcgcgattatctgtattgggacagcgaactggagagctgagcccgcacggcctgcctctctattggccgtacggccggcaaagaaagaaaatggcaggcaggctgagacaatacggtatccctttggcgctcatgatcatggtcgcggggatgacggggctggtatcctattcggtgaccttgtaccggctgttctgccaggtgaccggagcgggcggcaccacccagcgtgtcacggaggatgaggcgacccaagcggtttcatcccgcatggtcacggtgttcttcaatgccgatgtttccccgaaactgccctggcgttttcgtcctctgcaacgcagtgtcaaagtgcgtctgggacagcaggtgccgattttctatgaagcggagaacaccagcgatcaggatatcgtgggccatgccaccttcaatgtgactccggataaagcgggcatctacttcaagaagatcgagtgcttctgctttacggaggagaggctggcggcgcatcgctcggtgcagatgcctgtgctgttctatgttgatccagccatggccaacgatccggccatgcaggatgtggatcagattacgctgtcctatacgtttttccgttccgagaccgggcagactccggcggatctggcgcgtttccatgacgggccgccggatgcggcgctgggaaagaaaatattcgctgcccaatgttcaggctgtcatgaaatgggcaccgataaggaaggcccccgtctggcaggcattatcggccgtaaggcaggctccgtgccgggttatccatacagcaaggctttggcggctgcggatttcatctgggatgaggggcatctcgaccgctggctggccggccctgccgccatgctgcccggtgcggcgatgcccatgagcattgataatcctgtcgcccggcgggatatcatcgcctacctgaaacaggtcatgcccggaaaagcgacggaggcgactccccggccgccgactgcaccggtcgatcggaaagggccgggttgagggacaatattaaaacgacacattggtgcgaaaaccgagcaccaaagccgttccgtattgtcgtacaccgcctggatgcaccacgacctgaaggtcaggctcaatcgtcagaccttcgcaggcatggattgtatattcggcctccatgataacttcatcaccctggggtccgggaacgccgcccgtcaggggctgccctgcagcctgctcggctttttggagcgccttcaggccccggctctgctgagcgtaatagacggcgaaaccatagctgtccctgcgacgtgcgggccagaaagcacggtccaccattccgacaaaaccgaggctgcgatagggtgaaaacctgtcatccgacagggtgaaaccggcaaagacgatcagcccttcccgtgtatagggaccgcgccgcagcagcatctggtcggccatgatccagaatcccgagcggcctctgatcgttttttgcgtggccggattgttggaaggggcgggaaggtcatatccctcgtccgagggaagatcgcggtacagagtgttggtgcgcgcactgtcataataggcccctattttataatgccccgaccgctcgttattcccgccccccggttcccaaccgatttccaccgggatcatcataccgttggctgtggctgggctgaactgaagtcccgtacgacccccccgtgcggaattggactcaaaaacaccactttccacatagatttccggtgtagggcgaccgcggatgcgtccaccccagttggcggcggcaccattggtaaaggcgggtctgtcaccggccgataaaggcgtggggacaccacagaaagcattgctgacgaattcgcaatagagtggagatgatgcgaaatcggtcgcgacctgcaaccgccccacggcaatcgacactctttttttgagcaggagttgctcggcatagaccatcgacaaatgggccgcgacattgccgccgccgcccgcgatttcctgcacgggatagagagagtcccccatcaccgtactgctcagactgcgcccggcgcgattgataacgattgcgcgggtggtcaacccgttccagcccgccaatttattccagtcaatcttgagttcgatgccgcgattatcggcataggcaatgccacgcccccgaccaccggtgacattgcccatcgtctcgctgagatagccggcgataaggtcgatcccatgatgttccagagggggtctgagaccgccccaatcaccgaaaaaatgctctctgggcgccatgggcgggatggtcggatcaggtggttgcgtcagggagcgggacggcatggagccaagccccggggtttcagactgtgcatgggcctgggttatcagcgacaatcccatcgcagcaccgaccagaatcctgacagtcagacaaaggtgtgaaaggaacatcgcgaaccggaaagccaaaaaacgcatgcaaaaatatttcgataccgcattaagcaaactgcaatgacggtatgatctgaacaggatggagtttaaacgcgttcgctgatggcgatggccagccggcagccagccttgatggcaccggatagcagccgataggccggtgccagctctgcctcattggcaaggccgatatcgcggtgctccagttcttcctccctgaagcgggcgatggtttctttcagttcgtgctcatcatcgggcagagcctcgatctgtcgggcgtagtgatcgtcgatggtttcctcgacggcgacggtgcaggccatggcggcacgttctccaatggcggccgtcagggctccgagagcaaaaccggctacatgccagaaaggcagcatcgcggttgggcggacccggcgatcggcgatcatgcgggagaatgtttcgcgatgaacatcctcctgcgctttcatgtgttccagtgtcggcgcatggcgggagcggcgcaaaacggcaagctgcccggcatagatccgtgatgcgccgtattctcccgcgtgatccacccggatcatccgcgccagcctctcccgggccgggagatcgccgggcaaggagggcgacatgcgagccgaggctgaagctgtgtgcgtcatgcagcgtttctccggatcaggcgcggtctggtttcaaggccagcagcattttcatcatgatgatggccatagccaaagcataaagacagttcgcgaatgccatggaaaccggaaagcctggaataagataggtcggctcgtcacagggcttgtcgggccgggtcggcatatgtgccagcatatcggtaatagagagttgactgctgaagcgtggcgccgcgcattccggcaaagggctgggccagaaatgccactcgaccccggcatgcagcagtccggctccggctgccacacaaaaactcagcgccgccagtccacagagcacgagagccggacggggaggcagaaacaacgcgatcacgcccagtgcgattgcaatccggtatggccagcgttctaccagacagagcgcacagggcggccggtgcgcccaccattccaaggaaaaagccacaccaagcgccagagaggccataataacggcaaaaagagcgataatgcgatgacatgccataccgacaggataggacagaccgcgtcttctgtcgctactcctgtcgcaggaggtcatctgtaggtcgccagatgcgggaaaaggggatggcagggctgccgaggtggtcgattgccgctgaagggaaggcggcgttagggttgaacagattctcttcagcaggactgtagtgttcccatgagcctgattgccgcgcgtcttgaccgtatcagccccagccagaccattgccatcagcaccaaagcccgtgcgttgaaggctgctggccgtgatgtgatcagcctttccgccggagagccggatttcgatacgccggacaatgtgaagaaagcggcgatcaaggccatcgagaagggcgacacgaaatataccgacgttgccggcactgccgccctgcgcaacgcgatcgtggaaaaattcaggcgtgatagtggtcttgattatgctccggacgagatcatcgtctccaccggcggcaagcaggtgattttcaacgccatgctggccacgctgaatgcgggagatgaggtgatcatcccggccccgtgctgggtgagctacccggacatcgttgccctttgcgacggcaagccggttctggtctcctgcagcgagcagcgcagcttcaagatcagccccgaggaactggaagccgcgatcacgcccaagaccaaatggctgatgctcaacagccccagcaacccgaccggtgccgcctattccgcagcggagctgaaggcgctggcagacgttctgctgcgtcatccgcaggtctggatcatgacggacgatatctacgagaagctggtttacggcgggttcgcttttgccacgctggctcaggtagagccgcgtctgaaagaccgcaccctgaccgtgaacgggtgttccaaggcctatgcgatgaccggctggcgcatcgggtttgccggtggtccgaaggtgctgatcaaggcgatggacaagttgcagagccagtccacctccaacacctcctccatcagtcaggccgcggcggtcgaggcgttgatcggcccgcaggacagcatcgccgatatgctggccatctatcaggagcgtcgtgatctggtggtggagatgctgaatgcggctccgggcgtgacgtgtcataagccggaaggcgcgttttatgtcttcccgtcggtgaagggctgcttcggcaagaccagcaagggtggcgtcaagatcgtcgatgacgaatccttcgtgaccgcgctgctggaggaagaaggcgtggcggcggtgcatgggtccgctttctgctatccgggctatttccgcatcagctatgccacaagcaccgaggcgctgcgggaggcctgcacacgtatacagcgtttctgtgcggctctgtcctgaagcagtctttagtcctgacgggatggaaaaaggccgggcgcttgcgtgtccggcccttttcgttaagtgcatggcgctgatctatcgatagaaagacggacactctctgatgccgagttttgcgcagcgcctgaatgggctggatgtttcccccaccatcgcggtgacgcagcgtgcgcgcgtgttgcgggcggaggggcatgatgtcatctccctgtcgatcggggagccggattttccaactccaccggaagcgattgaggctgctcatgcggcagcattggccggggatacgaaatatccacccatcgtgggtgcgtcggcgctggtcagtgcgatccggggcaagtttcagcgggaaaacgggctggatttcgcaccgaacgagatcaccatcgccaatggtgccaagcagatcatctacaacgcgatcatggcgacggtggatccgggggatgaaatcgtcattcccgccccctactgggtcgcatatgagttggtgacccggctggccgggggcgtgccggtgatcgtgaattgcccacaggagacagggtttcgtctgaaaccggaggttctggaggcggcgatcacgcccaaaacccgatgggtgttgttgaattttcccaataacccgaccggggccgcgattacgcctgcggagatggcggcgctggccgaagtgatgcgtcgccatccgcatgtctggatcatgtgcgatgatatttatgagcatctgctctatgacggcttcgtctatcgcaccatggcggcggtcgcaccggatctgcgggaccgtatcctcactatttccggtgtgtccaaatcttacgcgatgacgggatggcgtgtcggctttgcgggagggccatcatccctgatcaaggcgatgaacaatatgcagagccaggcgacatctggtgtcgcagggattgcacaggcggcggcagcggctgccttgaatggtgacccggccctgctggcggagcgggcagccatttatgcagcgcggcgtgacttcgtggtgtccgcccttcaatctgcccccggcctgacctgccacaagccggagggggcattttacgttttccccggtgtcgccgggctgcttggccgtcattccgcaggcggccgtttgttgcagaccgatgaggatgtggcactggctctgctggaggaatcctatctggccgtggtgcatggtgcggccttcggcatgagtccctatctgcggttgagctatgccacggatgagacgtcgctggcgcgtgcctgcgagcgtctggtggccttctgcgaaactgtacgctgatcgcggatgctccttgcggaaagagaatggtgtgaggccggtagagccatgttaggagaggggccatgtccgagataaagacttcatgctccgcgctttcgcccactcctcaggagggcgatccggtcttttccatcgtggtcccgtgctacaatgagcaggacgggctggagatgttccatacccggcttgcctccgtcatggatgggatgggggagagctgggaggtggtctatgtcaatgatggcagccgtgaccgcacgctcgatgtaatgcaaactctgcgtcgggccgatccccgcatcagcgtggttggcctgtcccgtaatttcggcaaggaaatcgccaccaccgcgggactggatcatgcacgcggtcaggcggtcatcgtcaccgatgcggatttgcaggatccgccggaattgatcccggaactggtcgcgcaatggcggcagggtttcgacatggtctatgcccagcgccgtgtcagggaaggcgagacctggctgaaaaaagcaacggcgaatgctttttacaacctgatgacgcgcctcggggatgtcagcctgccccccaatgccggggattttcgtctgatgagccgccgtgcggtggatgctctgctgcgtctgagggagcagcatcgcttcatgaagggcctgttcgcctggatcggctatccctctgttgctgttcagtatgatcgcgcgccccgtgcggtgggcgagtccaaatggtcgtactggaagctgtggaacctcgcgctggaggggatcaccggctttaccgtcgtgccgctgaagctggcgacatatctcggtattctggttgcgctgttcgcggtgctgtatggcggcaatatcgtgctgtccaagctgttcttcggcaatcccgtgccgggttatcccagcctgatggcagtggtgctgtttctgggtggtgtgcagttgatgacgctgggcgtgatcggggaatatctcggccgcgtgttcaacgagaccaagcgccgtccgctctatttcgtggagcgtcatctgccgagcgatccctcaatgacgcctccctatgtcggagactccgtgcgtggctgacgggctggatcctgatgactgggacgcgttacgcagccttggtcatcgtatgctggatgacatgttcgaccatctggccggcgcacgctccggagcggtgtggcggcctttgcctcatcaggtgagggatgtgttcaaaacgcctgccccgcgtgatggcagcagtctggaatccgtctacgaacagttccgcaatgatgtgcaaccttatgcgaccgggaatattcatccgcgcttcatgggctgggtgcatggtggcggcacggcggtcgggatgctggcggatatgctggcggccgggctgaacgccaatctgggcgggcgggatcatgctccggtcgaggtggagcggcaggtgatccgctggtcggctgaactgttgggcatgccgtcagaaacctccggtattctggtgaccggctcctccatggcgaatttcatcggcattctcgtggcgcgtctggcggcgctcgggccgcaggtgcgtcatgaaggggtcgggcagagcggcttcaccgcttatgccggggctaatgcccatggttgtattccccgtgcgatggatatggccgggttcggcagcgatgccttgcgttcggtgccgctggatgatgcgcattgcatgaggctggatgctctggctgccatggtggctgaagatcgggcgcaggggaggctgcctgctctggtcattgccacggcgggaagtgtcgataccggggctatcgacgatctggatgcgctggccacattctgtgctgccgaagggatgcggctgcatgtcgatggagcgttcggggcgatgctggccctctcgcccgtgttgcgccatcgtgtgaatggcctggcacgggccgattccatcgcgtttgatttccataaatggccgcaggtaccctacgacgcaggctgcgtgcttgtgcgcgatcccgtattgcaccggcaggcttttgcgcaggatctggcttatctgcggcgcgatatccggggcttgtccggtggcgcgccatggccatgcgatcttgggccggatttgtcacgcgggtttcgggcgctgaaagtctggatgatgctcaaaacctacggcgccgaccgtctcggcgcggtggtagagacgtgctgcgacgtcgccacccatttggccgcgcgggtggcggctgagccggagctggagttgctggccccgctgcctgggcagaatggcctgaatgttgtgtgtttccgttttatcgccgccccgggtgatctcgaccgtctgaacatagagctggtcgcggatgttcaggaatccggtgttgcggtcccctcaacaacgcatttacgggggacgctcgcgattcgtgctgccatcgtcaatcatcggacgaggcgggaggatgccgatattctggtaaatgcagtgttgaaagccggacgctgccgtgtcagccagttggtggcaaccggctgacacaggcgttgcgtcagccgagttcggccagcttgccaagcaaaaagtcacggaatacggaaacgcgcttggaactgcgcagctcctccggatagacgaaatacacgtcgatcttgggagattcgatctccggcagcacgcgctccagcccgtccatttcgttgctcatgtaatcgggcagggccccgatccccagaccggactgaatggccagcgccatcgcctggagtgagttgacatccagcaacggacgtcgcggtgtgccgctcttgcgcccggcttcggccagccagttgatgttgttgaccggcgagtgatagtcgccaaacaaaatcagccggtgattgtcgaggtcttccactgattgcggccgaccatgctgctcgaaataggcaggtgtgccgaccacatgccatttgatggtcatcagatggcgctgcaccagatcaggctgcttgggcggatgcatacggatggccacatcggcctcccgcatcgccagatcgagatcggcatcatccagcagcagtgacagcgacacgtctggatatgcggccaggaattggtgcaggcggggtgccagccatgaagcgccaaagccgaccgtggtggtgactttcagacgaccggcgggcttttccttgctttcggtcagcagggcctcggtcatagccagtttggcaaaaacttcgcgcacggtacggttcaggctttcgccttgctcggtcaggatcaggccgcgggcatgccggtgaaacaagggaacctgaagggcctcctccagtgccgaaatctggcgggacacggcagactggctcaggttcaacgtatcgccagcatgcgtaaagctgcctgcttcagccacggcgtggaagacgcgcagtttgtcccagtccattgtttacgccactccccgcttccgggtgcgctatgtgcgacccatcgatgattcggcctgccgggccgcggtctcctgttctccgcgcacccatcccggacgccgggcgttggcggacgattcgctattctgctgccagcatggacgaatcggtatgttcggctacccacttttccgcctccagcgccgccatgcaacctgttccggcagcagtaacggcctgacggtatattttatcttgtacatctcctgccgcgaacacaccggggattgaggtgcagggggttcccgggcgggtcaccacatatccttcttcatccagttccagcttgccacggaagatggcggtattgggggaatggccgattgccacgaaaacgccatccaccggcagtgtgctggtatccccctttatggtgttgcgcaggacaattccatctacgcgatccggcggccccgatgctgtaatgtcctcgaccacactgttccagacgacggagattttgggatgcgcaaacaggcggtcctgaaggattttctcggcccgtaacgaatcgcggcgatggatcaacaccacttcactggcatggtgggtcagatacagggcttcctcaacggcggtattgccgccaccaatcaccgccacgcgcttgccgcgaaagaaaaatccgtcacaggtggcacaggctgatacgcccgccccctgaagtcgtttctcattcggcagccccagccagcgtgcctgggcgccggttgcaatgatgaccgaatccgcttcgaacacatcacccgaatccgcggtgcagcgaaatggggtgcgggtaaagtccacatcggtgatcagatcatacacgatctcggtgccgacatgacgcgcctgcgcttccatctgctccatcaaccaggggccctgcaccgattctgcaaagccggggtagttttcaacgtcggtggtgatggtcaactgcccgccgggctgaaggccgcataccagaatcggtttcatgctggcgcgggcagcgtagatggcggcggtatagccggcaggccctgcaccgataatgagaaccttgctgcgatggatcatggtttttatctatctgaaacacagggacggcatgcctttaggatatgaggccaatcctccttgcgggcaaggaggagccttcgcgcaaagtttttaatttttccggctgagaatggcttgcagccagcacgttgagtcataatattgcgcagtccaagcattcatgacaattttccgtttcaccacgatgagcatccccagcgcatgaccgccgatcattctcttccccatgagctggacgctattgaccggcgcattctggcggaattgcaggccgatggccgcatgaccaatgtcgagctggcgcgtcgtgcgggtatttcggcgcctccctgcctgcggcgtgtccgtcggttggaggaggcgggtattatccgtggctattacgccgataccaacccgcaggcgctgggctgggagatcgagttctttgccattgtcggactggacagtcagaaggaacaggctctggccgagttcgaaaagacggtgggggaatggagcgaggtgcgcgaatgccacatgattcgcggcggcggtgattttctgctgcgtttggtggcacgtgatacggcgcatgaaaatcagctgacccagcgcctgaccggtatggagcgtgttacgcgggtccagacgctccagacgattcgcaccagccgcgatatcgcgggcgtgccgttataaagcggctttgcaggaccagatcaggccctgttgaatttcgcctttgcatgacgcagcgcgaccggcaccagggatagcagcgccaggataaagagcggcaccagtaccgagggactcatcagcgcgtctgtcggagcaagggattgctgtatgctctggcgcaatcctgcgccgaggctgaccgtgatgctgatcaggggtgcgctgccgattgcggtggcgatggcgaatggcagaatgcgatggctggcaaatggcgcggccagcgtactgagccagaatggcaccattggcatgagcctcgctgccagcatataattgaacccgtcccgctggatctgtggggcgatctgatcgagccggtgcaggcaatgtgcgggcagccagcaccgcaggcgcgtcagcatgtatcgtctggtcagatagtgaaaagccgcggccccgagcgttgccccgacaatggcggagacagagccggccagcgtgccgcacaaagctccgcccgccagccccagaaacagaccgcccggcagcagcaacaggacgctgagtgcataggtgagcatatacagggtgaaagtcagcgccgggtgtcggtcagcccagggaagcacctgatcaagccaggaatgaaggacggcaagagcatgttccatgatgggaggtcagactcgcagaaagttaaaaaagcggattacagcgcgggatcgtccgccatgcacagcttctgattgacggatagccattcacccccctataagccgcgcctcggccggtcagatgcgtaggcgtctgcggaccatctgtattgtaccggaaatttcgaccgggcgcgatcccgaagctgggacgcccctagcctcggagagcctgacgtgaagcgtacttatcaaccctcgaaactggtccgcaagcggcggcatggtttccgcgcgcgtatggcgactgttggtggccgcaaggtgattgccaaccggcgttccaagggccgcaagcgtctgtccgcctgatttcggacagccctgtttcggtaaggccggattcgtatgtccctgatatgcggcccggctcccaacgaaagggttccgcagtcatgcgggaaaaacgtctgaagcggcgcgcggagttcctccgcgttgcctcaaaggggcgcaaggccgccgtgcatggtctggttcttcaggccctgcccgcgcaggctgccgacgcccctttgcgcattggctatactgtgaccaagaaagtcggcaatgcggttgtccgcaatcgcacccgtcggcgcttgcgtgaggcggcgcggttggtggcacgggaatacgatcaggccggcacacccttatcggcgcatgatctggttctgattggacgagacagcacgcgcgggcggcctttcgattctctgctggacgatctgcgccgcgctctggccaaggccggagtcatatgatggctggtcgtatcatcggatacgggctgaggcttgcggtgcgtctgtatcaactggttctgcggcccgtgctgggcacgaattgccggtttgttcccagttgcagcgattacgcgcttcaggcattgcgcgaacacggcacttttcagggttccatgcttgcagggcggcgcattctgcgctgcaacccatggcaccagggcggctatgatccggttcctgccggaagatgccgctgcaaagatcattcaggacagacggcgggttgatggaccagaaacggctattcctcgcgattgcgatttccttgggcattctgctgggtttccaggggttgtaccggcatttcgtgccggagcctcctgctgctgcccggacagccacgaatgccgggcagggtaaaccaaataatacgctgggtgcggttccgaccgatgcaacggcctcccagtctcctcctccgaaggaaggggcccgtctggctgtcgatgcgccgcgcgtaaagggcagcatcagcctggtcggcgcgcgtttcgatgatctggtcctgcgcgactatcatgagacggtcgacaagaattccccgttggttcgtctgctggctccgctgagcggagatgagccgtactatgtggaatatggctgggttccggaagaatcgggcatcgctacgccgggccgtgatacggagtggaaggccgatgccgccaccctgacccccaacaagccggtgacgctgagctgggataacggcgcgggcctgaccttcatgctcaaggttgcggtcgatgccgattacatgttctcggtaacccaatccgtgcgcaatacgaccggcaagccggtggtgctgcatccttatgcacgggtgcgccgcgattaccggccggaggtcgagggctataccgttctgcatgaagggctgatcggtgtggttgatggcatcctgcatgagatcacctacaagagcgccgacagcgatggggccaagaataacggccttgctttcgagcatgcctccaccggtggctgggcgggtatcacggacaaatactggctgacggcgctgatccctgatcagataacgtcggttgatttcagtttccgcgacaccaagccgaatggccgggacgggtatcaggtcggcatcatctcccataatccggatcaggtcgcggctggggcagagagcgccagcaccacgcatctgttcgcgggtgccaaggtggtcagcctgctggatcactatcaggcggagtaccacatccccagcttttgggaggcggtcgatttcgggtggttctggttcatcacccggccattcttctatgcgctggactggctgtatcatctggtcggcaatttcggtgtcgccattctgatcttcacggttctggtcaaggcggctttctatccgctggcaagcaaatcctatcgctcgatgagcaagatgcgtctgctggcccccaaaattcagtccctgcgtgaacgctacaaggatgatccgacgcggatgcagcaggaggtcatgcagctttacaaggctgagggcgccaatcccgccagcggctgtctgccgatgctgttgcagttcccgattttcttctcactctacaaggtcatcttcgtgaccatcgaaatgcggcatgccccgttcttcggctggattcacgatctgtcggcggtcgatccgaccaatctgttcaatctgttcgggctgctgcctttcgacccgacccatatctctcccttcctgcatctgggcatctggccgttgatcatgggcggcacaatgtatctgcaacagaagatgaacccgccgatgccggaccctgtgcaggccaggatgttccagttcatgccgatcatctttaccttcatgctggcccgcttccctgtgggactggtgatctactggagttggaacaatctgctgtcgatcgggcagcaatggctgatccagcgccgcaccaagctgccgcgccctgaactggccaaggtctgagcggcgtctatgtctgatcagacgccgcaatttgggcagacgccctcggaagctgaaccggatgcggtggctctggaggccgggcgcaagctctttgccggtgagtgtaccttcttccatggcacgcagaggctggatcagcttccgccgcccatgggggtggagatcgcttttgccggacgttccaatgtgggcaaatccactctggtcaatgccctgaccggacggaaaacgctggcgcgcgcctcatcccagccgggacggaccaagcagctgaatttcttcaacctcgccgaccagctcgtgctggtggatatgccgggatatggctacgcacaggcggcgaaggatgtgaaggaagactggcaggggctgatgttcagctacctgcgcgggcggcccaatctgcgccgggtcatgctgctggtcgatgcacgggtcgagttcaaggcgtccgacattgcggtgatggagctactcgataaggcggctgtcaccttccagctggtcgtgacaaaggcggatgccgtgaagccgacaccgttgcaacgccgtgtcgcggatgtctatgcggcggcccgtgcccatcctgcggcgcatcctcatgtctttgtcaccagcagcgatacaggatcgggaatcgctgagttgcgcgcggccctggccggcctgacggactgagcatccatgcgcggtcaggactggatgccggttctggtgttgctgggtctggtctgtctggctgtagcgggatggaggctgtttccccacctgcaagcattcattatgtttcaggattgcgcggcagcggggcgggttgactgctgaagccgggagaaaaacgctgtcaaaccgactggcttttcacgatttcctgtggctttgtgatcgggttcgactctggaatgatgtcggcgaatgtctttccgaaagcggggaatgatgactttacccgatgcgctgccagtagcacggatcatcgtgcagcctgatgatggtgttgctccggtcgttgaactgatcgcaggcgcaagccgctcggtcagattgaagatgttcacctttacctatgagcctatcatcactgcacttaaggcggctcatgatcggggtgtcagcgtgcgggtcatgctcaatccggcccgttcttcggggtcacgcgcgaatgatgagacgatggcaggattgcgtgccgccggcatcgaagcgatctggtccaatccggctttcccggtcacgcatgaaaagtcgatggtgatcgatgagcagcgtgccttgattgccaccttcaattttgtcgaaaaatatttcacccgcaccagggattatggggcgatcatcgaagatcaggcgacggtcgcggagatcctgcaaggtttcgatgccgactggaaccggcagcctttctggccgcgctcaggttccccactggtgtggagcaatacctccgcccgtacggccatgtgtgcctttattgattcggcgcaggagacgctgtggattcagcaccccaaattcgtcgatgccactgtgctggatcggatcgttgcggcacaggcgaggggtgttgcggtgcgtatcctgtgtggcggccggcatggcatcagcgaggttgacctgctggacacattttcctcactgcgcatcatgcagcgtatggatatagccattcacaagcagaaaacacttcgtgctcatgcgaagctgatgattgccgacaaaacgacggccttgatcggctccatgaatatcgaccgcagcgctttcgatatcaggcgggagctgggcattgtgctgcatggagaggacacaacaaagcatctgcgcgaaatattcaaaagcgactggaaaatctctcatcgctatgatccgccggatccgctgaccgtgcatctgcatgtcgaggatgatcatgagcctcatgatatcgaagtggctcatgaatgatcatatcccgtgtccggatgcatcatgtcgccggatgatgcgataagcccggttgagcgccccagcctgtggcgtatcgcaatgaccttcaaccagattgccttgcttggattcggaggaggcttatccgcgtggtcacgcgatgtactggttctgcgtcgccgctggctcagtgaagaaacctttctgagtgctctgacggtggcgcgtgttctgcccggtgcgaatcaggtcaatctcgccgttttcgtcggcacacgcctgagaggtgtcagcggtgccctggctgccattgccgggctggtgatggtgccatttctgattatccttgccctgagtgtcggctatctggaatttcagcatgcactctggttacagcatgttctggccggcctggcggcgggggctgtcgggctgacattttccatggcctggcagacgggcaggaaagtgctgaccgcgcctgctccagcccttatttttgctgccagtgttctgttatcgtcagtggtccgtatgtctctgctctggatgttgctgatcttgttgccggttagttttctctgggcctggttcaccaacgagaaggacaggcagcggtgatgtcgccgaggctactcgatattattatgctgttcggtggcgcttccctgctgtcattcggtggtggcaacgctatcgtgccgcatcttcagatgcagacggtcgaggtctatcactggctgaccgccgagcaattcgctgatgcctatgccatggcgcaggttgcaccgggaccaagcacattgctggtcaccattctgggttatgatgcagcgggcattccgggggcggtactggccacaatcgccatgctcatccccagcagcctgctggtcttcggagcagccttgctctggaaaagcatgggggagggccggttccggcgtatctttgaacgcgccatggcaccgttggcagtcggactggttctggccagtgggatcatcatcaccaaaagcaatgaccatagctggccggcttatggcattacggcagcctcgacgctggtgctgtgtcggtggcacctgcatccggtggcggtaatggcttgctgtggcgtcattggctggctggtgaaactctgactgttggctccggctttttcattgagccagaccaagcgtatcgcttttgatctgttgtagcgcatagcggaacggcgcatcggaaacagccacaaccccgccaagcggtgttgccatttccatgacgacgaacagggccacgcagatcgaaatggctgaaacaataagagcaacactgatgaaaatgctgaaatcggcattcagcccgtatataaagaaagatgccagcatccacaggatcagcgtgatataaaacggcttgctgatagaggatgttgattgcgaaataatctgccagtgaacccggttcagcggagaaaggcgctcctcaagttcaaattgcagccgcttcttttcgatggttttcggcgtccagtcacgtacgattgcttccatctgcatcagtcttttggcctgagcggttgctttgggggccgggtcattgaaatcatagatgcaatgggccgtaaattctttcagaagcgtctgagcatcggcaatgtcagtcccgtactctataagcagcctgttaaactgaacgatctggatggcttcctcgttcaccgagcgtgagaggctatcatacgcttctttacctgaggtcaccatcaggcccagaacaatggcgccgaatgtcaccagcatgccgatgacggcatgaacgacagccgatgtctcgctgtttcgatgatgcggcggcaggcggatacgcagccatagtccggcacgataggcccccagcagcaccacaaacatcagtgctacggccagaaaattcataagatcgtaataatccatcaggcgggtccgtttctggttccctcgccatcgagcgaatcagcgaggcgggggcacccatagtataaacggagacgtctggcgatcatgcggggataaggaggaggccaggctttcttaagcatctccgtcaggagatgaaaacagacagggcaccccgtataaatctggagtgccctgatgattgttagtcagttccgttcgaaataatgtcagtagccgtaacgaccgggagggggagcggggcgctggtaatagccggtcgggtaagcgttttgctgaggcgtggtgacggcgccgccaacagcccccagtgcaccgcccgccagggcaccgattgcagctcctctgccgcctccggcaattgcccccagcgctgcaccgcctccggcaccaagggccgccccacctatggcccgttggccgggatcataaggattggtgcaggcgccaaggccgagaatgccggcagccagcaatatgcgtcctgcaatacgactgtacatccgcgtgtttccctttctgttcagttttgtccattcttgccaccgtatgaatgtagcagaatggccaaggtcgcagcattattcagtcagtattttgatggcagaaataagacggttttaaggcgcaacaggacagtttcttgacgaatatggtctgttccgtgtgttgtggtgatggcggggactgcccatgccgatggaatgatgtcgagtgaaagagaacgtatgactggcgcgtcgcagacggaggttcacgtgaacaccgatgatttcggctcggcaggggagcaggcgcgaatccttgctcatgctctgccgtttatgcgccgctatgcgggtgcaacagttgtcgtgaaatatggcggtcacgccatgggtgatgagcggctggccgaacagttcggcgctgatatcgctttgctcaagcaggtgggcattaaccccgtggttgtgcatggtggtggcccgcagatcaatgacatgctgaaacgtctggcgatccagtcccgattcgtggatgggttgcgagtgaccgatgcagccatggttgaggtcgtcgagatggtgctggctggtactgtcaacaagatggtcgctggtctgatcaatcgtgcgggcgccatggcggttgggatttgcggcaaggatggcggtctaattcatgcacggaaattacagcgcacagcgatagatcccgacagccatatagagaaagcgcttgatctcggttttgtgggagaacctgctcatattgatgtccgggttattcatgccctgaccggggccgggctgatcccggttattgcgccggttggcatcggggaagacgggcagacatataatatcaatgccgattctgcggctggtgccattgctggggcgttgggggccaagcgtcttctgatgctgacagatgttcccggtgttctggatacggataaaaagctgattccggaaatgagcgcggcggatgttaaggcaggcattgccgatggcacgattacgggtggcatgatcccgaaagtcgaatgctgtgtcgatgcggttgaaaaaggcgtacgcggtgcggtgattctcgatggtcgtcagccgcatgcctgtctgttggaaatgtttacagaagggggaattggcacgctgattcgcggctgagccggatagcgggggaggggagatggcagcatttcccctcctattgttcagtcccgatggtcaggtaccgctcggccgactgcctgcccaaccagcaccagagctggaccgccttcactccagtccggggcggttgcaaccaaatgatccagagtgccgaacagggtgcgttgtgcttctgtcccaccccgttcgatcaacgcggagggcgtgtcagccggaagtcctgcggccagcaatccgtctctcagccgcggcagcgttacaatccccatatagacggccagagttcctcccaactgtaccgcgccgtgaaaatccatttccagtgtgccatctctggtatggccggtgatgaaggttacggcgcgtgccgcctctctatgggtgagcgggatgttggatcctgccgcgcaaccaagggctgcggtaataccgggaacgatctcgaaggggattcctgcttcagccagggcttcggcttcttctccgccgcgaccaaaaataagcgggtcgccccccttgagccgaacgacacgcttaccttcctgtccgagacggaccagcagggcgttgatgtcttcctgccgcatacagtgattggcgcgggccttgccgacaaaaatacggccggcatcacggcggcccatgtcgaggatttcatccgtgaccagccggtcatgcacgatcacatctgcttcacccagcaggcgttgcgcacgcagcgtcagcagatcaggtgcgcccggaccggcacccactaaataaacgattcccttgcgagagattgtgtccggttggttgatggcagcctcgaacagttttccggcttcgttctcctgtccgctcagggcaagatcggcggcgggtccggtcagcagggtttccagagcccggcgcctgatcgccatatcaggaaaagccgcccgtaccttgtccttgaattgctcggccaaagtagcgagcctggcatagttgggtgaaaccagtgcctcaatcttcgcccgcagcaaccgggccagcacaggcgccgcgccaccggaggaaatggcaatggtcaatgggctacggtcaacgatagcaggtgtgataaagctgcataattccgggcgatctactatattgaccggaataccacgctcgattgcggttctggaaagggcttgcagatcctcgtcaggcgcctccgctccgatggcaatagcgcagccgtcgagaagactgggtttgaatgttggcgatatgttcacctcggcaccggctcggcgcagggcctgtgccttacggtctgcggattcgccctggccaataaccagtgctttccgccctataatatccataaatgccgggtagtgacgcatatccgtaaagccttcttcaacgccgtattaagcttccttgctgtcggacaatatccatttcaccatcatttcaaaggtttgagacggtatcgatcctgtgaacagcgtccgggcgactttgtcataaaacagaggtggaatttctccttacgaacatgaaagagaatttatctcatttaagagccattcctatggcggaattggctaccaggaggctaagtgaaagaggatcgttggtcattctgtatctgctgacgggtttctgggcgaagcgttatacatttaaaaggtctgcataattgcctgtgctcgttaccggagtcgctggtttcattggctttcacgtcgcgcgtgccttaatgcgtcagggcgaaaccgttatcggcattgataatctgaacagttattatgatgttggcctcaagcgagctcggcttgctgtgttggaaagagaggcgaggttcagtttctttaaggtcgatctggctgatcgtgtggcgatggccgagtttacgcgaagctgttactcggtggacagaattgtgcatctggcggcacaggccggggtgagatactcgcttcttgatccctacgcctatgtcgcttccaatatcatgggacatctggccattctggagatggcccgtgccctgccggacctgcgtcatctggtctatgccagttcgtcatctgtttacggaggcgatctggaagccccgtttcgggagtcggaacggattgagcggccgctttcgctatatgccgcgacaaagcgtgctgatgagctgatgagcgcggcttatgatcacctgtttgggattcctcagaccggtttgcgcttttttacggcctatggtccgtgggggcgaccggatatggcttattatgccttcgccaaagccattactcagggagaggaaatccagcttttcgatcatggccgattgaagagggattttacctatattgatgatattgtggacggggtgattcgctgcctcgaccgcccacccagttcagcggacggcgcccgtctgatcaatatcggcaataacaggccggaggaagtctcttatctcgttcagtgtctggagaaggcgatcgggaaaaaagcgatgatccggacgttaccctgccccctgacggatgtgcaggaaaccgcagccgatatcacactgattcatgaactgactggtttcaagccacgaacggagctggatgaaggaattcgccgctttgtggcgtggttccgcgactaccatcgcgtctaaggctttctcctttctgtggggtgcctgtggggtggaaaaatgcggtttatgtcaaaaaactgaaaaacctgcttgaccgcctccatcttatcccctagatacccgtccaccgagacggacggctacttgatcttctttctcggttgggataatatcccgggcttcgctaaatcggaatgtcaatcttaacctgaggcggatgcttcggggtgggtttgatttttgtttttgttccttgaaatttgaatgaagatatgaagggatacgcgggcggcgttttgcttagcttttatagttaagtatgtatctgggtggactgatttacttttggtctttctttggtattgacgcttgcttttgatgtatcttggatgcgttgacagtatgtttcgagactgacggttttaggactgtcggagagaccaagggtcgttcgttatgttgggtgcttttgggtgcctggcttgatgaacctgagagtttgatcctggctcagagcgaacgctggcggcatgcttaacacatgcaagtcgcacggtttggtttcggccggacagtggcggacgggtgagtaacgcgtaggtatctgtcctggggtgggggataactgtgggaaactacagctaataccgcatgacacctgagggtcaaaggcgcaagtcgccttgggaggagcctgcgttcgattaggtagttggtggggtaaaggcctaccaagcctacgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcggcggggacgatgatgacggtacccgcagaagaagccccggctaacttcgtgccagcagccgcggtaatacgaagggggctagcgttgctcggaatgactgggcgtaaagggcgcgtaggcggttcgtacagtcagatgtgaaattcccgggctcaacctgggggctgcatttgatacgtgcgggctggagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggttacctagtaactcagtgtcgtagctaacgcggtaagcacaccgcctggggagtacggccgcaaggttgaaactcaaaggaattgacgggggcccgcacaagcggtggagcatgtggtttaattcgaagcaacgcgcagaaccttaccaggacttgacatgggagggctgtgtccagagatggacatttccgcaaggaccctctgcacaggtgctgcatggctgtcgtcagctcgtgtcgtgagatgttgggttaagtcccgcaacgagcgcaaccctcgcctttagttgccagcatgttcgggtgggcactctaaaggaactgccggtgacaagccggaggaaggtggggatgacgtcaagtcctcatggcccttatgtcctgggctacacacgtgctacaatggcggtgacagtgggaagctaggcagtgatgccatgctgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgcgcgaacccgcaagggacgcagccgaccacggtcgggtcagcgactggggtgaagtcgtaacaaggtagccgtaggggaacctgcggctggatcacctcctttcaaggaactgtcctgagttttatccatgcggatggatgaattgggatggttttataagaagtccttcgatgggatcgtcgaaggcactgtcaacctggtgcacctgttcaggcaggaagcgccgtccacgtatcccttctgcgaaaggtggactggattgtcattgaaagatgatggtctggtttattttttgctgcgacgatatctgcttggggctagtagctcagctggttagagcacacgcttgataagcgtggggtcggaggttcaaatcctccctggcccaccatgatgatcggccgctttttgaggaagcggctggtttgatgtgatgggggtgtagctcagctgggagagcacctgctttgcaagcagggggtcgtcggttcgaacccgatcacctccaccattgcgtgtggtgactggcggtttgccgaccggttcccttatcgtcgcatgggttaaaaatttccggtgatagtctggccccggtcgggttctgatatcatgcgggatgggccttcttgttgaaggctctgctatttgttctttgttatggtgaatatgttctggtgcgcctctgcgcatgccttgaccggttgtctgaccggattgacggggagacctgtcgtccacggtgaagggtatcatgatcagaggcgtttaagatgtgctgagtaaaatcacgcagaagcgttgcactgaaaggtgtggatgtcttctgtgcatgatgagcacggattggttgaccgatctgtgttagctcttgagcgcgataagggcattcggtggatgccttggcactaggaggcgatgaaggacgtggcacgctgcgaaaagccatggggagccgcgagcaggcattgatccgtggatatccgaatggggcaacccctccgcaaggagatcacgatctgaatacatagggtcgtgaggcgaacccggggaactgaaacatctcagtacctggaggaaaagacatcaacagagattccgtcagtagtggcgagcgaaagcggaacaggccagtgccttgatattgtgtagcggaacggtctggaaagtccggcgacaaagggtgatagccccgtatgcgatagcgatattaaggacatgagtaaggcgggacacgtgaaatcctgtctgaacatggggggaccaccctccaagcctaaatactccctagtgaccgatagtgaacaagtaccgtgagggaaaggtgaaaagcaccccgacgaggggagtgaaatagacctgaaaccgaatgcctacaagcagtcggagccgcatctgcggtgacggcgtaccttttgtataatgggtcagcgagtttctgtttgcagcaagcttaagccgataggtgtaggcgcagcgaaagcgagtctgaatagggcgtcaagttgcaggtagaagacccgaaaccgagtgatctagccatggccaggctgaaggtgcggtaacacgcactggagggccgaacccacgcctgttgaaaaagtcggggatgagctgtggctaggggtgaaaggccaatcaaactcggagatagctggttctccgcgaaatctattgaggtagatcgtcgcgtgtttacccccgggggtagagcactggatgggctagggggctccaaaggcttaccaaacctaaccaaactccgaataccgggaagtatagcgcggcagacagtccatgggtgctaaggtccgtggacgagagggaaacagcccagaccgccagctaaggtccccaagttgtggctaagtgggaaaggatgtgggaattccaaaacaaccaggaggttggcttagaagcagccatcctttaaagaaagcgtaatagctcactggtctaatagaaatcctgcgccgaaaatgtaacggggctcaagccacacaccgaagctgcgggtgtagagtgatctacgcggtagcggagcgttccgtaggcctgtgaagggagatggggtgacccctcctggaggtatcggaagtgcgaatgctgacatgagtagcgacaaacagtgcgagaaacactgtcgccgaaagtccaagggttcctgcgcaaggttaatccacgcagggtgagccggcccctaaggcgagggcgaaagccgtagtcgatgggaatcaggtgaatattcctgagcctgctggaagtgacgaatgtgaagcgttgtggggacttactggattgcccctgcagccggatcgttccaggaaatagctccagcgaatagaccgtacccgaaaccgacacaggtggactggtagagcataccaaggcgcttgagagaacgatgtcgaaggaactaggcaaattgcttgcgtaacttcgggataagcaagacccatgtccgggcaaccgggtgtgggtggcacagaccagggggtagcgactgtttagtaaaaacacagggctctgcgaagtcgagagacgacgtatagggtctgacgcctgcccggtgccggaaggttaagaggaggtgtgcaagcactgaattgaagccccggtaaacggcggccgtaactataacggtcctaaggtagcgaaattccttgtcgggtaagttccgacctgcacgaatggcgtaacgacttccccactgtctccggcatcggctcagcgaaattgaattccccgtgaagatgcggggtacccgcggtcagacggaaagaccctatgaacctttactgcagctttgcagtggcaccaggaaaatgctgtgtaggataggtgggaggctttgaagcatgggcgctagcttgtgtggagccaaccttgaaataccaccctgcgtttttctggtgtctaaccgagaccggtaagcccggtccgggaccctgcatggcgggcagtttgactggggcggtcgcctcccaaatggtaacggaggcgcgcgatggtgggctcaagccggtcggacatcggctgttgagtgcaatggcataagcccgcctgactgcgagagcgacagttcgagcagagacgaaagtcggccatagtgatccggtggtcccgcgtggaagggccatcgctcaacggataaaaggtactctagggataacaggctgatctcccccaagagtccacatcgacggggaggtttggcacctcgatgtcggctcatcacatcctggggctggagcaggtcccaagggttcggctgttcgccgattaaagtggtacgtgagctgggtttagaacgtcgtgagacagttcggtccctatctgccgtgggtgttggagacttgagaggatctgtccctagtacgagaggaccgggatggacgcacctctggtgcaccggttgtcgcgccagcggcacagccgggtagctatgtgcggacgggataaccgctgaaagcatctaagcgggaaacccacctcaaaaccaggtctccctgagggccgtgaaagaccatcacgtcgataggccaggtgtatacgtgcggtaacgcactcagctaactggtcctaatagcccgataggctcaagaacttccatcatgcacagaagtcatccacacatgacaaacagcacatcctaaaaaacaccagaacatcccatcacaacaccacccaaaaaggtgggttggacgacctggtggctatggcggggaaactacacccgatcccatcccgaactcggacgtgaaatgccccagcgcccatggtactgcatctcaagatgcgggagagtaggtcgccgccaggtcttccaacccacccctcacgctacctaccaccacaaacgcggggtggagcagcccggtagctcgtcaggctcataacctgaaggccgcaggttcaaatcctgcccccgcaaccacttccagactttgaaatagaaaccataaagccgatccctcaataatagggatgggcttattttcgtatgtacccaatacaataagcacccaagcagcgattagacacgctgaaatgtgacttattgcaacggctactccccatcgtacaacaagatgattacagtcgtggcatggaaatagtgccgcatattctgatcgttgatgatgaccgggaaatcagggaactcttggccagattcctggagaaaaaccgtttccgtgtgaccgcagtccgtgatagccgcgaggcgcgtcgggcttgggtcaacgggcattttcagctgcttgttcttgatttgatgttgccgggggaaggtggccttgatctggctcgctgggttaggtcccagtctttggttccgatcgttatgctgacagccatgggtgaggagacggatcgcatcgtgggccttgaaatcggtgctgatgactatgttgccaaaccttttaaccccagggaattgcttgctcgtatccgtgcggttctcaggcggacagaaggagaattgagaaccgttgagacagccaatcagaagagcaggcgttttgccggatgggtattggagccagcccgcaggcgtctgatcaatccgcaaggggcggaagttcccttgaccgggggagaatacgatttgctgagcgcgttggtggatcgtcctaaccgtgttttgacccgtgatatgctacttgatctgctgcgggggcgtcaggctggcccctttgatcgggcgattgatgtggcaatcagccgtctgcgccgtaagttggaagatgatggtcgtcagtcgcaactgatcaaaacggttcggagcggtggatacgtgctggctgccaccgttgaaatgatctgatgaccttcattgctgcgtttcagtcatgatgaggcttccattatggccacgtagtctcgccaaccgcacggcgctggttttgaccagtgttctggtcattgttcagttggcggggctggccattcatgctctggatcgcattgatcttcagcaactggctcaggcaagatatgcaggaagtcgcatatcgctgatttatcgcagcgtcatgtcggttcctccggaagagcgccaggcgttgatccagcgtatggatctgccgcccggttatcggctggctctgagccaatctcctcctctgggtgatacccagcctattccgcagacatggatgcaattgctgcgggcggggatgagtttcggtcctccgatgcaggaggtccatccagtcagtattattgtcaggttggacaggccccagcggatgctgcaggtgagtctgcagatgccatctgttaaagatgaaatggataataagatgcatgagcatctatccggtgagtctgaaggcaggtctccttcctggcatcctttggttggaaaagcagggaaacagtggctgacgttgtacattccgcttccgcctgttgaaccgtggcattcaccaacatttctggcggcttttattctgatgacgttaacagccgcatgtctaagcatttgggcaacccgtcgtctgattgcccctgtgcgtaccctgtctcatgctgccgaagcattagggcgtgacgtgaatgccccaccgttagaggaaaaggggccgcgtgaaattgttcaggcggcgcagatatttaatgtgatggcggcccgtatccgtcgctttgtacaggaccggactttcattctatccgccattggtcatgatctgcggacgccaatcacccggctcaaattacgcgcggaatttattgatgatgaagaactgcgccggcgcatgatcgccgatctggatgaacttgaagaaatggtcagtgccactctggcattcgggcgagatgccgatatgcaggagccgatggtactgcttgatttaccagaactggcaaagacaattcttgatgaagcagttgatgcgcgtccagactataccgagcggcttcactatataggtccagatcatttgcctgtacgtggaagaacattgccactgaagcgggcgataacgaatctgctgaataatgcgctcgcctatgggggcagcgcgaccatacggattagcctgtctgtgaatggaatggtcaggatggacatcgaggatgagggaccgggtattccgcccgaggatatggagagggtcttcgacccttaccaaaggctggaaggtagccgcagcagggaaaccggtggatttggtctggggctgcccattgcccgcaatattctacgtgctcatggcggtgatgtcgtgcttagcaatcgccgcgagggaggggcctgtgcctcggtcaccttacctgtttaacgagacgtgaccgaggggaggagacggaacggaactttacgcagctgcggaagcaggctccttgacgacgatacgggtccatccatgggtatcagccaaggtgccgtactggataccaatgatggtgtcatagagtttctgggtcagatcaccgatctttccccgattgatgatgatcttctgcccacgatagccaagctccccgatcggagagatcacggcggccgtgcctgtcccccacatttcagcaagatcgccacgctcggccgctgccatcacctcatggatggaaatggggcgctcattgactgtcatgccccattcacgcatcagagtcaggacagaatcccgcgtgacgccggccaggattgtcccggaactgaggggaggggtaatcacttcattcccgatgcgcagcatgatgttcattgttccgacctcatcgagatattcacgatgaacgccatccaaccacagaacctgcgtatatccttcggcttgcgcatcccgggcggcctgcaagctggctgcatagtttcccgctgttttggcggcacccagccccccctggacggcgcggacatgggtatcggtggccagaattttcacaggattcagcccctccgcataatacgcgccgacaggggaaagaatcacgaaatagatatagctatgagagggatgcacccccagaaacgtttccgaagcaatgacggtcggacgaatgtagagagaggttccggccttgcccggaacccagtcttgatccacctgcaccaaagccgcgatcgactcctcaatcaaagccgggtctaactggggaatacacagcttttcacaggactggttcaggcgttcagcgtggcgggatggcctgaaaatacggacggcgccatctgcgccccggaaagccttcagtccgtcgaacacggactgggcatagtgcaggacgcagcaggccggatcgaaggtgaacggagcgtacggtacaatacgagggtcgtgccaaccttgcccttcatcatagttcataatgaacatatggtctgagaacgtccgcccgaagcgtaaatcatcatcatgaggacgctgtttcggagatgtcgttcgtgtgaccggaaaagacattagccgggaactcctgggcagtaggaccgaaacagcacggtaggcaggtatagcagccaccgatcaagaaacctctcagtgcgacgaccaagcgatctgtcacatatttaaggcgatgttgcggtggtgcacagcttaaatgctcagagatagtcgctatgctgccgtgcagcatcggcggggcactccagcataatgggtgcaaaaacaagctaaaatttaaatcatcggttataaccgtatggttgaaaatctttgttcataatattattatagtaataataaaaataactaaaggttgatttataatagaaaaaaatattctataagtatataaaatatatttgactgattatttatttataaaaatagtaaaattgcttgaatgaaatctatttcatcgtctaacagaacgttgggaagcggagggttattccatgtccagcgttgtcactgttccaggtgccagtggtaccgacgcctatagtacaaacttcacgattaattattattccaaccttgggttgctttcaaagcagcttctggatagtgttctgccacagaattattcggttaataagccgaatactgtgatcaatccgatatcttcaacaaacatgtcggatagcgtcactatttttgagccaggatcaaatgcacgtgtcagtattccgcagggatacgaggtttctgtgcttgctcccatagcagcgggagccgtctccaatacggtttatttcaaccagaacactctcgataatcagcttatcttctttgggcaggcaggtaatcttctgcagctcgaacaaggatctggcactgttgtggggtctcttggtgataatacaatcgttggcggaaccactggcgcatggtctgttatgaccgatggcgggagtagtactgcaggaagcctggttttcggaaacaattcttccatgcaggtcgcctctttgggaacggacacttttgtcggcggctctggggttgcgaccgtggcaacctacggtaatggctcggaaatctggggtgggcagagtggttcctccctcagcttcaccagccattctgacggtattgatacgtatatggggggggctggctctgatacggtattcgccgaaagcagcggtggtttttatcagggtggatccggtaacctcactttcgtcaatgatacgggcagcccgactctattcgggggttccggttcggaaacgctgttcagtggcagcggcaatggtctgtatattcagggcagcggtgcgttctcgctcaccaatggtggtggcacgcaacatgtcttcggcggctctgtcggtggtgtttactatggcggcacgggcggtgaaattgacgtggcccaatccagcgccagcaataccttctttgcgggcaatggtaacgtaaccctgtccagcgctttctcttccggtgataacctgtttataggcggaacagggcggcagtccatcttcggcggttctggtgacgacaccttcttcggtggcgctggtactgccactatctttggtggtggtggagaagatgtctttgccgtggtcaatggtcaggccggtggtaacctcagcatctatgggtttgaagccagctctgatctggctatcctcggatatggtcagactgcgcaggatgttcttaacgctgctcagtcaaccgttgtcggtggagcatccagcctgcagattaccctgtctgactcgaccacaatcacgctggtcggggttaatcagctgaaccagaatcaaatcaccacaacctgatttttgaggctgtcgaaaagaaagtcgccaggttttcctggcggctttttttgtcaaaagtgccaaactattttttctgaagccacatattccatccgggaggtcttatcggaaacgagataaccttaccgggtgccgcattttgaaaacgggcaacactgtcggaaaaacccgcaggagaaacgaccagcatatccggataatgccagtccatgacaataccaaacagggttgtgctgagcagcagcatgccaaccagacggatcgaacgtattttggcctgcaaggtcactacaagaagggccgtgaaccaggccagaataggcatcatataatatctgccccctattcccggccgagcaagtgcttgccattgtggttccacctttgccgccagaggggatatcatcgccactgtcagcatgagggcggcaaataccagaagctttctgaaagcagaactcccggtcttggctgccactgccagcaagaacatgccagaaactgtcacgataaatggtaacagagtgctgtctgcccaccatggctgcctggatatccaggtggccccgttaaaaccggcaagcccacccacaaaaacttgcagcgagacaattttgaaaaaaccggaaacggaagccccgagtggtgcggggagagtgcgcgtgtggtgaaacaccatcaggaacccgagctggatcaatgcggatgcccccatgatgatgagacgcctttgagccgctgtatcctttctctgccaccgctcataaacggcaaatggtgtcagcagaattgaaaagggaccactcaagcccgcaatggccagacagaaagattcccaaatggctcccctggttgttgcagtggcggggctgatcacgatcagaaagcccagcagtgcaagatgccattgggtgttggtcagaatgacgaattcctcgaacccgtaaggcatggtgatcatgaaaccacccagcagaaagcgaattcgccagtcaggtacgagcggcgcaaaacgggatgaggtcacatatattgccggggctgcctgtatcagaagcgcaatcacagcaaaaaaaaccggcacatctcccagtggcaaagattgggccagcaacgctacaatccgggaggcagtttgcagatagcctacatgaggcagcaataagctcgaccatccgtgctggtaggcattctgataccagatgccatcttcagcccacaaagtggcatgatgcagaccaagcggataccggacagccagtgtcaccaaacagaaggcggaaaataagagccaataaaactgttggcgcttccacggaatcgaagaaaggaaatcgggggagggctgctggtctgtatgctcaggaggcatttgcaaatctttgttttggtctcaatgacagcaaaggcatttcgaaatatcgaaaagatgcccatgatagaataagaggcagagtcatgatcatgaccgtacccgtcccgcgaccgattttgtcctcaagcacccagatattgacgagttccagaataggaagatggaaaagatatagcccgtaagcctgattgctgagtgccttgacgggtttatccagcaggacaggtagacggcggatctgcagcatggcgggaaggcatagacaggcaccgatctggtacaaagtcaggatataggttcgaaaatagcgacccggcagaggggttggaaacaggagtagatgaatgatcagccccagccccatcagaaaaaacaggttggggtataggaagagcagactgttttttcgcgacagaacagcaagcagcacacccaatgcgatgccatccagacgatgaatgacaattgtgccagatgcctgggcaaataattcaggcgtcagaaaaaaccatcgcgccagatggggggcgatgatcattacgccaagggcaagaccgatcgcccagcttttacgaataagaagacttcctaaaatggccaggctgccaaagataacataaaaccattcttcgattgccagagaccatgtgacggcataccagttttgcgacggcagcggtgtcagcagattttgcgtgaatgtcgcatactgaagcaatgtctgcaccagatgctctgtgggcggataaataactgccagcactagcaagactgcataatacagcggaagtgtccgcgtccagcgccgcaataagaaaatgcgccaattggcgatactcggccctttgtcgacgatatcaagtatcagaccacccacaagaaaaccactgagggcaaaaaaaagatcgacccccagcagcccgaaattaaacagccagttttttaccggtatgccgaaccagtgggaaaatgtgctgagataatggatgaacagaacacataaaatggcgcaggcccggaaaatatccagacctgcacagcgtgtatgatagcctcctgcatgaccatatgcagaggtggccgatggttgggacattttcttatggttcagccggcaatggcaaaatcagtccacccggctcatcactgtcagcagaaataccgtccagaatccacggatggcgggtgcgcatatcgttgatcagatcttcctgattccggcttttattcgtcgttgtacgaagcatggattcgccatgcacccgataaaatccaagaattttatcgagatgtttcccataccatccatattcagccatccggcaccacagatcataatcttcccagcccagtggcatgcgcttatagccaccgatatgggcccatgcggacagcctgatcagagctgttgcatcaatgaaattgccgggtcggaagatggcgggattataatcccgtgcactgaagatcccgtcgccatcgtcgaattcctgcagggacggatagacataggctgcatccgtatccttaatggcttcataaagccgtaccgcggcttccggcatcagcttgttatcggcatccagtggcagcacgaacagcgtttccgcggcgttgaagccggcattgcgcgtcaggctcagaccttgattcgtcttgtttttcaggagcactgcccggccgaagcgggcggcattggtttccatccagtaacgcacgacttccagagaatcatcggttgaacagtcatcaacaacaaccagatgcaactgctcgaccgtttgatcgcggacagattccagcgcctccagtatgtactgacgataattgtagacgggaatgataaccgtcatttccgcatcccgcaggctgtcatgaaagaagacagtctctgtttcgggaatttccggaagcggatgcggccatgcctgccgatgttttatttcccgctcaaaggcccatgccgccgcacggcccgggcgcagcatctggtcaagccagcccgccacaagttcggtgcgcccgtcaggaccatagcgccagagcacatcgtgatatgcggcccgggccatatcccgacgtgcgtcgggattattgagcagttgatcaagcgcatccgcccattcctgcggactgtctgccaacataccggtgaccccatggcggattgcgtcacgatatggaaccgtcggagaagcaatggttggcacgccgacaagagccgcttcgaaatacttcagctcactcttggcctcacaaaaaacgtttccgacttccagcggtgccagattgatatcgaaacgggctatttccgtggggagattttcgagtggcaccagttcgcgccattcaatttggtgctccatggcatgcaggtcggggaattcctcaatatccatggccggccacggaccacgccggaacagaaccagacgacgatccggatcagccttcagggctgccgcaacgatggaagcaatctgggcaaaatctttctgatgagtgcggcttccccccgcatagccgatgcggaccagcggcgtctgtccatgtatatggcgtgtacgaacggcgttgcgtgatgtgctccatgtcgattccacaaagccattcgggatcaggaaggtggctttctgccgccggtgcattctggcggccatcggcagggttggggctgtgcagaaatccgcaatgcgcatcatctgctgcacgcgggagaagagccgcttgacgtctttttcagcgtaattttgcgagcggatcccgtcgataatgttcttttctgcaaaagcgggttcaaacatcagatcgtcacagtcgaatacgatcggcagcttgcgaccattcgcacggtggaaaataatttctgtatcaggcgtccattggctgcgccaaatatagataatatcagcctcggccatttcgtggccgtctctggcttcgggaatggtgcaaatagtagccctgccgcccgcagcgcggatggcatcggcaaaataaacgacccgatagaaatgccccgccgtatgcggctcaccggatatacacagaacgtagggcttacgtttgtcgtctgcagtcaagactggcggctgaatgacttcatccggttcggaggcattgtctgcttctgtgtcgtattccgcgatgactggttccggctctttgacaggcgcttcggcatgagaggagggcgctatctggcgctgttcgcttctgccatgcagctcataatgctccagcgccgtcagaccggcactgatcgaatccggataacgccggatatagaacgtggtagagaaatctggtccgggatcccgttcttcctgggttccgtacagaatataatggataaccggatcagttttactgctatcgagatcctgatacgtatccagataccagcgcgcatcgaacagagggctatccttgatgatgcggtacgcccgtttgattttttttctgttgcgatatcggaccatcaatgatgaaggcacgattttttgtataacacttgaaaataacgagcgctgaggctgttgctgggcgatggccaggcgcatccgcagcaggccggcttcttccagatgcagatcccgttcacgctgcaatgcctgtgcatggttggcggcatcggcgagctgtagatgagcatgcgcaatctgatgatgggcgttatccagctgctgacggatattctcggattgctggccggcattctgcagggcattccaggtctgtcgaagctcatgctccaccacggcaagtgtttgccttgtattgatcagggcagcccgtgtggtgccccgttcctgttcaacccatttcaggcgccgatattgttcggcaataatctgatgatctttggcaaagcctgcctgaatatccgcgatctcagcttcccgatgctccttgagcgctttcagctcgtcaagctgggcgtagatttttctgtccagatcactggtatggataaaaagactttccggcgtttcgggaagaggatcatccgaagcaatggccagcaggtaggtcgcacgcggcaggccgttggaggcttcagcatgcaggtcgccacggtgttcgatcaccagcggcagcggactggcaggtattgccagtccgggcaaagccggaatctgttcggctgcaatcgcgctgccaatgaaggcgcgttgtcccatggagcggacatgcctgaaattcgatagcagcagggaatgaaattcaaggcgtgtcagctcgtgcacatggtgcgggttggagccttggtcagggggagaataaatatcacgttccgggctggaaatgatcaacagaccgcccgggcgcagcaccctgcgcaactcggccataaaagattggtggtcgtataaatgctctatggtttcaaaagaaactattctatcaactgactggtccggtaatggaatggcaattccactcccttccatgaaagtgaggttcgggcggcgatagtgtaaacgagaatgggcaatggcatcatgagcgatgtctaccccggtgacggagcgtgctacctgggccagaatagccgtcccatatccttcgccagaggcaatatcgagcacatccagcccacggcagaaatgcctggccagataatagcggtgcaaatgttcaatttcgatgcggccagagacggtcgaggtaaagcgctcaccggtaaattcgagaccatcgctggctcgttcctggcggaagatttctcccaaccgctttctcctcttaaagatgctttgttattaaatatgcaggttagcaaacctgtatattcctgccgtgacatgcgatcatgtgcaagtgcggttcctccgaccatcctgttggtcggaggatatgaacattaagggcttttacactttgtctggccagctatcgacggaagcagaacttgaccttttacgcgaagagctggctcaggccaggctttcagaggctgagttaagggcgcaggtggccgtcctgacggctcaactggacatggctcggatatcaggtctggcccgtcagcaggaccgcaggctggattgggggcggctgcgcagaaaaatatcaaggaatttaaagcgttccgccggcaggctactgggcaaaccaccctctccatcgtcgggcggccctggtgtgcctgttctgcggatcgacaaagacactttccgggagcaagcccggcaggaattggaaagctttctggattcggaggaacgcctggttttctatggcggtgagactccggacatctcgattttgctggtgctttataaccaggcccccctgacataccgatgcctgcgttcgatcatggagcacgctgctcctctacaggtgcgagtcgtcattgcagataatgcgtcgtctgatgagacatcgcgtctgctggatcgcattgatggggcggtgatcctcaggaacaaggacaatctgcatttcctgcgcggggtcaatctggcggcggaccatgcggcgggtccggggctgctattgctcaacaatgatgccatgctgcggccgggaacgttgcaggcggcatggaacgcattgaacgctgcaccggatatcggtgcggttggcggccccatcattctgccggacggcaccttgcaggaagccggaagcattatctggagcgacggcacctgccttggctatggaagggggcgcaaccctctggaggcggaattccagttcaggcgtgacgtggattactgctccggggctttcctgctggtgcggagaaaggcgttcgaggcgttgggaaggttggatacagcctttgcgcccgcttattacgaggaaaccgatttctgcatgcggctgcgggaagccggatacagaattgtgtacgaacctgatgcggcgatcgatcacttcgagtttgccagcgcgacctcttccgcctcggcgctggcattgcaggcaaccaaccatgaacgcttcagaacccggcatcagcagatattgaagcgcgagcatcatgctcccggaaccgatcccctgttcgcccgcgcccgggacagtggaaagggccgtgtactggttattgacgaccgggttccgtttccgtccctcggcgcaggctatccccgcgcggcagaactgactctggctctggtcgcggagggctggtcggttacctattatccgcttctgacccccaatgattcctgggacgagatctacactttgttcccacgggaagtggaagttgccctgaatgaaggggtggatgggctgcgccgtctgattgataagcgggatggctattacgacacgattttcgtcagccgcccccataatatgcggctgtttctggaccatatttccacccgcccgtctgcccgcctcatttatgatgcggaggcggttttcgcacagcgcagcattctccagatgacgctggaaggtcatcctcccggcgcagccagacgaaaggagatgctggaggcggaaatgagtatggcccgtctggcagaccgtatcgtcaccgtctctccgcatgagaaaattctgttcacgcagggaggttgtgcagatgtccatgtgctgggccatgcacaggcaccggcccctactggaaacggcttcgatcagagatcgggttatctgttcgtcggtgcgcttgatgacgatccgtcccccaatctggacagtctgctgtggtttgccagcgatgtcatgcctctattgaccagagcaatgccggagaactggacccttcaggtggcgggccgtgcaggcgcacgccgtgccaaggcgctacaggggcctcgtattgccatattgggcagagtcgaggatctggacgcattgtacgagaccgccagggtttttattgcgcccacccgctatgcggctggtattcccttgaaagtctgcgaagcggcggcacgcggggttcctgttgtggccactgccctgctggcgcgccagctcggttggacgcatgagaaagagttgctggttgccgataacgcagaggaatttgcagacgcctgcgctcgtctgtatcgggaccaggctttgtgggaacggcttcgtcaggccgccctgaagcgtgttgagcaggaatacagccccgatttcttcagaaaccgggtggcggagatcatgtcccctgccatagagagccatgctctgcggcatgtgccggatgcatggcctgcgatggcttccgcactggtcaacacggtggctgcggatggcaggcaggcgccaggcagaatggcagtcgcccgttatcaggcgtatcgtgctctgcggcttgtgcggggggccagacagtatgcagtgcggcatggcctgtcgaaaacggtccagcgtgcgtggcttgagattctgaaacgcgtcgggaagcgtaatttcagtctctggagccagttttacgatacgctggatgacaaggacattgcggccatccatcggcatatggccaacttggtggagcgtccaaccttcgatgtgcgtatgcgctgggatggtgatgaggccacgctgcgggcttgtgtgacgtcgctgcaggagcaagcatatcagcgctggacgatgctgctgttgtcagcgcccgatgtttctccactccctgaatggtggcaggcgctggcgcgggaggacagccgattctcctcattgctgccgaccggaaaaataagacggcgtttttacacggtgctgctggagccgggggaccatttacgctcccatgccctgtatctgctggcggctgaagcggatcaggcaccgggtgccgtcatgctctacacggatgacgagattgccggggcagaggttcaaccgcatttctatccggaatggtctgaggaaagcctgcgtgacccctgcgcgctggatggtctggtggccatcagaagcgatctgctgcctgatggcgatctgctgacgggggcgctgtggcggcatcgtgtgtgggcgcaggcggttgctggttctgaaccgtcagaagtaagccacatagcccatattgccatccagcgaagggttcgggcggccccggatcggtcggaatggctcgatactcttcaggtgcaatgcccggacggagcacagattgtcgatgcaccgcatgggccgcgcattgtctatccgctgcccatgcagccgccgctggtcagtatcattattcccaccaaggaccatgcggcactcgtgcgccaatgcgtcgaaggactgctttacaggacgtattatcctgcgatcgaggtgattatcgtcgataatggcagtgtcgagcctgcgacggcgcgtgttctgaaggcccttcaggatgacgatgaccgcgtctcggttctgcgtgatgatggccccttcaattattcagccctcaacaacaaggcagccaggctgacgaaaggcgaggtcatcgcgctcgtcaataatgacattgtggtgagggagccggactggctgcgggagatggtgtcccagctgctgcgaccgaatgtcggggtggtgggggccaagctgctctatgggaatggaacggtgcagcatgccggggtgatcaccggcctgcatggcggtgtggcatcccatgttttccggcagagtccccccgatgccgaaggctatgatcgtcggcttgtccgtgtgcaggatatgtcttgcgtaacggcggcctgcatggtgatcaggcgtgatgtgtttgaaactgtaggggggctggatgagaaaaacctgcctgtttcctacaatgacgtcgatttctgtctgcgggtgaaacaggctggatggcgtgtcctttggacccctcatgcggtgctggatcatctggaatccatcagccgtggtgaagacacacagcaatccaacgccgagcgtgcacatcgggagtatctctatatgctgcggcagtgggagcatgtgctggggcaggatcccacctacaaccccaatctgtcattgcagacggagttcacgctttcctatccgccgcgtatccgtaagccctggtatcgctacaagtaagagactctcagccttgctcaagctgttccttgagcaaggcaatgttcagccagcgttcttccgtctcagccagcgttgcctcggtggtggccagtgcttctgatgttttcgagaaggtggccgggtctttcctgaacagatccgcatcctccagcttgcttcgcagccgggcgatctcctcttccaaaacggcgattttggcgggcaacgtatcgaaagcatgctggtctttataggatagcctgccctttggtgacggtgttctggcggcagcctgcgccggtttggtacggagagccgccggttttccggtcgtgccggatatgggggcatcgccaacgccctgaccgcgctgcgccaccatatcactgtagccaccggcatattccgtccagacgccgttaccttctgcgaccacgacgctgccgacagtacgatccagaaaatcacggtcgtggctgacgatgatgacagtgccgggatgatcggcgatgatttcctgaagcagttccagagtttcgaggtcaagatcgttggtcggctcgtccagcaccagcagattgcacggcttggccagtgcccgggccagcataagccgcccgcgttccccacctgacagcaccccgaccggtgtgcgggcctgttccggtttgaacaggaaatcctttatatagccgatgacatggcgactttggccgttgacgatgacctgatcgccgcgcccttcggtcagcgtatcggcaagggtacggctgtcgtccagactggcacggcgctggtcgagcgtttcgaccaccagattggtgcccagtttgatcgtgccggtatcgggttcgagcgtgccggtcaggagggagaggagggtcgttttacccgcgccgttgcgtccgacgatgccgatccggtctccgcgcagaatacgcagggtcaatgtgttgatgatggttgtatcagcgaagcttttggagatgtcctcggcatcgatcacgattttgccggatagctgggcatccgccgcgttcattttgagtgatgactggccgggtctggtctccttgaaccgtgcccggagagagtgaagatcacccagccgtttctggttgcgtttgcgtctggccgtcacgccatagcggagccagtcttcttccatggcgatcttgcggccgagtttgtgatgatcgcgctcttcctgctccagcacctgatcacgccattcctcgaaatgggaaaagccctgatccagccgacgggtgatgccgccatcaatccagacgatggagcgggagagatcggtcagcagttttcggtcatggctgatcaacaccaacgcgccgcgcatggatttcagctcggcttccagccattcgatggcggggagatcaagatgattggtcggctcgtccagcagcaggatgtcgggatcgggggcaagcgcccgcgccaatgcggcgcggcgtacctcccccccggaaaggttgacgggcgtgcgctccccagccagccccagctgctccagcagataggcggcacgatatgggtcgtcggaagggccttgcccggctgtcacataatccagcagcgtagcatggccgctcagatcgggttcctgcggcagatagcgcacagtcgtgcctggctgcacgaaacaggtaccgctatccggcttcagcaatccggcggcgaccttgaggaaggtggatttaccggaaccgttacgcccgaccagacataaccggtcaccggcagcaacattgagttcagccccggtcagcagcggcgcgctgcccaaagacagatgaatatcgctcagaagaagaaggggaggggccatggccccgcttttacgctctgtatcagtcgattggcgagaggggttggtaatcgtattcaggcattcaatgatgggagaagtttttggaagcaccctgcttatgaaccccgaccggtcgggatccggcccggatgatggaggtatgagtatgggggagtctatttgttggtatgtacgaagcaggatggtgcgtagaacgcatcagggaagcaaggaaggaccggccccatttgacggggtcttcctgctgtagtctctgccacaacgcttcccatcgcgcccggcgttcggccagaggcatggagagcgcccgtgcaatcgtctcggcaagtgaatcctgatcatgaggattgacgatgagcgcctcctccagatgatcagccgcaccggcgaatcgggaaaggatcagcacaccggggtcttccgggcgctgggcggcgataaattccttggcgaccagattcatgccgtcccgcgctggcgtcaccagcgcaactttggccagccgcatataaccggcaataatctccctccggccagcctgcgtgacaaggcgcagaggctgccagtgcggtgtgcccatctctgcattgatggcccctgcttcccgcgtgacatcttctttcagtcgacgataggcctcgacatcctgacgtgaggcagcggcaatctgtaacaggctggtcagttcgcgccactctggatgccgaagcagaaactggcgataggccccgattttctgccgcaagcctttggtgggatcgagccgatcaacccccagaatcagggattgcgtgcccagactttcctgaagggcgcgatattccggcccttccatcgcgatgctggcggtctgtgcaaaaccgcgtgcatcaatggcggcaggaaagacaccgagtctgacgcggtgcccctgcatggtttccagggtgggaggtaaaccttttacaagaccggcctgatgggcggcctgactgaaatggtccatatcggaggtgctctggaaaccaatcagatcggcttgcagcatctcgcgtaccaacccgtccatgccgggtacggtctgaagggtttcatgcatacagaacggaatatgcaggaaaaagccgatcggattacgcaaccctttctggcgcagcatgccggccaggggcaggaaatgataatcgtgaatccagatgaagtcgtcgggtttcagcagtgtggacacaaggtcggcgaaacgttggttgaccgcccggtaagtcgctgcatcctgctgacgaaagcgcaccagatcgggcattccgtgcaacaatggccagagagtgccgttagcgaagcgattataaaatccgtcatgctcatgacggcacagatcgatggtcgcgtaatcaacctgcccgtcagcctgatggtggatggtatcttccccatcgtcactgatccgaccactccagccgaaccataatcctcccttgctttgcagcagacccgacaaggcgacagcaagccccccagcaagcgaatcgttgcctggcagcggcacgcggttggatatgacgaccagacgactcatcctgcctccagcagagcgacaggaaggatattgaacagatcttccgcccttatccgggcaggcagagcgttcgtctccatcccatccagcagatttttgacctttcggccctgaaactgacgcggtacgtggatgaaagttcctttccatgacgttgccggaacggtccacagttctgactgcgtctgctccgcaaggggcaaggaaccgttgctgccagagtgaggctgagccggggaagaggaaaaatcatcttcatttcgcagccgcaccgtcagccttgtgacagctgtcagcgcagcacgtccctcatgcgcccgaacaaaggcaagaatatggccggattgaggcccttccacctttaacggcagataggttcctgcttcgaacaggcctggtgcccggcggcgcaagcgcaaggcagccgccagaattgcctgcttgatatgtccgtcatgccagtgcccggccagactggctgcctctgccttgttttcatcctgcaaagcggccatgcgggatggaaaatcaactggtcgacggttatcagggtcgaccagactgaaatcccagaactctgccccctgatagagatcggggattccgggggatgtcgctttcagcagagtctgcgacaggctgttgcaggcgcctgctgccatgataccggatgcgaaagccgccatgtcctgtgctacttttgccgggcggtccggattgagcagatcggacagaaaactgcggcaggcggattcatatgcctcatcgggtgcagcccactcggagtggcgcttggcctcccgcaatgctttttcctgccatgccgcgatacgctcgatgaaaatggccatgccttccctgttgtcgggtgacaggccaaagggccatgcgccgatcagcatctgatacagcatggcctcatcggcttcgtcgggtgccggatgatgctcgatctcccgtcgcaggggcgcgttcaggcggctccaccgcatgacggcgttttcccagatctctggaagttcggacagaaccgcgatgcgtgcgcgtgtatcctcgccacgtttgtggtcatgggtggcagtggccagcaggccgcgatgccagcgtttgcgacggtccgtattggcggcatgaaaggcggctggagtcagcgcgaattgctgcggctcggcgccgacttcattgcgggacagcaggcgtccatagcgataaaatgccgtatcctccaccgatttggcattggtcggggcggaaagctgttggaaccgtaccatggcgcgtaaccattcctgacgcctgggtcctgccggcacctgccgcagcccgctgccggccagccatcttccgaccagatcaagcaggccgatatcagcagagcgtacggttttccgggccccggcaatcgcccagtccaactcccgctcatcagattccgccatccctccaagcccggcatagatacgatacacgtggaaatgaaccagaatttcgaccagtacccgtcggatggcggtgagcgtataatcccgcgtatgtggatcgcggcgggcaagacgatgcagggcggcagctgtggcaaaggtctcgctggacaggctttcgcgtagaatttgccgtctggccgccttggcctcatcctcgaaatcaccgggacgatgcgtgaggctggtccagaaatgcgtcagcggcgcttctccgtacggatcatgcagcagggctgacacctgactcatgaaatcatagccggtggtgccatcggtcagccagtcggcaggcagtttctcatgcggggcgaggattttctccacccagatcaccggtttaatatgtcgcaactccaccggcctgctttccgttgcggcttcaagcctgcgccgcagcttccggcaatagccgcgaggatctgccagcccgtctacatggtcgatccgcagcccatcgatcagcccacgcgtataaagggaaagcgtatactcatgggttgcatcgaacacatgcggcacttcgacccgaaccccggcaagaccgttgatgtcgaaaaaccgccgccagttgatctcatcggaggctgcccgccagaagctcagccggtaatgctgccgttccagcaggcggtgcaggcgttcccgccccgccggctgatgaggatcgaaggcgcgcagggcatgatctattccgctccgcagggaaggctcgcgcaattgctgccgcaagtcttcgacctgccgtcgggtgctgtcgcggcccgcaggaagttcggcgatgtcgcgggcgatttcctccagccggccaccttcggcggacaaaatcgtcacatattcccgcggggtcacgggaaagcggtgagacccatagcagctgataaaaagccgcccgtcctgatcatcaaaatgaagggtgatatcgccctggtccagagcgtcgccgtaggggctgccgagaaaaggtgccagtatacgaccgcgcagggatgaatccggtggatcccagtcaatgtcaaaaaactcggcataggggctggagcgtccccattccagcacgtcgagccaccagagattatcggtgccgccgacccccatatggttgggcacgatatccaggatcaaacccatatcgtgctgccgtaaagcagcgaccatcgtttgcagcgctgcctcatccccgatttcggggttcagctgagtgtgatcgacaatgtcgtagccgtgagtcgatccgggacgcgccttcagcaaaggggaggcatagagatggctgatacccagactggccagataggggaccagtttcgtgccatcggcgagggtgaaatccttgtggaattgcagtctggccgtggcgctgatgctcatgaggggcggcttttttccaattcctgcaagcgatgcgacacgtccggggagtcgaacaatgcttccgctgctccattgaaacgacggcgccagttcggatgttccctgtaagtccccggaagattcggctgttcgcgtaatccgagcgcatcttctatcggcaacagcacgagggtcgagttcgtacggccgatatgacggatcgctgcatccacggcagggctggtattatgtgcctcgggcgcatcgccttgagccgcgcccgatgcctgcatggcaccccacagggcttgtctgtcacgctcgcgttcttcgtaactgagccagatagccgtgtcgtcacccagcaagccgagtgacttccgggtttccagatcatggccgctccaccaccccgcaacgggggcaaggtcgtgcgtgctggtcatggcgacggcggtgcgggaataatattcaggcggtttgaagccatgttctccgcgctcgaaatacagcacacgcaatccatgtacggcacgggcctgaagcgcgtcactaaacccttccggtacggtccccagatcctcgcccaggaccaatgcctgatgcgcatggctttccagcgcgatcaggcgcagcatatcctgcaacggaaagcgcagataagcgccttcggtcgcgcgcgcgccttccggcaacacccaaagccgggcaatacccatcacatgatcgatccgtaccccgcccgcatggcgcagggcggcgcgcagcatttcaatgaaagcgctgaatccttgctccatcagaccgacgggggagaaagccgtcaggccccaatcctgcccctgcggactgagcagatcggggggtgcgcctacggacaggccgatcagcgtttctttctgccggctccagcaatgactgccgcctccatccgtgccgacggcgagatcggtgatcagcccgatctccatcccgctttcccgcgcagcatgctgggcatgagccagcccacgctcggccagaaattgcaggaaggcatggaaatcgacttcttttgcatgctcgactgcaaaacgctgtacggtgagggaggcagggtgacgatactcctccggccagctccgccagttccagcgggacgggtcggttccgaagaaatgcccgtgcagggcttcaaaacgggcgtggtcctccaccattttgccaggaccggcccgccatgcggtgaagtcgggatgggtgccgcccagcgcatcgaacagggcgcgatagcggcgcagacgcagacgcgtggcggcaggccagtcaatcaggctgaggctttccagatgctggcgctcggcctctccttccgggaaggaaaaaccgtccagaagaccggcatcgtcgccatgcagcacattgagcgcaatacggctggagggagaatacgggctgaatcggtccggatcggcgctgaactgggcatggaccggactgatgccgatcgcgtgcgcaccctgccgtgcggcggcgggagcaaagcgggccagcgcggcgaaatcaccaatgcccccatctccttcgcggcggagggcataaagctgtgctgccaccccccagcttccatgacgggggcgtttgcactcggccggagcattggcaatagtgatgcgctgtccggctatttccagactgtgataaccgggttcttcaatgggtggcaggctttcgccaggattgagtgttccgctgcggcgtgtgccgttctccagcgtcagttcccacgcgccttcctgctgcccgagcgaaatgggctgccccgcatcggcggtcatcaggggaggaagatgccgcccgtcttcccgtgcctgaagaatggcgaggctgtccgcaatctggcccggactgtcgccgggcagtcctattgcccgcaatacggcccgcaatgtatccggggagacggcattatcatgtccgaaagcatctctgtaccaggtagatactccggcacggtcggcaaggcgatggaggtcttcatcaatcacggaacatcctcggcgctggcttccttgaaccatagcgcggtggtggctaccggcaacagggtgtgattggaggatgggtcgcgcgtactgaaaatggcttttccggctatcggaggcaggggaaccggttctgtgccgagattgatgccgatactcatgagtgcgccatctcccagcttccaccgtgccagcagggcgccctgacctagaatatcaacccctgcgctgcgtgttcctgccaggcggggcagcaacagagtatgacgcagtgacagcagtatctgccggaatgccagtgcatcccgcccctgctgtgtctgagcagcgctaaagtcggggattgagcgggtaaaggtcgtctcggcatttgggtcagggatatgctcccgtttttccggatcctgaaaggcggagaaatgtttgaactcagcccgccgtccttctctgacggcgtcggcaagttcgtcgtgatggtcagtaaaaaacaaaaatggtgtatgtgattcccattcctcgcccatataaagcagaggtatttgaggcataaggatctgcaacgcggtagccgcccgtaaggcgtcatgatccgtcagggtgatcagacgctcccccatggcacgattgccgatctggtcatgattttgcaggcagatgatgaaagcggtcgtaggcagcccatcggcgggatggccacgatgctggccgctatggcgtgatacttctccctgataggcgaagccgtcactcagacaacgtgccagaaggttggtagcatcctcgaaatcttcataatatccttcggtttctccggtcagcagcacatggagacagtgatggaaatcgtcagtccattgcgcgtcgtaatatgcgccgttcttggccgggcggagcaggggggaaacattgccctcatgttccagcatcagatgcacatgacggtctgatggcgtgatttgttcccgaatcaggcgcgccatgtccggcaaaaaagattgtggctctatggcatgggtggcatcgaagcgaagcccgtcaaagcggaattcgttcagccagtaaagcgcgttgtcgacgaaataatcctgaacctccgaccgtgtaaaatcgatggcggcaccccaaggcgtatgtttgctttcgtcaaaaaaatctttggcataaacatgggcataggcaccatcaggcccgaaatgattgtataccacatccagatagaccatcaggcccagcccgtgcgcagtgtctatcaaagctttcagatcgtccgggctgccatacgccgtatcgggggcatagggtagaacaccgtcatatccccagtttctcgctcccggaaaatcagccaacggcatgagttcaagagcggtgatcccgatagttttgagggaaggcagataatcgacgatgcctttgaatccgccaaaagcgcctggatgaagttcatagagaatggcttcatgccatggccggcctttccattccgtatgcttccagacataggtagcgggatcggtgacgatgctccagccatgtacatctccgtcctgacagcgagaggcagggtcaggaacagcaagcccatcaggcaggatgaatttatatctggttccggcagatgcactctgttcatactcatgccagccgccatcaagggcctgcatcggtacaggatcatgaccctgaatctggagtgacatgagggtgatatccggtgcccagatgcggaaacgggtgatgtcgtcctttcgcatcacgccatgtctggtgggccatttataccgcgccattgcgatcagctttccggcttcagaatgatggttgccagtggtggtagcgtcagttgcagggatgcgggatggtgatggctgggcgttgcatccgccatgcgtcccccgccattgccggtattggagccgccataaattcccgcgtccgtgttgagaatttcccgccagtatccaccctgcggcacaccaattcgataatcatgacgtggtacgggtgtcagattgcacaccaccagaaccggagcatcggaatctgctccgtaccgcatataggcgaaaacgctctgcgtcctgtcgtcgatcaccagccatgaaaaaccatcccacgcgcaatccttgcgatacagggccggttccgcgcgatacagcatgttcagatcggccaccagacgttgaacaccctgatggttcgggcggtccagcagataccagtcggtaccatggccttcgctccattcctgttcctgggcaatctcgccgcccataaacagcagctttttgccgggatgcgtccacatgaagccataataggcacgcagattggcaaaacgctgccattcatcgcccggcatgcgcccaagcaaggaacgtttcccatgcacgacttcatcatgcgaaagcggaagaacaaatttctcgctgaaggcatagaccagtccaaacgtcatctgatcatgatgccagctgcgattgacggggtcttcctgcatataatgcagcgtgtcatgcatccatcccatgttccatttatagtcgaagcccaacccgccttcatgggctggtctggtaacacccggccatgcggtgctttcctcagcgatcagaacggcgcccggtgcacgggatttcacaacagtgctgagatgttgaaggaaactgacggattccagattttcccggccaccatacatgttcggtatccattcaccatgcttgcggctgtaatcgcgatacagcatggaagcgacggcatcgacgcgcagcgcatcagcatggaaataagtaagccagtgaactgcgctggaaatcaggaaggcccgtacttcattgcggcccagattatagatgtaggtattccagtcgtagtgataaccctcgcgcgggtcttcatgttcgtaaagtgcggtgccatcgaagcgggccagcccatgcgcatcagtgggaaaatgcgcaggtacccagtcgagaataacgccgatacccacttcatgcagtcggttcaccagagaagcaaaggattccggtgtgccgagacgtgccatcggcgcaaactgcccgagcggttgatagccccatgaaccgccgaacggatgttccatgaccggcagaaattcgacatgggtaaagcccagcgactgcacatagggaatcagccgatcggcaagagtgttccagtctccacatttcgccggcatccaggaggttggatgaacctcataaatcgaaatcggctggtcagccgcctgtaatctgccgcgctgctgcatccattgttcgtccgtccactgaaacggagcaggggaggcgacgatcgaagccgtggcaggaggaatttccgcataccaggccaccggatcggctttcaaaggtaaaagctctccgttcgggccgagcaattcgtatttatagatcgttcctgcggtcagaccgggaatgaacagctcccatacccctgcctccacgcgtttgcgcatggggtggcagcggccgtcccaatggttgaagctgccaatcacggaggcacgggtggcatttggcgcccataccgcgaaacggaccccttcgacctcccgtccgtccggactgtgcatggtggtgacatgggcacccaaaacacgtcctagatcctcatgccgcccttcagccagcaggtaaacatccagatcgccaagcagattaggaaaaacatagggatcatctatgatatccgtcccggtcgcggtcacgattttcaggcggtaacctgtcctgcccggcagacgggcggcaaaaattccgtcgccatgcacacggtgcagtgtggcgatctcctgtccactctccggatttatcgccaccacgctggtggcttcaggttggaagctgcgcaggaccacaccctcacgggtggtatggatgcccaatacgctgaacggatcgccatgccggccatgtatgatcgcggtggctacatcgggatggatgagggtgtctgggtccagcgcattcattcaggaatgtccttcatcggtagccggagaggagggggatgcaccgaaaaccagatggtacagccccgccactggaatgccgatccagcccggccggttggcggcttcgtagcgtatttcgtaggcagctttttcaatcaggaacagcgtcagcagtggctcgatcccttccggctgaacccagggcgtatctgctgaacgcaaaacctccagataggcatcaaggaaactgcgtgtggcactctgccggaactgttgcaacaaatgatcccgtcgttccgtcatctgtgcagcgccggcaatggtcagcgacatgccgccggaggaggccgcatagtcaaaactgcgcagcaaacccgcaacgtctcgcaaaccattgcctttggcgcgtcgctgctccagcggacgggcaggctcgccctcgaaatcgatcaggtaggcgtcatcctgcacgaccagcacttgtccaagatggaaatccccgtgaatccgggtctttattgcgcctgctccctttgtggcgagtgtatcgaggcgttctactatttccgcctcctgagctagcagagctctgacctgatcggcagtttcgttggaagcaaactccgtcatgccatgtagcaggcggaaggcgtcgcgcacctgttcccgcgcactgtcggcccagccctgcaagtcatggacatcgacggcaacagggctgaaatcaggattgtcatcgggccatgtcaggatcgcatgcatttccgcaagacgacggccgatagcggaggccagcacattataaccgccgaacaggtcactttccgttgtgccactgcgaccggtgacggcatattcctccaccgcccggctgaggaaatccagcgtccattgccacgcatcgccctgattgcgtacgaagccctgtgccagcgccagcgtatgcggtgtgccatcggggccgatccgcaccatctcgccataaagcggtgctgtattcgcaaagccgcgttcagtcagcacccgcgtcatctcgccctcgggatggataccgctgctgacacgacggatcagcttgaagacgatcgtttctcccaaaatcagcgaagaattggactgttcggctgaaagacggcgaatttccggatccggcggcaaagtaagctccgccagaaggggggtcggacgaaattctattgtgccatcatccacgctcaatgagctgtgattattggcagcacggcgcaggcttgtcatcagtgcgcccgtcaggctgtccaccgcgaaggcatcggtaagatagcccacccttcgtccacgtcgtacacgggccagggcaagctgtgcgaccagcgggctgctgatatcatcctcccacacaataccgagtggaagcgtataacgttcggtaaatgagccgagctgaacttcgacctcacccagcagcaccggatcaccctcatggccgccgaggcgcgccatgtaggcaaagcgtgcggctttgaccctttcgcctttcgcgccgaaccagcgccgtttgggcagataggcggggaggctttcagtttccagaattttgcggttctgtgcttccagaacctcgctgatgtcggaacggatcaccaccgttgcataatccggcagggattcggatgggggcgtgtaccaatgtggcagatgctcgctctgggccagcacgaaccagaagaaaccataagggggtagcgtcaacagatacggcaattgcccaacggggggaaaagcagagccaccgaccatgtccaccgggacgcgtccactgaaggcgctgatgtccagctcgactgcctgcgccgagcgggacagattgcagatacagagaatggtctgctcattgccgctatcctcatgttcacgcagataggccagaactttacggttctccggatacaggaaacgcagcgtgccgcgcccgaaagccgtgaactgcctgcgtaccgccaacatgcggcgcatccagttcagcagggaatgctggtccgctgcctgtgcttccacattgacggcctgaaatccatagactgggtccatgatcgtcggcagaaccagtgctgccggattagcacgggaaaaaccgccattgcggtcgctggaccattgcatcggcgtgcgcaccccatcacggtcgccgagatggatattgtcgcccataccgatttcatcgccgtaataaataaccggcgttcccggcatggagagcagcaacccgttcatcaattcgatacggcggcggtcatgttccagcagcggtgccagacggcggcgaatgcccagattgatgcgtgcccttcgatcagcagcgtatgtgctccatagatagtctcgttcgctatccgtgaccatttccagcgtcaactcgtcatggttgcgcagaaacaccgcccactgacagagagctggaatttcaggtgtctgccgcatgatgtcggtgaccgggaagcggtcctcccgtgcaatggccatatacatgcggggcatcagcggaaaatgaaacgacatatggcattcatcgccctcgccgaaatattgctgcgcgtcttccggccattgattggcttctgccagcagcattctgcccggcgcatgcgcatcgagttctgcgcgaatgcgtttcagaatatcgtgcgtttcaggaaggttttcattattggtgccctcgcgctccaccagataaggcacggcatcaaggcgcaatccatcaacaccaatatccagccagaaccgcatcaccgacagaacttcctgcaagacgcggggattgtcgaaattcagatcaggctgatgggagtagaagcggtgccagaaataggctttggccgtttcatcccatgtccagttggatttctctgtgtcgagaaagataattctggtgccgctatattttttgtcgtcgtcggaccagacataaaaattgcgtgctgccgatccgggcttactttcccgggcttttttgaaccatgggtgttggtcggacgtatgattgaccaccagctccgtaatcaccctcagcccgcgcgcatgggcttcggctacaaagcggcggaaatcggccagtgatccgtaatctttatggacccccctgtaatcggcaatatcatatccgtcatcgcgccggggagaaggatagaaaggcagcagccatatggccgtgaccccgagctcggcaatatagtcgagttttgaaagaagtcctttaaagtcaccaattccgtcattgtcgccatcgaagaatgatttgacgtgcaactggtagatgattgcatctttgtaccagagcggatcttcaatgggtgacagtgcggtgtttttgctcatgtgaactccaatcaacttggtcttcaggccagtcaaagcacaaggaaaaatttggtcagacttcccgccggcagtgttgtcagatggcggatctggcgcgccagatggcataggggcgcgtccatggatcaagccggatatgctggatctttccggtccagatgaaatcatcgccggagatgagatcctccatcacaagtgaaccgtgatcgggaagattccaaagccagagaggtatttcgatgtctgtttcctgagcattgaaagggtcgacagtcaccgcaatcagcagaacattttgccggtcgggagtcgctttttcatagaacaggacggcatcattccatgccgtcagaaaccgcaccgtcaaatgggattgaagcgccggattgtcacgccgcagacgattgagcacgcgaatgtcgtcgacgatattgccggggcgatcccagtcccatgccttgatctcgtatttttcggactccgcatattcttccttgccgggcagggcacggccttcgcagagttcaaatccactgtaaacgccccacaatcccgataatgttgctgccagtgcagcacggatacgaaaaccagggcgtccggatgtctggagaaaagtggggttgatgtccggcgtattgacgaagaaattgggcctaaaaaattcccgcgttgatgtgccgatcagctcctgcaaatactccgccagctccgccttgctattgcgccaggtaaagtaagtgtaggactgggaaaaaccgattttcgccagacgatacataattttgggccgggtaaatgcctcggccagaaacagcgtgtcggggtgggttttacgtatttccgcaatcaaccattgccagaagggaaacggtttcgtgtgtggattatccacgcggaagatcctgacaccctccgttacccacatcatgactacatgatagagggcaacccataaatcaggtatcgccttgtcgctgtaaaaatcgacattgacgatgtcctgatattttttgggcggattttcagcatatttgatcgtgccatccgggcgccatgcgaaccagcctggatgctgtttcagccatgggtggtcgggggaacactgcaccgcgaaatccaatgccaattccagcccgtgtcttgcggcctcatcgcgcagatgccggaaatcctccagtgttcccagttcaggatgaagggcgtcatggccgcccacctccgatccgatggcataggggctgccgggatcggtatccgaaggtgtcagggtattattgcgccctttgcggttttgccgaccaatgggatggatcggagggaaatacagcacatcaaagcccatatcgcggatacggggcagatgtttttctacatcccggaaggtgccatggcgctccggatcatcgctcatggagcgtgggaatatttcgtaccagcttgcaaaacgtgccgcctgccgctctgcttcgacaggataaaaggctgagcgtgtccggaatggacgaggatcaagggaagccagatgctctgccgtgccgggtgccagcagagcagcccgtgtggcttgatcatcggcataggtaagggctttcaggccatccgggacatcagcgtgtccctcgatcaggcgctcgaccagtaatcttccttcctgaagctccagtgtgatgtcgtttccggcttcgtattttttgcgcagttcctcgcgataggtgccgaattcatctcgccatgcctcgatacagaagacatggtctcccagcctggtcagggggaaggaaccctgccaccgatcattgcccagcggctgcatccggctttcatgccagccggtttcatcctttgcgcgccataatacgctgactgcctgaacgtcatggccttcgcagagaatatccgcttccactgtgacggtttcaccgacggtgcgtcgggcgggaaagtctccgtcattcacagcggggctgacattttcaatggcaatccgtgcccaatggctggcattcaatgctgagtcgatgacggaaagcgacgccctctcgacaatgggaggagcgggcgaaacctcgatgtccaccgtgccgagcgggctgatggtgatcggaacaggattgcgcagggaaagcgctgtgcgggacgcggccagcagatcagcgggaggggtgacactcgatgtcgtgctggtatttaccagcaggagacgtcccgacccatcagttccgctgcgcaggcacgcgatcaattctgcaccgggcgcactgatcagcacggcgctacgactgaacctggccagaaaatgcgcccgatcattggcctgacggagggcgatattgcgggcggaagcctgatcatccgcctgcccccatgaagccgtcaccgacagaccggtgcccaggatggccgccagttcagcctgaaagataaagcgggtatcatcgtcatgctccggcagcggatgaatcaccgcggcaatccgttgcagggcagccagttcccgccagaaccatatcccgatcccatcccaccaaggataggatgaaagaacatgggtcaggcctgtctgctcgaaatcctgaagacgatgaataggtgttccggccatatccccgatcagcagcctgccttcccgagatgccaagtcggtgaaatgacggattgctgccgatgaggcgtcctgcaatccgccaatcaggaggccgtccagcgtgtccagaatgggagaaagagatggcagagcatccagatcaccagtgtcgatacccaaaatgacgccaatgtctgccgcacgcgcctgtcgtatcaggctactgagaaggggaacactgatcccgcccgcatctgccgcaaagtgggccgttaccacgacatgggtaaatccgtcctgcctgaattggaccatccggtgcagggtgctctgccagtcctcctcccgctccagcgctgggagggccgggaggcgagccagggtgacggcttttgcccctgtcatatgttgactgactggcttggcgatctgatccagaacttgcatggatacggtgtctgctccgaaaagagggacgtcgatcctgtcgacacttctccccagaaagcgcctcgcagcggaatgggttcctcaccggaagctcaagtaggggggaaggcaccgtgcttattgacccgcaggcatgccttcaccccaatgatacaccacctgtcactgcctgataggtcgtaatggcgagtgtcatcggttcgaaaggtttggtgatgacaaaagccggttccgtatgctccccggtcaacagacgctccggataggccgtcacgaaaatcaccggtgcctgatggtgcgccagaatacgggagacagcctgcatgccatctccacccttgccaaggttgatatcggccagaatcaggccgggacggtgtttcagggccatctccacggcttcctgctccgaggctgccagcccgacgacatgatggccgcagctttgcaccagctcttcaatatccatcgcgataatcggctcatcctcgataatcaaaacattggccgaagcggcattacgcagattgctgcgcgcatccgccaacagggaggccgcctgatccttgctcaggcccataatcggtccgatcgcctccaccggaacttcctccagatgggaaagaagaagactctgccgctgctggatcgaaagcggcccatgatctgatggggcttcggcagaaaactgctgtgtgacccaatgatacagcccgaaacgggcattatcctgtggataacgcgactctgcagcggtcaatgcctgccgcaggctggaggcaacaagggcatcgcctttttcctgatttccggccagcgctctggcgtaacggcgtgcatagggcagggcttgaagcaattcatcgcgggacaggctctgcatccgtatcattccttggctctgcgcttgcgcatgcgcgcgccgctgttactgtgcccccatgacacgacaaccgcgtcacgcgggttctcctttatcatccgcttctcattcgcgtgccgtgaaacctgctccgggaccgggggaggagaatcaggcgtcgctgtcggatgctgaccaacagcatggcgcggctgaactccgcgtgcaaatagcaactttgttgccggagttgcgtggctatgcgcggtttctggccagggaccgtcatgccgcggatgatctggtgcaggatgccgttctgcgggcgctgggtgcgcttgatcagtttcagcctgataccagcctgagagcatggattttcactattctgcggaatgttttttatgagcaggcccgccacctcaggacagagcgcagggtgctggaagatgtcgggcaggccggagagagcatgggcgttgccttccatataacggaacaggatcagcgtcaggatctgaaagatatcgaaaagctgatctggtcgttatcaccactgctgcgggaagcattgatgctgatcggggcccatggaatggagtatgaggaggctgccagaatctgtggagtttcggccggggccatgaaggtccgcgtctctcgtgcccggcggattttgagccaggcggcagaatatggggtcagtgagaatgattaagttattgaaaaatatactttaaaaataaaaagaggcggtcgggatttttttggtatcggccgatgtaaccttttttctcctgcttcattgtcctcatgaagacagaaggaaaaaccctatggcgaccgagagcttccacgatcaagtgatagctattctgccgaaactgcgggttcaggcactgtttctgaccaggaatcgggcagtggctgaggatctggtgcaggatgcggtttgcaatgcactgtccgccagcgagagcttcgttccaggaaccaattttgcagcctggatgcatcgaatcttgcgcaaccgatttatttccaatctccgcaaacgccgcgatatcacggatattgatgacgtgccggcatcattttttgcaacagacgcagcccatgaggaccgtctggcgctgaaggaacttggcaaggcaatggagcgccttccggttgatcagcgtgaggcgctcgtcatggtcgtcatccacggcatgagctatgaagacctcgccgaggcaaccggttgcgctgtggggactgctaaaagccgcgttttccgggcgcgccgtcagctggaggcctggctgatgggtgaagaccgctccgaagccgcccgcgacgggaaagtatcccgtattgcgacgaagaaggcggctactgcacaacatgatttgcgtggtttacaggcacaatgaacggccgggcatcaaccagaaggttgatgcccattggctaagtccatgccagtgcagtatgctgatcccagccgataggctggtcggtaatcattgccagccgcataaaccaagaaatatcgtgtcgatgaaaaagcggaaggatgacaggcctgcatcagaatccggttccgcgaagaccgatggggcctttgatctttggctccagcgtagtctgcatcagatttttgacgatatcgcaaaagaaccaataccggaggagttgctgcgtctgatcgagaaggatcgtgcaaaataaggcatgttcggcagccggccagcctcatctgttttcttttggaagattatggctgtcgatgaggggttctttcagaatccgtctcatggggcttgttctgctcgctgttgctcctgtttttgtacgtgcggtctctattgaatggtcgaattaccggcattcttcttatcatgctgaattagccgctctggatactgttaccgaatatcagcactcttttcttcgccagataaacggcacgcaggaggttttgaaaaccttgtctcccgcggtgctggagttcgtgcagcacgatattgcctgctctaccttacttgagaccgtccaagccttgaaaaaaggaagcattctctggctggctgtttttcagccgggtcggggtaatttatgtgacagtgtcacagaagatcagcccgctccatcacagagcctgcttgatgggatgatcaaagataagtctttgccggcttatgaggaaaaaaattccccgcaaaatgcgcccgaatggcatgtcatcatccggtatgctctttccggccagaatgtcggtccatggcttttgagcgatatgcgtttgcacattgctcccaaatttgcagattcccatgtctggttgatcgacaaaggtaaaggggtggcgggggacattgaaaatggtcttccccgatctgtgccgctgctttcgttgcatgacagacagaacactgtcttttccgatatgtcgcgtagtggggaacattccgcatacgggtatgttgcgttgacagatcaaactggttttctgctgggtctgtcagagggaagaaatcatttcgccgcctaccgggttttcatatcacgggtgggagaatttctgctgctggtgctgtgcggtctgctggctgtctggatcgccaccgatctgagcgttaccagacccctgcgacggttcacgcatcgcgtgatgcagtggcgcaccatggatatcgaggatgtcagcaaagatctgccgcttccttctgagcttcgtgccttgtctgacacatttgatcaggcggttattgccgtcagacaaagggaaaatgagctgaccacagttcataaacagcaagaattgctgatgatggaaattcatcatcgggtcaaaaataacctgcaaatcattgcctccctgcttaatctccagtcatcccgcattcgcctgcctcaggcgaaggcggagtttcaatcggcgcgtgatcgcgtgcgggcgctcgcgacgttacaccggcatctttatacgcagggagaattacaggcgatcaatatgcgcagcttcctgaatgagttgtgtgagcagctgtttcaggcattcggggaagtgccgggtgagcgcatcaacctgcatatcgaggcgccggaggtgcgtatgaccagtgaccaggctgtgcctttggccctgattgtcactgaagtcgtcagcaatgccgtcaaatatgcttttcctgaccagcggaaagggagcgttctggtgcgtctgacagtcgagaatgacgatgtctgtctggtcattcaggatgatggggtcggcctcaacactgcgcccgtcaaagtggaggcagatatgcgtgatgggctgggacggcagttgataaagggcttttcccgtcagcttggtgctgctctggatgtctcggcagagggcggcacacgctatgagttgcgggtcaggctacgcaatcacgggcgcagatactctgcctcggaggaggctgatctatcggtagaggatgatgagagctaaggctaagccctgaagcgcgccagctcagcccgcccgagattgtccagcagacggacggaaccaagacgcgcagcggtgatcagccgccagtcatctccctccggcaaaatggcgatggaagagagggagctgccctcgatcagagcaaaataatcgacatcgaagccctgtccgttcaacgccgcaattgcgttcttgcagatttcctctgcatcaggggaggaggataaggcatgcccggcctgcaacaatgtcctgaacagcaagggggcaattgcgcgttcctcaggagagagaaagcgattgcgcgatgacatggccagcccgtcttcttcccgttgtgtcggcacgccatggattgcaaccggcagcagaagatcagccgtcaggcgacggatcacctgtaattgctgccagtctttttcgccgaaaaaagcggcatccgggcgcacctgaccgaacagcttcgcgacaacctgcgcgaccccgttgaaatgaccgggacgtctggcgccttcccaccccagagcaggaccgcccatgacaaagccggtcgcatctccgggcgggtacatggtgtccacatccggcagccaggcaatggagcagcccgtgcgttcgagtatggcgatatcgcctttctcatcgcgaggatagcgtgccagatcctctgagggcccgaactgtgtcggatttacaaagacggatgtgacgaccgcataatcctgcgcgattgcggcccggaccagtgattgatggccttcatggagcgcccccatggtcggcacgaaggcgatgcgctttccggcatggcgcaactgatggacagcctgctgcaaggtgggcagggtgcgggcaagatgcatgtgcttgtgatcggtcaggaaaccagaagatcgcagagtttttcgcggctgagggcggtcaggcccagcgcacgctcgaaataccgttcgatagagccatattccagacgaatggcctcgaaagccgcgtgcagcatctcttcatgagcgttgaggagggtggcgcgggcatggcgtggaacacggtccagtaattgctggtccggttcccatagctggttggtggcgaggtaatcttccagaatatcgtcccagcggaccccgactgcgcggaggatcagcgcggcgccgaagcctgtgcggtccttgccgatgctgcagtgaagcagcaggggaatatcattctgcaacagcaggtcgaacatgccgcgatagctcggtccccattccagcgcgtaggcgatataggcccggcgcagaaggtggctgatatcctcgcctgtctgcgccccgcgcgtcagcagctcgataatggagccgccgacggccgggttgatgggcagacgatgaacggtaacgcctggaaggtgcgtaaaaaccgaatcggacaccgcgctttcactctcgctccggaagtcgcagacggctttcaggttcagtgccgcgatctcgggggcaatgttgtcccgatcggcgggaatggcggctgagcggaatacgcgtccgaaacgaaccttcccgcccagacgggtcgaccatcctcccagatcgcgaaaattatgggctgcttccacgcttacctgacgcggaagtgtgccgacctgttgatgtgcgtacattcggccctcctgctgtttccggcgtgggatatccggaaaacccgaaacctgaagctacggatcgccaaaggaaatgccagaccgcatgacgcggggcaggcttacgcccggatcggggcagggcagggtggcgtgggacgcggggatggagttcatcaccggccttaatcttccggggtgacggcggcattctgtcatgatagggacaacccggccctgccgtgtctgaaacgcgcggaagggttgagtttcacgcaaagcgaccgtctggcactggagcggcccgcgatgaggacgctcatcgtcgataattacgactcatttacccataatattctccatctgtttgcccgtgtgaccgggcaggaacccgtgatcgtacgcaacgatgcgggcgcgtgggatggtgcgctgtggcgtgatctgcgccggcagggtttcgatgctgtggtcatcgggccggggccgggccacccgggccgggacggtgatttcggcgtttccgcggatgtgatccgcagcggggcatggcctctgctgggtatctgcctcggtcatcagggcatcgccgcccttgccggggcggaagtggcagccgggccggagccggtgcatggcaaggtctcgttggtgcatcatacggggagcggcctgtttgccggtctgcccaatccgtttccggtcgggcgctaccactcgctgattgcacgccgcccgctgccacaggggttggaagaaacagcctggaccgttccggatcatctggtgatggggcttgccgcccgctcagcaccggtctggggcgttcagtttcaccctgaatctatcctgaccccggatggggagagactggttgcgaatttcagggatctggcgctggcggcacgctcgcaccgtccggtatttcagccgcctgtggcggaggagccggaacccatggcttttccagtgtcggaatttagccataccagccgggtcatcagcctgtgcctgccagtagaaattgataccgaggctgcgtttctgaccttgttcggggcttcaccccatgccttctggcttgatggagccttgagcgagcgcagccgttcgcgctggtcctatctgggggaagcggaaagtgcgcttggctgtgatgcatttcatcacccagagcaggcgcgggatattcttgaggcgctggccagcctggttccccatagggcggagcgaacagagcttccggtgccgttccgcggcggttatgtcggctggttcggctatgaattcgcgcaggcagtcgggggcccggtgcatcgtgcttccccgacaccggatgcgctgctgatgcgggtggagcgactgatcgcggtggatcaccagactggccagacctggctgattgcccctgccggagatgagggctggatcgaacaaacccgtcaggccctggtgcagatgactgccccgtcaccgccggagacaggagaggcctcgtctgttgttttcacggcggatcgcgggcgcaacacctatctttcggatgtcgcgcagtgtctggaatggatcaggcagggtgagacctatcaggtctgtctgaccaatgagatcagctgccagcttcagcttgatccgctgaccctgtaccgcatcgtgcggcggcagaatgcggccccttacgcggcctatctgaaatggcccggcggagcggtgctgagtgcttcccccgagcggtttctgcaagtggatcgccatggtggtgtcgagaccaaaccgatcaagggaacagccccccgcggcactaccccggctcatgatgcggcgctggccgaggcattgcgggacaatgtgaaggaacgtgctgaaaacaccatgattgtggatttgctgcgcaacgacctttcccgcgtctgtataccgggcagtgtgacggtaccggcgctgtgcgcgatcgagacttatgccacggtgcatcaactggtcagcacggtgcgcggatgtttgcgaccgggagaaggtattgccgggctgatccgggcgactttccccggcgggtcgatgaccggttgtccgaaacatcgcacgctcgatctgatagaccgtctggagcagcgcccgcgtgggatttactccggtgccctggggtggatcggtgatgacggagcggctgatctcagcatcgtcatccgtactatcgtgatgcagggggatcgcctgtctattggcgtggggggcgggatcgtcgcccaatccgtgccggagcgagaacatgcggagatgctgctgaaggcgcaggcaccgatgcgcgccatcgtcactgccgcaaccggaggctggagcgaggaacgctgtattctgaaagagcgtacgcgatgacgcagcccctctgctggatcaacgggcaggttctgccgctctccgaagccggactttcgccgatggatcgtggcgcgatgctgggcgatggcgtgttcgagaccattctgatgaggcatggccgtctgatctgggttgccgaccacctgcgccgcctgcgggaaggggcgcaggtgctgtccatcccggtgccgatggaggatgaggcgatgcgctccggcctgatcgctctggccaaagcggccgggctgacggatgccgcgctgcgtttgaccctgacgcggggggaggctgcaaaacgtggtatctggccgccgggggagccggtttgcccggttctttatgccaccattgccgccaaagccgctgatacgctgatcctgtcctctgtccgggtgacggtgtgtgcggtaacccggcggaatgctgattcgccgctctcccgcatcaaatcgcttgcgtatggtgatgccattctggcccggcaggaggcggagcgtcggggcgctcaggatgccgtgctgctcaataccagaggagacgtagcctgtgccgcggccgggaacgtgttcctcgggcttgagaatggcgcatgggtcacgcccgcgctggagtgcggaatccttcccggtctgacccgtgcccgcttgatcccgctgctgaaagcccgggaggaaagcgtgtccgtggagacgcttcgccatgcctcccggctgctgatcgtgaacagtctgggatgcacgatggcggcctccataatggatggaaacggtgaaagcctcttggcgacggagcttcccttcgatacggacctcctttaccgatgcatgaattgagcgggaggcgcggatgacacgcatgctgaccagcgtcaccgggccagaagaagcggaagtcgcgcttgccggcggtgctgatattattgatctgaaagacccatccatcggggcgctgggggctgtttcgccggatgtggtgcggcacacggtcgatgcggtggcccgttgggatgctgcgcataaccattccggtcacaaggtcagcgccgtgacgggcgatctgccgatggacccggcgctgatcgttcaggctgccgaagccatggttgaggcgggtgttcactatgtcaaaatcggctttttcgagggtgatccccagaaggtgctggacgcgctggcccctctttccggtcgggtgaggctggttgcggtgctgtttgctgaccggaaacccgatctggccattctgcccaccctgaaaggcgccggtttttatggcgcgatgctcgataccgctgataagggcgcgggtggtttgctcagccatatgaaggccccggcgttgctggatttcacccgcgcctgccgcaggatcgggctggagccaggtctggccggatcgctggaagagccggatgtgccacgcctgctgctgctggcccctgcttttctcggtttccgccgtgccttgacggagggtgcccgtgctggcgccgtgacgctggagcgtgtgcgtacggtgcgggcgctgatcccgcgcgtggccgagccgaatggggccggggtggttgattaccgcgtgctggcgacccgtggttacacgcctgatccgcaaggcgacatgtcgctggcggatcgtattttcgtgcgcgatctggtgctgccggtgcgcatcggtacctatgagcgagagcgggagaaaccgcagaaagtccgcttcacggtggaggttctggttgcgcatccgcgttaccagaccgacgatatgcagaatgtgttttcgtatgacgttatcaccgatggcatcgccatgctggtggaacatggtcatgtcgggttggtggaaacgctggccgagcgtatcgctgctttcgtgatcgtgcacccgcgtgtgatgaaggctaccgtcacggtcgagaagctggaagtcggcaccggcatcgttggcgtgaccatcgagcgcacccgcgaaacggcttacagtgctgcggcggatgcgctgtttgcctatggtggtgccgccggatgacgctggtcgtcaaactcggcggcagccatgcggatacgcatttgcgacgggattggttgctggcgattggccgtggtgccgggcggatcgtgctggtgccggggggcgggccttttgcggatactgtgcgggcgatgcaacccgtgattggctttcacgacgcggcagcgcatgaaatggcgctgctggcgatggcccagtttggtctggcattgtgcggtagtgaagccgggcaggaagcccgcctcgttccggcggcttccatgacggagattgaaacggcgcttggcgatggtctggtcccagtctggatgccggcggcgatgctgcgtggtgctccggacattcaggaaacatgggatgtgacctcggacagccttgccatctggctggcaacccggcttggggccgaggttgtactgattatcaagcgagattcggcggggagcgtggatcctgcttttcaggcgatgcgcgtgcgctatcgggggcgggtgctgatcgccgggccggaagatattcccgtctccgggctggatgcagcccatccgccaggacatgaaagggtcgtggtatgagcggatcgctcaaggaagaaatggacgcgctggctgaggaaagccgccatatcgtcaaaccgcgctggggctgggccctgaccggatcagggcattatttcaccgaatgtctggatttgatccgcagtctggatcatgtcgatctgttcgtcagtaaagcggcggcggaagtggtcaggatgtaccacaaagatctcaaactgccagacaatgtccgtatttttcgtgatacgactgccagtgcggcgccggtcggtaacttttatttcggtgtttatcataccttggtcgtcgcgccggcaacatcgaatacggttgcaaaatgcgtggttggaatctcggacaatctggccaccaacgtgtttgcgcaggcgggaaaatgccgtgtgcccaccatcgtcttcgcttgcgataccgcaccggaaatggatacggaagctccgtccggcatggtgaaagtctatccgcgccggattgatcttcagaacaccgaacgcctgcgtgatttcgaagcgacgactgttgtcgaaacatatgaggatttgcaggccgcgattgacggtcgccgtagcgcgttcgctcaatcccggtaaatcagcgccatggccgatgcctctgccgaacacatcgtttttttgaccgggcatctggcggaagccagattgcgcgatgtgctgcaagggctggggcagaccccttttacctgggaggtggccaatgtcggtgtgaaggtcgcggcattgatgaccggagccatcgtgcagcgtcgtctgaaaacgccgatacaggcagatcgggttatctttcctggccgggccgggatcgatccggatgaaatgcaggcccatttcggggtgcatttcgaacgggggccggaggaactggccgatcttccccgttttctgggacggaaaggtggtcctcctgatttatccaagcatgatctgagaattttcgcggagatcgtcacggcgattgatctttccccggatgcgattgtcgagcgggcgcgctggcttgccgcggatggggcggatgtcattgatgtcggctgtaagccgggacgtcatttcgcgcatctggaagaccagatccgtgccttgaaacaagctggtttcaaggtcagcgtggatagcggcgatcctgaggaattgcggcgtggcgcgctggctggagcggattttctgctgagcctgaatgaagatacgctggatgtggttgatggcactgcggcggtgcctgtgctgctgtccaaaccacatggtgatctcgacagtttggtccgggcggccagaaaagcggatgccaagggcatcgactatatgctggatccggtgctcgatccgatcaatttcggctttacggattcactgatgcggtatgtgcggatcagggaaatgctgccgaaggctgaaatcatgatgggcaccggtaatctgaccgagctgaccgatgccgatacatccggcatcacggccactctggtcggcatctgcaccgagctgcgtattcgtaatgtgctgatcgtgcatgtcagcccgcatacacgtcgcacggtagcggaacatgatgtcgcgcgccgtatgatgttcgcagcccgtgcccatgcggagttgccacgcaattataccagtgccttgctgcatgttcatgatcgctggccttatgcgcagtcatcggaagacattgccggtcttgccagtgaaatacgcgattccaatttccggattgccgtggcggaagacggtattcacgtttttaacggcgcattgcatcaggtttcggacacggcttttcctttcttcccccatcttggggtagagcaggatggcgcgcatggattttatctcggcgctgaattgatgaaggcggaaatcgcctacgccctcggcaaacgatacacgcaggacgagccactggattggggctgtgccgtgcgtccgggggcagccacggatcgcacgcgtcttgcggatgccgggcatacgctgaaatcgaagcaggagagggaagagcggaaacgtgcatccgacacggcaccagatgcttccccgccgaccgggcaggatgacattccatgattcgtgaaacgattgtgacgactctgtcggtggatggtgtgccgcatctggctccgctcgggctgatccgtgatggcagtgactggatcgtggcgccgtttcatccatccaccacgcttgccaatctgcgcgcgcggggacaggcgacggccagccataccgacgatgtccgtgttttcgcaggctgcctcacgggtcgacgtaattggccactggctccttccgtgtctgtggcaccgccccgtctcgcatcggctctggcccatgaggagctggaggtcatcggggtggaggaagacgatttgcgcccccgtttccgctgtcgggtgaagactgtccagacccatgcgccgtttccgggattcaaccgtgcccagtccgcggtgatcgaggccgccattctcgccagccgcctgcatatgctgcccgtggacaaggtgcgggcggaggtcgattatctcagcatcgccatcaccaagaccgccggcccaagagagcaggaggcgtgggaatggctgctggagaaaatccgcgccgttcacccggacattggcgtatcaatgcctgctgtcagtttgcgggacaactgagatcccagctctggcatttcaattgtgcagccagatcgtgattgcggctttccgtgagggtctggaggcattgcgcattgatcatcggccagatgctgccgccctggtcggggcctccgccggtgcggaacaggcattcccgatcacgatatgcaatccaggccctttgagccgctcgcagcctttgctgactgtcagggtcgatttttttcagaagctgctggtacagcgtgttcatcgtcctgtccgcactggcagccgcctgtgccgcgcattgagagagctgcatctgattgccatcggtgcagtccgcagcaaaaccggtccggcagactacaacaagcaggcccgtcaggcaggaggcgagaaggatcgttcgcatagtctacttgtcctgtttctgcgtcatgtcagcagcatggcaacggcgatggcgggcgcgaagctgccatcgccgcccagtccgggcaggttgccgaaacgctggaagggccgcccgagccgggccgccaacttttccagcactcttatcccgataccggcccctatgaccggagcctccgcaggcagggcgcggttggataacagcaacatggctgcatcctgaatccgccgcagttgcgattcgtgcagccactcggcaaagccgcgcatggcggtgtcggaaaaatccccggcatccgcccccgccatccgtgccagccgccggtgcgagccttcgcagcttttcgccccaccatccgctgagggatattgatctgcggcttcttcgagccatccgagaatccggtagatgtcagcagccgtagcgaaatactcggcggtcagggcagtgatccggccgttcagcggggcatggctggcgatggccatgacgggcgtgcgcaccattccggtatagacgagttccccactctccagccgtcccgcatcggtgtagccgatatcggcgatctttccggcacgcagcaggatcagatcggtggtggtagaccccatatcgatcagcagcccgtcccgcacatggcgggcggcaaggctcgcgctcgcatgccagttagcggaggcgatatcgtccgtgtgctgccctgcatgttccggcagaatccatccggcccgtccgccatacagtttcaggcgtggtaaagactgcgccagccgggctgacagggtagccacaccatcggcacgggaagaaaaaatatctgccagctcgcccgtcatggtggcggcatggcagggcgcatcgccgagatcggccagagcctgtgcaatggcggcatccagatgctccagtccacgccagagcgggcagggatattgatgggcgaccacgatttgcccctgttgacgccgcaccgcctttacatgggcccccccaatgtcccacccgatgaccgtcatgttgttccccatcctgtccgggtatttatagcccgtgtgtgcattgacagaaattcctctataatcggggcgtggacattatacccgtcattgatctgaagcagggacaggtggtgcatgcccggcatggccagcgcgaccggtaccggcctattcagacaccactttgcgcgggcagcgcgccgcgagatgtcgtggccggactgctgaagctgcatccattccgctcgctttatatcgccgatctcgacgcgatcgaggggcagggcagtgctgccccgatcctgcgggcgctgcgacaggattttccggatctcgatgtctgggttgatgccggcatgcgggctgaggacgcgcgcgactggctggatcgtcatacgcatgatcgtctggtgctgggcagtgagtcgcagaatgatacggaagccatgttgtctctgacaggcgagtcacgtgtctgcctgtcactggatttcaggggggatgtgtttcagggaccgcagaggctgtgggaggatgtggctttctggccaaccaggctgattgccatgacgctggcgagggttgggtcggagactgggccggatttgagccgtgtggaagggattgtggtgcgtgcgggccgtgcgcgacgggtctatgcagcgggcggagtacgcaatatcgccgatctggagcggttgaaacaggctggtgccagcggtgcactggttgcaaccgccttgcatggcggcactatcacgcaggatgatctgcgacgcatctgacgtgtcagaaagctgtaacgaataaggctgaaacgaaaaacgcccggccagaggccgggcgtttcgctgtgcgcaaaagtgcgcgcgccaattagttggcggcgaacggatgcttcacgctcttgtactgagagacgacctcagaggccttcggctcaccgcgaacggcgcggacgagggcttccttggtggccttgtagttgtattcctggatcttcttgtcgtcttcggccagccagtggatgaagacgccaacggagatgaacaggtcatcggcttcggcttccgggatgatgccttcggcaacggcttcggcaactgccagagccacgccgtgctgggccgggccgaacatctggacggcctgcttggcgcccttgatggtgaccttgttgaacaggattgtgttcggcttcaccatcaggttcggtgcaaccaccgcgagcagggtggagaagccgtccttgttgttggtgagggcgtttgcgaacgcggtttcggcagcgctgccgcgcgggccaatgatcagatcgatgtgagcgacttcgttaccgtcgccaaccagtgactcgccaaccagggtcttcgtgatgaccgccatggtgtgttcctccgaataaatggcaggataggcttttcctattaccgcatcgggtgcagtatcaggaaaacccgcaacgccgaggccttgaggaccacggcaagcgcgcgaatatcaaccattatcggcgcgatcccgcaaggtgcgcagagagggaataggcgaatattgtcgccacagtcaggtctgcgctggtgccggggttaatcccggcggttttcagtgcggaatcgaaggccagaatttcggtcaacagagcctgaggatgtgcggctgcggcgattcggttgctcagtgcttctgcctgctggcgcgtggtctcggcggtttctgcatcgaaattgcggacaatatggctgtcaggtccggtcgaaaggaaatgcaggaacaccgccagagccgcccactggcggtccggccagcgttttctggcctcggtatagacgggcagggccttgttaaagatgtcctgaaatccgctgctccattgccgggcgatcatgtcatgcccggcggcggcttgcatggcggtcaggatcggcacggtcgcgggggcgcgtacatcgtgctcggcggcttcccccagcccgccgggggagaggatgatgattccatgaaatatggctctggtatcctgtaaaccggtccgcgcgatgatgtcgtgtatggcggaggacgaaacttcccccgactcgaacgccatggcgagcggggcacagagcagcagaatgccgatattggtgttccgctgcaccgcgtcccatgttgcctgtgcggcatcgcggatgcgggggccaaggctggcaccgctgcggcacagggcgggggcggcggcacgggcgctgcggatgaaatcatccatggtggcgccgtgaccatccgcataaacatggatattgcccggcttgggggcctccagctctgccagacaggcatcgacgaaggcttcggtggtaaaggcggtgttcatggcataaaaaccgtcaacggcgcaggctggccagcatccgggaggccagttgctcggcgatgggataggaaaccacctgctgcaaaccacgccagccgggcatgctgttgacctccagcaccagatattgtccgtccgggtcacggatcagatcgaccccggcataggtggctccaacagcctgagcagcccgccgggccagatcgcacatatccgcatccggggtcagggcagaggggatggccccctgacggatattggtgatccagtcatcagcccggcggatcatggcggcgatcacctctccgtcgcagacgaacagcctgtaatcctcgtaaccacgcccatgagcggggataaagcgttgcaggtaatagacgtcgttgacctcctccggcggcggcagatcctctgcccgggcgatcatggtcaggcccttgccctgagaaccgaacaggggcttcagcaccagtctttcctgcaccagctcccgatgggcgatggccagggcagcatcgcgaccgggaacggtccagcttggcggagtgggaagcccggaatgttgcagcaggaaactggtcatggatttatcgacgcagcgttcaatcgcgccgacagaattccagaccggcacccccatcgcgtgcagagcatgcagtacgcccagccggatggtcacggattcgaaactgccccccgcgactgcacgcaccagcacgccatccggcaatctgccatccagcccggggatcagcagcccgtacggctgggtggtgtccagcccgcaatcgctcagacgtactggcagcagcgtggctcccgcagcggaaaaagccgcgcggagcatacgcagatgccagtcctgatcgtcgatgaacacgacgatcaggggagaggagccatttacgggccgggacacggtcgcaggctcgggatcagttgaaggatgcgtccagcagggcctgatcgcgcttaccggcgcggaaggtctcgccggtctcgatggccgtcaccagcacttccgccgggctgaacagggatgggtcgatcttgtagaaatcgcctttcaccgctgcgaagatgtccttgaacggcttgccgtaatcgcgggaggtcgaggcaggcagctgttcggccagcttgcgggcttcctcggcggagcctttgacgaacagatgcacccggcccgcgaagataatcgcatcgttggtgcggcccatggcggtcacgaaatccgggtgcggcggcggcagcggggcggaggcaatgccgtccacgacgttttccagcgggaaatgcagctcatgcgtcttgtgcagggcgacttccagcacgcgccccaccacctgcacggaaccggcgaggctctgcgttggggcatagatgatgccgagattttccggggcgacgcggcattcccgcgccacgcgctcgacaatggcggccggcggcggcttggcggcttccagcaccagcacggcatgggtgctttcatcgcgataggtcagttcctcgaacagcttttcgccccgtgccagggcgcgggccgggccggagccgagcgcgaagaaggagccgttctcgtccttatggtgcaggctccaccctgcatactggctggcaaggcaggaggtaacggggttggaggacgcgacggagacgctgaacggccagttctccagagtctggtcgggcagcagcgtgacggtgccgagaccgcccatgcagatgcgggccagttgcagaccggcggcgatgctgccgggcacggcggagccggcatcaatcagtgtctcgcccaaagaaccggtggatacgccgatttttagttcctcggcattgttgatcatgtcctgcagcaaggcccaggcgcgggcattgacgctgacgggggaagcgttgctcatgatgacgtctccaggcgctgaagaatctcgtttgtgcgatcctctgccagtgctttggcggaggtggcatctgccgcttcggtcaggaccgtgcagacaggcgcgccgcgtgggatgagggtatgcgtccgcgagtgatccgccgtccagtccggccagacaaaatcctcgggaattttgattgaccggggtgcataggccactgcacaggcgcgtgatccggccatcgaagcgagagaaatgaccggctccgggatcgtcccaccgcttgccagcatgtgcagggtgatgagtggctgttccggaaacacgtccagcgtagctccggggcgtggattgatttccagcaggtgaaaaccgtcctcgtgaaccagaaaatccaggctccccagcccgaccagcccgctggcccgcgtcagatcgagcgccgcgtgctggagagcaggggagaggcggccattctctctctctgtgagacgcgccgcaccaccgaaacggaacggtgtgcagggggagggggcggtccattgccggctccatccaatcagcagtggtgcatgcatagggcgacccagcatcagagccgagatcggtatgcccttgacgtgttgctggtagtagcgaccaggcttggcagagcccgggccacgcaccgggtggatatggcttccgccggaaccaccgattcgcttggtcagccaggaatggtcggtaaatgcttctcgcggcggtggagacaggctgatggcagggaatggaacggcgtattcccggcacagagtggccagaaaaagcggatttttcagatcggcgatgcgggggggaggtgtgccctgcaagggatggtgcttttgcagactttccaggacgctggtctggtcctcgaacccgcttccccagatcagcggatgggtctttccggcacaaagcgtatccagcatgcaagccagtgcatgcgcatcgataccgtgatccggacggaagggtagaagggtgtgctgttcggcaagagcgatggtgtcgctgtcaccgaacagatcgcacaccagcggcaccaatccctcccgccgggcggcagaggcgagagcccgcccggaaaaggcgataatcagaacgggactgcccggttttgctgcttctgttgccatatcagcgctgccggtagtccctgctctgcgcagatcagctggcggaagcgatctcacgcgccagatgaaacgcgtcgcggaagtcgaaggagacgatcttgtcgctctccagcatttttttgaacagttcgaactgtgcccggtacttggtatggccgatggccagcgcgccgatgccgatggtcttttcgcccagcttgacccggccggaattcacatccagcccggctacacccagcggcggcacggcattgacgtccgccacgaccagcagatgcggtgcgtctttcagcagcagggagctgatgacctgcaccccggcctttgcggcggtcatcgccacatcgacgcgcttcagcaggtcgcctttcagttcctcggtgctggcatccacggcttcgaccgtgacaccgaagcgatcctgcatttccctggccgattcgctgacctgcttggcgccgttatgcccggcgaggatcacatgcgcgccttccagtgcggcgatgaccccggatgcgtagccaaccacccccgtcgcaccgaacacggcaaccttcagccccttcaaagtttggttgaactccttgcgcagcatggtgtccacatgggcgaccattgcggcggcggtggtgaaggagcctgccggatcggcataaaccgaacagccgaatggggggaccaatgcctttttggattcgtcgatccagtccagcgcctgaccggcattacgcccggcgataaaaatccctgttttcgggccgagccgcggcgggcgggaaaaaattgcgtcctgaaccagaccgttcacctggtcgttggtgacgtccacatacgggatgacggcgtcaaaccccgcatccagcgccatgttcacgtcgaacggactcatctgcttcagtggcgtgagcatgtgcaggatggtcttgtcagccatgagagctgctctcctgtgtcgtgcgtcttgatcaatccgcccggctcgcgcggaccatgatcgggatcatggtgacggaccagagaacagacatatccagccgcgcgcgatgatggtggtgttattcctctatccgatccgcatcgtcctgcaaatcggtatggtcaataatccagattggtatctccgattcagagacatttccgtggcattgcgtcaggtggcttccacctgtgcgccctgattgagcgcccgttgcaccgagactttcagcgatggcatccgtgcgcgcagcagggcggccagacgctctgcctcctgttcattcggtatgatgccgaaaccggccggtccccaggagctttgtcccacgccggcggccccccagccatgcaatagatcgagcgcctcggccacgcgtaggctggcgaagcgtcctccctgcgcgggggcgaaataatcgccgatcaggcgctgtacctgggtgatggcggctccgaagggtgcgatggcgccttccgccagcgcgggcaacacccccatggcgacctggcggcatatctgcccggagacttcttccgtcatcgggggcaggtcggcaaacgcagccagttcagccgatccagcgaggcctgactgatcgtcatccagaatcaggatgaagcgccaatcatctggtaccggcatacgcagcagcatcggcggcacatcggtattggaaccacgtccaccatccatgacgaaaccaccctgttcgaacagggcgacgccaatgccggaacgtgcaccgcgatccagcagcgctgcatcttcgcgtggatgggagggacggttttcgattttgcgcagggctgcactcagggcaagcgcaagctgtgtgccggagccgagacccgaatgggatggaatcgcactttcgaccctgatggtgtaagaggattttacattcagctgatcgagatatcgaatgatgcgatcccgctccggaccttcgacatgcatggtatcggcatgctgaatgctgagcgttgttgtgggcgaatccagcgccagtccgatactgccgaactgtctgccaagaccgccgtgcagatcgagaaaaccgagatgcagtctggccgcgcatcgaacgcgtactgaacgtgtcatcgtttcgcaatggcgtaagagtgataatcggaatgaataaaaccggtcttgcagcgaagacgtggatcggatgggatggacggaacagcgtgcatgacgcatgttccactttcaccgggcggggggcaagaccacgcccgcttttcctgcgcctgtctgacgggcggcgaggctaaccggagggagatgccgatgacggcgcgtgaaaccgccttggcagaggccgagatacagcagcgcctgcaggacggcctctctcattggcgatatgagaatggctggattcgcaggacctatcggacggcaagctggaaagcgactctgatggtcatcaacacggtcggccatctggcggaagcggcgtggcatcatccggatatcacggcgtcctatgcctgggtcgaggtgcgcttgcagacccacactgcaaagggcatcactgaaaaagatttcgcgctggctcgcatgatcgaacaggttgtgcaatggcagccgggcaaggatgacggcccgctggaagggacaccatccggtgaccagcgttttgcttatgtgaaatacgatacctgaaccgttgtgagcgcgatggcgatacgtgacacgggggacgctgcgggcgccctggcctggattgacggccgcgaggccagtttggatgacgcggttgacgctgccgtcgaattgctgcgcgaaggacgcagcccggcgattggcggattggcgaccgacctgaaaggactggaagctgcggtggcgctggcggaggcggtcggcggcacgctggaccatgccgcgtcggaagcggctttccgcgatcttgatctgctgcgggagacgggactggtgacagtcacgcctttgcaggtccgcgcccaggcgcagaccgtggtgctggtcggtgacggggtggaggccatatggccgaatttcgccgccgatctggctctggacgaggcgccgaccatcgccactcatcgtggggagcgccagatcatccgtatcggagcatcctccggcagcgacctgaaagtgaatgaggaagagcttcccgtcattctcggcgcgctgcgtgccgccgtggccggacggaccgtgcgtctgccggcagcgcggctgaaagccgtgcaggcgctggcggaaaccctgaaggcttcatcctatggtgcgatcctgtggtcttccgagacactggatgcgctgtcggtggaaatgctgggtggtctcgtcaatgatctgaacgctacaacgcgctatgctgccctgccggtggcaggccccggcaatgttcagggtgccattcagaccgtagccgggatcaccggtctgccgccgcgtctgggtttcggtcgcgggcgagccgaacatgatccatggcgcttcgacctgctgcgactgatcgacgaggatgagacggattgcctcctctggatcgacgcgctcgattacgaattgccgcctgatacccccgttccggtgatcgccctgaccagtggtgatgaagcgccggagcaggcggcggttgcctttgccgtcggacagcccggtgtggatcatgatgcgatcctgttcgcaggggctgtgggcgggcagatcgaccatccggcctcttccgctgcatcgcggagtgcgcgtccggatgtcgccactattctgggccgcctgcgtgcggcatatgaggcaggctgatgctgacagttctgaaaggcggacggatcgtcgatccggcgcgcgatcgtgatgaagtggccgatctatggcttcaggatggccggattgtcgaggctcccgccaatggtcgggccgatgaggtggtggatgtcagcggctgcgtggtgatggccggggggatcgatatccactcccacatcgccggcaccaatgtgaacacggccaagctgttgctgcccgaactgatcggacaggaaggcggcttcgatggcacgccgatcccgcatgaggtcgggcgtctgtatgtgcagatgggcttcaccaccgtggtggagccggctatttccccgcatgtggcggtgcaggcccatgccgagttgtcacgtatcccctttattgacaccgcaacgctgacggtgctggggaatgatgactatttcctgcggctggtgcgtgatggggagagtgacgcggcactggccgattatgttgcccgcaacatcacggctgcccgcgggctgggcctgaaggtcatcaatccgggcggtgcggcggcattcaaggaaaacctgcgcagcttctcgctggacgatgaagtgccgagctacggcgtttcttcccgccagattttcaaggcggctcagcgggcgcgggacgtgctcggtattccccatccggttcatctgcactgcaacaatctcggcatggccgggaatgtggaaaccgcgatcgcaacgatggatgcggcggaagggctgccggtccatttcgcgcatctccagttctattcctacggtaccgaaggtccgcgcaaattctcctctgctgccgctcggttggcggaggaaatgaacagccgcccgaatgtgaccgccgatgtcgggcaggtcatgttcggtcagacggtgaccatttcttccgatgtgctgcgccagttcgatggccgcgtggccgctttcccgcgcaaatggtcgatcctggatggggacggcaatggcggcggcgtcgtgccttatcgttacaagcgcaccagcttcgtcaacgcactgcaatgggcggcggggcttgagctgttcctgctggtcaatgatccgtggcgtttgttcttcacgaccgatcatcctaatggggcgccgttcacggcttatccggacctcatggccctgctgatgagccgcgatctgcgtgcgcaatggatggagacgctgccgaaagacgcgctggacgccaccacgctgccttctctgaaccgtgagtatgactggcgcgagatcgcgatcatgacccgcgccgctccggcgcgtctgctgggcctgtctgatcgcggtaacctcgctatcggatcgaaggcggatgtgtcggtgtaccgtccgcaggaggacagggctgccatgttccgtgacgcagcctatgttttccgtaacggcgaactggtcgtcaaggatggcaggacgcagcgtacggtgttcggcacgtgcttcacattgcagcccgaattcgacagaagtgtcgaccggcgtctgaaagggtattacgaacaggtctatggcgtgccgcatacgctgttcgatgtacccggtcatctcaagagctttgaaacagtggaatgcgcccaatgagcaaaagcccgggcaaaggaagcaaggcgcccagtaaagcgcccaatgctggccgtactgtacggccaaagcctgtcgcaccgattgtcgtggaacaggctgcaaagaagaaaatttcggcagcatcggcaaaaccgacggcaatcaagacgccgcgtgccgcacgcgttacgaaagtggtggtggacgataccttcgccgaagcgtttgatatgcgcgcgaccggcgtgatcgtgactggcaccaaccgcaaatgggcgcgtcaggcggcggagacgatgaccggcttcgcgacatcggtgattgcctgcggtatcgaggcagggatcgaccgcgaactccgtccggatgaaactccggatggacgccccggcgtgcgggtgctgatgtttggcatgggctggaacgaaatgcagaaacaactgcaaaatcgtgtcggccaatgcgttctgacctgtccgggtgccgcctgctatgatgtcggtattcccgggccggagaagatgaagatcggcagcctgctgcgctatttcggggatggctggcaaatcgcgaagaagctggatggccggcgtttctggcgtattcccgtcatggacggcgaattcgtatgcgaaggcaccacaggctacacgaaaaacgcagtgggtggcggcaatctcatcctgttgggccgctcccccgccgcgacgctgctggcggcggaaaccgcggtcgaggccatgaaagtggtgccggatgtgatcatgccttttccgggtggaattgtccgttccggctccaaggtcggatcgaaatacaagatgctgccggcctccaccaatcatcgtttctgcccgaccttgcacggccaggtggaaaccgatctggatgatgatacgcgcagcgtactggaaatcgtgatcgacggtctgacggcagaggcggtggccgatgccatgcgggccggtatggaagcaatcatgaagctggggcctgataaaggcgcatcccgtatttccgccggtaattacggtggcaagctgggcaggcatcatttcaagctgcgggagttgctgcggtgactattcgtctcactctgaaggcggacccggagcagcgcctcgatctgtccgccttgacgccggaaaagctggatggcctcaacaaggccgccatcgaaaagctggaaatcaacaccactcgtgaagtggtgacagtcggtgacgcgtttaaactgcgtggaaccggtagcgagcagattgtgatcgagggcggttccgaccggctggattacgtcggtgcaggcatggccagcggctccgtgctgctggatggcgatgccggggcctatgccggtcgtggcatgaagggcggtgtattgcagattctcggcagtgccggaccttatgcggcctccgggctgaaaaacggtctgatcgagatttccggtgatgtggcggaacgcctcggcgctcctgcggcgggcgagcagtatggcatggcaggtggcgtggttgtggtccggggggatgccgggccacgggccggggatcggctgcggcgcggcgtgatcgtgattgagggcgatgccggtgaagccgtaggcagccgcatggccgccggcacgattgttgtctgtggtgaggcgcatggtctgccgggctatctgatgcgtcgtggaacgctggtgctgggggcaacggcggaggttctgccgaccttcatcccggtgcatgcgccggatctggtgttcacccgtctgttggtgcgcacgctggaccctgtcagccggaaagcggctcgtctggccagtcgcgcggcatcccgctatgccggcgatggtgccgtgatcggccgaggtgagctgttcctgctcgaagcgtgacagaaacatctttatcccgggatgccgctgaccggtgtcaggcgctgctgacggcggagcaggtattgcgggataaaggcgttgttgcgttgctggtgcaggcgcctgatctcaatggcagcctgcgcaccaagatcacgccgctccggttcgcgaccgagggggaggcattcaacgcgatgttgtatgcctccagcccggcagatggcgcacctgtccatgagccgctctatgacggggtggtgggacggcgggaggatggcttcgccaatattctggcgctgccggatccggatacggtgcgatggcacccttgggatcagggttttgcctcggtttttctgaatacctatctgcctgatggctctccatgtccggtcgatccgcgttacttgctgcgcctccagcaacggcgggcagaggaaatggggttcgaggcgcgattcgggctggaatatgaatgcacgcttttccatgcggatgatgcgctggttcaggcaggtcggtttgatgccctgactccgtacggctgtggggcggtcaattatgatcttcatcgtgacaggggttttcctgattttgctgcggccttgatggcacggcttgatgtgttgggcatccgtgtggccagcatcgtcagcgaatacgggcagggcatttacgagatcgcgcttggtgctgaaacgccattgttggcagcggataatgccatgcgcatgaaatccgtgctgcgccagctctgtgcggagaagggattgctggtgacgttcatggcgcgctcccgtccgccggggtctgagagcggatgcggtctgcatcatcatcaaagcctgtggcgggatggacagaatgtattcgcagatggaggaaatctgtccgcactgggctgctcttatcttgcgggattgctgtccggcatgcgggatgcacatttgctgttccgcccgacaatcaatgcctatcgacgcatggatcgggcggcatggtcacctgatcgggccgattggggcatcgaaaaccggatgagcgctgtgcgtgtcatccctggagccacgtccgggatgatgaggctggagcaccgcgtgccgggtgccgacgtcaatccgtatctgacgatcaccgccatgctggctgccgggctggatggcattcagaacgcagacgtattgtctgatgatgtgggtgatctgccgggtacgatcaaggaatctttgactgcatgggaagaatcagagcgcgtaacacgctggtttggaaatgcattctgcgcacatatggcggcaagggggcatgcggaagtaagagccttcgagcagtggttgatggaccatgtgacgggatttgaataccagcgttatttccacagcgtataagcgagaaagtggacgatcatgatttgatcgtccacttttatcttattctgccggctgcacaaaaatattacggagcgcctgggcggcagaaaccatattaaccagtgctggtctgacctctttccaatgacgggttttcagtccgcaatccggattgacccatatctgttccggcgagagatgacgcagcgccttttgcagaaggtctgtcatttcagtgacactcgggacacggggggagtggatatcatagacacccggcccgatttcgtttggatagcgaaaatcggtgaatacatcgagcaattccattttggagcgcgatgtttcaatggagatgacatcggcatccatcgcggcaatggcatccatgatgtcgttgaattcagagtagcacatatgggtatggatctgggtcgtgtttcggacactgcttgatgacaggcgaaagcaggaaacagcccagtccagataatgctgccattcggaggttttgagcggcaatccttcacgaaaagcaggttcatcaatctggatgattttgattcctgctgcttccagatcagaaacctcatcacgaagcgccagagcgatttgctggcagaccttttcgcgaggaatgtcgtcacgtacgaacgaccattgcagcattgtcaccggtccggtcagcatgcctttgacgggccgctctgtcagagactgtgcgtagcaggcccagtcaaccgtcatggcatggggacgggagacatcgccgaagatgatcggcggccgcacatagcgtgatccatagctctgcacccagccatgtgtggtgaaggcatagccgttcaattgttcaccgaaatactgcaccatgtcattgcgttcgaattctccatgcaccagcacgtcaatgccggtttcttcctgccaccgtattgcctgttcggtttcctgacgcagaaaagcggtgtattcctccgtgctgatacgctgtttcgcatgatcggcccgtgccttacgcacagcatccgtttgtggaaaggaaccgattgttgtcgttgggaacaggttgagtttcagcgctgcgcgctgttcctgcgcccgtgtagagaacggaacctgccgtttcgccatttcaggcgagagggatacaatgcggctctgaacagattcactatgcacttttctggaggatctgcgatgtgatgccgcatctgatgatgctgcaagagcatgggaaacgacatcacgcccatttgccagagccagaccgagcgtcgtcaattcctccattttctgcacggagaaggcaagccattgtctgacttctgaatcaagatcggcttcagcctgtaaatcaactggcacatgcagcatcgagcaggatgttgcaatctgtacccgatctttgcccagttttgccaccacgcgttccagttgattgagctttgccgccagatcagtgcgccagatattccttccatcgataacgcccaatgaaagcacctgatgtgagtgcattgccgacagcacatgatcaagctgttccggtgcccgtaccagatcgagatgcagacccgcgacggggagcgtacgaacagtgtccagcatatcgacaatgctgccgaaataggtggtgagcatgatgttgagggatggcagcgcctgctgcagcgtataatacgcatgacgcagcgccgctttcgtaacggtgtccagatcgagcacgaggcatggctcatccatctgaacccattctgcaccagcatcgtgaagctgtgacagaatttcgatataaacgggaagcagtctgtcgatcagcgaaatcggatcgaaattgccgtccctgcttttactgagagtcagaaacgtaaccggtcccagcagcaccgggcgtgtttccagaccgagtgctctggcctccagatactcatcgagtggtttggaggaagtcagggaaaattgctgatcacgatgcagttccggcaccatgaaatgatagtttgtgtcgaaccatttggtcatttccagcgcggggacagaagcatttccacgcgccatggcaaagtaagtgtcgagtgagaccttgccgccggtccatccataatgctcggggattgctccgaccatcacggtggtatcgagcacatgatcgtaaagcgaaaaatcgttcgacggtatgacggttacaccgagaccatattgtctggcccagtttgccgcccgtaaagcggtggcggttttttgaagcgcatcggcatcggatgcgcctgaccagtaagattccagtgcagatttcagttcacggtgcggaccgatccgcggcacaccgagcgtactgactggcagagaagaaaaagacatcggcttacactccagaagatggaagcaaaggccgagcggacgcatgcaaagttacccgtgatcgcggattggaaaacgggcgtgcaggcgcaccaccgggacaccccgcccagggacgattatggtgtcgtggcaggtctcctggctcacgggtcattgcctgcgatcctgtcttcccgaggcggaagcctcagtgacgtcggtggatgcaggctcgccgcttacagttgcgggggcagctccggctttgctgatgcgcaccggattccctcttggctccggcgttcgtctttgacggacccgcagaaccacgaccaggcatgcttaggaaaaagaatctcatcagtcaatgcggatataaatatatctttatgtaaattttggagatgcattggattgatggcttgtttgttatgttataacataactttattgttttcggctttatggctggtgtgaggatttgccatgacgagtttgtgcctttcttccgcgtctctcgcccgcccgcgtttcctttgtgatgagccaatgccggacatcagcccgttttgtgagaaaacagcgcatcgcatcatggctgccgcgttagagaatggggcggctggttttttccctcgccaactggataaggtggtggcgcatgcgctggaatatacacctgactgcaacctgccggagatgcgtgtgatcgggccttcgtcaggaatggcagctgcagtggaggaggtctgccgggatgccgctttcggcccggcctggctcagggtctggctggcgcaggatatactggcgcttgggcgtctgtttcaggccatcactggcgcgaaggaacttctggtgcggttggaagccatccgcaccgatgcctgccgccgctttcatgcggatcatgttcaccatcgcctgacctgtacatatcgtgggccgggcacacagtggattcaccccgatatggcaacagaatgggagcaggggaaagcatggcctgcttctgctattcgtcaggcacagaccggtactgtgaccatcatgcggggccgtcgggcggaaacggtgcagaaaccagccttgctgcatcggtctccgcctgtcgcgggcagcggcatcacaaggctgtttctcgccattgatgatgccactgatcatgacaacggtgatggtattattccggaatgatccagggggtcacatactgcatgacgacaacgatcataccgagcaccagagtcaggatgatgctgtgccagaaggtgcgggccaggaccgcgccttcctgacctttcagattggtggtggcgacaccggtggcgatattctgtggggagatcatctttcccatcacaccccccgaagaattggtcgcagcgaacagcacaggattcagatgcagctgattggcagccacgacctgtaaattcccgaacagggcattgccggatgtatcgcttccggacaaaaacacggcaatccagccgagaaaagcggaaaggatcggaaaagccggccctaccgacgcaacggccagaccaagcgtataggtcatgcctgagtaattcatcagataggcgaggccgatgatcagcgcgacagtcagaatggcgatgcgtgtctgccgccatgttgccaccatggcattgaggaaaccgcgtggtccgatgccaaccatcagcgaggtcaggatggcggccagcagaatggccgtaccgctggccaggggctgaaacacccagttggccgcataaggtttgccatacagggttataaatacggcatgatccagccctggccagggaattttatgtgccccgatctcgaagatgcgtaatgacgtccagatgatcaccaccgcggagacggtgagccagggcagccaaccctgccatgatggtatcggcgcacgatcggattgcgcttttgcggcggtctggctgcgatcaatacggaaagcaggatcaggttcaggctgccatatccgcaggaaaccgatagtggcggcaagggcggacaaggatgaaagaacgtcggtcagcttgtagtcgatgaagttggaagaaacgaactgtcccagtgcaaagctgctgcctgatacaagcaaaaccggccagagtgcacgcaccgagcgcaggccaccataaacggccatcacatagaaaggcagcagcagggccagcagtggcaactgccgcccgaccatggaagccagcacggtgtcaggcaggctggtgacttgccccaataccgtcaccggtgctcccagtgcaccgaaagcgacgggtgcggtgttgaagatcagggtgtaggtcagagcctcgatcggcggaaagccgaccagcaccagcaaggcgctggtaatggcgataggggtgccgaaaccggaaacgccttccatcagcgccccgaagcagaaaccgataacgatcagaaccacccgccgatcatccggcagatggtcgatcacccagtcgcggaatgcgtcgaagcgtcgtgattgaacagcgacattatagagtaccagcgcgttgaacacgatccacatgaccggccacagtgcgaacgtcattccggcggcaatgctgttgaacgcgatgccaggtgggcattgccagatcagaacggcgcagagcagcccaacgaccagtccggcaagggaagcttgccaggctggccgccgcaccacaccgagcaggatgagaacggtggcgatgggaaggatcgccaccagaaaagacaatggcagactgtccgaaacgggcctgagaacttgctgaaacatgatagggaattgtccggtcctgtgctgaaggatgggcttcagtgaatgggttgcgtatggaacggcacggggtagaatcgaatgtccgtatcatggtatttccggcacaggacaagggctattcagtctcctgcagaagagaattcgggtggagactggctcagtgtgcggtatccgggtctgctccggtccggcaatctgtgcgcagggcatcgatcatccgcatgtcggtggcatccagattgaaatcgaacagggcgatattgtcttttatgcgggctggcgtggctgatttcgggatgaccgcgctgccattctgaagatgccaccgcaatacgatctgtgcgggactgcgctgatgtctggctgcaatagtcacaagcctttcgtcatgcagtatacttccgcgggccaaaggactccaggcctgcgtcacgatgcctagtgaggcatgaaaggcacgcaaggcgggttgagacagggccggatgtagctccacctgattgagacagggtatcacgcccgtttcatcaatcaggcggcgcaaatgggctggctgaaaattggaaacgccaatcgaccttactctgctttctttctgtaagcgtatcaacgcccgccatgtgtctacataacgatcacgcgcaggcacaggccaatggatcagatagagatccagatattcaagccccagtctttccatactgagatcaaaagcgtgcaaagtctgatcatagccctgatcgtcattccagagcttggtcgtgatgaacagttcgctgcgaggaacagaggaggcagcaatggcagctcctgtctgctcctcattgccatagaaagaggcggtatcaatcagccggtatccggcttcaatcgcggtatgaatagccggttcgacctgatggtcgatgattttatagacgcccagtccgatctggggaatggcgtgcccatcattcagggacagcagcggaacctgcgatacagcgatggaggccatgcggagatctcctttctgacaggttttggtcaaagcgatgattgtttttccagccagtgagccataccgctggcggcggctcggccggtggcaaagcatgcctgaagcagatatccgccagttggagcctcccagtccagcatttcacccgccacgaacaggccgggcctgctgcggatcatgaactgctcatccacggcttcccatcgcacaccaccagcagtggagatggcgcgttccagaggctgtacccccgtcagacgcaggggcagagacttgatcagagcggcaaggcaccctggatcggctggtggtgagaccgtactttccctcaacagatggcttgcggcagaggacagggtcagggctttgcgcaacgtgttcgagagagattccctgctgcgggcgcgtgcgagtttggctgccataatgtctttcgccatatccgggcgcagatcgaggcagagatcggcatggccattccgttcgatcaggtcgcgcaggcgggcggaaagagcgtaaatcgggccgccttccagcccgtaagcggtgatgatcaggtcgcctcgcgcagtctgatcgggttctccggcaatggacagggcgatgtttttgagagccgttccttcatgccggctgatgaaaaacggtgtccatggtttggaaaatccgcaattcgcgggtttcagcggtgcgaccggcagcccggcttttgtcagagacgtcacccagtcaccattgctgcccagcctgggccaggaggctccgccaagggccagcagggtggctgcaacaggaggtaactggtggggagcgccatccgggccgcttatcaggagggagccatccggctgccatccgcgccattcatgcctggtatggatgatgacaccctgtgcagtcagtcgctccagccaggcgcggagcaggggagaggctttcatcgcccgcggaaagactcgtccgctgctgcccacgaacaggggttggcccagcccctcggcccagtgacgcagggcatcgggtggaaaagcacagagcgctgcttccagtgacgggcacgcggagccatagcgtgtcaggaaatcggccagcggttcggaatgggtcagattgaggccgccgcgtccggccatgagcaggcggcgggcgggggacggcattttctcatagacatggactgtatggccgagggcggaaagatgctcggcggcgcataatccggctggccccgcaccgatgatcgcgataccgctcatcggagggcaggccgtggcagacaaggtggcaggacaggattcgtgcaggacatgacggcgagatgatagcggcttttcagatgctcgtcttgacgggcgcgctcggagttgtggccgcctggatgctggcgcggcctgcttcctccgtggtgctgcgcgcactgcctgccttcatgcatgcgatagccgggatgtgcagcctgtttttgctgtggcgtggacagaatgagccggtgaggggagccgcgtttggtgtggctcaattcggtagtatggcatttgggttgatcgcgacggcttttatgatcgctatggggatgctggtttgccgctgggtcggacgcaggccgcccattcttttggtcgggctgcatgcgacgctggctatggggggcgtgctgatgctggctgcttatgttgcctttccgggaccgtgaaacagaaaaagggggctgactgcccccttttccgttacagattggattccgtttgattcaggcggcaggctgcgggtcttcgtagcagccggactggcgggcgcgttcccgtaccagggccagcaccagctcgcaggacggcatcggtgtcccggtgacatgacccagctccaccaccgcgcccagcagcgcgtcgatttccattgggcggccacgttccagatcctgcaacatggacgtcttgtgcacgccgacctcggccgcgccatcgatgcgcttttccagatcgatgccgaagcgcacgccgagcttttcagccacgatctgggcctcccccatcatgccccggcaggtctggcgcaggtcggggcgggtggtgatgatgtccagcgtcgcgccggtcagtgcgctgatcgggttgaagcagagattgccccacagcttgacccagatttcatcacggatgcgcggacgtataggcgctttcagaccggcggcaatcatggccttgctcaacgcctcgatacgcggcgaacggctgccatccggttcgccgagtgagaagcgatcgccataagtgtgttcaataacccccggctccaccacttcggaggccgggtagaccacggagccaatcgcctggctgggggggatgatgtcccacaattttccacccggatcgacgctttccacccgacgattggcgtgctcgccttccagcccgtaaaaataccagtagggcacgccattgatgccggtgacgagtgcgctgtccggtcccatcatctgtgcgatggacggggcggcgccgggcaacgaatgcgccttcagcgtcacgaacacgtaatcctgaattccggcctccgccgcactgccgacggcgcgcacggcgacggtgtcacgctcaccatcgcggatcagggtcagcccattctgttgcagggcggcaagctgcggcccgcgtgccacgagggtgacatccactccggctttcgcaagcttgaagccgagcaatccaccgatggcaccggcgccgaaaatggcgactttcatcgtctcgatccttgcttatgacggccttccataccgggccgtgttcatcatggcgggtcaggcgacacagagtaggaaaaccatctgcaccgccttgttttatgcgttggaaaagacgggtgcttacgccgtcagccccagtttttccgccagaccgatgcgttgcagcttgccggtggcaccttttggaatttccgtcaggaacacaatcttgcgcggcaccttgaaggcggccagacgctggctgagatagtcgcgaatctggtgctcatcagcggtctggccctcatgcagtacaatggcgaggccggcttcttccccgagcttgtcatgcggaatggcgaaggtcaggcattgctgcaccgccgggtgttccatcacgacgttatcaacttcaagcgggctgaacttctcaccgccgcgattgatgatttccttgatacggccggtcagccacagatacccggcttcgtcaatcttgccctgatcgccggtgcggaaccagccattatggaaacccttcagattggcatccgggttgttttcatatcctgccgtgacgttacggccgcggatcacgacctcccccagctggttcgggccgaggatggtaccatcatcatccatgattccgacttcgggaccggcagcaatgccgacactgccggcataatgtgcgcgcgggggcagcggattggagcacatctgatgggcggcttcggtcatgccgtacgcttccagcactggtacggagaacgcatcctccagatccttcatcacctgcggcggcagggaggaggaggaggaacggataaagcgcagccggcttctggcgatggtgtccttattgcgtccggccagacccagaatggcctgatgcatggttggaaccgccgtgtaccagctcgggtttgcttcagagaaccaggagaagaacttgaatgcattgaagcccggggttgccaccacggatgcgccggcggcgagggatgacagggtggcggcgatcagcccgtgaatgtggaacagcggcatgatgttcaggcacacatcattgggcgtcagcgccagcgtttcggcgatatggatcgcggatgcagagacattgacctgacgcagcggtacgattttaggacgtgaggtggtgccggaagtgtgcagaaccagcgcgatatcctcggcctgcgggatgcctgccgtggaaggctcaccgctcagcccttccggcagcgccagtgaaaaatcacccgccccggaagcctcgatcgggtccagttcgatcaccgggatggagcggcgtgccgcgacaatgcgcgccgggctttccatgccgcgctggatcaccagcgccttggcgttgagatcggacaggtagaagtcgaattcttcttccttataggcgggattcaacggcgcggtggtggcggcatgagccacggcaataaagctggcagccatttcagggccgttcggcagcacgatggccacgcggtcaccgcggccgatcccggccttgcccagcgtttcggtcgtgcgggcggccagcgtgcgcagccctgcataggtcaatgcggtgcgaccgggcgcgccaatggcgggcgcatcagcggcgccgcgtgtcagcagaccctgaatcgtgtcagcgaaatactcggtcatcgtatcccctcgatgtcatgagcggttatgcgtgagacgatccgcaggctctgccaccccggtagaggcggatcgtgcgccggagcaggcgcaaagcagtaaatcttcgtaaggttttatcagggccggatgcaatgatggccgcccggccctgataggtccgtctcagtcgtaagatacgggagacagggaaagcccgttttcttccatcgcccggatgttggcgtggcgtagtggcttgagcacaaacaaggccagaatggcagccagagcattgctggcggcggcgacatagaacacggcctcccagcttccggtatgggctgtgatgatggagctgaccggaaccagcagggcggaggtgcctttggctgtatacagcatgccgtaattggtggtggcatatcgccggccgaacgtatcggtgcaggtggccgggaacaggctgtagatttcaccccaggcgaaaaacaccagaccggtgacgatcacgaaggcaaccgggctgtgcgcataatgcagcagggcgaaaatacccacggcctcgatcccgaacgcgatgaacatggtcagttcacgaccgatacggtcagagacccagccgaagaacgggcgtgtcagaccattcagaacgcgatcaagcgacagggcgaaagtcagcgcgggtaatgtgaggccaagcagggtcaccggcatctgatcaacaccataatctctggcgatgaccgcgatttgggccgttgccatcaatccgccggtgcagaccagcacgaacatcagatacagcagccagaacaccggatggcgcagggtctgagccggcgtcttgccttcaagctctcctgtcgggcggccggtatcgatggcggaaggtgccttttgcggggcgacaaggaacatggaggcgatcatcacgatgatgccctgcccgagaccgaaggtcaggaaggcggattcataaccgtgagaggcaatccaggatgaaatcggcacgatggtaacagccgagccagcgccgaaccctgcggcagtgatgccggaagccagaccgcgtttgtccgggaaccatttcagagcgttaccgacagtagcaccataaaccagcccgcatccgacaccaccgatcgcagcggcggtgtagagcacggtcagcgaatcggccatgctgtcgatagcccaggaagcagcgatcagcacaccacccgccagaacggccagtctgggaccatagcggtcaaccagccagccttcgattggtaccagccaggtttccgtcagaacaaaaaccgtaaatgctacctggatggcagcgcgtccccaatgatgcgccttgtcgataggcaggacaaacagggtccagccgtactgaaggttcgcaatcatcaccatgcagacgacgccaagcgccagctgcagccaacgggaacccgatggctggagggcggttccactcataatgcttaggctccctaacattgcgggaaactcatccccgcattgattttctttctacaaaacccccgccagcttgttaagtgttgcgagggcgaaattttatgtttttatggcagcatgataagaaattttcaaacaaaataattctatttgtctttataattgatcatccccttgaggggggagggtatcgcatggcattggcatccccctgaaccgtgggaatggccctgacgaatgctgcgccgtctatatgatcgtatcctgtccttggcctcttccccgcgtgcagcatggtggcttggggtgattgcatttgctgaaagcagctttttccccatccctcccgatgcattgctgattcccatgtgcgtcgcgcgaccggaacgcgcctggcgcttcggcctgatctgtacggtggccagcgttgcagggggagcgttgggatactggattggctttgccctgctggatgccgtggcaagacctattctggaactttaccattacgaacatgccattacgcgttttcaggaaacctatgcgcagtacggcctgtgggtaatcctgctgaaaggattgacgccgatcccctacaagatcgttacgatcggctccggcgcagcgcatttcaatttcggtatcttcatgctcgcgagtctggtgacccgtgggctgcgtttttttctggaagccgcgctgttgcgccgtttcggtgcccccgtcagtcattttgttgaaaagaggctgaccctggtgacgactttgttcgcgctggcattggtgggtggtttcgttctcttgaagttcctctgacagggctttccaccccccccttcggaacctccttaaaccttctgcgttcgatgcgtatcgtggggcaggtcgttttgacctgttcaattgatttgtatccttataaaacagtccccttatcataacggacgttctataaggatattctgcgattctgtgcctgtccggcttatggcaggttatttgtcgtgtgtgaccttttatgcctgcggggaggagttcctcatgattacgttgaatatcaacggcgccgatcaccagttcgatctgccggaggacatgcctctgttgtgggcattaagggatgtggccgggctgacaggcacgaaattcggctgcggtattgctctgtgtggagcgtgcaccgttcacatggacggggaagcggttcgctcctgtacccttccgttgggagaagccgccggtcacaagatcatgacgattgaggcggtcggcgatacaccggcaggggcgaaagttcagaaagcctggcttgatatcgaggtcgtgcagtgtggatactgccagtccgggcagatcatggcggcaaccgcactgttgaatgctcatccccaccccacagatgacgatatcgatgcggccatgagcggcaatatttgccgttgcggcacttatccccgcatcaggcgtgccatcaaacaggcagcgcaggcataagggggtagaaagccatgaatcatactcctctttcccgtcgcggtgttctggccggaggggccgctctggttatcggtacatggctgccgcgcagccgccatgcaaaggcagaaggggctacggagcaggccgagcactcatttgcacccaatgcctttattcgtgtggcacaggatggcggtatcacgttgatcatgcgtgatgtagaaatggggcagggcatctggacgggagcgtccatgctgttggctgaggaactggaggtcggtctcgaccagatcagcccccagttcgcaccgccggatgacaaactgtatgcgtcgccgctccttcagatgcaggcgaccggtggttcgacgtcgatccgcggcgactacaaggaatttcgtatggccgccgctacagcacgcagcgtgctggtgcaggctgccgcccgtgaatggggcgtgccgcccggggaatgcactgtgaagcgtggcgtgatcagccaccaggcctctggtcgcagtgcaccatacaaggattttgtggctgttgccgtcaccttgccggtgccgaaagatgtgccgctcaaggatccgaaagattggacattgatcggtcattcgcaacggcgtctggatacgcccccaaaggtcaatggcacggccgtatatgggatcgacgttaagctgcccggtttgaaggttgcgacagtcgaaacatgccccgtcctcggcgggaaactggtttcgatggatgagaatgcggcgcgggctgttcccggcgtgcgggatgttctcaagctggatcacgctgtggctgtggtgggtgaccatttctgggctgcaaagcagggggtagaagcactccatatcgtctgggacgagggacccaatgcgcaggtctcacaggccgagatcgtggagggccataaggctgcttccagaacggatggcctgacagcgcgcaaggtaggcgatccggaaggcgcattgtccagggcaaccagcaggattgaggcggtgtaccaattgccgtttctggctcatgcccccatggagccgatcaactgcacagtccatgtaagtaaggaaagtgccgaagtctggtgtggcactcaggttccggcgcgtgcgcaggaggaagtcgtgcaggtgaccggcctgcccaaagataaggttcaggtccataatcatatgattgggggcgggttcgggcgtcggctggaggctgaatatgtccgtcaggccgctgctttcggccgtcaggtttcatatccgttaaagctgatctggacgcgggagaccgatattcgtcacgatcggcttcggccttactattacgataccttatccggtgggttggatgcggatggcaaggttatagcatggacgcacaaaaccacgggcgccagtgtgttggcacggtgggcaccagtggccatgccgaaaacaggtattgatcccgatctgatagaatgtgctgaaacaccctacgatattccaaacatgcgtaattcatgggtgcgtcacgagccacccggtgtcgttgtcgcgtggtggcggggtgtcggaccggcacataatgtttttgtggtggaaagctttgtggatgagcttgccgctgccgccaaacaggatccgctgaatttccgccgtgctctgttgcataaaaatcctcgtgcacttggtgtgctgaacgcagccgctgaaaaggcaggctggggaacgtcccttccgccgcgccacgggcggggcatcatggtacaaaacgccttcggtagttatctctcagtcgtgtgcgatgccgaagtaaagccggatggaacggtccgtctgcacaggctggttgcagcgatggattgtggacgcgcaatcaatccggattccgttcgggcgcaaattgaaggtgggctggtcttcggcctgacggctgcactttatggcgagatcacgcttgaaaaaggccgtgttcagcaatcaaatttcaatgattaccgcatgctgcggatgaatgaggttcctccgatcgacatcgtgctgatcgatagcaccgaagatcccggcggtttgggagaaaccggtactgcggcagcattccctgccattgcaaatgctgtttttgcggcgactggaaagcgtatccggcgtttaccgcttggtctgggacagctggcggatgcgtgagcgtgacaggaagggatgcatttcgatgtctgattttacagaaattgctcatcaggattcctgttccacattttcctccggtccactgtcggggcttgggcgtgccatcacgacaggattggcgacttttgcaatagcgacctgtgtggcgggcaatggtgtcgcccatgccgcggatagtgcgcatgacgcactggttgaaaaaggaaaatatctgactacggccgcggattgtgagtcatgccatacggcaaaaggaggtgttcctttcgccggcggtcgggagttcaagctgccgatgggcgttttatatgcgccgaatatcacgccggataaggagacaggaatcggcgagtatacggatgatgagttcgtctcagccatgtgggatggagtagggcgtggcggccgacatttatatccggcttttccttatacgtcgtatacgaaactgtcacgggatgatgtgctggcaatcaaggcgtatctgttcagtctcaagcctgttcatgctgtctcccctccaaacaacatgcgttttcctttcagccagcgctggttgatggtggggtggaacatgctgaacaatccgggaagacggtttgaacctgattcttccagatctccggaatggaatcggggtgcctatctggtggaggcgctcggccattgcggggaatgccacacgccgcgtggatggacctatggcctgaaaaacagccgtgccctttcaggtgaaacgatgcagggctggaaagcctacaatattaccagcgatcctaagcagggaattggtgactggtccgagagtgagcttgaagcctatctggccacaggtcatagcgatggtcggggcagcgcctctggaccgatggcagaagcggtcagttacagcctcagccggctgacccatgatgatattcacgccatggtggtttatctgaaagccgtgccgccgattgccgatggtgtcggtgttgcgcctgctccagagcaggcgaaaatgccggatcccgctgcttccgcaaacagcgagggtggccgcctctttgccggtgcatgcaaaagttgccacacactcagcggagcagggcggcagacgaactatgccgctattgccggagcagctaccgtctccgatccggagggtactaatctcgttcgcattctgcttgatggttctgtgctggatatagagaaaaacggcatcccgaccgtgcatgcgttcatgccttcctttggcctgtcacataccgatgcggaattggccgttctctcgaactatgtgcttggccacttcagtggcgtgcgtggaactgtcacggcagatcaggtgagggatgcacgcaccgcccaataaggcggttcagccagtggtaaactgaaacccgatctggtgccgatatagttcacctggcttgacgatcgagtagggaaaactgctgtgatgcggggcgtccgggtagttctgtgcttccagtgcaatccccgcatagcgctgatgaagcagaccgttcagccctttaaactggccagtcagattattgcctgtatagacctgcaaacccgcttgcgttgtcatgatgcgcaaaaggcggccattatcgggatgatacagccctgccacgttacgcggattctcggttacccgaccatcaaggcagaaacagtgatcaaggccgcctgcgattttcaattgcggatgatttgataacaggattgcgcccaacacggcaggctgctggcaatcaaatggcgtatctgcaacgaaacgcggcggagaaaacggaatctgggcagaatcagttgccagatactgtgtggcagcaatctggattatatgatcgtggattgtgcccgaagtccccagattgaaatacggatgtacgctgagattgatcgcagtcggtttgtctgtctgtgctgtcaatgtcagccagagtgtatcacccgccagcctgtattctgcttctgcatagacttcccccgggaagccctgatcgccgtccggactgctcagaccgaaggtaatactttccgcgtcatgccggacaacctcccagagcctttttccgaaaccatcagggccaccatggcgtgtattgccgttttcgttagtggccagacgatgatgagcaccatcaatccgtaaatcgcctcctgctatccggttggcatagcggcccagcacgacacccagcgagccgccttccgccgcataggcttcagcactgtcatgaccaagcagcacatgatcccatgcgccatgacggtctctgctcatgatggagaccatccgcgcaccatcatcggtgaaggcaacctgcagatgctcattaccggcccggaaaagggaggctttccggccgtctgccgtttgcccgaaagcggagtgctccatcgagatcgcctttttgagaggagggcgattatttccgctttgtatggcgtgcgacaagccctttgcagtcatccactgagccgattcccgtctggatggtcggtaaaagggcgagcggaggaaacaggatgccaagaccaatcgcagctcctgcccggactccaagctccgcgcctggcgtaatggaaggatttttaaaggtgccgccaatattgatgggagtgggcagtgacccgatcgtaaaatggtttgcttccgtccgtattgcgtaatccagtgtttccgtacggaggttgatcttaccggtgccccgtatgtcggactctgttgtgtcgatggcgaacaaccgcgtatccatcaccccttgctgcagggtgtaatctgcaatcatacagcgtatctgtgctttggagggaataccaagtgcggagagcacggcattgccgaattgaaggccggaaagattgaccagcaatgcgctgatattaccgccatgtcccatggtcaggcgcagatagccatcgccatgtcccagcatcgcggcaatggaattacctttggttttgatgctggcctctccgccgatctggccaccgcctgtgaaaccggacactgatttaagcaggcgttgcaaggaaattttgtgaaaggcaatgctggcatcagcatcaatcgtgtttccatccggtgatagattaatcgtgctggtgacatccccgttgccgataccaaaggagaggggatgaagctgaatacggccatccacgatatccatgacgactgcgacattatccagcggcattgatcgaccgagaatggactggcttttatagcggagatggatatcggcggctttgagtttgggaatgttgatggggcgtgtaggaaaaagctgaggactggcctctgccttggcgacttctcgtttctgctccagcgtttgcccgggtgtcgtggtttttccgggtgtggagccgatgaagccgcccagatcatctagatcgaccttgcgactatgcagatcggccgtaaccaccggcctggcaccggatggtgcgacgataatcgaaccgttgaggtcgcttgatcctacatggccggtaaaattctcgaacctgatgcgctgctccgcataggtcatatggccttcaatatcgtaaggcggagtctggggaatggggattccggtcagcggatacagggccgccatatcggctcccttcagcgtcaatgtcagatcggcaccggcgaaatgcagtggatcggcaatagtgcctcgcagggagcctttggtcgggccgttctccagatggagtgacaaaggatagaccgtatggtcctgccgcaaggtcagcacgtctcccgcaaccagcccgccagtcatcggttgcccggcatagctgcctttggcctctgcgatcagagcattcttgccggtactgtccgagcctgttgccagggtaatcgaaacatcggcttttaacggggcatcctgaaacaggatggagccaccttctatatggagggttccgatttcagggctggcacgcttatgggtatctgcgtctgatttgtcttcgtttttgccggacggaaatgtccagttattgcgattgtcttccgtcctgatcaggtgaaacgccggtttcgtcagggcaatgcgaggaatggcaatgaggtgctcctgcaaatagcgcaagacatcaacctctatttccaggtgttctatccgggcgaactcgttttcggtgttctgctggcctgactgtttcccatcggaagagggaggcatagggaatccatcaggctgggcgacccgcactccctccaattcaacgctggtgatccgcccgggatggagattgaaatgcgtcaggctgacgttccggcccagcgcctgactgagctgagatgccacaagcggcctgaaccagttccagtcccacaacaggatcagcgcaactgcgcctccgcacacaaaagctgtgctgatcaaccattttttcttgcgcgcggagggtgccatcctttgctaacggcgggataaacgcagggttgcgccagcagggaagaggcagacaaccctgttttttaatcagggatcctgccaatcctcatgccacgtgcgcccatcgcgttctatcagggcaatggaggcagtcggcccccagcttccggccggatacatgcgtgggccttccgtgctgttgcgccaggcttccagaatggggtcgctccatatccaggcggcttccacttcatcacggcgcatgaacagggaggggttgccgcgcaccgtatccatcagaaggcgctcatacgcatccgggtagcgcatgccgaatgcttcctcaaaactgatgttcagccgtgccggtcgcagccttagcccacccggaccgggatctttctgcatcgtcaccagccgcatgccttcatccggttgcagacggatgaccagccggttcgcctgtaactccgtgctgtccgaagggaaaatcgagtacgggacatgtttgaactggatgacgacttcgctgactttctgcggcaggcgcttgccggtgcgcatgtaaaacggcacgcctgcccagcgccatgatctgacttccgctttcagggctacgaaagtttcggtcgttgttggatgtccgacctcatcgacatagctgttgaccgcacgaccctgaatcgcccctttcccgtactggccgcgcacggtggacagcgcgacctcatgctcggccagcggtttcagggcacgcagaaccttcagcttttcatcacgcagcccgtctgcttccagagaaaccggcggttccatcgccagcacgcagagaagctgcagcaggtgattctggatcatgtcccgcatcgcgccggagccgtcataatatccggcgcgctcttccacaccgactgtttccgagacggtaatctggacatgatcaatattatcggcgttccacaaccgctcgaaaatcgaattggcaaagcggagcgcgatcaggttctgaactgtttccttaccaaggaaatggtcaatgcgataaatctgccgctcggcaaagatcttgccaactgcgtcgttgatcgcgcgggacgagtccagatcctgcccgatcggcttttccagaacaacgcgtgactgctcggtgaccagtccggctttctcgagattttcgcatgtgtcgccatacagggcaggggcagtggccatgtaatagactcggatacgatccggttgttcatccagcaatgttgccagagcctcgaacccgtcaccgcttttgccatccacatgccggtaatgcagcatcgaacgaaactggctgaccgtttcctcctgccactcatcccccttgatgtgtttgcgcagatgctccagcaccgtattggcatagtcttcgctgctgagatcggagcgtgccgctccaatcaggcggctatcgggtggaatctgcccgtcacgcagccgccgatacaaggccggcatcagtttgcgaagagtgagatcgcctgtagcgccgaatacgacaccatcaaaagtactgacaggaatgatctgggccatcgaagccttctttcgaatctgtcgggtcaaagagttgcatcgtgatcagtgtggcaccttatcgttgatggcacttgctgtaccatctcgaagaggatgaaccatgtcagacaggcaatgtgctacagacaggggaaggctgccaagtatgatcgaattatggacatggcctacgccaaacggtcaaaaaattcatattgctcttgaggagatgggtctgccttaccgcgtcattccggtcgatatccggaagggtgaccaattttcctccgaatttctcagtatcacgccaaaccatcgaattccggcgatcattgatcctgatggtcctgatggacaggcgctgaccttatgggaatccggtgcgatcctgatttatctggcggagaaaaccgggtgccttctgcccgctgatccggtggggcggctgaaggcgatccagtggctgatgtttcagatgggcggtgtcggaccgatgttcggccagtggaaccatttttcagcgtacgcgcctgagaccatcccctatgccgtacaacgctatcagaacgaagttttgcggctgcatcgtgttctggagacacgcttgaaggaggctgattatctggccgggacggagtattccatcgctgatatcgctacctttccgtggatcacggccataaccgcgaaattgtctgttctggatgattatcctgcggtgcggcgatggcacgaccgcattgcatcccgtgatgctgtgcaacgggggatgtccgttcttcaggatcgccgccagaccacgccgatcaccgatgccgaacgtgacgtgttgttcggctctggccagacaacatcgcctgtaacctgatccgcccgttgcttccgcctctgctcgaccctctgcccgaccctctgcctgtggcgggctgatgatcagggatgggatcagcctttttgcggctggtagcgccagacgctggccggggggaagttcaggggtgtccatgcttcccgctttcccgtcagcccgtgcttgcgggcgggaaggggggaggtcgcacagtagctgtaatgcaagaaccccattcctggtgcgacggtttccatcgcatctatgaaccgtttctgggccgggaatggcagcagaaccagcggaataccgcatacgatgctgccaacccgaccgtgccattgcgcaggcagaagagcaggcagttcccgtgcgtccccttcgatcacctgaacacctggcagggccttgcggagatgaacggccatatccggtacgatctcgaccacaaacagccgctccggggggataccgctttccagcaaggccttggaaatcacgcctgttccggcacccagttccagtacgatctggtcatggttacggcgaatctgagcggccaccctgcggcaaagtgccggggatgaaggaataaccgatcccatctgcaagggattggccagccaacgtttcagaaaaagtgctgtatttgaaacattgctggatttttgtttgggtgattgtttcatatttgtggcagtagtctcgacttgtattgtcataatactgcaatatttccgatttgttggaatattattagtgaatactccataaaattcttgtcgcaaagatatgaaatgcgtcttccgatcagagaggctaatagaaatccgtcttatggtcaggaacgcgcaaaaccccgcgtaccatgggcacgcggggtaaaggcaggtcaggctgacaggacgatgcgggctgatcagatatcagtccggcaggccctggagagccgcagaaaaactgcgaccggaattatttgattttggcttccttgaaggtcacatgcttccgcacgaccgggtcgtatttgcggaattcaagcttgccggtctgggcgcgggcattcttcttggtcacatagaagaagccggtatcggcagtggaaaccagtttgatctgaacagtgttgcttttggccatgactcgctacctctcgaagcgccggaacatgctcataccggggcctcaggtcaagcttttcgcatcgtttccatgataattcaggcccgagcataaggaatagctgccttgacggccgattatcggggcagattcagccccagcgtggccggaatcagcgcggcggcataggcagccggatggtccatcaggaaatgggccgcttccatatcggaatcgctaccctccgctgccgggcagctgttgcggatatccatcatttccgcggcgggcatcggcgcgcgggccatgcggttgcgtgtcagggccgccatcatcggcaactgaccattttgaagggccatcaattgagcatccagcgcgacatggcccgtgctggtacagacctgaggcatgacgcccagcccctgaatgggccagccgaggggtgccagaacccggctccatgtaatgaacagcgtgccgccatccggcaggggggagaccgtttgcaccagtcccttgccgagggtcgtgctgccaatgacgacgcccctgcggtcatcggcgagagcagccgccagaatttccgaggcgctggccgagcgtccgtccacgatgatgatgacggggagcgtaccggtcagatcatccccggttgcctgccagattcggttggcctgaggatcgcgaccgctcattgtggcgatcaacgaatcatcacccagaaaggcactggtggcagcggcggcctccttgaccagaccgccgcgattgccgcgcagatccaggacgatgccccgtagggtacgtctgctttttcgctgacgcagaaactggctcaatgcgttggcgatgtcttgcccggtggaatggctgaaactggtgatgtgcagcacaagcaggttgcccgactggctggccgtcaccgtattctgctgcggctccgcccggcgcagctggatgtcgcgggccagttgatggctggggccgcctgatacggtcagccggaccgttgatccttccggcccctgcaactgtgcttcggcggcggagacggtttcagcctccagaggatgtccattcagcgcgatgatgctctgtcccggctgaagtccgatcgcctcggcggcggttccggtggccacggtacggatgatgaagccatgcccccgtcgcgccaatgtaacgccgattccggcttgagctgtcacggatgtatcgtcatcgcggggtggctcatagcgggagtaagggtcgaggtgattgaacacctcgtcgaacacgctgttgatgatcccctgagtctgtgcatgacgcagttggggcgaaacggtccaggcagaggccgccatacgggcaatcagctttccccaggccgcatagtcggtgaaggggggacgttcgatccctgtcacgagcctgctgctctgcgttaaaatcacattgtgttcatccatcgacgtggacagggatggatcaatcgcggtcaggccacgcagcccccataaagcaagggtgggggccggcactgcctccagagtgcggggggccatgaaagtgaaggcactgctgaaaacatcggcggccagtgtctgggcgaacgcggtttcctgatccgtggcggtaggctggggcgtggcggcgtccatctgcgcctgtgccatggcaggccacatcaacagcatggccagtgccagcctcagggccagcctgcgtcgcagatctgttctgatgctgcgcgcttttttcaccgtctggatcgtcccggactgccacgcttgcggctgctgaaccggtcctgagtatttgtccggtctgtgctgtctgggcgggaggacgcagaagatgaagcacccggcagcaagttgaacaccagccccccggtaatcggcgtggcttccgcaaggcgcacagtgacgctctgcgccagacgccatacggcccggctgttacggccgatcagggcctgctcacgctcatcatgaatccagaaatcgtcggggagagaggaaatcgggacaatcccgctggcaccgttttcctcgactgtgatgaacaggccgaagcgggtgacaccggaaatgcgggcggcaaagcgggcgccaaccctgtcggccatgaaggcggccaggtaacggtcgatggcatcgcgttccgccatggccgcacggcgttcggttgcggtaatatgctcggcgatgtcgacgaagcggctggcttcatcgtcctccagactgccaacacccagttttaacccggcaatcagggcacggtgcaccagaagatcggcatagcggcggatcgggctggtgaaatgggcatagcgactgagcgccagcccgaaatggccgatattgtcaggattatattccgcctgagattggctgcgcagcatggtctcgttgatcagcgcggcatgttccgtcccggccacctgcttcagaatatggtccagatcgcgaggatgaatttgcccggcgggaggcagggaaatgccgaaactgtccagaaaaccgcgcagggcctcggtcttttcgtcgctcggcggtgcatggacacgatacatgcagggacgatgcagccgttccagctcctccgctgcggcgacattggccagcaccatgaattcctcgatcagccggtggctgtcgagacgggggcgcggaatgatagcgtctactgatccggcctcgttgaggatcaccttgcgctccggcagatcaaggtcgagcgtaccgcgcgcagtgcgggccttgatcagagcgtggtaggcgccgtagagcgcatcgagtgtctcatcgcctgcctcatgggcctgctgcacctcctcataggtgcggcgagcggtactgcgcatcagcccgcgtccgaagcggtggcggatcttgccaccgccggcattaatcatcatctccacgaacaggcagccgcgatcctcgtccgggcgcagactgcaccagccatttgagagcgcttccggtagcatcggcacgacgcgatccgggaagtaacaggaattgccgcgtttgaacgcttcccggtccagtgccgagccggggcgtacgtaatgcgccacatcggcaatggccacgatcagacggaatccgtcattctctgcccgttcggcaaaaacggcatcgtcgaagtcccgagcatcctcgccatcaatggtgatgagaggaatgtcccgcaaatcctcccgcttttccagtggaacggcgcgggcttttcgggcttcggaaagggcctcgtcggggaaaatctggggaatatcgtgggtttcgatgcagatcaggctgaccgagcgggcatccccgatcttgcccagcttttcaatgatccgggccggtttcagcccgtaccctgtatggggcagaggcatggcacgcacaatgtcacccggttccgcccccccttcctcgccggcaggaacaagccattcggccttggagcggcgatctgtcggcaccaccctgccttccggttgtgctgtggaggcattctgtcgtgccagcatctgtcttgcggcatgggaggtccgggtcgagcgtgggaccagggtgacgggttccgacaaccggtaaacccccagaatggggcgcggtgtatcgccacccagccgcttgatagtgcggccttcatagcggccatggccgatcgggcgcagccgggccagcactttttccccaggtgcaagcgccggacgtccccgaggctccgggtgcatgaggacggaggggggaggcccggcttcccgaggccactcggccgggcggccgaccgcgtcgccatcccgatccgtgccggtgatgaggatcacggcgacttccggcagatgggaactccctttggcatgagggagcatgctccccccggcaggcatgaagcgcttatgcccggcaggggcgagattgccctccgaggccatgtctttcagcagatcacgcaggtgcagcttatcggcggctcccagtccgaatgccttggcaatctcccgtttgccgacccggccggaggcttccgccacaaaacggcgaatggcctcccggctcggcatcgtgccgggttcatggccggggaccggtcggaccgcctgcgaggatgggcgggaggatttcctgccagcctttcccccagatggtcctttggcggctgatcctttggccggtttgagacgacgcgccacctagcgctccgctttcgccgttttggccgtagcgctgcgcgtccctgattttttggccgctgccttgcctgcgcctgctgctctggtcgtttttttcgccgtggcttttttcaatggctgggcctcattgccatcagcagaagcggcttttttgccggatgatttggctgcgaccttgcgaccgcctttcgccttgagaggtttgcctttttcagcaagccagcccagcgcatcatcaagcgtgacatcgtccatctcgatttcacgcggtacattggcgaccacctgcccatgctggacataggggccgaaacggcccttgcgcaccaccaccggctccttgtctttcggatgggtgccgagcgtgcggatactggccatctttttggccagcacatcgacagcgcggttcagccccaccgtcagcacgtcatcatccttgtccagattgccgtagatcccgcccattttcacataggggccgaaccgaccgagattggcctcgatcggttccccggtttccgggtggatgccaaccagacggggcagggagagcaggccaagcgcctgatccagcaggatggtctctccatccactccacgcggcagggaggcacggcgcggtttctttttggagccttcctccgcctcgccctgttgcacatacaggccatatgggccgcgcttgacggtgatgtcctctccggtttccggatgctgacccagcacccgcatgccttccttgagggtctcggcctccccttccgccccgtcgatgcccagacgtcgcgtataggagcagccgggatagttggagcagccgataaagctgccatgccgccccagccgcaaacccagccgcccgtcaccgcaggccgggcagatgcgtggatcagtgccgtcctcccgcgtcgggaagaaatgcggtccgagatcacgatccagcgcgtcgatcacatcgctgatcttgaggtctttggtctgttcgaccgcctgataaaaatcctgccagaacgcctgcatgacctgacgccagtcggcgcggccatcggaaatctcgtcgagctgcgtttccagcgaggcggtgaagttggtgtccacatagcgttcgaaaaagctggtcaggaacgccgttaccagccgcccgcgatcctccggatggaaacgccgcttgtcgagccggacgtaattccggtcctgcaacacggacaggatcgaggcataggtggagggacggccaatccccagctcctccatacgcttgaccagtgaggcctcgctgtagcgcggcggtggctgggtgaaatgctggctggcatcgacccggtcctgacgcagcggatcacgctctgccatgggcggcagcatgcggccttcttcttcctcggtatcgtcctgcccctcccgatacagtttcaggaagccgtcaaaggcgatgatggagccggtggcacgcaactgcactgatttcgcgtcaccggtctgggggaagatatcgactgtcacctgatcgagttctgccgattgcatctggctggcgaccgcccgcttccacaccagctcgtagagccggcgctgttcggggttcagatagcgggccacgctgtccggtgtgcgctcgacatcggtggggcggatggcttcatgcgcttcctgagcgttctttgccttgctggaatactcacgcggcgcggcgggcaggtagtcgagaccgtaagaatccttcacatggtcgcggatcgagaacatagcctcccgcgccatctgcacgccgtcggttcgcatgtaggtgatcagaccgaccgtctcgccaccgatctccacgccttcgtaaagctgttgcgccagccgcatcgtggcctgtgcgccgaagcccagcttgcggctgctttcctgctggagggtcgaggtcgtgaagggcggcggcggattccgcttgaccttcttgcgctcgatcatgccgacatggaactggccctgttccaccagcgcacgcgcgcgcatggccagcgcttcggtgttcagatcgaactggtcgagctttttgccgtccagatgggtcagccgtgccgtgaaaggcgcgccggcaggggtgaagaaatgggtctcgacggtccagtattcgcgcggacggaaaacctcgatctcggcttcccgctcgcaaatcaggcgcagcgccaccgattgcacccgcccggcgctgcgactgcccggcagtttccgccacaacaccggcgacagggtgaaacccaccagataatccagcgcccggcgcgccagataggcttcgatcagtggctgatccagatcacgcggatgctcaatggcatggcggatcgcgttgcgggtgatttcgttgaaggtgatgcggcggacctcgacgcctttcagggcccgggcttcctccagcatggcgcggacatgccatgaaattgcctcgccctcacgatccgggtcggtggccagatagagcgtctccgctcctttcagggctttggcaatggccgcgacctgtttgcggccgcgttcatcagcctcccagtccatggcgaagtcctgatccgggcggacgctgccatcctttggggggagatcgcgcacgtgaccgaaactggccaggacggtatagttcccacccagatacttattgatcgttttggccttggcaggcgattcgacgacaacaacgtccgtcatgagtattccaattatggcaacgtcatgaggcaccggccaagcgggcgacgcggttccccgggagcgatacgacgtgagcagaaagttccatttccagcaacgctgccacgacctcggatggagacaactggcagcggcgtatcagatcgtcaactgcgacagggtcaggaccaagcagcaagaggattttttccttcaacccgttcgtttctgacacggtaaacgcaccacccggtttttgtttcgcagacggagcaggcccagagggagaaagaaacaaatccggtgtctgtggtgctgttctggtggttctggaggttacgggcaggttgttcagaacatcttcggcggtttccgtcacccaggcgccctgacgcagcaggtcattcgatccccggcagcgaggatcgagcggggagccgggaacggcaaaaatttcccgtccggcctccagtgcgcagcgtgctgtaatcagactgccggattgaagggcggcctccaccagaatgacgccttccgacagcccggcgataatccggttacgccgtggaaaatgccgggcaatcggggctgtgccgagcggtagttcactgatgacggctcctcgtttggcgatgaccgattgcagacggatattttcacgcggataggggcaatcgagtccgccggctacgaccgcgatggtcaagccggtctccattgctccgatatgggcggccgtatcaatgcctcgtgccagcccggagacaaccaccagcccggcggaggccaatgtacgtgacagatcacccgcaatggttcggccattgatggaggaattgcgtccacccaccatagcaatgcaccgccgcgatagcaggccgatatccccaagcaccgacaagacgggcggaggatccgccgtggcggccagcgcagcagggtaatcaggcgtgccgaggaagatcatccggccaccaaagcgttgcagagcctccatttccgcccggatggcttcttccgacgggatgatcagggaggccgcacggggcaggccgggcagggcacgcaaagccgccccggcagagcggaaacgggtgatcagcctgccataggcggtcgggccgatcccctcggtgcgggcaaggcgcagacggtcgagggcatcgtggggcgtcatgacggagggttcaggatctggtgccgattctggattcggtcccggcgcgcagccgtgcgatattgtcagcatgccggaggaagaccagaacggcgatcagcatgaaagcagcggctgcctgccagtgggattgggcaagaggtggcggtcccagccccatcccgcccacggccagcgccagcagcggcgcgaaggcaaaggcacagagcgcggcggcagaggatattttgattgtccgcgccaccgcaaaccataaagcacagcagatgagaccaaccggccacgcagttgccagtagcacgccaagcccggttgccacccctttcccaccgcgaaacccgagccatacgggaaaaagatgcccgatcacggcggcgatcccggccggcagtgccagcgcccagccgcccagatgcacagccagcagcgccgcagcagcgcctttgccgccatccagcagcagggtcgtggcagccagccccttgcgaccggtacgcagaacattggtggccccgatattgccggacccgatcttgcggatgtctcccgccccgctcagcctggtcaggatcaggccgaacgggatgctgccgagcagataaccacccagcagggcaaggcaatagctggtcattgtgccgttcatccgaatacccgcctgcctgctttccaggtaccgatgacgcggccttccagcggtctgccgtcgaagggagtattttgtgctttgccgggcatttttcctgcttcaacctgccatgccctctccgggtggaacaggcacagatcggccggagcgccctgccgcagcgttcctgcttccagcccgaacaggccggccgggcggctggtcagcatggcaatggcctgcgacagcggcaatccgttaccgtgcacttgcgccagcgtgatgccgagcaacgtcaccagcccgactccgccgggggaggcctgtgcgaagggtacccgcttgtcatccgcatcacgcggttggtgatcggaggcgatcgcgtcgatggtgccgtccttcagccctgccgcgatggccagccggtcctgctcggcacgcagcggtggtgacagcttggcatagctgcgccactcgccgatggcagtctcgttgagatcgaaatagggaggcgcggtatcacaggtaacgttgataccttcatttttagcccggcggatgagggatacggcctctgcggtcgagacatgtccgaaatggacacttccgcccgtgagtgccgccagtctgatgtcacgggcgatcatgatcgcttcggctgctggagagatgccgggcaggccgagccgggtggccagttccccctcggttgcagccccgcctgcggcgaggctggggtcttccgggtgctgcacgatttttgccccgaaaccgcgggcgtaggacagggccagccgcatcatccgggcggaggcaatggcggaggtgccgtcggtaaaggccacggctccggcctcgtgcagcaagcccagctcggccagctcttccccccggcagccgcgggtgaccgcgccatagggcagaatgctcaggctgccggtttcttcaccacggctgcgcaggaggtgaaccagcgccggatcgtcgatcgagggtctggtatccggcagggtgatgatggtggtgatgccacctgccgctgcggcttgggcggtgctggcgatggtctcccgatattcatgccccggctcgccgaggccgacgcggatatccaccagtccggggcacagcacacagccatcaccgtcgatttcctcgaccccatccgggcggcccagggacggtccgaaatcagcaatccggccatcccgcaccagcagggagccgggctgatcgaggccgctttgcgggtccagcagccgcacatgggtcaaaagaagatcagagtggggaggattggtcataagcggtggctccgcagccgggaaagcgctgtgccggcatcttctgtcggatcgggcacgggatatagcacggtgaggataagcgtatcgcgcaggatcagggtggcacgctgcgtcagggattttccggcggaggtaaagcggggcaatgccagcgcattgccgaaagccccatctgtatcactgagcagtcggaatggcagatcaagccgggtggcggcctcaagctgggcatcgctatcctgtgcgctgaggccgaaaatagcgatcccttcccgctgaaatgtttcgtgcaggctacggtagcccagcgcctgtggtgtggagccatgcgcaccgggaagctgatcccagtccggcgggttggggcggtcggggcggccgatcagcgtatgcacgaacagaatcgtcaggccgcgcagcccggccagatcaagtatcgttccgtcatgggcgtgcagttgcagcgcgggcagcatgcgaccggccagatgatcgcacgcgccatcatccggcaatggcggcaggccgggcagggaccatgaggagatggacatcagaccgggcgggaggaaggcaggcggctcctttgccgggccagcgcgtccagcacggccatgcgcacggcgacacccatttccacctgttccttgatgacactgcgcaccggatcatcggcaacgcggctttcgatttcgacaccgcgattcatcgggccgggatgcatgatgatggcatccggtttcgctttcgccaaccgggcctcgttgaggccgaagaagcggaaatactcacgctcgctgggcaccagaccgcttttcatgcgctcccgctgaagccgcagcatcatgaccacatccgcgccatccagcccgcgatccatatcgtgaaagacttcgacccccagacgatcagcggcgcccggtatcagggtaggcggcccgatcagacgcacctgactgcccagcgaggccagcagatagatgttggagcgtgctacgcgggaatgcagcacatcgccgcagatcgccacggtcagtccttccaggcggcccttgtgacggcggatggtcaatgcatccagcaatgcttgtgttggatgctcatgcgtgccgtccccggcattgatcacggcagcatccactttctgcgccagcagattaggcgcgccggattggctgtgccgtacgaccagcagatcgcagtgcatcgcattgagggtagaggccgtgtcgagcagcgtctcccccttgttcacgctgctggtggagaccgacatgttgatgacgtctgcccccagccgcttgccggcgagctcgaaactggtgcgggtgcgggtgctgtcctcgaagaacagattgatcagcgtacgaccgcgcagcagatcccgctgcgtcttgccggagcggttgagcagagcatagctctccgccagatccagcaaagcatgaatctcgggcgggtgcagtccctcaatagcgaggaggtggggtctgacgaaatccaattccaggaatccggtcggttgaaaacggcgcagactatcccccccagcccagcggggctagtgggggcatgggtgctcaggacggtgcgtaggtgtcaggttcgtccagttcctgctcccagtagggtggccgcccgaaacgggtttgcagaaaatccagaaacgcccgtattttcggcggcacctgccgatgcggaggataaaggccgaaaattccgctgggctgggtcgcaatcatggcattccagtctggcagcacgggtgacagccgtccggagcgcagatcattgccaaccagccatgtcggcagcagcacaataccaagcccggacaaagcgcagccacgcaaaggctcggaatcatcagcacgaatggagccgcgaactggaacggccacttcttccccgctgatcggatgatgaaaaaaccagttccccgaaggttgcagcgaataaatcagacagttgtgctgcaccagatcctcgggatggcggatagcagggcggtggtcgagataatccggggaggcgcagataacccgccggtgcggtgccagcttgcgggcgatcagcgatgagtccagcaagggaccgatccggatggctgcatcggctccggtcgcgatcaggtcaacccgcacatcgctgaaggacatgtcgagtctgatatccggataggtcgccagaaattccggcatatgcggtacgatatgcagccgggcgaacgcatctggcaaagcaagacgcagcagtccttgcggatgcccttgctgggcggaggcggcagcgcgggcttcttcgacctcccgcagcacgctacgggcatgctgatagaaaatacgtcctggttccgtcagatggacccgtctcgtactacgatgaaacagatcgaccccgagattttcttcgagcgacgcaatgccacgtgagatggcagagatatggactcccgtaacacctgccgctcgggagaagctgccgaattcaacaacccggacaaacatctgcatggttgctagcatatccatggcagggcttctccgatagaaatgtcattagaatgccagtttgatagcagattatgcgctgcagaatgaatacgataaagtattttggttgcggaattctgtatgagatagaaaggtatatttattttgagctagatatctaattgaaaattataatgtgcttctttccaagaattattttttgaaaatatgatggaatacggtaaatattgccactgccctttgtatggcagtggcaaataaagaccatcaattgtatgcaggattagcctagttttcgcaccactaccgttccggcaaagtctgcaaccggaatgattttttcaggtttgtccgcaaaaaattcattgatggctcgcgtaggcccttcccaggtcagactcatgaagtcatgcataacaataaagccgccttctaccattctgggataaaaatattcgagtgcactgagaatgggggcataaagatcacaatcaatatgaacaaaagaatattgattgtcggataatagttgatttgccgtatctggaaaatatccctgaatataacgaacgctttcctctccgatacgcttgcgaacagctgcaaggctggtatctttaaaagctgcagaaagatgatcttcattttccgcaagatcccgctgatcaaatccttcaaacgtatcaagaagccaagccgtcacattccgtttgcgggcaaaatcggcaagaagaacggcagtatcgcctttccagacaccaagttcaagcaaatcaccggttatattttcagcaatcaaaatatcaaaaaacatgatgaatgaaaaaaatctcaccatatctccgtcagagtagcaatcagatgaaacaagccgctcaggtgaaaaaagaccgccttctgcaatatattttgaaagattagtgccatatcgctcaggcgtatggagaatatattgattttttggtaaaggagattctttatctttctttggagattgtgttaaaattttctgttttgtatcatcaatttccaattgaagagctttatttttatgctttaaatgatcaatttctgatttaaaattatcaagggaaattttgttttcatcatttgtatttattaattgattagaaattaattctattttgcgttgattttctaaaattaaatcttgatttttgtttaattttaattctgtattgcgtattctatggattacttcggaaatgagggggaaacgttccatcattttggtaatcattctggggttgttcttattttgcatttttgacctaagattttacaaaacaggacgaatatttcactaaaattaccttataaagtcaaggcaatgagagtttaagtcgctttattcaaatgtaagaaaagcgatttcccaggtcagtcagcatatccatggctgggcctttcagcgtttatggaaagccatacgcgattgttgcggattatgcaaaaattatatgcctgattgctgtctactcctcagcagcgtgcaggactaaattggtattggtgcagcgcagcatgtgcgctttcacgcctatcccgctgcaaagccgccagcatccatccggtgcggcatcgtgaggagtattgagcatggcggccaagccaaagatcaaaccgtatcacggaccagccggaggcattggtgcgcttgaggctgtggaaaagcatctgtgccgccagaagattttcctgagcggcaacaaggcgttgctgtcgatgaacaagccggaagggttcgactgcccagggtgtggttggcctgatccgaagcacaccagctcttttgagtattgtgaaaacggggcaaaagcggttgcctgggaagccaccaagaagcgtgtgacgctggatttctttgcacggcatactgtgacggaactgctcggctggagcgattacgaactggaagatgctggtcgtctgacccacccgatgatctatgaccgggccaccgatcaatacacgccgatctcctgggaggatgcattccggaccatcggagatgctctgaaccgtttgcccgaccccaatcaggctgagttttatacttcgggccgtgcctccaacgaagctgcgtttctgtttcagcttttcgtgcgggcttacggaaccaacaatttccccgactgctccaatatgtgccacgaaagcaccagcgtggcgctgcccgacagtatcggcgttgcaaaaggcactgtgcagctcgacgattttgaaaaagccgaagccattttcattttcggccagaatcccggcaccaacagcccgcgcatgctgaatgatctgcgcgctgccgcaaagcggggggcgaagatcgtttccttcaacccgatccgggagcggtcgctggagcgttttgcgtctccgcaacatctgggtgatctgatcaagccggtgtcgatcagttcgcattattatcaggtgcgcatcggtggtgacatggccgccgtcaagggcatcatgaaagtggtgctggaggccgatgatgctgcccgtgccgccggtcaaccccgtgtgctggatgtcgcgttcatcgagacccacacccatggctttgaagcggtcgaggccgatatccgtgcgacggattggaaagaaatcgagcgtgccagcggcctgagccgggcgcagatcgaggaagccgcgtccatttatattcaggccaaaagctgtattgctgtctgggggatgggtattacccagcaccgcacgggcgtcgccaatattcagcagatcatcaatctgctgctgatgcgcgggaatatggggcggcccggagccggtgcctgcccggtgcgcggccattccaacgtgcagggtgatcgcacagtcgggatctatgaaaaaccgaaacccgcttttctggacgggttgcagcgcgcattcggctttaaccccccgcgtgagcatggccacgatgtcggagaagccatcgacgcgatgttcgaaggtcatgcacgggccttcatcggccttggtggcaatttcagcctcgcggttcccgatacggagcgtgtggcggaggcgatgcgtcgccttgacctgaacgtgcagatcgccacgaaactcaatcgcggtcatctggtggtttgcaatacatcgctattgctgccttgccttggccgtactgaaatcgatttccagagttcaggtccgcagatggtgacggtggaggattcgatgtccaacgtccacgcttcgggtggcctgaacatgccggcctcggagcatctgcgctcggaagtcgctattatctgcggtattgctcaggcaacgctgaaggggcgttacgatattccgtggcagtcgtatagtgaggattatgaccgtatccgtgacgcgattgaagcggtgatgccggaactgttcaccggctttaaccagaaaatccgccaaccaggtggcttccgtctgtattctccggtcgattaccgtgagtggaatacgccgaatggcaaggcgaatttcctggtgcatgaaggcatcgatgaaaatgagatgcctcaggatcgggaggatgtgctggaactggccacaatccgcagtcacgatcagtataacaccacggtctatggtctggatgatcgttatcgcggtgtgttcggtcagcgcatggtggtgttcattaatgcggccgatcgtgagcggctcggtttcgaggaaggggccatcgttgcgatgcgcactgtcagcgaagacgggctggaacggcgtgtcggcggtttccgtctggtagattacgatattcctgccggatgctgtgcggcttactatccggagaccaacccgctgattcccgcaacacgtcgtgctctgcgcagtaacacgcccacatcgaaatccgtcccggtggtgttcgaggcatggaagggggaatgggatgaccgtcccaatcctgagctggcttccatccagacacaagtgatggctgttgcggcagaataagaaattctctgcttatgactgcaaaaaaccgctttcaccttgatcgggtgaaagcggtttttgttttcacgagcctctcgtctggctggttatacggcttctatccgggaagtgacttcactggcaccaagagcttccagcgttgcatcaatgggcgggctggtggtgccaccggtcagggcaacccgcagcggctgggcgatctggccgagtttcagcccgtgttcctcggcgaaggcgcggagggcctgatccaccgcggcggctgagaaatcggtagcctgcaattgcggcagcagggcgcgtagccagccgcgtgcttcatcggagagcagagccgccgctttcgcgtctttcgggccggaggggcgttcgatgacgaagcgggcgctttccgcgagatccaccaatgtccgcgcccgttccttgagcttcggcatcagccgcctaatccggctggaggcatcgctgtcaggggagaggtccagacggcggcagagatcggtggtcagacgctgatcatcggcttcccgcagataaacaccgttcagatgagtaagcttggcataatccatccggctggcggcacggccaaccccgtccagatcaaacagggcaacttgctcatcgcgggagagaatttccgcatctccatgtccccagcccagacgcagcagataattgcacagggcttccggcaggaaaccttctcgttcgaattccagcacgctgacggcgccatggcgcttagacagtttggctccgtcggcgccatggatcagggggatatgggcaaaacgtggcagatcccagccgagagccttgaagatctgcacctggcggaatgtgttggtcagatggtcgtcaccgcggatgacatgggtgatggccatatcgtgatcatccacaacgaccgcgtgcagataggtgggggtgccatcgctgcgcaggatgatcatgtcatccagctcggcattggcgacacgaaccggtccctgcaccagatcatcgaccacggtttcgccttcctgcggtacgcggagacgaatgaccggagcaatccctgacggggcttcggacaggtcgcggtcgcgccatgggctgttgatccgcagcgggcgtttgtcagcggcggcctgatcacgctgggcctgcaattcctccggggagagaaagcagcgataggccataccgcgttccagcaggctgtgagcgacttcagtatgacgtgtctcacgggtggactggaaaaccggttcctgatccggtgacaggccaagccagtccagaccgtccagaatgacctgcaccgcttccggggtggagcgcgcgcgatcagtatcctcgatccgcagcaggtattcaccgccatggtggcgggcgaacagatagttgaacagagcggtacgggcgccgccgacgtgcagaaggccggtcgggctgggcgcgaaacgggtgcgaatggtcatgtcaccgcctctaacatgcttgtgcgtggtcagggagtgcaaagccgcgtaacctttccattcgcatatttcatagccgattgcagtgcagccactgatttatctccgccgggccagtcagagtgcgcgggatgctgccggggtgttggccggtcagcagttcggacgcttttccctgtggctgccggtcggcatggtgaccggggattatctgtattttctggcgccaacggagccaccggtatggatggggttcgctgctcttggactgatgatctgcctgctcgtggcaggctggttaagcccgatcctgcgcgcggtggctggtatgggattggcgatggcgttgggatggagcgcagggcaacacgccactctgaccgctctgccgttggagcctgtgccaaacagggccgtgattgtggaagggatggtgaccgcggttgagaccggaccagactggcgcaggattgttgtcgccgctccctggttggatggggtgacgcattggcagcgttcggtgcggttgagagtgcgggatggagaccatacgagccttcagtcaggtgaccggatatcggtgcgggcgctgatcagaccgccaccatggcctgcttatccgggtgcgatggatcggcagagagacgcatttttctcccggataggggctttcggttttgctctggcgcctgtttcgcatctggtatcgcggcaggatgcggtctcgatccgtttggccagagtgcgggaaatgatcgccgagcacgttcgcacagctttgccggggcatgagggagcggtggcaacggctttgttgaccggcgatacggcttccattccgcaatctatccgtattctgtttcgggatacggggttggctcatttgctggccattgcgggtctgcatatcgcgattgtcatggggaccatctttgccgtgacgcgctggctgctgacccggagcgaatatatggcgctgttctggccgtgccgacagattgccgccgtgatttccttgctgtcggggatcgcctacgcggtgctgaccgggttgcatgtgccgatcatacgcagtgcggtgatggcgatgattgcctgtctcgctctgtttctggggcgcagggcattgtccatgcgagggttggcgattgctgcggctttgattgtcctgatctggccgtatgaagtcaccggggtcagctttcagatgagttttgctgccgtgatggctctggcagccggatatgaggcgttgggaccatggctggccagtctggccgggcggcgtgtgctccatcatctgacggcggtggcgttgaccagcttgctggcaggcactgcatcggctccgtatggaatttatcatttcgggcagctccagctttatttcgtggcgaccaatctgatcgcggtgccactgatggcattctgggtcatgcctgccggtctgctggccatggcactgatgccgcttggccttgatcgacccgtttttgttgtcatgggaatcggaatcaggctgatcctgaccgttgcgaaactggtcgcagccttgccggctgccgtccttgctgtgccgccaatgccaggctggggactgttcatgatcagtgccgggctgatctggctgtgcctctggcgtggtcgtgtccggttgtgcggtgtgccggtaatggtggcggggatagcgtctgtctggctaactgtgcatgccgacctcctgatatcagcggatgcacgtatggttgctgtcaaagccggtccacgtgtttttgccttcgacaagggaagttcgcccctgctgacggaggcatggcaggcttattggggtgtgaaagattttacgccgctttccgtggcggggcgtcttgccacgcacatggcgcgatgtggtgagagcggctgtctcgtcacaccggtgccaggcgccccgcgggtctttctgaaaacgggagagggcacggagatatgccagcccggagcgcttgccgtcattctggatggctggagcagccagtgtcgggatcagcccgtgatctccctgtcgcagatacgagaggaaggcagcattgcggtatggttcaggcccggcaggatctctgtgctgacagaccgggcatggcgcggggaccggccatgggtacaaccaccacctgataccagcccgggccagtggaaagcgccgctggcccggactgatgagacaatccctcagtaacggcgaagcaagccaatcagtcttccctgaacccgcacccgatcagccgggaaaattctggtttcatggcgttcattcgctggttccagtgccaccgacttgccgcgtcgccgcaggcgcttgagtgtgacttcagtatcatcgatcagggcgacgacgatctgcccgttttcggcaaggtccgattgctggataatcactgtatcgccatcgaaaataccggcatcaatcatggaatcgccagcaacttccagtgcgtagtgctccccattgccaagcatatcgatcggcacgctgagataggcgctggtgtcccgcaatgcctcaatcggcataccggcggcaatgcgtccgtaaagcggaagctgcacggccgaggcatcctgagccgcccgtacccccgcgatccggctggagaaactcccctgaataacgttcggtgtaaaagccggaggcgaggcaaaggacggagccgaaggggctgttttcggcaccggcatgctggcggcttccggcatgcggatcacttccagcgcacgggcgcgatgatggcggcggcgcagaaagccgcgttcttccagagctgaaataaggcggtgaatgcctgatttggatttcaggttcaacgccgctttcatttcctcaaaactgggggaaaagcctgttttacgcagatggccatcaatgagcagcaacagctcatactgtttgcgtgtcagcatgcagaaggcctttcaagaccgttccgaaaggaaaaaagcgcacaaaagaacaaacgggcaacaaagatgttctacataagttcgttctgtcgcgtcaagcgtcctttataatccggtactctccagtggcaggactggcacgatctctcccgctgcggcctgtggcgcatggggcgcccgcatgatcagcgcgttggcccgtgccagggcgctgatcattgaagaatcctgcacaggaaaggattcgacaaccggaccggattccgtctgcgttatgatcccgcgcatgaagtcggtgcgatgatcattggctcgcaagggggccaccagtcgtgccggctgtgtccgcaagggagtgtcaggcagaccgcgtaacacctccaatgcaggcagcacgaagagcagggcgcagacataagccgagacggggttgcccggcagaccgatcaaaggtgttccggccagttgtccatgcatcagcggtttgcctggtcgcatggcaattttccagaaatccagcgtcagcccgcgctcccccaatgctgagcgtaccagatcatggtcgcccacgctggccccgccgatggtgatcagcagatcggattttgtggcggcttccgcacgggcgcggatggtatcgctgtcatccccgctgagcggaagcaggatcgggtctccgccagcagcacggatcatggcggccagcatgtgggaattggagctgacgatcccacccggtggtactggctcccccggcagtacgatttcatcgccggttgccagtatcgcaacgcgagggcggcgatgaaccgccagccagggactattggcggcagcggcaagaccaatatcccgcgctgtcaggatacgccctgattccagcacggtttgatttgtggtgaaatcctgtccctgccgtctgatgtggcgatcaggccgtatggtctcggcaggaataacgatatcatcctgtcgctgcgcttcttcctgcaacagaatggtatctgagccttgtggaacaacgctgccggtgaaaaggcgaactgcctgaccggtttccacgctgccgctgaacggatgtccggctggagccgcgccgatgacggtcagtctggctcccgccactgcatcggcgcagcgtactgcatagccatccatggccgaaacatcatggggaggttgggtcacccgtgcctgcacactgacagccagtacccgaccatgcgcttcggcaattgagaccgtctcggccatggtgggggagacggaggccagaatacgggcgcgggcttcttcgaccgggatcatgattctttgttcaatcctgtcggaaatgacctgacttgccgccggatttttcaaccacacggatgtcgctgataatcatgccgcgatcaacggctttgcacatatcatagatggtcagggcagtgacgctgaccccggtcagggcctccatttcaacgcctgtgcgcccggaggtccgcacccgcacctcaatctcgacttctcccggcgtatcgtttcggaaatcaaccgtgattgccgtgactggcaacggatggcaaagcgggatcaaatcagccgtccgcttgaccgccataatcccggccagccgcgcaacgcccagcacatcgccctttttggcactgccttcctgaatcatcgcccatgtggatggctgcatcgtgatccgtccacgggctacacccagccggtccgtgaccggtttgtcggcaatatccaccatagccgcttccccggcggcattgaaatgggtcaggcggggagaatgcttatcctgcatgtcaggcaatgggcgggacagaagatgaagcatcgatgcctatcagctcacgcacggccttggtgacatcctgctgccgcatcaggctttcgccgaccagaaagctgcgtacgcctgttgccgccaggcgctgtatgtcttcatgcgtgcggatgccgctttccgcgaccagaaaccggtcgggcggaagcaaaggcgcgatgttcagggtggtggagaggtctgttttcagggttttcagattgcggttattgatgccgatcagtcccgtctgaagggccagtgcacgatcgagttcggcttcgtcatggacttcagccagcacgtccagatcaagatgacgggctgtttcttccagttcccgtgcttcgtcatcggtcagtgcggccatgatcagcaggatgcaatccgcccccatggcgcggctttcatagatctgccagggatcgaggataaaatccttgcgcagtaccggcagggacacggcggcacgcgcagcgaccagatggtccggatcaccctgaaaatacggtccatcggtcagcacggacagacaggtcgcgcccccgacctgataggctttggccagttcggccggattgaaattcgggcgtatcaacccgccggagggagatgctttcttgatctcggtgatcagaccatagccaccctgaagcacggcatccttcagtgcctgcccgaagccacggggggcaggcagatcacgaatacggttgatcaacgtttctttggaaagcaacgctttgcgttgcgccacttccttgcgggtatcggcgcagatacgggccagcacatcgtaaccggtgggcgtggcggccccggtttcggctggcgtggtctgatccggctgtgaggcgggaagtgttgtcatcatggctccgaaagtagtcacaggcacgaatgaagaagcaacaggcctataccaccgtcatggcgatggtaaaaacgggcttcttcagtgtcccgataaaatcaaagggatcaagggattgcattggttgctgcccgaagcctgttcagggccgataatgctgatccatcatcaatggatcggcgggcaagggcgaccccttctttcagcgtgccggtctgtccggcgacgatcagggcggccgccgcgttcaggcagacagtatcacgatatggtccgtcggctccgtcaagcaaggcctgcaggacccgggcgttgtggtccgcatcgccaccctgaatggtatccagcggtgcgcggggcaggccggcctcttccggggttacactgaactggcgcaggctgccgttttccagcgcggtgacctggctttcgccggccagcgtcagttcatccaggccgaggccatggacgatccagcatgtctccgtgccaagctctcccagtaccctggccattggcgcggcccagatcggatcgaaaacaccggtcaactgccgcttgacgccagcaggattccccatcgggccgatcaggttgaacagggtgcggatgccaagctgtgaacgcgcctccgcagcatggcgcagggcaggatgaaaatggggggcaaacaggaacgcacagtgctcatcatgcagaatggcttcctgccgctccgtgccgaggtcgatctgcacgcccagcgctgtcaggacgtcggcggcgccagagcgggaactgagggcacggttgccgtgcttggcgattggaatgccgcatccggccacgacaaaggtgacggcagtggatatgttaagcgttcccgcaccgtcaccgcccgtgccgcagacatcaatagcgccatccggtgctttgatggggatcatatgtgaccgcagcgcccgcacggccccgcccatttcagcttctgtttccccgcggagacgcaaggccataaccagcgcggcaatctgggaggatgtggcctgaccacgcatgatcagatcaaaggctgcgaaggcttcttcttcgttcagatgttcgcctttggcgaggcgcgacagaactgggcgcagatcggtctgcaccggaacaggggaggaggtcatcggaaaaatcaggcggcaagacgcggcggcaggatggctggaacagcttccccccgggcggcggcaagaaaattggccagaatggcatggccatggcggctggcgatgctctccggatggaattgcacgccgcaaatcggcagggagcgatggcgcagccccatgatgagaccatcttccgtctcggcggtaatttccagcacgtccggcaaggtctcccgctcgacgatcaggctgtgatagcgggtggcctcgaacgggtcggggaggccggagaaaacatcctgccccccatgatgaatgggggaggtcttcccatggagcggataaggcgcccggcagacaacgccaccaaaggcttgaccgatcgtctgatgaccaaggcataccccgaatagcgggatagtgtgttcagccgcggcctgcaccagcggcagacaaattcccgcctgttccggggcgcgggggccgggggacaacacgatcgcctccggtcgcagggcaatggcctgttccacggtgatgtgatcgttgcggcgcacatcgcaggtcacgccgagatcgcccagaaactgtaccaggttgaaggtaaagctgtcgtaattgtcgatcagaaggatcatcgtcaccgcacccggcgttccgcttggttatctgctctgaacacagagtgtattatcctctgcatctctgcctttgttgttctcatcgtggcgcgtttcaatccccgcgcccagcccgttgttgtcatgccggaaatgtttctgacgctgagccgctttgcagtgagtcatgaagggaatcagcctctccattcctgaaagcgaccagaaatcgggtgaggatggagcgagcttctcccagtgccgtctcccagtcaccgggtgttggctgccggacgatccgcatggaggggtaccatgcggtgcggttgccatgcatgcgccagcgccagtccgtggtgaaacggttcagcatcagcacgggtttaccaagggcaccggccagatgggcaaccgatgtatccactgtgatcaccagatcgagcgccatgatcagtgctgcagtatctgcgaaatcggagagatgtgaggttggatcaagcaggttgatcccggcgggagggtatttcgcttgctgcgccggtgaccctttctggagcgagatgaaatgagcgccggggagttgggcaaatgctgcaaaagcagacaaaggcagggagcgctgggcattccaatgctggtgttcggcatcattatcccggatgctgccagcccagcaaataccgatcagggcatcacccggccggggggtcaatatctgctggaatgtatttttccactgagcttcatttgctgaagatgcagacagataggggaccggctctgcattgcgaatataggggtcattcatcacatgcggcaggctgagcagcggacaatgcagatcgtaatgcggcagggccgcaccgcgtggcacgacgaagataatgccgggaatatgtctgatcagcctgaccagcggttgatccacctccaccacaatcctgtgttttctggccagaaccggcagataacgtgcaaattgcagcgtatctcccataccctgctcggcccatagcaggatggtctggccctgtgtgtcctgcccttcccagcgggggcaggggaaggggcgtggttgccgcccatcacggtgccatcgcgcctcataaagcgcgtacccttcctgcatcgtgctgagcagcatcagcacatagccgagattgaattctgttgtcgggtggccgggcctgagcgccaatgcccgacgcagcagcggttctgcctcctccggtcggccgagatccttgcacgcaccggccagagacagcagcagatcggggttatcgggctgcctcaagacggcgcgggtcagatagggaaccgcttcttcgagtgcacccgtcgcggcgcaaagtgtgccgagtgcttcctctgccgcttcatgatccgggctggcggccaccgccccccgcatcagggtgaccgcttcctcactgcgccccagatcgtgcagcagggaggccaggccaaccgcataatccggccggttcggctccagatgcagggcgttgcggaacgcggtttccgcttcttcatgccgcaaatcctttagacaggcatgggccagcgtattctggattgcgctatcctgaggggccagtttcacagcttgccgcagaattgcggctgcggcggcgtattcctgccgttcgatcagcagcaatcccagaagatgcgccggcgcaggatcagactgattttcccgccacgcctgtcggtatgcattttcggcgtcttcgagcctgccctcccggtgggcagcgcgggcgcgttcgaaccaggactgttcaaacgtgctcacgaagcaatcccggtggcgaaaaggtgatgcatttgaaaaccatgccgcttttgcaggacttcaccaacgcgcagccggtgacagatatgaggatcggtttcgtaacaaagcaggcagcacggtgcctgaccagcaagtgttgcagcttgctgaagggccatctctgcttccggtgtgatcagtttttcgtccacgatggaccagaagcgaggccagtcacgcctcttgttagcttcccgtccttccggcggggtgccaagagggcggagatggacataagaaattccgtgctccgccaggctgttggcaaggatggtttttgaaaatccggcccgtctggataacgggcgatcccggacatcaatcagtgttttgaccccggtctgaagcagagcctcgatcacgtcccgctgtgccgttttctcatagccgatggtataaagtggcgcaggggacatggcgcggttatttcagtgcgtcttgggttgcggcggcaaagcggattgcttcttcggcggcacggaacagggcgcgggctttctgccgggtttcctcatattcggcagcgggatcgctgtcggccacgaccccgcatccagcttgcacatgcatcatgccatcctttaccaccgcggtgcgcaggccgatacaggtatccatggtgccatcagccgcgaaataaccgatacagccagcgtatatcccgcgccggtcgggttccagctcctcgatgatttccatcgcccggactttcggggccccactcagcgtgccggcagggaacccggcacagagcgcatcgaccgcatccagacccgctttcagcctgccgcgcacttcggaagaaatgtgcatcacatgactgaaccgctcaatcacgaagctctccgtgactcgtacgctgccgagttcggagacgcggcccacatcattgcggccgagatcgatcagcatcagatgctcggcccgttccttggggtcggcaagaagctcctgttccagcgccttatcttcctgcggggttgcgccgcgccgtctggtgccggcaaggggacggatcgtgacttccccatcgcgcaggcgaaccatgatttccgggctgctgccgactacggcaaagccgtcgaaagccagatgatacaggaacggggccgggttgatccttcgcaaggcccgatacagggcgagcggtggcagggagaagggtgttgagaagcgctggctcggcacgacctgaaacacatctccggcacggatatagtcgatcgcccgcacgacaccggcctcgaaatcctcgcggctgatattggaggaaggctcgatcgtgccgccgccatcctgaggcgcgcctgtcatcatggcacaggcaggcagaggacccgccagacgggtgagggcagccgtgattgttgcgcaggcccgttcataagcgtcccgtgcgctgatatccgagcgcgggaagagaggcgccgcgagggtcaggccatccttgaccgtatcgaaaatcgccatcagggaagggcggcccagaatggcttccggcacgtccaatatggtctgatttttggtgggcagcacttccatctgccgcaccatgtcatagccgagatagccgaccagcccggccgccatggcgggcagaccatccgggatatccagcctggtctcggcgatcaggcgtcgcagactatccagcggtgcgtccggttcgggtgtgaatgagtcggcgtcggtcagggcggaccggttgatttcagcctgaccattccggcaccgccacagcagatcggggcgcaggccgataatggaataccgcccgcgcgtggcgcctccctcgacactttccagcaagaaagagttcggctccccgttggccagcttcagataggcggagaccggtgtttccagatcggccactgcctgcgcccagaccagcacgccctcaccacgatcataggcggcctggacggtttcgaaatccgggaaaaaaggcgggggcgtcattgttgcataatccgttgcagcagagcgttattgacccgcgcatcggctttggaccgcagcgatgcgaggaatgtattttccagatcctcggccagcccttgcgtgatttgttcccgtgcctgcgagaaggcagcagggtcgtccttttcggtcgggctgagaatacgggtcaggcggatgatcgcgaagccatccggcgtgttcaccatggtagagtcattgagcttgagggcaaacaaggcgcgccgggtgtcggcactgacatcgccggtttcgcctttacgtgtcagcaggggaatctgcttcagcgtgccgccggagagggtgacggcatcagccaccgactttccctcctgcagggcgagcatggcacgggtagcggcctcttcctgactgtggtggcgtttatcctgtatccagtccgcggtcacttcggccttgacctccgggaaaggacgcagggcgccgggaataatgtcctctacctgcacggcgaaataggtggttggtccggccggcgtacccggctggctttgcggtgtcacgggtaccagatggggcgcatcaccttttttcatggagaacgcggcggtgatgagtgcctgtttcaactggtccgagccggggatgggggccggggtgccttcgcgtgtattgccttgcatgtccagctgaccagagatcgctgccacagcatcggcatccggcagcttgtcatccagcgtcgatccctgcgcaaacgcctcgtccagatgggaggagcggtcatagatctgctccatggcgcgctgggtggagagaatctgcttaatctcctccttcatctcctcgaagctgcgatgggtggcaggctggattttgccgacacgcacgacatgccagccaagcgaatcgtgaaccggcccggcaatctgatcggttttcgtggtctcgaaagccagaggcatgagatcaggcaccggcagctgttgctttgtgatgccggtcagttccactgcactgccgccatcgctgttggccagagcactgatctttttccagtcggcaccgttgtcccattgctctgccagcgctttggcctttgcttcatccggcaccagaacgatgctgacatcccgcttttccggtgtgtcgaaatggatgccattcgcgtcgtaccaggcacggaggtctttttccggcacctctatggctttggcgaccgtttccggggtcaggacgatagccttgatccgacggtattccggggcggtatagcgtgcgggatgattggcccagtaacgttccagctgcttgtcagtcggctggggcggggcgggtgctgcggagaccgggacttcgatcatgtctccgctgcgctgctccttctgccaggcgaagagcggagccaccagaattttgggggcgctggctccggcgcggatcgcgtccagaagctgccgttccgttatagtgcgccgcaaataggcgacatagctgtcttccgtcagccccacactgttcagcaccgcctgaaagcgtgcctgatcaaactggccctgatcgtttttaaaggcaggcatagcgtaggtcgcctgccggatatcggcatccggtgtggtcagccccatttttctggtcaggtcatccagcactgtctccgtcaccatctgctgcaaagcctgctgggccaccattttgcggatgtcgggcggcacgtcctgccgtcccccgcccatctgctggcgcacgcgattcagctctctctggtaggtggcctgaaaagcctgaggttcgatccggctgccattgacggtgacgagtgcgccgcccccggtggcctgggtccagacatcggagaatccccatcccacgaaggccagcaccagaaggccgaacaacaggcgcacaggccacgcattgagagagtttcgaaaggtagcgagcatggggcaggtatccatggagcgtatgagggccggcaccataatgcggcttgaccgtcagggaaatggtctcgctggtcctgataaagcctggttgcattttgcgtcttgctggaaacccccttactgagagaccgtccatgccgcagaaagacggttgttagatttcggaagggtcccgatacgccatgcgccagctgattgccggaaactggaaaatgaacgggctgcgcagtacgtcggagtcgttgttgcaggccctgcgggatgcggctcctcacgcgctgcggaattgcgacatgctgatctgcccgcctgcgacactgattgcacaggcggcatcggttctggccggtagcgggattgaggtcggggcgcaggattgtcatatggcccgctccggcgcgcatacgggcgatctgtctgcggaaatgctggttgaggcaggcgcgcactgggtgattctgggtcattccgagcgccgccgcgatcatggtgaattgagcgaaacggtgcgtgagaaagtcatcgcagctcgtcagttcggtctgaccccgattgtctgtgtcggtgaaacggaggatgagcgtgcctccggccgggaaacggagattgttggctggcagatcaagggcagcctgccggacgggtttgcagcggactcgaatggcgttatcgcctacgagccggtctgggccatcggtaccgggcgcacagcgacggtagaggatgtggccatgatgcatgccttcatccgggaggaactggttcgccagtttggagaagccgggcggggcgtccggattttatatggcggctcggtcaagccggagaatgcggccagcctgctgcgcgtgccggaggttggtggtgcgctggtcgggggggcgagcctgtcggcacaggattttctggccattgctgaggcttctgcctgaccgaaagccggcatgcaggaaggggcgggcataccggcatgggggatgtctgcattttgcgtaacggaatgctttgcagagtccgggcatatctgtagaaaccgcgccggttacctgctgaggtcatcccgttacggtcaccccgtggtcacagggcctttgtcatgtcggcatgatggctttgaaagacgatcctcggctctgaccgtgctatatggttggaaagatcatctggaataaccggcccccggccgcgaaaggctgcttatgaataccgtgctgctgataatccacctgttcgtgactctggcgctgatcggcgtggttctgatccagcgcagcgaagggggcggtctgggcattggcggctcccagggaatgggatcgttcatgagcggtcgcggcaccgccaatctgctgacacgcaccacggcgattctggcgacgctgttcatgctgctttctttgacgcttgcgctgctcaatcgcggtacggcgggtgtcggccattccgtactgttcggtcagggcacgcctgctgcaccttccagcccgtcattgcccgctgccccgcctgcgcatccccccgccggtagccagcctgccgcgccggatgcaaagacggctgttcccaagactccttcggcaccacaggtgccggcgaattgatgatgggcgcgtctcctcacgcacagtgtttgttccgttcctttgccacagaagattgagatctcatgacgcggtttgtattcatcaccggcggcgtggtttcttccctcgggaaaggaatcgcttcggcggcccttggggcgctattacaggcgcgtggttattccgtccgtctgcggaagcttgatccttatctcaatgtcgatccgggcacgatgagtccgtatcagcatggtgaagtgttcgtgaccgatgacggggcggaaaccgacctcgatctcggccattacgagcgttttaccggtgtgcatgcccgcaaatccgataatgcgaccaccgggcgtatctattccgatgtgatcgcgcgggagcggcgcggcgattatctgggtgccacggtgcaggtgatcccgcacatcaccgatgcgatcaaagatgcggtgacacgtgatctgaaccaggatctcgatttcgccctgatcgaaatcggtggaacggtcggcgacattgaaagcctgcctttccttgaggcgatccgtcagctcggcaacgagcttggcccgtcacgcaccatgttcgtacatctgacgctggtgccctatattccttccgcgggggagctgaagaccaaaccgacccagcattcggtgaaggaacttcagaatgtcggtatccagcccaacatgctgctgtgccgctgtgaccgtctgatcccggaaaacgagcgtcgcaagatcgccaatttctgcaatgtgcgtcaggaagcggtcgtctcggcattggatgtcgataccatttattccgtgccgatccgctatcatgaggaaggcatggaccgggaggttctgcggcacttcaatcttccgattgggggggagccggatctgacccgctggcgagaaatcgccgatgttgtgcgcgcccctgatggcgtggtgaagatcgcgatcgtcggtaaatacatcaccctgctcgacagctataagagcctcgccgaggcgctggttcatggcggtatcgccaatcgtgtcaaggtcgagatcgactgggtggatagccagatttttgaacaggccgactccgtgcagcgcctggaaggggtgcacggtattctggtgccgggcggcttcggtgagcgtggagccgaaggcaagatcgaggcggtgcgctttgcccgtgaacacaaggttccgttcctgggaatctgcttcggcatgcagatggcggtgattgaggcggcacggaacctggccgggctgccggatgcgtcctccaccgaattcggcccgtgtgaggtgccgattgtcggcctgatgaccgaatgggcgcgggggaatgatctggagcgccgttcggcatccggtgatctgggtggcacgatgcggctgggttcctatccggcggcgctgatcgagggatcgctggcccgtgaaacctatggtggtgtgccggtggtgcaggagcgtcatcgccatcgctatgaggtgaacatccattaccgggagcagctggaagccgtcggcctgcgcttctccggtctctctccggatggggtgctgccggagatcgtcgaatatgccgatcatccatggttcgttggcgtgcagtatcatccggagctgaaatccaagccgtttgatccgcacccgttattctccggttttgtggccgctgcggtccggcaggcgcgtcttgtctgatcgcggtgagaatgggcaggcgcggattgtcacggtcggcaatgtgcgcttcggcaatgatcttcccttcgttctgatcgcggggccgtgccagattgaaagccgcgcacatgcggaaggtgtggcggcggaactgcatgcgatctgtgcgcggctggacatcccgttggtgttcaaggccagctacgacaaagccaaccgaaccagtgtcggtggcgcgcgtggggtcgggatggagcgcggcctcgatattctggccgggatcagggagcgcttcgacattccggtgctgaccgatattcatgatatcgggcagtgcaaaccggcggcagaagccgtcgatattctgcaaatcccggcttttctgtgtcgtcagaccgatctgcttctggcagccggagaaaccggtcgcacgatcaatgtcaagaaagggcagtttctggccccttgggacatgcggaacgtagctgcgaaaattgcgtcgaccggcaatcacaatctgctgttgacggagcgtggcgccagtttcggctataacacgctggtcacggatttccgcgcgctgccgatcatggcgcagaccggctatccggtggtgttcgatgccacgcattcagtgcagcagccgggtggtcagggcacggcatcgggcggagaccgtaccttcgctccgattttggcacgcgcagctctggccgtcggcgttgcctccgtgttcatcgaatgccatcccgatccggatcgggcaccgagcgatggtccgaatatgatcccgctcgaccagatggaggaaaccctccgccggttgaagcaattcgatgtgctcggcaaggctggctgaagccagagcctatgatcacgcaacgggaggggaaacaagcatgaccgccgataaacccctccgttattggcaggatatgagttggcccgagattgccgccctcgataagcaggccgccattgctgttctgcctgttgcggcggtggaacagcatgggccgcatctgccgttatgggtcgatgcagccattaatgaggggctgctgaagcttgctctcgatcgcgtgcccgacgacatgcaggtgctggcactgccgatgcaggcggtgggatggagtgaggagcatatcgcttttcccggtacgctgaccctctccgcggatacgctgttggctgtattgcgggatctgggggccagtgtggcgcgtgccgggttcaggcgtctggtgtttctgaattctcatggcgggcagccgcagattctcgatatcgtggcgcgggagcttcgtatccgtttcggcatgttcgtcacagtgtgtggctggaccaagctcggtgtgccggatggtctattctcgccgctggaacggtcgacgggcatccatgggggggcgctggaaacatccctgatgatgcatctgcggcctgatcaattgcgcctgtcacggatcgatgatttcgtgccggcgcatcgtgatgattctcatcggcatctgtcggcgacaggacggattccctatgcctggacggcgcaggatctgaatcccggcggagcatgcggggatgccagagcggccagtgcagagaaaggacgtattctggccgagcatctggccagtcaattcgtcagcctgctgcatgaggttgaaaaattcgatctggcccggttgcaggagacgattgattcatcgcttgtaaaacggcagtgaaacgaaatccgggacaggatgttgtaacccggatcggccttatcagggcgacaacatcaggacaggatgcagacgatgacgctggttgacaggagcggcttcgacaggacgggccggttcaggagttgcagtcggcgaatagcgggcattctgagcgtggcggcattgctgttgctgacagcctgttttcatcatccggcgcagaattacttcatattctttgcccccgatgcgtctcaaccgaaaacggacagcctgccgattttgaaagtggcggtgacctacgccaaggatcatcccgatcagaatatcattgtggtcggctatacggaccctgtcggctcggccaaggataatcatgatctgtctgaagagcgtgccgacaccattcgcaaggatctgatcaaggccggtattccgcaggcccggatcacagcgcgcggtcatggacagacccagccggaatggaacaatcaggaaagccgccgggtcgagatcagattcgagcacccctgacaagagactggatcatgaaacagtcttctggcgcagttctgtttgtctgtctgggtaatatatgccgctctccattggcagaggctgcttttcggagggaggcgcagcgtgccggcctgacggtagatattgattctgccgggacgggaggttggcacgcaggagaaccccctgatccccgtgcgcagaccatagcgtggcgtcatggagtggatatttctgactatcgggcgagacagatcagcgcggatgattttaagcgttttacccatatcattgcattggaccgcgacaatctggcggccttgcgccgtttgcgcccgaaggactgcctggcttccctcagcctgcttttggatgaagtgcccggacgggagggacagtcggtcgccgacccgtattatggcggcctgaaagatttcgaggttacctgggccgatgtatcggcgggcgcagcgagtttggcactgcgcctgttgcgggggcggaatacaccatccgactaaggggcactttcacagtcttctatacctgcccctatgacgacggggccaagtccgttgctctgtgatctgcaaccggtagtggcattgctttttcccggaccaattgaggccgaggaattgcttccggccgatgcggctgaggaagaggggagcatggcaggcgtgctagttgccgtgctgccgccattattcatggccgcgggataggcggccgggttcgtattcgtcatcacggcgctgccttccgccgggcgtgcagcggtatcgtccgtggcacgattcacggcactggttgcagggcggctggctgtttcagtggtcgggctactctgctgcacagtggtttgtgccgcagtctggggagacgaactttggacagatgatgaagtggctgtctgggccgggcagggtaaggaaagaagactgcctgccagaaaaaccggaatggaaacaaacagggcggtgctgatccccctgcaccgggaatgctgtttcagtctgctcatagtctgcctccctgtttcacatgggccgtgagaagaacggttcaaccggcatccagattgcgcagggcatctccccggccgaacagacgcagcagggagcgtgcagccagtccacgagggccggtcaggccggggtcctgatccagcagataggccgcatcccggctggcgatgcgcaacagcgctgcatggcggtccgtatcggccagccgccaggagggcaggcccgattgtcgcttcccaagcagatcgcctcctccccgcaggcggaaatcctcatcggcgatcaggaagccatcttccgtgtcccgcagtaatgtcagacggcggcgcgcggtttcgctcatgccgtcttcatgcaacagcaggcagaaactggccgcagcaccacggccgacccgcccgcgcaactgatgcagctgcgccagcccgaaccgctcggcatgctctaccaccatgatgctggcttccggtacgtctacgccgacttccaccacagtcgttgccaccagcaggctggtgcggcccgcggcgaattcggacagcgccgcctctcgttcggcactgtcctgttggccatgcgccagaccgaccttctcgccaaacctggcacgcagcacggcaaaacgctcctctgccgcggccatgtcgctgacggcgctttcgctgaccagtggacagacccagtagacgcggtcgcccttgtccagcgcccggccgataccgtcgatgacggcgtccagtttgctcagagggtgcagggtggtgcggatgggttggcgcccagccggtttttcggtcaggcggctgacatccatctcaccccattgcgtcagcagcagggtgcgggggatcggggtggcggtcatcaccagcacatcggtccggctgcctttgctgcccagcatgccgcgttgctcgaccccgaagcgatgctgctcgtcaatcacggcgaggccgagatcacgatactgcacactgtcctgaaacagcgcatgggtcccgacgatgatcttgatgcgcccggcctggatgcccagcagcagattgcgcctcgccacccctttgaccgagccggtgagcaatccgacctgtacgggggaaagtttcgacagggtgcggtaatgctgttgcgccagtaattccgtgggcgccatcatggctgcctgcgtacccgcctctaccgcacgcagcatcgccatcagcgctaccagcgttttgccggcgccgacatcgccctgcaacagccgcagcatgcgccttggggccgccatatcgccgtcaatttccgacagggcctgaagctgcgaaccggtcatgggcttgccgaaccggatgagagcttcttcccgcagggtattgtcgccggagagagaccggcccgggcgctgtcgctcgcggcgtttcatccatgccatggccagctggtgggcgaacaactcgtcataggccagccggtcatgcggggactgatccggtatctgctccggctgatgcagcgcatgcagcgcggcaccgaaacagggccaggatttcttcgccagcagatgcggatcaatccattccggaaaatcgggcaggcagccaagtgcttctttcagcgcacgccggatctggcccggaaacagtccggccgtaagcggccagaccggctcgatggctggaatggtgtccatctgggtgatggggacgatatggtcaggatggggaaaggtgattttttcaccgaaccggtcggccttgccggaaactgcgacccgggtgccgatcggcaaacgatccaaccgggcgcggctgaagaacacgatatctgcctcgcatccctcccggtccatgactttcacacgccatggctgccgtctggtagccggagcatgatgcgccacgacgtccagcgcgatcgtcaccactgtgccgggttgagcttcccgcaaagcgctgatggctgtacgacgggtgaacccatccggcaggtgaaacagaagatccagcacgcgtggaccgccgcaggctttctccagcagcggggcaagagtcggaccgatgccgggcagggaggtcaacggagcgaacagggtggaaaaaggatcgctctccaccggtgcgtgatctccctgatgtgaaccggtattttacactgaatcgcagatcatgaccggatcgttgacatggcgggctgacaaaacctgccatgcggctatatgaaccggcctgatggtccatgaaacccccctttccgatctttcccctgttcctgatcccgctctggaatcacgacgccgtcgtttgctgttccgtgccacgcatcgtggcacgcatgagaacgacattctgattggcggttatgtcgcggcccgtctggaacagttttccgaagcggagctggatgcgttggaagcaatcatggatctgcccgatcctgaccttgcggactggctgaccgggcgcaggccgatcccgccggatcatgacacctctttgctccgtgcgatgaaggacgccgccggacgttgaacggagacccgcgatgctgacagtttacggtgctcccgagggttgggatgcggttctgatcaatcgccgccgtcaggagacgggtggggtgatcgtgcatgtggcgcgggatgatgcccgtgtggcgcgtctggccgaggcgctgcggttttttgcgccaaaggtcgaggtgctgactttccccgcctgggattgtctgccgtacgaccgtgtttcccctaatccggagctggtcagtgaacgtgttgccacgctggcgcggctggcggagatgcctgattctccgcgaatcgtgctgacgacattcaatgcgctggtgcagcgtgtgccgccacggggccagtttcatggcacggggcttgatctgggggtaggcgatctggccgacccggatgagatggcgcggtttttggaccagcacggctatgtgcgcgccggcacggtcatggaggccggggaatacgctctgcggggtggaatcgtcgatattttcccctccggtgaggctgagccgatcaggctcgacctgttcggcgatcagattgaaagcatccgccgcttcgaccccactacccagcgcagcggtgaggcggtggagcggctggtgttgcgaccggtcagcgaaattcccctcgacaaggacagtattacccgttttcgcactgcctggcgggaggtattcggtcaggacgcggcgcaggatccgatctatctgagcatttccgatgggcggcgtcatgccggtatggagcattgggcacccctgtttcacgaaagcatggaaacccttctggactatgtgcccggcgcggtggtgagtctggaccatcagggcgaggatgttctgcaatcccgtcttgagatgatcgaggatcattttcatgcccgccatgctccggtgcgggagggcgaaacaccctatcgggccttgtcaccggagcggctctatctgacccgtgccgaatgggatgcggcgatcaatccgcggcagccggtgattttttccgtgttcgaccggccggatggagcacagggcgtggatggcggtggccgctccggtgcgctcttcgcgaaaacagccgcgactgaaggcggcaattcctttcagcaattgcgggatgcatcccagcaatgggcgaaagatggccggagactgatcgtggccgcatggtcgcgcggctcccgcgagcggctgatgcatctgctgcgtgagaacggcataaaggcagagaccgccggaacgttcgagggcgcgcgcaacctgcccttcgatacggcggcgatggtggtgctggggctggaacgcggatttctggccgaaaaaatcggtgtggtcagcgaacaggatctgttgggcgagcgtatcgcccgtccgccgcgcaagcgcaaaagagcggaccagtttatcgccgaggccaccgaaatcgccgagggtgatctggtggtgcatcaggatcacggcattggtcgctatgacgggctggtgacgctgacggtcagtggtgcgccgcatgactgtctgcgcctgctgtatgacggtaacgacaagctgttcctgccggtcgagaatatcgagatgctgtcccgtttcggtgcggaaacggcgggtgtggcgctggacaagctcggcggcgtcagctggcagagccgcaaggcgaagatgaagcagcgtatccgcgatatggccggagagctgatccggatcgccgcggagcgtaaggtgcgtgaagcaccgatgctgaccccgcaggaaggcgcgtgggatgagttctgtgcccgttttccattcgcggagacggaggatcaggcgcgggccatcgccgatgtgctggaggatatggcttccgggcgtccaatggatcgtctgatctgcggcgatgtcgggttcggcaagaccgagatcgccttgcgggcggctttcgtggcggcgatgacgggcgcacaggtggcggtggtggtgccgaccaccctgctggcgcggcagcattaccggaccttcgccaaacggttcgaaggactgccggtgacggttgcccagctctcccgcatggtcacggccaaggaagccagccaggtgcgggcggggctggcggatggctcggtgaatatcgtggttggcacgcatgcgctgctggccaagacggtccagtttgccgatctcggcctggtgatcgtggatgaggagcagcatttcggggtctcccacaaggagaagctgaaagcattgcgggccgatgtgcatgtgctgacgctgacggcaacgccgatcccgcgcacgcttcagctcagcctgtccggggtgcgggagatgagcatcatcgcgacaccgcccgtggatcggctggcggtgcgcactttcatcatgccattcgacagcgtggtggtccgggaggcgatccagcgcgagcgtttccggggtggtcaggttttctgtgtctgcccgcgtctggaagatctgggccgtatggcggaacgtttggcggaaatcgtgccggaggcgaagctgatcaccgcgcatgggcagttggcccccaccgagcttgagcgggtgatgaccgaattcggtgacggcaagcacgatattctgctggcgacgaatatcgtcgaaagcgggctggatatgccggcggtgaacacgatcatcatccatcgtgccgatatgttcggtctggggcagctttatcagctgcgcggacgggtcgggcgtggcaagcagcgtggctatgcctacctgacctggccgcaggcgcatcgtctgtcggtcgcggcggaaaagcggctggaagtgatgcagacgctggatacgctgggggcaggctttacgcttgccagccacgatctggatattcgcggtgcgggtaatctgctgggtgacgaacagtccggccatatccgcgaggtcgggatcgagctttatcagcagatgctggaagatgcggtcgctgatatgcgccatgccagccatcgggagtcggcacgcgactggacgccgaatatcggtctgggtctgccggtgctgatcccggaaacctatgtgcgcgatctgccggtgcgccttggcctgtatcgtcgcatcggtgcgctggcatcggatgcggagaccgaagccatggcggcggaactggtggaccggttcggccccatgccggaggaggtcgaaaacttgcttcaggtggtatcgctcaaacggcagtgccgtctggccggggtggagaagctggaggccgggccgaaaggcatggtggtacagttccggggcaatcattttgccaacccggccggtctgatcgcctggctcgccagtgttcagggaccggggggtgttccggggcagggcctcaaattgcggcctgatcacaagctggcgctggtctacgacatgactgtggcagagcgtgtgcaggttgcgaaaaccctgctgggcaatcttgttcgcttgacgcaacaggcgcaggcggcatgatctgcggatgaaacatccgaatggctccctactgcatgttctggttggacgctctgctccactgggggagcggcaggtgccgagcgcgatcgacaagcgcccggttgcgggggccttgcaggcatatcggaacgggttcgctgaggacgatcaggcggatcgccgcgtgcatggcggccccgacaaggcgctgcatcactacccggtcgagcattatgccatgtggcgacaggaagaaggggaacaccctttgctgcgtcccggcggctttggcgagaatttatcctccctcggtatcatggaggaggatgtggcgcttggggatgtgttccgccttgggggtgccttgctggaggtctcgcagtcgcgtcagccttgctggaagctgaatgcacgcttcggcctcagaaaaatggcgctgcgtgtgcaggaaaccgggcgtacgggctggtattatcgggtgctggaagaagggatgattcgtgccggggatcagttccagcttcttgaacgccgctctccagaatggacgctgcggcgcgtatggaacgtgctgtatgtcgattcactgaaccgggatgagctgtcggagatggccgcgctgccgcatctgccggaaggctggcaacgcgccgtgctgcgccggctggaagtcggggtggtcgaggactggtcatcccgcctgaatggatgaagcgtttatcctcagccctcgttttcaagcgcgcggcatcgtgcgtagagatcgaaattgtccttttccaacccggcaattctcgcttccagcgctgcaatgcgggcagccattgcctgcacgggaattttgatcgggatatgcgccgcacagtttgaatcccaggcggtgacatgcatgataaaggcctgaagcggatgcccggcataggaatcgacgcgcagcctgtccagcaaagcggggtcgtcatcaaccatacgagcctcaccccatatcttgaccctgtggcgttcctcataatccatcagaaacaggcagcattttggattttccgacagattgccggtggtgatgtactgccggtttcccttcagatcggcaaagcccagcgttgaactgtccagaacccgcagaaaaccgactgctccaccacggtgctgtaggtaaggctgtccattggcgctggaggtcgcgaggtaaaagctgtcccgttcggcaatgaaatcggcaagaggctggtcaatgctggatcggaatgttttctggcggagcgcctgataggagccgaatcgtttctgggcgttctccgttgcctgagaaaacacagtctggcgggtgctggtcgaagcagaagactgaatatcctgagctgtcatgctttctgccggaggttcagtgcgggtcatatttttttatcacaagccggtgaggaaaaaagacaaagtaaaatctcgccccattgcgatctggcacgttacactcagaatgcaacgagaacagggggccgtatcatggcgcatgacaataatctgattgccatgatcgtgatcggtttcggtctggcctttctgtttggaacagcggcgcatcggctgcgcctgcctccgctggtcgggtatctgttggcgggcgtggcgctggggccttttacgccgggctttgttgcggatcagacactcagttcgcaactggctgaaatcggtgtgattctgttgatgttcggcacggggctgcatttttccgtcaaggatttgcaggccgttaaaaatattgctgtgccgggcgccttgttgcaggtttcctgtaccagcctgctgggatttggtgctgcgttattgttcggctggtcggtgggggcggcgatcgtctttggcttctgcctttctgtcgccagtactgtcgtgctgatgcgtgccctgcaggaccgccacctgatggaaacagccaaggggcgtcatgccattggttggctgattatccaggatctggtcactgtccttattctggtgctgctgcctgcactgaccggagtactgaagggtggaaagattgatgttctgccgttgctggaaaccatcggtctgacgcttggcaaagtcatcgctttcatcgtgctgatgatggtgatcggcaagcgcgtgatccccatggtgctgcactatgccgcgcataccggttcgcgcgagattttccgtctggcggtgctggcgattgccttgagcgttgcattcacggcttctgaactgttcggcgtctccttcgcattgggagcattttttgccggcgtggtgctgagcgaaagtcagctcagccaacgcgcggcagaggaaagcctgccgctgcgtgatgcgtttgcagtgctgtttttcgtttccgttggtatgctggtcaatccgtctatcctgatccgtcagccggtggaggtgatggttacggttgcggtggttgtgattggcacgccgctggtgacatttttgatcctgcgcgcccttcgccagtccatgagtgcatcgatgatgattgccgccgggctggggcagattggcgaattctccttcattctggcatcgctcggtgtttctctggggctgatgccgaaggagggacaggatatgatcctgggtgcctccatcatctcgatcttcctcaatcctctgctgttttccttctatgagcggcgacgtcaggccgttgcagccgctcagcaggagacagtaagcgcgttgactacgcccacagaagacaagatccccgctcagccagagagcgaagagccggacgatacgccggttccaaccaccctccggcagcatgctgttctggttggggcaggccgtgtcggtggcctgattgccgccgccctgctggaaggcggcaagccgctggttgtcattgaggaaaataacgagcttgcccgtaacctgcgcgatcatggggcggatgtgttcctcggcaatgctgccggtgggaatgttctcgatctcgccaatgtgactgaagcgaggctgctgctgatcgcgatccccaacgcattcgaggctgggcagatcgtcgagcaagcccgccagcggaatccgaatctggagatcgtctgccgcgcgcatttcgatgacgaagtccgccatcttcaggaatacggggctgatttcgtagtgatgggggagcgtgaaattgcgcttgccatgctgaaccgggccgaaacggtcgaggtccggcacgatgaaaaccccgacgaggcctccccaagcctcggcttttcagctgttgctccgactgatgtctgagcatcaatcggggaggaagctggggcaggggtaagacagcatccatgctccggcagcccagccgttcggttttggcataaccatgcctttgtgacgaagagtagagcctgttttgtacaggtcgcctttgttcaatgccaatgaccgctatggtcaaaaagcgtcagcatggtgaccaggtacggtaacaaggagcgtttcctctcatggctctctcagcgaagccggtccagcgtccggccaatccgcaattttcctccggcccatgcaccaagcatcccggttggtcgctcgcggcgctggatgtatccctattgggtcgtaatcaccgtatggtcgcgccgaaggcccgtctgaacgaagtgatccgtcgcagccacgcgctgctggagcttccggccgactggatcgtcgggctggtcccggcctccgataccggggcggtggagatggcgctctggtcgatgctcggggcgcgtggcgtggacgtgctggcctgggaaacctttaccgaaatgtgggctgtggatgtcgccacgcagctcaatctgactgattatcggctgttccgcgctccatggggtgaactgcctgatctatccgcagtcgatgccctgaaccgtgatatcgtcttcgcctggaacggtaccgcagccggggtgaaaatgcctgatgcgaactggatcccggctgatcgcaaggggttgacgatctgcgatgcgacctcggctgcatttgcgatggaattgccatgggacaagctcgatgtcgtcacatggtcctggcagaaagtgctgggtggagaagccgcgcatgggatgatcgcgttgtcgcctcgcgcggtcgagcgtttgctgaccttccagccgccacgccccctgccgaagattttccgcctgactgaacccggtccggatggtaagcctcagttgattgatagtcttttccagggtgagaccatcaatactccctccatgctttgcgtcgaggatgcgatgtcagccatcgcatgggcggagcatatcggtggtgtgaaggcgctgatcgcgcgcagtcaggcgaatttcgcggcggtggaacgctgggttgctcgcaccccgtggattgattttcttgcaaagaaccctgctacacgcgccacgacctccatcacccttcgtcctgtgtcaccgtggtttacagcgctggatgtggtggaacaggctgcggcggtaaagcggatggtgtcgttgattgaggcggaaggggccgggttcgacttcgccaattatcgtgatgctcctgccgggttccgcatctggggtggggccaccgttgaaacggctgatgtcgaatgtctgctgggctggatcgactgggcctatgctcaggtgcagtcggaatatgtgcaaaaggctgcctgatcgcagtcgcttcagaagtttgaacaaatgggccggatgcaactctggagggggtatgcatctggcccgctgtttgctgcgttcatgccgagcaatgtgattgagcagtgagggcagtatgaagttcccggcctggttggctcccggttttcttgcgggatgggtggctctgacggggctgacggtctgtctgcctgataaagcgcaggcggaactggcggaagggcagcaggcccccggtttttctctggaggctgcgctggccggaaagaccttccgtttttctttggccgaggcgctcaggagcggtccggtggtggtctatttctacccggctgcttttacttccggctgtacgcgggaggcccatgatttcgctgaggccatgccgcgtttcaaagcccagcatgccacggtcatcggggtatctggggatgcactgacaacccttgaaaagttctctgagtccgcgtgtggcgggaagtttccggtggcggcggatccggatcgtgctgtgctaaggcagtatcaggtgcttccggatgcgctcagcatgcatgccacccgtacctcatacgtgatcgtgccgggtgctgcgggacagcctggtcggatcatctacgtctatacggatggtaatccagagaaacatgtttccaacaccctgcatgccttgcagcaatggcggtctcacccgtccggccatgaggaacaggtcaggtcacactgacggttcacgcgggttcgtgataacgggtatgatcctccgcttttcgggaatggcctgatccggtccggcgatgacgcctgatgaaacagactcagaagcgggtagagtggacgatggataaccgttccttgatgatcgtgtggtttgtcggagccgtgatcgccctgacgatttacgcgcttgaccctggcagcttgttcgtaatgctggctgaactggtggaaacggtccaatcccataccatggatctgttggcgacgctgggggtccggctggagaatctgatacgggcatcagccatcgccctgtattttgtttttattgttctcggctttcttgctctgcgctccggattaaaggcgaaggcggccctgctggtagtatcgggggtctttttcatgttggtcggatctcccggcggatggggtgtgccggataatggaggacactggggtgccgcctgcctgctgagcggagcaggtgccctgaccatgacaagacgtattctgctggcctctcacatggaattgcgggagggttctgccggttgggagcggaagttgccttgaagaaaccggctttggatgcaggacgatatgcagggtgagggctggcgctaaaacctctttcgcgttttatctacgcggcccggtttgcggcttgcattctctctggacggtgtttcccgtggccgggaacatcactggcatgaaaaggtaaggtcatgatgcgtctattcgtttttgctctgctcaccgtctccgttctgcctgccatggcgcaggccgccgatacgggctggaagccatcgaaatgcggggcagagccgtcggccccggccatcgacctcagcaactacgctaaatacggcgagagcgtaaaaaaggtgaaccagtaccagaaagatgcacagacctataatacctgtgtccgcaatgaggcgaagacggaaatggacgccatcagcaaatccgccgccgctattcagaaaggtatctgggacaatttcagcaaatataatgcggctttcaaggaagctgaaagcaagacaaaaaagtaatttctgcagaatagcatcaggaccggccctgtttgaatgccggtccatgttatttacggcccgaatacgcgcactgcccgacgccggacaataaaatcggctggcgtgcgtgttgtgatctcaccgtctgtattaatactgcgaggatgtctggtgtgtacttccagagcctcctctgacagggttatgacttcacgccagcgtccctgggttcctcgccacagggccggtaacaggcggatcagcctccatgcgctgtcaacttccagactccatacatccagcttgccatcatcgatggaggcatcttcgctgaccgtcatgcctccgccataatggcgtccgttaccgatggccagatgaagggttttagtgaccgtcgtcgtaccaccgtgacggatttcagcatgaaagggacgcaggcgccgtgcgacacgcagggctgcgatcgggtaaccgaatattccaaaccgttttttcgagtcgctggtcagcgcacgggtcagggcgacgccgaacccgatactggcgacattgaaaaagggcactccattgacttcacccagatcaatccgatgctgcttgccctgtgctatgatacgtgccgcctgctccgggtcggcagggatattcagtgttcgtgccagatcattcgcggtgcccagcgggataatgcctaagggaagctgtgtctccatcagagccggggcggcggcattcagcgttccatcaccaccgccgatcacagcacagtcgatagagtcgcgcaggtggagcagactgtggttgatgtcatctggcccctggcaggatggtatttcgacctttatcccttgggcttccaaagcggcgatgacttgatcagccgcatttcgtcccttgcggcttttcctgttgatgaacagggcggctcgccgtggtggagcaacctcggctttatcactcatgatgccagtccgatcagatgcaggatggcggtatagccgagcatcaccagcgcaatatcggccaccagcgctaccagagccatgatccagcctaccgcaatccaacgtccatcccgaacgaaaacaccggtggcagagaccagcagggcggaagcgggcagcatattgcccagtggaatcggcaggataatgaggattgcattgctcaggcaggcaagcccggtcagcttctgccatatcccgtccatggcccaaagccagccgggcctgctgtgacggcccagccagttcaaaggccgctccagacgcttcaggacggcattgatatcgtgtcttgccatgcttctgcgacgcagaaaatcaggcatccagagatgatccccgcgaatcatcagaccgatggagatgatacaggtagcacccccgaaaacaggtgcaggtcccggtatcagcatggccagtccaagcagcaacaggatcaaccccggcccgctgctgcctgcatgatcggacagcgcaccaagcccgatccggctgctggtgggatcggcactgccatcaacgatgccatagagatttgtgacgagattactctgacgggagggcgggccagagggcgggcgagagggcggtgacgtggctgacgatggcgacacgatgaaaacgggtctttctgttgaggatcgtaacgagaccgtaaaggggttccgtaatctggaacgactctggaaccatcaggttgccgcatcggcctgtcagatatcacggtcaatggcagtggtaatggctgcggttcgggctgtcatcgagagtgaagccgcacatttcaccctataattctgctggacagaggagaattgccaaactcctgccttcctgatggtgctggacggatgctatagcccccggcggcatgagtgacatcacatccaataaggcgctgctcccgtcgggactgcgcgatctgttgcctcccgaggcggaggcagaggccgtttgcgtagcgaccctgatgggggttttctcggcgcatggttatcgccgggtcaagccgcccctgatagagttcgaagaaaccctgttcgccggagcgggtggcgctgtatcagatcagtctttccggctgatggacccggacagccatcggatgatggcggtcagacccgatatcacaccccagattgcgcgtatcgcgaccacaaggctggccgaggctgcgcgtccgttgcggctgtgctatgccggggaatgtgtgcgggtcagccccggttccctttccgccgaccgtcaggtttctcaggccgggatagaattgatcggggttgatacgccttctgccgatgcggagcttattctggtcgcacgggaagctctggctgcagccggcctcacgcaggtcagtttcgatctgaccctgccttctctggtgccggtgctactggggcaggccgggcgtgaagagggtagtctgaaacccctgctgcatgcgttggatcgcaaggatgcggcggaggtgaagaaacaggccgatcgcattgtcgggcctgctatcgccgatattctgggtgatctgctgttatcggccggtccagcagacggtgcgctcgccgccttgcaacgggccgcgttgccggatgaggcacaggctttggccgagcgtctggcggcaacggtgggtgaaatccaggccagtgcgcctgatctccgcctgacggtcgatcctgttgaattccgtggcttccgctatcataccggtatctgcatgacggtttacgcccccggaggcggtgcgcccggtgtggggcaggagttgggtggcggtggccgctatatgtgtcagggggaagcaggtccggaatcagcatccggcctgaccctgtatccggaagccattctgagggcagtcgcctccaagcatcgccctgtccgtgtatatgttccggtgggtgccaatgcggatcgcgctgcggcattgcggcgtcagggctttgtgacggtggcggccctggatggtgttgccggcgctcatgcatcggatcacttcgtagcggcacggcagcagggctgtgtgcatgtccttgctgacagtgcgttggtcgctgtgccggatgcattgggcagctgattttgcttctttgcctgccggtctgatcccgatgatatgtcaggatcataccggcgtggtgttttaagcgcgcaagcgcattgtggatggcaggttatagagcagcctgcctgatttcatggagtaacgcgcatggccaatgttgccgtgatcggcgcccagtggggtgacgaaggaaaaggcaaggtcgtggactggctcgccagccgcgccgatgtcgtggttcgtttccagggcggccataatgcgggccatacgctggtggttggtgatcagacttacaagctgtccctgctgcccagcgggctggtgcgcggtaagctcggcatcatcggcaatggcgtggtggtcgatccggaggccctgctgtctgaaatcgcccgtgtttccgcccaggggctggccgtagggccggagaccttgcgcattgccgataatgcgacgctgatcctgccgctgcacggtgctatcgaccgtgcgcgggagcaggcgaggggtgacagcaagatcggcaccacaggccgcggcatcggcccggcttatgaggacaaggttgcccgccgcgcgatccgtatcgccgatctggccgagccggaaaccctgtccgccaagctggacgagctgctgttgcatcacaacacccttctggccgggttgggtgctgaaactttcgagaagcaggcgctgctcgatcagcttctggcgctggcgccgaaaattctgccttatgcggaaccggtgtgggaacggctggatgagatcaagcgggccggacagcgcatcctgttcgaaggggcgcaggcggtgatgctggatgtcgatcacggcacctatccgtttgtgaccagcagcaacaccatcgcggcgacagcagcaggcggctccggcatggggccaagcgcggtcgatttcgtactcggtattgccaaggcctattccacccgtgtcggctctggtccgttcccgaccgaattatttgacgaaaccggcgaactgcttggtgatcgcggccatgaattcgggaccgtcaccggccgccgccgtcgctgcggctggttcgatgcggtgctggtgcggcaggcggtgaaggtcggtggtattcaggggctggccctgaccaagctggatgtgctggatgggctgccggagctgaaaatctgcaccggctatcagatcaatggcgagacattccggcgtctgcctgcttctcctgcggctcaggcggcagcgaagccggtttatgagtcgatggaaggctggtccggctccacgcagggcgcgcgttcatgggccgatcttcctgcgcaggccatcaaatatgtccggcggatcgaggaactgaccgaggttccggtcacgctgctttccaccagcccggatcgggatgataccattctggtgaaagacccgttcgagggttgagacgcctgtaaaaacggcccggttgaaaaaccgggccgcttgtctgtgttagggtggaaagcagaagaaagacgatcaggctgcggtggcgcgttgatagtcctcgaccttctgatcggctatgcggcgctgttcgatgacttcggctttcatcgccttctgaagcttctcgaaagcgcgtacctcaatctgccgcacccgctcgcgcgagatattgtagtgctgcgacagatcttcgagcgtggtcggctcgtctttcagacgacgctcggtcaggatatggcgttcgcggtcgttcaaggttttcagggcattggccaacagggttttgcggccacccaattcctcagtatccgcgagcacggtttcctgtgtctcggcatcatcgaccagccagtcctgccactctccttcgccttcctgacgcagcggagcgttcaggctgtgatccggggcggacatgcggcggttcatctgcaccacatcctgctccggcacattcagcgaggtagcgattttggacacctgctccggcttcagatcgccatcatcaatggcctgcatctgccccttcagacggcgaaggttgaagaacagttttttctgagccgcagtcgtgcccattttcaccagcgaccagctatgcaggatatattcctgaatagcggctctgatccaccacatcgcataggttgccagacggaagccgcgatccggatcgaaccggcggactgcctgcatcatcccgacattgccttcgctgatgagttcaccaacgggaaggccatagccgcgataacccatggcaattttggcgacgagacgaagatgggaggtgacaagccgatgggccgcacccatatcttcagtgtcacgccagcggcgcgacaggtccagctcctcctcgggggtgagcatgggatatttgcgaatttcctgaaggtaacgggaaaggttgccttcaggagcgattttaatgacggcagaggccacggacaggctcctttcgtctggcgatgtgctgtgtcctgcccatgataaggcgcagaaggcacatcggttccggaggatagaccggaaagggtgtccggaagaccttatagtcgcttcatcatccctgcatgaggcaatgataaagacgacaggccgacacggtggggcaccccacagcaccgtgtctgtgtgaaaaagataaaggaccaatctggtccggtcaacattaaaattatgataaactatgaattatgatcgagtaaatcgatgaggctcatcatatcttccggcaatggggtctcgaaacgcagattttcaccggttcgtgggtgcctgaaccccagcacgccggcatggagcgcctggcggggaaagtcgagcaaagcgtttttgacatcctgatccagactctttgcgacggctggaatgcggcgcagatagaccggatcaccgatgatgggatgtccgtttgcggagagatgcacgcggatttgatgagtgcgcccggttgcaagcttgcattccatccgtgtgacagcgtcataccatgttgccatggcgcggtaatgggtcagtgcgggtttgccgccatgacggacaatggccatgcgcttgcgatctcttgggtcgcgcccgatggcaccttcaatatcgccttctcggggcgtaaggacaccccatgcgagcgcggtatacagcctttccagatcacgtgccgcaaacagggctgaaagggctgccagagcaaactccgtcttggcgacaaccatgacgccggaggtatctttatccagacgatgcacaatgccggggcgcttttctccgccgattcctggcaggttctccccgcaataggccagcagcgcattgaccagcgtgccgtctggactaccgggggccggatgcaccaccatgccagccggtttgtcgagcacaatcagatcgtcatcctcgaacaggatcgggaaggcgatgtgctgagcaatgggaatggccggagcaggggtgggcagacgcagccggtacaggctgccgggacgcaccatctcagccggtccacggacactttgcccatcacggtggaccgcgccactctcgatcagtgatttcagccgggagcggctcatatcgggcagatggatggccagaaagcggtcaatccgctccggtactgcgtcgggggcggcggagaccgttatttctgcttggcttggatcgttcggggtggcaggcatggggcgcggatagcgcaattatgatcgcttaggaaagacaaaggacgttcatgcagcagcttctgaaggccgccgttattctgatgggtgttctgatcattgcgggagtggtcgctctggccatcctgatcccgcagcgtatgggcggtgctggctggtttcagcagggcgcgcaatccatctcggttccggccccgtccggttcccgcattgccagtgtcgggctgagcgacaagaggctggcactccatctgcaagggggtggccctgatcgcgtggtgatcgtcgatatggcgaccggtgccgtgcgcgcgcagatcgttctggccccacagattcctgagatagccagataatagggcggcggcctcttgcgttggcaggaggccgcatgtatagagcgcccctcacaatgcctcgtcccattcgtctagaggcctaggacaccgccctctcacggcggcaacaggggttcgaatcccctatgggacgccattgaaatcattaaatattttgagttatccacaaatgttttagatggtggtttgaccatctaaatatcagagatgctctttttgtttaaacagttcctaaaggcaccagcctctattcgggactggcggctccgtcggcggtaaaccagatcacctgaccatgcgggcatagatgcgtggcgggaacgtcggtggtgccttcacgaacagctttgataatctccgccttccctttgcccgtcaccagaaaagcgatcacggatgcactttccagagcgggataagtaaggctgatcctgacctccgggcggccttccgatacggcggcaacccatttttcgcgctctttcaaaatgggctggccgggaatgagggacgctgtatggccgtcctccccgagacccagaaacacgacgtcgaaaaacggcttttccggatcgagcgtatcagtcccataatccgccttcatcctcgcttcatagcgttcagctatgacgactggatcgccttctcccggaatgggaaaaacattgctgggcggaatgtcgatatgggacagcaaagcttcgttcgtcatgtggaagttactgtcggggtcatcatgcggaacgaagcgctcatcaccccaataaagatgcaccctggtccagtcgatctgcttgttccacggggcctgcgcaagcgtctgatagagtttccggggggttgatccgccagacagcgcgatacgcaccggggcctgagatttctggatacgctcggccagccacgcggcaacatggtcagcaagagcctgtgccgtatccagcacgacgagttgtcctggcaatgcagccgcaccgggattggtcatgagagaaaatgctcctccatcgctttcgcgaacccttcatcctcgacagagctggtgacggcgctggcttccgccttaacctcatcatccgcctggcccatggcaatgctgaatccggcgaccgtgaacatttccacatcatttgctgaatcgccgatgaccgcgatctgcgcaggctcaatgccgtaatattcagcgagataacgcaccacgccgcctttgttggcatcgggatgagtgatatcgagataatagggctgtgaacgattgactgacgcctgattgccgagtgtggtcttgatatgccgttcagcgcttttgacgcgttcaccatcatcgctgacgcccacgatcttcacagtgtcgttcaggagtgaaaacagatcgtcagtcacggctggatcggattgtgtggtccaggcttcccgttctacatgcgcggcatcgggattgcgcagataccactgcttctccgtgtaaacccagatatccagaccggcctcttccagcatctcgacagcctgcttcgcagcattcgggttgagagtgcgggccagaatgggatgaagcgcggtatcggtgatcatgccaccattgaagcccgcaatcggcgtatcaagggtgaggggttcaaacagcatccgcatcccgatcggagggcgaccactggttacggcgaatttgatccccttgtcccgcaacgcctgcaccgccttgattgctcgcggggtcagaactttctgttttgtgacgagtgtattatcgacatcgctcagaacaagccggatattctggctcatgaattaagatccctccactggaacccgtctttcgccagcaaatcatcggcttctttcgggccattgctgccggatgcgtagttcgggaaatcaggcgtctgcctggcccatgcatccagaatgggctgcacgatcctccagcctgcctcgacgaaatcggcacgctggaacagcgtggcatcgccgatcatgcagtcatagatcagcgtttcatagccggtcgtcggacgacgttcgaagaaatcagaataccggaaatcgctcgatacctgtttcacttgcacggtcggcccgggaactttggcgttgaaatcaatcgacatgccatcattcgggctgatgcgaatgacaatctggttgggcggtaaattttcgatcccggtgtcacggaacagcgtgaacggagggcgccggaattgcagcacgatttcggtgcagcgttcgctcatatgcttgccggtgcgcagatagaaaggcgtcttgccccagcgccagttgtcgatcatcaacttgatggcgacgaacgtttcagtggctgaatgcggatccacattcagttcggaacgatatccctgaacgtctgcgccttttacggtgcctggaccgtactggccgcggacggcattgtcggccacatcttcctcggccatcagacgaacagcctgaagcaccttggctttttcggaccgcactgcatccgcatcgaatgaaacgggaggctccatcgccgttacagccagcagctggaacagatggttgggcaccatatcccgcaaggcaccggcatggtcgtagaagccgccacgcttttcaacaccgaccgtttcagcggcggtaatctgcacatgttcaatgaagtggttgttccacagattttcgaacacgccatttccaaagcgcatcatcatgatgttctggacggtttccttgcccagaaaatgatcaatccggtaaacctgattttccttcagaataccaaggatttttttattcagatcctgtgctgatccaagatcatggccaaaaggcttctcgacaatgacacgccgccatggcccttcatctttttgctcggtcagtccggcggagccaagctgttcgataacctgcgcaaaaaatctgtctgcaacagcgaggtagaacagacggttgccatcacgcagagactgccccagatttttaaatgtctgactgtcggagaaatcacctttaacataggtgaagcgatccatcagccatttccaggcatcttcgtcgatagaatctgtttcgaattcgacaccttttttgccgataaaagaatggatcatgtcggtcagctgttgacgccagctttccgtatccagatcggcgatatcgacgcccacaacccgaaaatcatccggcagcatttttgatgctgccagactgtagagtgacggggtcaccagacgtttcgtcagatcaccacctgccccgaaaataaccatgtcgcaggcaggggcgggctggaacaccgtgctgttggtttcagcctgcgcccgcgtgcagcccattttgggaatggaggacatgacgatcagcctttctgctcgacatggcccccgaagccgaagcgcatggcggagagcatcttctccgcaaagctatgctcctcgcgggagcggaagcgggtatacagtgcggcactcagtacaggggccggtacggcttcctcgatggctgcattgatggtccaacgaccttcaccggaatcggagacggagccggaaaaattatccagtgtcggatgctgtgccagtgacatggcggtcagatccagcagccaggaggaaatcacgctgcctcgccgccagacctcggcgatatcggtggtgttcagctcaaatcgctcatcttccggcagttcgggggagtttttgttatgcagaatatcgaagccttcagcataagcctgcataattccgtactcgatgccattatggaccatcttgacgaaatggcctgccccggccggcccgcaatgcagatagccttcctcggcacgggcatcgaacccttcgcgatgcggcgtgcgctcgatcgtaccgataccgggggccagcgttttcagaacagaatcgatccgctctacaaccggcttatccccaccgatcatcatacaatagccacgctccagcccccatacgccaccggatgtgcccacatcgacgtaatgaatgcctttttcgcgcagggatttggcgcggcgaatatcgtctttatagaaagtgttgccgccatcaatgatgacatcatcactgctgagcaaagaggaaagttcggtgatggtggcttccgtaatttcccccgccggtagcatgacccacactgtgcgcggcgtatccagtttggagacgagatcggacagggaggatgctccggttgcaccttcatctgacaatttggacacgacatccgcggcacggtcatagacgacagtcttgtgtccgtcccgcatcaggcgacgcacgatattgccgcccatacggcccagtccgataacgccgatctgcatggttcgtcagtccttctggttttggtctgccccggtgtagagaatggccggggcagacaatcgataaggcttggtcttatgcgcaggcgtaataaacaatcagatcaggacagcgcctgtctgactgcgtccgcaagtgtcgtgagaccgctttcgacaccgctggtgaaatgaacccgcaaggcgcggcgcccacgctcggccagtacatcgaaatccccccgtgcctgagccgctttgacaatgctgaagccgtagctctggccgggaacgggttgatcctgcgcatcttcggtggtgatttgcaggaacacaccgctgttcgggccacctttataggcctgtccggtagagtgcaggaaacggggaccgaaaccgaggcaggttgccacatgcttcgcgttcaggatctgtgcccggatatcctgcatcgcggcttcatgggcctcggtacgctcgatataggccagcagcgcggcataatcaccgctgccgatccggtcgaaatggatcttcagcgctgctgccaggctggtgggggtgccaaatgctgccgcattgcgcggatcggcatagagagcaatgccctcaccagtgaagaacggcttttcttcaggcagagagccagttttttcaaccgaggcggtcagttcgcgtgtcttgatcttgctggcttcgacatctggttgatcgaacggattgatgtcgaggatggcgccggcaacggctgtcgcaatttcccaacggaagaattcctgcccgatatgcagcgtgctgggaacggtcagacgcgccaccggatgcccggctttttccagagccgccacaaaggcagcctgttcagcatcttcaccgtctttcaaagcgatataggcaaagaaacgatcattcccgtaagcggtgggatcaagacgaggttcatcggcaacagggataagccccttgccctgcttaccggtcgattccgccagaagctgttccagccacgcgccgatatcggcaatgccgggggaggcgatcagcgtcaccttgtcccgtttgtattttgtcgccgcgacgcccaaagcaagaccgagttgcagcccgggattttgtgccggaggtgcataaggaccgcaggcatgaaccatttcaagcgttttcgacaggaaagccggaacgtcgatgccgatagccgctgccggcaccagaccaaatttggagagcacggagtagcgtccgccaatgctcttcacgccatggaagatgtcggcaaacccatcctgtcgggcaacctcttccatatgggagccgggatcggtcaccgcgacgaaatgacggccgttcttgcccgctgcttcatagaaatactgtttgaagatattcggctccagcgtgctgccggatttgctggagacgatgaaaagggtggtcggcaacgccaccgcatcacggatcgccttcacctgcgccggatcggtgctgtcgagcatatggaaaatcggccagccactgcgctgtccgaaagtcttgctcagcacttcggggccaaggctggaaccgcccatgccgagcagcacgacatcggtataaccaccttcctggacatgctgagcaaagcgggtcagcgttgcagcatcagccagttcctgttcgacgatgtgcagccagccgatccatttgtcttcatcggcattggtccacaaagtcttttcaccccgccacagggcgcggatcaggccgtcgtgacgccaggtttcggtctcggtctcgacatcttttttcagcgcgtcagagccgaaagagatgacgctacgggtggcttcaccatcgaaaaactgggcacgacgttgggccacggcaccgtagagcttgtcggcatcatcagcgaaacgctgtacgccatcgaccaccagatcagtggtgatctgatcgagggaaatgccctgtgcggcgaggtcgtgcagggttttctgtgcggcttccagatcgtcctcgatcgtggttgcaattttgccgtgatcgcgggtggcgtccatggtcgcgggcggcatggtattgaccgtgttggcgccgatcagggtctcgacatagagcgtatccggcagatccttgctcttgacgccggtggaggcccagagcagacgctgcggatgggcgcctttggcttccagtgccttccatcgcggatcggcgatcagtttcttatagtgctgataagccatttttgcgttggcaatggcgactttgccttgcaggctgcgcagaacatcggcatcgccttctccggctttcagcttgcgctcgacttctttctcgacagaggcgtcgatgcggctgacgaagaagctggcgacgctggcaatgtgggagatgtcttccccctttgcgacgcgtgcctccagacccttgatataggcccaggcgaccgcatcgtaagctttcagcgagaatagcagggtgacattaatattgatgccatcggcgatcagcgtttcgatggcgggtacgcctgcctccgtgcctggcaccttgatcatcagattcggcttgtcgacggtctgccacagccggcgggcctcatcgatcgtatcctgggtgcgcagggccagatagggggatacttcgaggctgatatagccgtcctgacctttcgtctgctcccacactggatagagctgatcggcagcatggctgatatcggtgatcgccagcgtttcataaagcgtggaaatgtccagatcgccgcggtcgagcgtttccttcaactgcggatcgtattccgtgctctggccgatggctttttcaaaaatgctggggttggaagtgacgccgcgtacaccgtcacgctcgatcagcttcaccagttccccactttccagcagggagcggctgacgaaatccagccatggcgattgcccgtgatcgttgagctgggcgagggggttcttggtttcgctcatgatatcaccgtgctttcgcgtgttttttgacctgctcgcgcgcggcttcggccacggcgtgcggggtaaagccgaaatgtttcagcagctctgccagcggggcagaggctccgaaagtgtgcatcccgatcaccgtgccttcagaaccggcatagcgttcccatccgaatgtcgcaccctgttcgatggtaacgcgggccttgatcgagggaggcaggacagtgtcgcgataagactgatcctgacgctcgaacagttcccagcttggcaaggaaacgacgcgggccttgatgccttcctgagccagggtttcatgtgcggcgatacagtgctgcacctcgctgccggtgccgatcaggatcacatccggggcgccatccgtgtcagccagaatatagccgccacgggcgacaccgctggcagatgcgtatttgttacgatctacagtcggcagggcttgacgcgacaggatcagacagaccggctgatgctggaacgggatcagggtgcgccatgcttctgcgacctcgttcgcgtcggcggggcgaagcacgatattgccgggaatggagcgcaggccgatcaactgttcgaccggctgatgggtcgggccatcttcgcctacgccgatgctgtcatgggtgaaaatccagatcgccgggatttccatcagcgcggcaagacggattggagcgcgcatgtaatcgctgaagatcaggaagccggagccgtaaggtcgcagctttgacagcgccataccgttgatcgctgaccccatcgcgtgctcacggataccccagtggaaattacggccgaggcggttttcagccgagaagcttccccccgcattctcaccggccgtatccgtgaaagtcagcagcgtgttggtggagggggcgagatcggccgaacctcccagcagccagggaatatgcttggcaacggcattcagcactttgccgctggactgacgggtggcaatgcctttcgcatcggcttcaaagaccggaatgtccttatcccagccttccggcagggttcgtttctcgatctgatcgatttcgttggcgagatcgggatattccgcgcggtagcgggcgaacagcgcccgccattccttgttcagacgggcagagcgtgcaccgattccattggcgaatgtttcgtaaacgccgtccggcacaaggaatttggcatcttccggccagccgtaaaacttcttcgtgagtttgatttcttcgtcgccaagcggggagccatgagcttcatgcgtatcctgcttgtgaggggcaccccagccaatgatgctgtgaaccagaataaaggccggcttgccggttttggcgctccggatatggcttagcagcgcatcaagcttcgcagtgtcgttggcgtcgtcaagagtatggacatcccatccatatgcggcaaaccgcgcggcgacatcctcaccgaaggccagattggtgcggccctcgatcgtgatgtggttgctgtcatagatccacaccagattatcaagcttgagatgaccggcgagtgaagctgcctcgccagaaacaccctccatcatgtcgccatcgccgcacagggcataaatagtgtagtcgaacaaagtgtagccgggacgattatagcgggcggcgagatatttctcggcaatggccattccgacgctgttggcgacgccctgacccagcgggccggtcgtggtctccacaccgctggtatggtgatattcggggtgccccggcgtcttgctgctcatctggcggaattgctcgatatcctgaagtgtcaccgctttctggccggatgtattgtattgattgtcgacagattcggtgccggtaaggtgcaacagcgcgtagagcagcatcgatgcgtgaccgatggacagtacgaaacggtcgcgattcggccagatcgggtccgtcggatcaaaatttaggtgattttgccacagtgtataggccacaggggccatggacatgggtgtaccaggatgcccggaattggccttctggaccgcgtccatcgccagggtacggatggtattgattgcaaccgtatcgcgagtatcggggtggtgcgtgtccatcaaggcaatcctcttccgcgtaatatgtcgatgtcaggccaatagagcagagcgatgcgaccgggaaggtagcagaccacttatcagcgtgccggagcagcatgacgggttcccagtgaacggtcgaacgaagagaagcgttccatccctatacacgattgggtaaggcccgttgtgaggccattggtgcagggcatgccatatgcctggtatgttatcagccagggccattatctgccagttcagaaaaatgtcgtctgtgcagtcagtggggactgtcagtctggagtatgcagcctatcatctaacacgtcgtccgcaactgccttcacacgacaaacctgtgacactgcgctgtgagattgcgccgtactcggatttgcttgttctgcatgatcgagcaggggagagcgggcgaaagaaaatccgattgccttcggatagcctttgcttccggttccatgctcagggcagccatactggtgacctttctgcgatattggggcatcagacggagagtgcatcttctgagcagagtatgtcactttaaaatcttgtttattgtatgtgcctgatgcggctgagaatcatcgtgccgtatcgggataaaatggttgtggggagcctgaacgatggatacggatgcgctgaagcgcctggcgggggaagaggcggcagcccttgttcaggatggcatggtggttgggcttgggactggatcgaccgctgcctgcatggtggatgcgctgatcagacgcgtggctcaggggctgaagatcgtgggaattccgacatcgctccgcacggcggagcaggcgcaggctggcggcattcctctgaccgatctgggtgcccatccgcggatcgacctcacgattgacggtgcggatcaggtagagcgtggcaccttgaatctcatcaagggtatgggcggcgccctgttgcgtgaaaagctggtggctgctgccagtgagcggctggtcattattgtcgatgatcgcaaattgtccgaaaatctgtctctgccggttcctgtcgaggtggttcccttcggctggcaggcgaccgatctgcgtattcaggcgctcggtggccgtaccgtattgaggggtggtgcggatggcactccttatgtcacggataatcacaactatatccttgatgtggatttcggagcgatgggcggctcccgtaagccggagacactggatgcggcgttgcgggagattgtcggtgtcgtggagaccggatttttcatccaccgtgcagaaaccgtcattatcgctggtgaagggggcgtcacacgctggcagcgttcggcctgagcccttatggcggtttgtcgatccatgctgctggtggtgatgggggtttccggctccggcaagaccaccattgcgcaggcgctggcgcggcggcttgggctggtgtttcaggatgcggacgatttccattccgcagccaatatcgccaggatgaaagcgggcattgccctgacagcggctgatcgcgcaccctggcttgccaccattgcggcctgggccaaaaagcaggctgaatccgggcaagggggcgttcttgcctgctccctgctgcgccggctttatcgtgagcaggttctgacaggggtgccagatcgacgcctcatctatctgcgggtgaaagcggatattctgagggcgcgtctggagcatcggtccggacatttcatgcctgccagcctgttggacagccagcttgcgacactggaagagcctgccgatacggagcatgctttgacagtggatgccggccagagtcctgatgccgtagtagcggagatcatacgccggttgtaacaggagggcagcggcgatctcgctccgcagagtcgctgacttattctgacacttcggacatttcaacggatccatgaagggggactcatgaagagccgacagtattgggtgttgtcattgctggccatcggaacctgtgtgttggggtctgtttcggcacaggccgagccgcctctcatcagtgaggtatgggcgcgtccttccattggtgctgaacgtcctggcgttgcctatctgaccatcagagggcgcggagagggtgacagggtggtgtctttctccactcccgtggccagttcggcagagttgcaccggaccacgatggagcatggcatcatgcatatggacaccgcttccggcctcgatattcccgccaatggcacggtgcgtctggcccccggtggctatcacatcatgctgatggggctgaaacaggggttgaaagtcggtgatcattttccgctgaccctgacatttcagcacgcaggcgcgcaaacggtggatgctgtcgtggcgaccgggggcaatggtgcccatgatcagcatgtcaaagatcaccattagacaagggtgatggtgatggcgacatggcagggcctgctgggtctggcggcatttcctctgatcgcgtggttgctgggggaatgtcggcgcgcgcgggtgccgtggcgcgtcgtgatatcggcttttgtactccagatggtgtttgcgctgcttctgctgcgtattcccggtagtgcggtcctgctactgggattaaacagggtggcactgaccctgcaggaggcaaccgacgccggaaccggttttgtgttcggttatctgggtgggggtccgttaccgttcgcggaaacaatgccgggagccagtttcattctggctttcaaggtgttgccgcttgtgctggtgatcagcgctctgtccgcgctgctgtattactggggcgtgttgccgcttgttgcccgtgtgctggctctgctgctgcgccgggtgatggggatttcgggtgcgctggcactggcggcggcaacccatatttatgtcggaatgatcgaggctccgttgctgattcgtccttatctggccgggatgcagcgtggggaactgttcgccgtgatgacctgcggcatggccggaatcgctggaaccatgatggtgctgtatgccagcctgatcgggccggtcctgccgggcgcgttggggcatattctcgtggcgtcggtgatcagcacgccggcggctctggggatggccgcgttgatggttcccttcgatacggctgaagatcgtggcaaggaaaaagggttgggggcatcactttctgttgaggaagcgccggccggagcacttgatgcgctggtcaagggaacgcgggatggtatcgcgcccctgatcggtattctgactgtgctgatcgttgcagtggctctggtgcatctggtgaacgatgctctgttcctgatgccgggctcgcccagtttgcaggagctggctgcatggccctttcgtccgttgatgtggctggcgggcatcccgtctgatcaggtcggggtggcggccggcctgatggggcagaagaccatcatcaatgagttcgtggcctataatgggttggcccatctgccttctggaaccctggatgcgcatgcgcggctgatcgtaacctatgcgctgtgtggttttgccaatctcggctctgccggtattctgatcggcggcatgggggccatggtgccggagcgacgggctgaaatcgcagcactcggtctgcgctccgtgctgtccggaacgctggcgacctgcatgagtggggccgtggccggattgctgttgggatgagaccggggcggatttcctgacagcagacaggcttgcaaaatcttttcaggacagctctattgtaccgatcggtacaaaggaagccttcatgtctgctacggttcaggatcagccccgtcctcccttgccgcctttttcgtgggaagatgcagtgaagaaggtgcgtgctgcggaggatgcgtggaacggacgcaatccggcacgcatcgcactggcgtacacatctgacagtgtctggcgcaaccgctccgaatttttgcgtgggaggcaggagattgaggcgttcctgacccggaaatgggagaaggagcatgactatcgcctgatcaaggagctatgggcttatggcgatcatcgcattgctgtgcgcttcgtctatgaatggcggaatgaacacggtcagtggtttcgttcacatggcaacgagaactgggaatttgcggcaaacggtctgatgcaagcgcgtcatgcgagcatcaatgatgttccgatcacacaggagcagcgcctgtttttatgggatcgttcgggaccgcgcccggcggatcatcccggcctgaccgaattagggctgtaacccggcgatggaacagccggaacgtatgtcggtgattgccgcgctgggcgaggtgttcagggagcatggctatgaaggggccagtctcagcctgatcaccgcgcgaaccggccttggaaagggcagcctctatcatctctttcccggcggcaagcaggatatggcggaggctgtgctggcagatgtggcacgctggttcgaggagcaggtattccgccctctacgggagcagaccgatacgaaggcagccataatcgccatgagcgaggcctgtatcgcctattttcgtggtggaggccgggtctgtctggtgggggcctgggcgctgtcggagacgcgggacaggttcaggacgcagatcatgacctatttcagtgcgtggcgggatgcgctggcggacgccctgacgcggggcggggttgctgaacatacggcgcataggcgggcggaagaagcggtggccctgattcagggcgctcttgttgctgcgcgggcgctgaatgatgccgcgctgtttccacgtgtgctgcgcgatctttctgcgtctctggtccgttgatagggagaatatctcatacaatccgggcgaatatggcgcccccggatgagggcgcatacgccgtgcggggggatgcgggggcggatgtcacgctatcgggcagggttgcctcgccgaacaaggtgagggcagcacgtacgcgtgcagcacagatttcgtcggtcaggcgatagaaaacctgtcttgcctcccgccttgtggagacgataccggcctgccgcagggcgctcagttgctggctcagcccgggctggacgatcgtggttgcggcttcgatatccccgacattgtgctcaccctgcagcagaatcgacaggatcagcaggcgttgcggctgggcataaagccgcatctgtccggcagcgcgggtggcctgttccggggtaagggtgaacctgtccatcagggcacggaggactgaaaacggcagagccagcgatccgtaatctccgccatctcggcctgcgtgacgggggcgggcagcagcgtatcctcaccgggttgccagccttctggggtcagggtgccggttcggctggtctcctgcaaagcaatcaacagacgcagcatttcctcgaccgagcgtcccacctgcatcggatagtagatcgcggcgcgcagcacgccatgcggatcaatgaagaatgtgcctcggacagcagaagaatcgggtgcggatggatcgatcatgccgtaagcgcgaccgatcaccatggaggggtcttcgacaatcgggaacggaatggtgatgccgaactgcgccttgatggcacgaatccaggcgaggtgcgcatgcaggctatcaacggacaggcccagaagatcgcactggcggtccgcaaatcggtcggcagcgcgggcgatggccatgaattcactggtgcagacgggcgtaaaatcggcaggatgggaaaagaaaatcagccatcgcccacgataatcagccagagaaacctgcccgtgagtggtgcgggcacaaaagccgggaacaatgtcgcccaatcggggtgggcaggcagagtgcgtcggtttttcctcgatcggtgtcgaaggggaaacagggggtgtcatccggccagagctgtctttcatgaacgggatgacctttcatgcacggagcaaacggggaaggtcaatttaaactttcattctttctgaaacaatgtatatttgcttcctatccatatcaatgcggtggcgctgtcagatgctgcctgaccacaggatgccgatgccgtgacggagatttcttgttcctctatgccgacagccccgcctgatccggtgatcggggctgcatgcaggcagattgtgcagtccgtccaggatgggttgtgcccggtggtgcaaagttttttcgatcgtcaaacgcatactgtcagccatgtagcattcgatcctgacagcaagcaggccgccgtcatcgactgcgtgctggattacgatgcggcatcaggacgtacctctaccggcaatgccgccatgattgtggagtgggtccggcagaacgggttgagcgtgcaatggctgatcgaaacccatgtgcatgccgatcatctttcagctgcgccatgggtgcacgggcagcttggcggtacgctgatgattggcgagcatatccggacagtacaaaacacgttcggcgatatttttaatgaaggcgacagctttgcgcgtgacggatcgcagttcgggcgtttgatcggggatggtgaaggctttgcgctgggtcgcattcctgccatgacgctccatgtaccggggcatacgccggcggatatggcgttcatcatcggcaataccgtctttatcggggatacgctgttcatgccggattacggaacggcacgggcggattttccgggtggtgatgcgcggacgctctaccgttctatccgccgtctgctgtccttgccggcagagtcacgcctgtttctgtgtcatgattacaagccgccccatcgcgaccacttcgcctgggaaacgacggtggccgcacagcgggcgcataatatccatgtccatgacggcgttgatgaagaaagttttgtcgccatgcgggaagcccgggatgcgacgcttgatctgccggatctcattattccctccgtgcaggtgaatatgcgggggggacgtctgcccgagccggaaaagaacggggttcgctacctgaaagtgccggtcaatctgctgtaatggctgatctggcgaatgactgtgtgtttgtcttcagaagtctgtatcagcaggaaatggcgcgatgtccttccataaaatcacttccagtttcacggccgctccgcaactgacggaagaggctgtggcaaaggccgcggccgagggatatcgcagcattttctgtatgcgcccggatgaggaggaagcaggccagccttcatccacccggatcgccgaagccgctgcgcgccatggattggcgttcgcttctttcccggtggccgcagggcaggtggcagacagtgcaacggtggccagaatggcggaggcgttcagaacgatgcctcatcccgttctgggatattgccgcaccggacaacgtgcggtttcgatctgggccttgtcgcagtctggcattctggatccggatgaaatcgttgctctggcgcagagtggaggtttcaatgtcgaaccgcttcgcccccagcttctgccgcttgcgccggtcggtggacgcaaaaccttcagtgtggtgattgtcggcggtggcgctgccgggatttcggtcgcagccagtttgctgaagcgtcagaaaaatctgtccgttgccattattgatggcgctacggagcattattaccaacccggttggacgatggttggcgccggtgttttcagtgccgattttacgcgccgttccgaagcatcggtgatcccggggggtgcacaatggctgcgctctttcgtgcggtctttttcgcctgccagtaacgaggttgttctggtggatggcacggtggttgaatacagcgtgctgatcgtcgccgcaggaatcaagcttgactgggatgccattcctggcctgacggaaacgcttgggaaaaacggtgtcacatccaactatcgttacgatctggctccctatacttatcgtctggcaaaagaattgcggggtggccgtgcactctttacccagccgccaatgccgatcaaatgtgccggtgcaccgcagaaagcaatgtatctgtcatgtgatatctggcagagcgcaggcgtgctccgtaacatcaatgtccagttccacaatgcgggcggcgttctgttcggcgtggcggcctatgtgccggcgctgatgaaatatgtcgaacgctacggcatttcccttcaattcggatcaaggctggtggccgttgatggtcccgcccgcactgcaacgtttgagaaagatggcgagcgtatcgagcggagtttcgatatgctgcatgtcgtgccgccacaggtcgcgcctgatgtcgtagcccgcagcgaactggctggaaaagatggtttcgtggaggtcgacccggccaccatgcgtcatgtgcgtttttcgaatatctatgcgctgggcgatgtcgctggtacatccaatgcgaaaaccgcagctgcggcgcgcaaacaggcaccggttgtggcaggcaacgtgctggcgacgctgcatgataaggaaccggattatgtttatgacggctatggttcctgcccgctgactgttgagcgtggccggatcgtattggcggaattcggctatggtggcaagctgctgccgacattcccgaaatggttgctggatggtctacgtccgacacgtctggcatggtttctgaaagcacgtgttctgccttcactttattggaacggtatgctgaagggcaaagaggttttcgcgaaacctgcccgacgtaacgacgcctgatcgcgtagagcgggaggatcggatgatcctgagcaccacccaatatctgctcggtgcgatgtccggcagtctggtcgggctgacacttggtgtggtgggagggggcggctcgatactggctgtcccgctgatggtgtatctggtgggggtgccgtcgccgcatatggcgattggcaccagtgctcttgctgttgcagccaatgctttttcaggattgatcggccatgcgcgggcgcataccgtgaaatggcgctgtggtggcatgtatgcggcttcgggcgttcttggtgcgctgggtggatctgtgcttggtaaaatgatgaacggacagaaattactgtttctgttcgctctgctgatgattgtcattgccgtacagatgctcaggggccgcaagcgggagggtaatccgggagcggagtgcaaccgcgaaaaagctcctaaagtgcttgcatacggattgggaaccggcctgttttccggttttttcgggattggcggtggttttctgattgtgcccggtcttgtggcctctaccggtatgccgttgctgaatgcggtaggatcatcgctggttgcggtcacggctttcgggctgacgacagcggcaagttatgcgttcagcgggctggtggactggccactcgctattatgttcattctcggtggtattgctggatccatggtcgggattgccgtcagccgctatctggccgggcgcagcggcatgctgggaacagtgtttgccgggctgattttcgttgttgccgcctatatgctctggaaaacgcttacctgattgtgatgtgccgagtggatgacacggcgcaggtgtcatcctaggattccgacgaccggttttttaaaacggtacggagcaggactcatgacagaaacccccattctggtcggcactggtgagcatgaagcacgtctgctgcccgcttttgccaaccggcatggcctgattgcaggggcgaccggcaccggcaagacaatcactcttcaggtgctggcggaatccctgtccgctgccggggtgccggtcttgtgtgcggatgtgaaaggtgatctcgcggggttgtcgcagccgggcgcccccaatccgaagctggaacagcgcgcgtcccggctgggcgttcatgattacagctatcgtgccgcgcctgtcgtattctgggacgtattcggggtttccggtcacaaggtgcgggccacagtggcggagatggggccgatcctgctttcacgcatgctggagttgaatgacacacaggaaggtgttctctccatcgcctttgcggtagcggacgatgaaggcctcctgctgcttgattacaaggatttgcgggctgttctctcgcacgtggccgagcgggccggggagctgggcacagaatacggcaatgtcagcaaggccacgatcggtacgattcagcgccgcctgctgagactggaacaggaaggcggagaagcctttttcggtgaaccggcgctggaactggctgatttactgctgatcacgccggatggacgaggagcagtgaacatcctggcggcggatcggctgattcacagcccgcgcctgtatgcgactgtgctgctctggctgctgtccactttatacgagaccttgccggaagtgggtgatctggcacgccccaaactggtgtttttcttcgatgaggcacatctgctgtttgatgatgcccccaaggcgctggtggacaaggtgacgcaggttgcgcgtctgatccgttccaagggagtcggagtttatttcgtgacacaaaatccgctggatattcctgcctctgtgctgggacagctcggtaatcgtgtgcagcatgcgctgcgcgcttttacaccagcggaccagaaagcagtccgcgcggcggcggacacgttccgccagaatccgaggctgaataccgaggaggcgatcggatcacttgcagtcggtgaagcgctggtttctttccttgacgagagcggatcaccctctgtcgtgcagaaggttcagatcgtgccgccccgctcccgtataggggcgattacggcggaggaacgggcagagatcatccgcaaaagtccggtcggtacgaaatacgatgcatcgattgaccggatcagcgcttatgagcgcctttccgggcgcgcgacttccagccagcaagagaccgcccctgtttctcctgcgccggtcgagccgggcggtgacccttggggcacagcgatgggaccggcacctttgccgccatcatccggacaaggatcggtctggaacagcaatggttggcagggtgggctggccgattcagccccttatcctccgcaagagccggtttcccgccccgccccgcgtgaagtccggaccccgtcccggaacggggaaggcggcgggtggctcggcgatgtgctcggcagccatggtgggcgtcaggggctgggtgaggcgtttgccaaatccgtcatccgcagcctgggcagtcaggtcggtaccaaggttggtggggaagttctgcgtggtattctcggatccatcctgaaacgctgaaccgccacgccactcagcgcaccggcgtatccccgagcatacgggctatatgcggctccattgcctgcgccatggccgcctgtgtggctgcatccgggtgaagaggcggctccggcggtgtcagatggatgtccagaaagcgggtgcgatccacctttcccccgctcatgaacagggcgcggagatcgagaaaggtcacacgatggtcatagcgaccgggcagggcacggttgagggccacagtctgcgcgtcgacccattcattgcgaatggagggcagcacacccagcagcagaatctgcatcttcggcaggtggcgatgcagggactctatgatggcgtcgatcccttgcagggtcggttcagcaggccagcggagcttgccgaaattattggcaccgatcagcacgacggcagcccggggattgatgccgctggcttccccgttttcgatccgccacagcaggtgtgcggtggtatcgcctttgtagcccagattgatggcgtggcggtgaccataataatggttccagaccggggcgaaattctgccagggttcggggccggttttctcccaattctgggtgatgctgtcgccgtagaacaccagatcgaccggcttctgacgcagttcgcgttgtttttcttcccagcgatgtttccaccagggcagatcaagacgggacagcggtgttgctgccagcggcttgccgttatgggcatggcccaggcgaggtggcagcgacatggccagaccggagccaagggctgcagacagcatcgtgcgccttgtccatgcagaagaagcgttcatctgaaacgtccttgtctgggattcggtcttgtgtcaggcgaaatgcagccacgccagcgcaccaaggcccgctatgatgcagtaaaaagcgaaaggcttcagcgcccaactgtcatgatcccggaaatagcgcatcagaaaggccgtgctgagccatgcagtgatgccggctgctacggcagccagggcggcggtctggaatacgcctggtgcgatatcggcatgcagtaattttggcacttccagcacggtggcccccagaatgatcggcaatgcgatcaggaacgagaaatgcgcggaggcttcatgatcgattccgcgcaataatccgccgacaatggtggcaccagagcgggaaatacccggaatcagcgcggcgcactgccaacagccgatagtgaatgcatccatgacggtgagggtagacagggcgcggcgctctgtaacctcatgatcgctggtctggggataagggctggcggctcctcgcaatttctccccgaacagaagaagtccgccattcaccaccagaaaaaacgcggcaatcggggccgattcgaacagcgcccgcaacatatgctcaagtaagccgccgactacgatggctggcagcgttgcgaccaccagcagcataaaaatccgtcgcgcttgcggtacatgatgggccggggcaaagccgataacgccgctgaacaacgcccaccagtcgcgccagaaatacagcagcagtgcagccgcggtacccagatgcagaaacaccagaaatggcaggaaggtctggctgtgttgcggcaggctccagcccagcaatgccggaaggacaacggcatgccccagtgaactgaccgggaaaagctcggttgcgccttgcaggatagcaatggcgatggcctggatcgcgttcatggattctatcctcaaccggtcatctttccgattgagtggcggaaaccggcagctctggcaagcatacgggggcagtatccggcatatgctcttgacccgcgatcatgaaggaggcaccccacccgggtgagaaagacggacgcacatattctggttttcgactccggcattggcggccttggcgttgccgattgtatccggcgcatgctgcctgcggcgacccttggctatgtcgccgatacggcggggtttccctatggcgcgatgagtgacgaggctctggtcacccgcgtgctgacggtgctggagcaggcaatagcccggttgcggcccgatatggtcgtgatcgcctgcaacacggccagcacgctggcattgtctgcgctgcggtctcggcatgatctgccatttatcggctgtgtgccgcccctgaaatgggcggcctcggtcagtgccacccgccagatcggtctgctggcaaccccggcgacggttgaccgtccttatctgacggccctgatgcaggaacacgggcagggttgtacgcttcatgcccatggcgcccgtcatctggccggttatgcggaggctgtgttccgtggcgaaacggtgctggttgaggccgtcagggccgagctcggtattctcggtatgatccccgacattgatgcggtggcgctgggatgcacgcattacggacggttgcttccatggttgcggcaggccatgccgcgtccggtggcatggctcgatccggcagaggcggtggcgcggcaggcggccagaatagccattaccgctgcggctactgccgcgcctgacagtctgccacgagctgcgccatgctgggcacagacggtctttacgaccggagctgtccccgatgaggccacacggcaagcatgggcggcggaggggtttccggagtggcagcccctggagatcgcctccgcctgagccggataatcaggctttcgttttgggagccggcggtttggctcccgtctgctcgaaggcggctgcggcggcttcggccacgctctgatcctgctcgccggagcctccgctgattccgactccaccgaccactttgccatcgcgccgcagcgggattccgcctgcgaaaatcatgacacgcccatgattggattgctggataccgtagaactgctggccaggctgggcattacccgccagatccttggtggaaatatcgaaagcacgcgcggtgaacgccttgttgatgctgatgtcgatgctgccgagccaggcatcatccatccgatggtgaagcttcagatttccgccgccatcaacgatggcgatgttcatcggctgcccgatttttcgagcgtgtttttcagcggcggtggcgatcctgacggcgtcttccagagtgatcatggtatcccttaacgaccagagaaaagcttttattcatcaggctgcgtccttttccctgccatggaaaggagggacaaaaagcccaatgccggtttcccgccggatgcggcaaatcctcttttcaaacgctctgaacgggaactcgttcgatccggtcgatacgtgtgtcacgggcataaagccggatttaaggaattaccctgtcaaagacagagccgagaggttaagaagcggcccataatgcgtgacaaaacccgttcttcctccggttccgctccgatgacaggcgcttcctctgcgcgtgcagggggcaggcgtcattctcctgcccgtgggtggctgaaggaacaaggggggctggcccgccggaatgcgcgccatgtcatcctgttgggcctgaccggcaccattctggccgtggggcaggcatggtgtctggcagcggttttcggcggcacgcttggccacgccatggtcggtggactgccttatgccatggcttttctgggaattgcggcaatacgcgcctttctgggggctatgacggagcgctatgcggcggcggctggtgcagcggctcggcggcggctgcgggatcaggtgatggcgaggctgctggccattggtccttccttgctgcgcggatatcattccgccgagctggcggcgattgccgtggatcggatcgaggcgctggacggatttttctcccgctgggttcctgctgcttctctggcgattctgtcgccggtccttatcctgctggcgatcctgccactggattggcgggcggctctggccttgctggctgcgggtctgttggtgccgttcggtatggcgctttccggcattggcgcggcggtcgcttcccgccgtcagttcgtggcgatgagccgcctgcaggcccgttttctggaccgggtgcgcggcattgccaccatcgttctgagcgggcggaccgaggatgaagccatcgctctgggacgcgccgccgatgagttgcgccgccgcaccatgcgggtgttgcgggtggcgtttctgtcctccgccgtgctggatctggcgatggcggcagctctggtcggtctggcgctgcattacggacaggcgatcctgtccggtcaggcaggtcatccggcgcgggcgctgttcgtgctgctgctggtgccggagtttttcgcgccgctgcgggccttttcgcttgcctatcaggacaagatgcacgcaaccggtgcggccgaagccatcgccgccctgccggagccaccggaaaagcccgttcttcaggttcgcaccattgaagcacgtggtgtgacggtcacgttcgatcatgtctcgctggtgtgggacgagacacgtggcccggccctgcatgatgtcagtttccgtattcctgccggggagacagtggttctggccggtccttccggatcgggcaagtcaagcatcatggaggttttgctgggctttacccgtccaacgagtggacgggtggccctgaacggcatggacatcacggatattgttccggcggctctctcccggctgacggcctgggtcgggcagaaaccgatgctgtttgcggggaccatccgcgacaatatcctgttcgcccgcccggaagcatcggagcaggatctgctggatgccatccgtcatgcccatgtggacgattttgcccgcgccctgccggacgggctggagacgatgataggcgagggggggtatggcctatccggcggtcaggcgcagcgcgtggcgattgcgcgcgcctatcttcgcaatgctccgctgctgctgctggatgagccgacttcccatctcgatccggttactgaagctgatattctggacagcctgaaacgtctggcggttggccgcaccgtattgctggccagccatagcgcggctgcgcatgcttttccgggtcatcggattgatctgcgggatggcagtgtcgtttccgcaccattcccgaccatgtatggaaaggtgatggcatgaccgcatttcttcgcccgctgctggatgttgccgcgctgtggcgtaaccgtttgccttggttgctggccgggatcgtggtttcggttctggccgttttgtctgcggcgctgctgatgatgctgtcaggtcgtaccgtggcggccgccatgatgctcggcgtgctggccgctcccatgctgttgcgctggaccggtgtggccagggtggtgttgcgctaccttgagcgcgttgtcacgcatgatgccatgttccgggcactggctgatctgcgggtctggtttttccgtggtatagcgcgtgatgccgcaggcggattgggcttccgccgtgccggagacgtgctgtcccgtctggtcaatgatgtggaggcgctggacgggctttatctgcgtattgtcgttcctgttgccggggcgctggtgctgttgccggtgctgctttacgcgctggggcggctggatgccatgctggcgatagtggtcggtgtgttgttcgtgctggctgctttcgtgctgccggtcatctccgcccgcactgcagcggggcagggcgcaaggctgaccacttccatgagtcggttgcggattgcaaccctcgataccctgactggtctcagagaggtgcgggcctgtggtgcggaagaccgcatgctggcagatattcaggctcgccaggcgctgctgctgacggcacagcgtgagggggcggcccgtgccgcatgggcatcggcggcgtcatttctgtttgggcaggcaggcgtagcggctgtgctgttcgcggtcgcgctcaatgtcgtgacgactggtccggcagccttgatcgggtgtgcatttctgacgattgctgcgtttgaggcgatcgggggcctgccgcgtgccggtgtgctcgccggacatgcctccgctgccgcggagcgcgtgctggaagcggcctccaggcccgaaagcaatgtgccgcagggtgtggcagatgttgaagaaagattgcgggaggaaagactgcggccggtacgcggtaaaacggcggccctgtctttcagacatctctcgttccgctggcggcaggatgggccgctggtgctggatgacctcagtctggatttgcccgcgggtgcacgggttgcgctgctcggcccttcaggagccggaaagtcgaccattgccgctcttgcgatgcgcctcgctgtgccggaggcaggacatatttttctgtcaggcaccgatatggcgaccttaccggtcgatatggtgcgaggccatttcgcatggctgtcccagacaacgcatctgtttgacgacacgatcagggccaatctgctgctgggtcggcccgatgcgcaggaggccgatctctgggcggcgctggatgcggcgcagttgggtgctgtggttcgcgacctgcctgatggcctggaaagctgggttggtgaaggcggattccgcctgtccggagggcaagggcggcgtctggctctggcgcgggcgctgttatcccatgctccgatcctgattctggatgagccggcggccggtcttgatgcacagaccgaacgtgaattgtttctgaccctgaacgaggtagccggcgatcgcaccgttctgctgatcgcccatcgtctgacaggagttgagaagctggaccgtatctacagactgtctggcggtcaggcagttcctgcaatgagctgaagagctgaaacaattaacagaacgtcatcatttcatgcgtgacatgagggagcttgcccgcttttctgaccggatgggttgaaaaggcatgcaatcgtgacggattctcctgttgaagatgcgatcgtccagatcgacagtctgcgcaagagtttcgacggtaccgagattctcaagggcgtctccttgcagatagagcaaggagatctcgtgtcgatcattgggccgtcaggctgcggtaaatcaacattcctgagatgtattaactttctggaaatccctgattcgggacggatatccgttgccggcattgcactggaacggtccggtacagatgagcgctggaccaatgcgatggaggagcgtgcccatgcgctgcgtgagcaggtcggcatggttttccagggctttcacctgttcgcgcatcgcacagtggcagaaaatgtgatgatggcaccgatgatcgtgaaaggcctgaaaaaggctgcggcgcgcgatctggccatgcatcagctctcccgtgtcggtctggccacattcgccgatcgctatcccggcacgctgtccggtggccagcagcagcgggctgccattgcgcgtgctctggccatgtcgccgaaagtgatgctgtatgatgagccgacctctgcgcttgatcccgaactggttgatgaggtgcttcaggtcatgcgcgatctggatgcggatggcatgacgcagctgatcgtgacgcatgagatgcgcttcgcgcgtgatgcttccgattacatcgtgtttatggaaggtggcgaaatcatcgaagtgtccgacgaggacgagatctttgaaaacccgcgcgatccccggacgcgccgtttcctgaagcggttcgcatgatgcgttgtatgctggctgtcctgatggttctgctcctcagcctgcattccggagcggtgcgggctggggatgatctccgctggggtgctgacgcgcagtctgatgcaccttatatttttcacgatccagatcgtgaggatcgcctgattggttatgaaaaagacattgttgacgagatcgggcgtcatctcaatcgcaatctgatctttgttcagaatggttgggacagccttatccccggcctggatcggggactgtatgatttctcgatcgacggtctggaaattacccccgcccatcgtgaggtcgttgatttttcaaagccctattatgtaacgtcggaacagctcgtcgtccgtaaggacagcaagggactggatacgctggagtcactccacggccatgccgtcggcacactcaaggccagcgtgggcgagcggattctgcagaaacaccctgatatcaacctgcgtgtgtatgaggaggagatcgacgcctataccgatctccataatggccgtaccgatgcggttctgctcgattggccgattgccctgtattattcagcgacagatcccagcctgaaactcattggtaaaccaatcggtcacctggaatacggtattgccgtgcgcaagggtaatcaggtgttgctcgatcagatcaatactgctcttgaccaaatgcgtgccgatggaaccctccgtcgtattctggagcggtggaacctctggacgcctgctatggagacgttcaccggggatcacacctctataacacagccggcggtttattatgatgaatttgtaaaggcgcacgcaccggccacggcatggcggatcaaatttaaacgctatatcggttttatcccgctgatcgctcatgcagcggtcacaacactggaagtctccctgctggctatggttctggcggtggcaatgggattgttgctggcggtctcgcgattatatggcccggccccgctgcgtatgctgtcagtgatgtatatcgaaatcatgcggggcacgccgctgctgatccaggtactgttcgtattctacggactgccgaatctggggatcaggctggatccgtttttcgctggcgtactggcgctgggcctgaactacgcggcgtatgaggcggaaaactaccgtgccggtctgggtgcggtcccgcatggccagtacgaggcagccattgccttgaacatgacgtctttccaggccctgcgtcatgtggtgattccacaggcattccggctggtgattccggtgatgaccaatgatttcatctctgcgctgaaggattcttcgctgctgtctgttatcaccctgtctgaactcagtcagacctatgtgcgtctttccaccacatactatgattatttcggcacgggtctgatgatcggcgctgcctatcttctgatcggtctgccgtttgtgcgtctggcacgctggacggaggaaagacttcacactggccgcaggccgcagcgccgagtgtagacagaaacgcaacggttttcatcaggccggttgacgctcatcgccttcggaggcacaccttgtcgtaagacggtacagctttttaacaagggagtcggccatgcgccgcctaagcctgctttgcttgcccctgatcgccgctgcatgctctcagccagccgcgcttcagcgttcctataatgtttacttcctgcaggattctgctgtgctcgatccggcggccactcaggtggtcagctatgccgcggagctcgcaaagcagtatccaggtctgaaggtgaccgtgtcaggctatggcggtaagtcctctgatcaggcgtctacagtcacggaaacacctttggccaagctgcgtgctaatgcggtgcgggatcagctggtctctgacgggattgctaaaagcagaatcgaacgttcggtccacacggttgatgcatccaatctggccgtggcagagcgccgcgtggatattgatatcggagatgtcagcagcaagtaatccaatgaccggcatattcggtattggctttgcttgacaggctgctccaccctttttcgggtcgctcacaggaaaacccggcgctggatgttctgcgccgggttttcggctatccggcttttcgaggattacaggaagacgccatcgctcatgtgattgagggtggtgatgcgttggttctgatgccgaccgggggcggcaagagcttgtgttaccaggttccggcgctctgccgggatgggatggcgattgtggtgtccccgctgattgcactgatggacgatcaggtggcggcgctgcgtcaactgggtatcaatgccgccgccctccattcggagctggaagccgatcagggccgggccgtgttcagggcggcgatggatgccagactcgatctgctttacgtctcgccggagcgattgctgaacggtctgatggatcggttgccggaatcgcgtatcgccctgattgcgattgatgaggcccattgcgtgtcgcaatggggccatgagttccgccccgaatatcgcgctctggctcgcctgccggagcgattccccggtgttccgcgcattgccctgacggccacagccgatgctcgcacgcgcgatgatattctccgtgcgctcggaatggagcatgcccgggtttatgcggcttcatttcatcgccctaatctgcgcatcgcggcagccgagaaaattgctgaaacatcgcagatgatggcgtttctggcccggcatcgtgatcaggcgggaatcatctattgcggcagccgtgccaagaccgagcgtacggcgcagcgtttgcgtgaaaaagggattgatgcgatcacctatcacgccggtttgccaccatcggaaaagcaggtggccctgacccgtttccgcggcggggagtcggtggtgatggtggcgaccatcgcgttcggaatgggtattgatcgtcctgatgtgcggtttgtggtgcatctggatatgccggacagtccggaaagctactatcagcagatcggtcgtgccgggcgcgatggcgaggagagtgagacacttctgctgtatgggggcgaggatatcgcccgtgcccggcatttcctgtccatttcggtggcgcctgacagtcaaaagcgggtgatgcggcaacgtctggatgcgatgatcggtctggcggaagctgccgattgcagaacgcgggcgctgctctcctgttttggcgagagtatggagcagccatgtggtcattgcgatttatgtgcggcaccgccagaaacttttgatggttcggtggaagcgcagaaagttttgtctgcggtttatcgcaccagccagccaagacccggagatacgcggcccggcatggtattcggcgccttgcatattgtggccttgttgcggggggagttgacggagggaatccagcgtcatcagcatgaccgtttgccgacttacggtgttggcaaggatcgtcccgccaccttctggcgtagtgtgatccggcagctgattgccagaggcatgctggatatggatgtggaaggccatggtggattacggctggtgcctgatcgcgtccgaacggtcctgcgtggtacggagaaagtctttctgcgacaggagaccgcttcccgcctgccagcacgtcgtacgcgtgaggaaagaagggcaagcaatccggtttctgacaatattccggatgcgatccgtgctgaattcgatgcgctgagggcatggcgcatgaaggaggcaaaggagcagggtgttcccccttacgtaattttccacgacagcgtgctgcgagacatcgccacttctgcccccaccgatctcgaaacgcttggtcgtatcaagggagtgggggcatcgaagcttgaccgctacggacggcatgttcttgctgtcctggccggggtttgagcgcggagaccggatcccggttatttgaccgtaatggtcacaggttccgacagcaggggatggctgtgcggcacatggccggcatcgcccatgatcagttgcagcgtatgtttgccgggcggcaatttgatatcaacctgcgtctgccctccgccaaggtgaacatggtgggcatctttcggaatggattcctccagcgcctcaccctggggggcaggtgtatcgatcagcagatgatgatggccggtgcgcggttgatcgtcaccggctggtgcaatccccagtcctttcagcccggtgacgactgtgaaggggcttgagaccactgcgccattggccgggctgatgatgtacggtctggctccggacggccagaatgactgatcattttctgcagcctgagcagggttgagcagggccgcaaccggtagggaaaacagaccgatcgcccctacgaaacggagagaatggaatgaagaaaacatatgcctgttcatgatcggtttcctttaaaaatctgaaacaggaatgaaaaatttaaagcggcgtgcctggtgtttgtccgtatcccttgctgcgtgtcttgtgggagattccccgatcagccgccttctccagagtaagataaggatagcggcggcagagagaaatcacctcgtcctgcaatatttgtttcgaggcatggtcgagattggaataaaaaggtgctccaccctcccacagaacgcggttatcggcctccatcagcgcattatcgacgtttttcagcgcctgtttggaatctccgatatcgatatccttgatggtctgcctgcatgtatccggtatggcatgggccgggcatggggcagtcaggcaaagcacggcagcggcggacaaagtgaaaaagcacggaacggcacggtaacgagaaaacatgggactctccacccctgttgcgtggccgtataaagtttttactatgccagactatgcagggatttcaccttcaattttgagtgtggtcacctgtgccctggctggatgcttgaaccggtccattcagcaggacccgttgatactgttcttcgacataggcgaagggttgaccgtcgctggtggtcagcagggcgcgattgatcagaatggcctgtttgggagggctgtcagcctcaatgggtgtttcgcccaccgttgattgaggaattttggaatcactcgccagacgtcggcgttcgaaatgcagtggcagaacgattttgccaaaaggttgatcggtcagcagcaactgacggttcatatcgggcgtcagtttttccggcaggtaggcgagtgtcgcaatcgagaccacatgcggcccgcacatcagatgaacatggcgggtgactatatcgtatcctgctgagggatgtagagactcgagcgcctgtgacggaactttgccggccggttgtttctgggccgtcacatggctggccggcggcatcagcccgcgtccgatgcaccagcgctgcaacacttttgtggcactcggttccgctgcaagatcggcggtcagacggtccagcgtataggcaggcgttacaaaagcggttttgtccgatgcaggctggcatccggccagaagaagagaggcaaggaacgcagtgatagtgcggggataaaaaggcataggaaaaatcactttatcgtctggccggatgatccggcaggttgcaatgatcaggcaggcggcagcgtgacaatcaccggcagccgatcccgagaaaaacgacgaccctgcgatgagatcagtctgttctgaggagagagggcgagtgatgccatccatgatcgtcccctgacagcgccatagggaatcaggtgaagcggtcggctcagggaccagcaggcaagcgtaggaccaatccggtcgcgatcaataccccagcgcatacgcggcacggtgaagaggggcgttttatgaagcccatgggcggtcagcgtggcaaaccagaccggcacagtatcgaatatcaacatggaggcaggaaaacgcttcgtcatatgccgcagcaatggagcgacacgatttggcgggaaatacatcagcagcccctgcatcaggaacaggcaggggcgagatggatcaattgcctccagccagcctgtatccagagcatccacgccgaggctgcggaaccgctccgtatccggcagcatctgccgacgcagagcgataacctcgggcagatcaactgaaagccatgtgcaggtgccattgtcgacccggcgtgactgggtctccagcccttctccgatggagatgaccatgccgtcaggatgcctgctcagccagtcggtcagcagagtgtcgatcgcccggctgcgcccggcaaaggatccgtcagccgctccgaaacgggctatccagtcgatcatcagcgcgttgcgcatgcggattgcgtgaggatcatgcagaatgccatcaggccgcgctgcttcggcagcacggtcatgcagggtccagagcgtcgtttccgggattccgcacaggacaggccgtatgggccggggaatgtcggcattcatgccggtatcatagcagagctggtcctccctgtccgctggtcacgacggacagggagagagacttacgcgatgctgtttcaggccgggcgcagtattcctgcctgatcgggttccggtcgatgcagaatcacagtccggtcatggtaagcggaggtcgcttcaccatgcgcaatggagacgatggtggtctctggcagtttctgccgcagcgcctgataggcctcctgttcggattcggaatcaagattggcggttgcctcatccataaacagccagtccggtcgcaccagcagggcgcgggccagagcaatacgttgttgctcaccgccggacaggcgatgcgaccattgatcggtctggtccagacggggaatcagatgatccagcctcatggcatgcatggcatccgcaatctgctcatccgacactgaagaagggttcagaggataggtcaccgccctgcgcagggagccgagcggaagatagggacgctgtggcagaaacaggaagcgccccggaatatggatcgactgcacggagccgaacggccagatgcctgccagcgcgcggaacagagtcgatttccctgagccggagcgtcccttgatgcggatattctggcccgctgacagaaccagctcatcctgatgcaacagaacctcgccagttggcagggaaagattcaatcctttgacgacgacatcattcggatgggccgaaacagggctggacgctgtggtatctgacccgcccgacaaggtagccgcacggttgcgttctgctgcgcgtgcctggttgagggcgtcctgaaaagtggaaagacggctgacgaccgccccccagcttgccagcgtcgtatagctgctgacaaaccaggagagtgatccctgcacgcgcgagaaagcttgcgacgtacgctgcaacccgccaagcgtaatctgtccgctgaaataatgcggggctgccatgacatagggaaaaaccgaagcgatcagatcatagccgctggaaaaggaattcagccccagatagcgccgcagcatcgcataccagttgatgacgatatccccgaaacgtgatttcgcggtggctcgctcttccgcttcaccatgatacagggcgatgccttcgctgttttcacgtacgcgaaccaatgcgaagcgcagattggcttcgtaacgttgctggacgaagcgcagatagatcagcttccgcccgatcagatgcgtcagtaacgtgccgatgatggagtagatgagggctccccacagcatataacccggaatatggaagccgaagatcgtcattgcgccggagagtgaccacagcacacccagaaacatcaccagcgtgaccgcgttggagatgaagctgaagccgatcgacaatgtgtcggaggtaaagtcgcggatatcgtcgctgatacgctgatcgggattatcggtcgcggtatcgttttcctgatgcagcagacccagccggtaatagatccggtcatctatccactcatcaatcatgcgcttggtcagccagcgccgccaacgaatctggaggctctgctggagatagatcgaggccaccccaaaaatgatcgacgggatcgccagtgtaatgaaaccggcctgtcccttgtaccagaacaggaacagctgcacgaaggcggaggcgtctttttcctgcagggcgttgaaaaaagcgccgtgccagtaattcatgaccagatccagcccgttctgggccagattgagggagagcactgtcgccaacagacccagcgcaacccatttttcctctgacaggaaatagggaatggtcagccgccaggcgccccgtagaattttgccgaaatcatgcatgcgttgaaacctgccctgccagcgaatggtcgaaaagcggatggagtgtcagaaagggaagcatttcaagatagggttgccggaatggcgtgatgctggctcatggttatcaatattgtaaccatttggctcgggcccacgatgcggtcagtaaccctgagccggttcctgatcctgcgttaaagaattcggttcctccgggggattcggccggacgcgcaggcgcagcaccccacgcatggtatcgggtgtaaccggttgtggcaggggtttgcccttgcgcagtacgtcgatcagtccggcactggccagtctggccgcctgccgtcggacctggctcagcaggcgtcgccattcctccgtcggggccagtgcccgtgcgacttcggtcggacagatggaggaagcaggaccgcgttctgtggtcagtcgtatgatctcggcatcaatggcctgggggctgactttggttctggtggcgggggaggccgggcgctctgtcatggcggacagggttgaaccattgtgcggcacttcgcaagggagagttaagacctgacagcttcatgacccggcttttcgacggctggaacaagggcatagacagggtaggggaatcctcggcaagaaagggtcgtcatcttcgatattcatcgggctggcggcagtgtgaggcgcggagaaaagcagaatcatgcaaaccagttttacgccggagcagctgcgcgaccctgatatagcggcctccaaccaggtgctgcgtacctgcgtgcattgtggcttctgcaccgccacttgtcctactttcgtgctgctgggggacgagctggatagcccgcgtggccggatctatctgatcaaggacatgctggaaaatggccgtgcagccacgcaggaggtggtgaaacatctcgaccgttgcctctcctgcctttcctgcatgagcacctgtccctccggtgtgaactatatgcatctgatcgaccatgcgcggagccatgtggagaaaacctatcaccggccatggcatgaccggctgctgagggcggtgctggcacgggttctgcccagcgtctcgctgctccggggggctttggtcatggcacggatcacccgcccgttggccggcgtgattccggcccttctgccgaaaggccatctgctgggtcagcgtctgcgcgctctgctggacctggccccaaaggccccttcgtccggtcatgccgtgaaaccgggcctgtaccgcggacaggcgggaatgcagactgtgaagcggcgcgttggcctgctgaccggttgtgcacagcaggtgttgtctccctccatcaatgaagcgaccatccgtctgctgaaccggctgggggtggaggtggtcgtgaccgcggagcaggggtgttgcggcgcgttaacccagcatatgggccagcatgaccgtgccatggccgcggcccgggccaacattctcgcctggagccgggaaatcgagggggaagggctggatgcagtcatcgtgaatacatccggttgcggcacgaccgtcaaggattacggcttcatgttccggaatgaagctgaggcggctcaggcggagaaagtggcgtctctggcgctggatatttccgaatatctctgccgcatcggctatactccgactccgttgccggaagatgaggcacccctgaccgtagcctatcatgccgcttgcagccttcagcatggccagcagattcgtgccgagcctaaaaatctcctggttcaggccggatttcaggtggtggaaccggtagagcctcatctttgctgcggatcggccgggacatataatatcatgcaaccggacatcgcgacccggctgagggaccgcaagcgcggcaatctacgggcgcttcagcctgatctggtcgcagcaggcaatattggctgcatcaagcagcttggttgtgactcccttccagccttgcatatggtggaactgctcgactggcgtgccggtgggccggagccggaggtggtccgcatcgtgcaggcccggcgtgccgcatccgctatggcaagctgatcggccctgttccaatcaatagaatcgcgccgcctttaccctctgtttctccatgacttcaggtggagtttgagggagagatgttttcgcgcaaccgtgtcattcaggtgtctatccaaccctgcgacagggcgggaagccgggctgcaaattgttgaaacaacagggataacgcacgatccataataccctatatggtgtgttacgggggatcctcaccaatatatgtggggtttggccgggaaaatgagttgacggcaagggcgcaaacgtagagcatccagacctgttcgggcgcgggcttgagacatgccgcgccatgatccgttacccgcgatgaaatgaactcagggagttgcctcatggcaccattcaggcatgccacgacgatgctggctatggcagccgatggcagtctttccggcgggcttctcccggtcggcacggaggcttctgccgcagccctgatcgatgccggtgttcagatgaaagaccgtggccagattatcaaggatgacagccgtgacgctctgctgaccgatttcgggaaagcgacgctgaacgaccgttacctgatgcccggcgaatcctatcaggatctgttcgcccgcgtatccagctattacggcgacaatgcggagcatgcgcagcgtatctacgattatatgagccgcctgtggttcatgcctgcgacgcccgtcctgtccaatggcggcaccaagcgcggcctgccgatctcctgcttcctcaacgaggcctctgacagtctggaaggcattgtcggcctctggaacgagaatgtctggctggcctccaagggcggcgggatcggctcctactggggcaatctgcgctcgattggtgagaaagtcggtcagaacggcaagacctccggcgtgatcccgttcatccgcgtgatggacagcctgaccctggctatcagccaggggtctctgcgccgcggttcggcggcggtgtatctgccggtctggcatccggaaatcgaggaattcgtggaattgcgccgccctaccggtggcgatcccaaccgcaaggcgctgaacctgcatcacggggtgctgctatccgacgcctttatgcgtgcggtcgatcacgatgaggagtgggcgctgctttcccccaaggataagagcgttatccgcaagatctcggctcgggcgctctggattcgtatcctgaccgcacgcatggaacagggtgagccgtatatcgtcttctccgaccatgtgaaccgtgccttgccggagcatcagaaactggccggtctggaggtcaagacctccaacctgtgcagtgagattaccctgccgaccggaatcgatcagcatggcaagcagcgcaccgcggtctgctgcctttccagcctgaatctggaaacctggcatgcctggaaagatcatccgacctttatcgaggacgtgatgcttttcctggacaatgtattgcaggacttcatcgaccgtgcgccggatacgatggagcgggcgcgatattccgccatgcgtgaacgctcggtcgggctgggcgtcatgggattccattcttttctgcaggccgagcgagtgccgttcgaaagcgtggtcgccaaagtgtggaacctgcgcatgttcaagcatatccgtgcgcaggcggataaagcctcgcgcatgctggctgccgagcggggcgcctgcccggatgcggcggattacggcttgaacgagcgtttctccaacaagatggcgattgcgcctacggcatccatttccattatcgctggcaatgccagccctgggatcgagccgattgccgccaatgtgtttttgcagaaaaccctgtcgggcagctttacggtccgtaaccgccatctccagcaactgctggctgagcgtggacaggataatgaggatgtctggagcagcatcaccctcaacaaagggagcgtgcagcatctggactttctgaccgaggcggaaaaagccgtgttcaagaccgcgttcgaactggatcagcgctggatcatcgaacatgcggccgaccgcacgccctatatctgccagagccagtcggtgaatctgttcctgccggccaatgtccataagcgagacctgcatcaggtgcatatgctggcatggaagcgcgggctgaaatccctgtattattgccgcagcctgtccatccagcgggccgatgccgtcagtgaaaaggcggtcaatctggatcatcaggcaaaggccgctccagcggcggcggtcagcaccacgaattatgaggaatgcctgtcctgccagtaaaaatggcatgacggtgtgatcgcttcacgacggctcacggcggcgaaaaaagaaaaaggctttcggcatgacggatgagaccattcagggggcggcaccccaggcagaacaggacgtgcctgtccgctttgatctgctgaccgaaaatccggtttacaagccgttccgctatccatgggcgtatgaggcctggctggtgcagcaacaggtgcactggctgccggaagaagtgcctctggccgatgacgtgaaggactggcaccgcaatctgaacgaggtggagcagcatctggtcacccagattttccgctttttcacccagtccgatgtcgaagtgaataactgttatatgaaacattacagtcgggtgttcaaaccgactgaagtgctgatgatgctttcggcattttcgaatatcgaaacaattcacattgccgcgtacagccatctgctggacacgatcggcatgcccgaagtcgaatactcagccttcctcaaatacaaggagatgaaggacaagtacgactacatgcatagcttctcggtcgacagcaagcgtgagatcgcgaagacgctggcggcattcggggcgttcacggaagggcttcagctttttgcctctttcgcaattttgttgaattttccccgcttcgggaagctgaagggcatgggccagatcgtcagctggtcggtgcgtgatgaaaccttgcactgcctgtcgatcatcaagctgtttcacgtttttatcgacgaaaacagggaaatctggactgaggatctacgccaggagatccgtcagatatgcgccaccatcgtcgagcatgaggacgcctttatcgatctggccttcgaactcggctctgtcgaggggctggatgctgctcaggtgaaatcttatatccggtatatcgctgatcgcaggctgattcagctggggcttgaaccgctgttccatgtcgagcgtaatccgttgccatggatcgacgatatgctcaatgcggtggagcatgcgaatttttttgaaaatcgtgctacagaatacagccgtgcctcaaccgtcgggacatgggaagaggcgtttgcataaggctcattttgcaaacaaaatcggaatattataacgcaatagcatctaatgaacgaaataaaataaagaggggtcttgtttaaggcccctctttatttatttgccgcaagaatgccctgaaatcagtccataactcgctgtcatcttttctggaagagcgcctgatgaagaccgatctatatgccagccgctttttccgccgtggtgcacttattctggtaattgctgccgtggcggtgatgggggcatggcacgccggcctgttcggggaagggggcggggccgggcaggaggccaatttctcgcgcggtcaggaggttgatggccatgcaggaatcggcggttctttcatattgaccgatcagaatggccggacagtgacagaccagacactcaggggacgctggatgctggtctatttcggctatacgttttgcccggatatatgtcctaccgaattgcagagtatgtctgcaactatcaaggctctgggagcgctttcaggacggctggcaccggttttcgtcacgattgaccctgcccgggacaggccggcagaacttgcggcctatctggcgcattttgaccccaccattatcggcctgaccggaacagaagcgcaaatttcaacttttgcgagaaaatatcatgtatattatgctaggaaaggcgaaggaaaagactatagcatggatcattcttcttatctttatctgatgcgtcccgatggatcgtttgatcggctgttcccgggaggaatgagcccgaatgatctggctgctgcattgcgcccgattctgtcggaagcccctcattcatgagcgagttcctgtcctctgttccgcagattgatgtgccgggtgccccgcgtttcagtcggaagcttgctgacaagatcctgtcagcttttcatcaggcctgtgatcagaatgagctcgatgtggcagatcgtcttctcaaggtgctggagatgatgatgagccgccgagtctccagaatggatgtaacgcgccgccgctcgatcgaggctctcgttgctgcccatgagcggctgtggcatcttcgtcatccgggtgggaagagcttctgagactggcttccaccagttttcgcggctgtcgctgttaaaaagccagtgcttttccatatcgcaggatctcatgagcctgtggggtaaagctgccatcctcctgatgcagcatcagcccgggttctaccctgtcaggcccacgggcagccttgatgcctcgtacgataatgattttggcgcgccgtcccgctttcggccatagcggatagaggctgatctctccggccttggcctcacgcaggctggtcatggcctcactgatcagtgcagcgggcaggatcaggctgatcgagccgcgcggcctcaccatgctgcccagtgcctgcacccactgactgacgagcccggcatggcgacgtttcgcctgatcacgaagtgcgacgggggaaggggaagatgcttcctcatgccacggcggattggcaaagacgtgatcatagtttgatggagaacccgacatctcctgtgcaaagtccaaaatatcctgcgtgataatcgacagacggttttccagatggttggtctggacattctgacgggccagtgtcgcaatgtcgctggatttttccactcccgtgccctgaatgccaggtacacgatgggcaaggcataaaagcccggctcccggaccggtgccggcttccagcacgcgctcttcggcccgtgcgggaatcgcggctgccagcagaaccggttcaagtccggtgcggaaaccagtccgtaactggcggtaagcaattgcgccgttgagcagactgccttcggtgacatcgttgttttcgttcataagaggaggttttttgagcctgttgggcggcttggcaaggcttgttttctgacaggatcggtcgatcaggatgccttgaccctattttatccctgtcgatagggtgcgtggctgcacaaaaccttttatgacatcttatccagcagagtgcgtgagcgatgtcggggagatgccaagctgaggtaatctctggggttatcaggctgcggctgaatcagattaccgctttatcaagtccaggagacagctttgggcgtcgtcgccagttcaccggatacagatatgatcctgccgccgtctgatgcagaaggggtagaaggtgccttgtcgggcctgatcgcactggtgcaggacgacctgaccctgtgcaatcaggctattatagatcgtatggacagtcaggtgccgctgatcccgcaactggcggcccatatcgtggcagcaggggggaaacgtcttcggcctctgttgacgctggccagtgccaggctctgtggatttgataccgccttggcgggtggggtgccgcggcatgtccatctggcagcctgcgtggagttcatccataccgcgacactgctgcatgatgatgtcgtcgatgaaagccgcatgcggcgcggtatggccagtgccaatgcggttttcggcaataacgcctccgtgctggtaggcgatttcctcttcgcgcgggcgtttcagctgatggtggaggacggatcgcttcaggttctggcgatcctttccaaggctgctgcaaccattgctgagggcgaagtcctccagctcgctacgcagaatgatctggagacgccggaatcacgctatctggaagtgattgagggcaagacggcctccctgttcgcagcggcctgtcaggtcggagccgtggttgccgcgcgtccggctgaagaggaacaggcgctatatgattacggtatgagtctcggaattgcgttccagttgaccgacgatgcgctcgattatgcggcggatcagcgtaaactgggcaagaccgttggtgacgatttccgtgagggcaagatcacactgccagtactcgctgctttccatgccggtgatgcggaggaaaagcgtttctggcagcgcactattggcgagagcgatcagaccgaggatgatctggaggaggctttgcgccttatcgccagacatgacactatcggcctcaccctcgaacgggccaggataatggcggaaaaagccaagcgggcactggatatttttcctgataccccgcttcgtcgcagcctgtgcgcggtggccgactacacggtctggcgtgcgcggtaaaacggccagacggcttcagggggctggactggtgaaggtgttgcaggcttccacctctccggtttgtagccctttgcgaaaccaggccacccgttgggatgagcttccatgcgtaaaggaatccggtacgatatagccgcgtgcacgcttttgcaggcggtcatcgccgatcgcgtcagcagcgttcaggccctgttcgatatcgcctttttccaggatagaccgggcatcattggcctgctttgcccagaccccggcgaagcagtcggcctgtaattccagccgcacagacagtgcattggctgtgccttgatcggcttcttctcgccggcgagtgactttgcccagaatgccgagctggttttgcacatgatgcccgacctcgtgtgcaatgacgtaggcacgggcgaaatctccccctgcgcccagccgctcctgcaattcacggaagaaggatgtgtcgaggtaaactttttggtccaccgggcaataaaatggtcccattgccgactgtgccgtgccgcaggctgagcgtgttgtgccatcaaacagtaccagaatcggcggctggtaggtttttccatgggccttgaaaacggtgctccacacgtcttctgtcgaggccagtatgcgactgacaaaccgacgttgtggatccgatccggatggatcgctttgtgcttgctgcgccggggaaaggggggagggaacgggcgatgaaaccgggccgccatttcccgtcaggctgagcagaagacgaggatcaatgccgaaataaagcccgaccagcacaatggcgattgtgccgagaccaccaattttgatcccacccggaataaaggggccgccagtacctcgatcatcctgaatattgttactttcacgctgatcatcgagtcgcataccgatccccttttgcaagggcaggatgatgtctcgatacgcttccatcctgccacgatgccgtgctcaggaagacgtttgcggcaccaggcaggttgcatcatcggccctgcctgatgccgtttcggattcaggccttcggaatttaacccttttgggcggaggcagctttgcgtgcagcggcttcctcggcgctggcaacaccgccatgggcggcggaccagcccatcggatcatccagaaagcgccgcacgccagccagtacatcgctgctgaaatagcttttatccttgcaggcttccagcacatcccaccaggtgcagaggtgatgcagcgtcagatccatggccgacagggtttcaaagctgccggggaagacaccatagaaaaataccacgaatgcatggttgcacagcgccccggcatcgcgcagtgcacgggcgaactggatcttggaaccgccatcggtggtcagatcctcgaccagcagagtgttcagcccttccggagtatcgccttcgatcagagcgttacggccgaagcctttcggcttcttgcggacataggccatcggcaggttcatgccatccgcgatccaggcggcaaagggaatacccgctgtctcgccacccgctacggcctgaatggtctcatagccgatatggcggctgagcttttcaatggcgagctgggtgattttctgccgcgcccggggaaaatagataatccggcgacagtcgatatagacgggggatttccagccggatgtcagcgtataaggttcatccgggcggaaattgacggccttgatctccagcagcagacgcgcagtggtcaaggcagcgtcacgatcccattcactggtcagatgcgacgcggtcatgtgttctcgtccttgccgttatcatgtgatgctgcatgctgttagcgtctgatgattgctccgtccatgctcataccgccatgtctggtcgtgacagcctgacgaattgaggggatcatgggaaaaacccgtgctgtttgcttgcgccgcggagggtagcaggatagaatgaacgtcattgcgaatgactcgcaacgacttcgggaaatgtggccttgaacaacgacgtcagcaacattacacgccggtgtgaacgcgcggtcattaccgcctatcgtgaactgcgtgcatgcggcagtgctgacatggtggcatttcaggcctgcacaacgctttatcgcattcatcatccggaggctccgctcagtgaagcgcggcgtctggtggcggagtggatcgatcatcatatcgtgcgcagcgccaatggcccgacgcctggttgcgagtgcgactaagggatcggtggtatcggcctctttataccgctctgttctgtgttccgctgctggtcgcctgtagttcccggctgactcccgagcgtgacctgacatgtcatatgacggtcgataccggctttctctatgttatcgacaatggctggcacactgcgatcggtttcgatgctgttgacctgacgggtggtcttgccactttcaaaaccatcttcccccatgcaagggcagtggtgtttggatatggcaagcgaaccttcatgacggcccggccgcagaccatatccgaatatattatgggaccagtgccgggcccggcggtgatcgaggcggtcgggctgactgtctcaccggagcttgcttacggtcagcagcatgtcagccggttacggctgccccgtcaggatatagaagctgcggtctcatgggtggcgaacgatctggctgacgatccgcaaggtcagccgaggctggtcggcttcgaggacgggaaacggggtgcattttatgtggcacgtgaccggtattcgatgctccatacatgcaatcgctggtcggcggacctgctgcgcaaggcgggagtgccgttggaaccggccggtgtcgtattgagcgggcagctgatcaggcgcctgaatcaggcggcgatccagtgcccatccgatcagtccccggcagtgatcatcagcagggcggcagacgaccatcagagcatactgcactctgccccgccggaataatgatgatgcgttcattacggggtggggatcctccgccactgctggaactgcaagcggccagcgtggtcacgatcagaaaagcaccggctgtccagacaacgcgcatagtgaattccttacggtcaaaaaactgaagtgccaatacagccctgtcccctcctgacatactttgtcgggcggttcaggtcagcatagggacatggtttttggacaaaataattcactttgtcacaaaggcggcagcagaaagacgaaaagcgccggttgcccggcgcttttgcttgcatcctcatgaaaagaccggcggccattcaaggccgccaccctgatcagcggtgatcggccgacacgtaatcgcgcggcccatagccggtgtagatctgccggggacgcccgatacgctgggccggatcctcaatcagttcctgccactggctgatccagccgacggtgcgagccacagcgaacagcacggtgaacatgctggttgggaagcccatcgccttcaggatgatccctgaatagaagtcgacattcggatacagcttcttactgatgaaatattcatcgctcaacgcgatccgctccagctcgaccgccatatccagcatcggatcgtccttgatgccgagttcagtcaacacctcgtgacaggtctgttgcatgatcttcgcgcgaggatcgtagttcttgtagacgcgatggccgaagcccatcaggcggacattgctgttcttgtccttcaccttttcgatgaaggcaggaatgttggagacatgaccgatttcggccagcatcttcagcaccgcttcgttggcgccgccatgggccggaccccacaggctggcaataccggcggcgatacaggcaaacgggttggcgccagtagagccagccagacgcactgtggaagtcgaggcgttctgctcatgatcggcatgcaggatcaggatgcggtccatggcccgttccagaaccttgtttcccttataatcctccgacgggcgcccgttgatcatgtagaggaagttttccgcatagcccatatcgtaacgcggatacacgaaaggatggccgatcgagtatttatacgcccatgccgcaatggtcggcactttggcgatcaggcgcagggcgcagatattccgatgttcgggattcgtgatgtccaggctgtcgtgataaaacgcgctgagagcaccgacgacgccacagagcatggccatcggatgggcatcgcggcggaagccctggaacacgctgcgcagttgttcatgcagcatggtgcgacgcatgacttcggtgctgaattccgtcagttcatccggcttcggcagttcaccgttcagcagcagataggccacttcaagaaagctcgacttctcggccagctgatcaatcgggtagcctcggtgcagaagaacgccttcatcaccatcgatgaatgtgatcttgctttcgcaggcggcagttccgccatagcctggatcataggtgaagacacccagatcgccctgcatcttcctgatatcgaagacagaagggccaagcgtgccgtcgagcaacgggtaggttgccgacttatccgtgccgttcagctggacggtgacgctgcgcgtaggggagccgctcattcaaacacctcatggcagaagcggctggaaaccgcctgactcagattctgtgtaacgaatgggatgaatgatgccattagaagcaagatcattccataggagacgttattggagcaatcttcgcacttgcgaaaaaaaacggcaagccctgccgcgccatcttcagcgaaagtttaaaactgcggcctatacgtgcgccacaatccgcgatgggctgcccgtgcctgttcctcatcagaggtcaggcccaatgttttgaggggggcagagcgcgtttctgcacgtgcttccgcatacgtttctgctctggcccatccggcctgaaccactgcacgattgatgacggtcccctgatttgctccctggccttctgtctgggtttcacagatggccagagaatggtggttggtatcgtgccctaatatttcacattcgacgggacgattcttgatgatttccgccagagcttcggcagaggctgcaccgcagtcgaaacggcttccatcaggcgttctgcattgctgcccgcgattgggggcggaaacccctgccagccgtataaccgtatcggcaacccgcaatgtctctccatcgacgacggctacctgtgcgggtgaagcagtcaaagatatatcacgctgggtttctgtccccgttctgctgcctctgatttggtcgagcacattctgaagcgagataagggaaaccgacgggagggacggcgtaaataccgcaatacccccgatcccgcccagtgacagcacgctgccgagcataacccatcgccgccacggtctgcgtttatgggcggttgaggaggtgaaaatgcgtcgtttgtgtttcaggtacatcggtcggacctacgatatccgaatgcgcagagaggtgctgcatgacagggaatggccattctcccgaaagggcgacgtattaatgcctatcctggtgccgttgccaagttaaggtcgtgtggaccgggataaagtcgatcagttccagaacggctttgccgcatggaaatgtttccaggcggcgataatcttctgtctggcgctggccccatgggcggcggagaagcccagcacgatgccgcgggcctgtgcgccctgcacgccgtctttcccctcaatttcctgcatcagcccggccgccacggctccgtcattgagaatgccgagttcttcctgaagttctgacagccggcggatcatccggcgtccctgtttatgggggaagcaggcggcaaagaattcacaagcatagcgcaaacgttttgcatgcaggcgtaattcatgcagggcggcggtgggcagatcagagatcggggcgctggcgggcagttttttcaggcgttttttcagtaccccggcggcgaagatttcgattggctggttcaggtattcttcacgatgatgccgcacttcatcatggagcgtatggatcgcctgtcgccatggccgcacctggcacagcagggcgagggatagccccagcctgtcgaaaccgggggtttccagactggccagcaaggtgtggtaatgctgttctctctgttttgcagcccgctccatcagacgtttcagtgcggcatggtcagggaaggtgtccagcagggtttggccagtctggctgataaatacatcccaatcgcgtgctggccccagcagagtaccgattgttttcagatgcgccttgacgttatccagctctggacaggccagtacggcggagaaaatcgatagggctgaacgcaggcggcgcagcgtcacccggatctggtgcacaggctccagcgcggctttgtcgatttcgcctggttttagcaggcggatacgtggcgcccagtaaagcaatgccaacgtcagatgaccgatgatatgccgtgcggcatcttcggtgctgatgccgggatcaatctccggcgcagccaggccggcggcggggcgggctgccagtccgcgtccgtgggaaacggctagcatggaaagcggcgtttccggaatccgaagccgggcttcctcattctcctgaagctcggatgccaatgcagcgatggcccttgcatcgccctggatatggatgcggccaaagggaagcacgtcggtcagattacggatcgtgccgtcttcaatgaagacggtcagttcttcactgtccatccgtgtctgatcgctcaggacgagactgcgctggcgtccttccacggatgcgatcggcatgactccgccctcgataccgtacgacgcaagcaaggtttcgatcggcgcaatcagagtctgttcatccagttgcgaaccgggcagcgaagggggggtggcaagactttccacgcgccacattcccccatcgacaaccagagcccgatgatcggcaaaaaaggccgcctccggtgtgtcgtgataaatccgccggaacgaacgcgttttcatccggcctttgcgctggcgtgacagcggtgcaaggcgtggcagtcgttctgccagggccggatcaaaagccattgttatcgtcaccggggcatggcctggttctgtttccggcacaaggtccagcatttcagcagcaggtgtctcagccacggtatcgatcacgactggaggcaatgcagatgtatcaatcatgttggcccatatcaggcagttcagagggggtaaggaagcgtgtcagccgcgccgcgccgggtaacagtccccaccagggctggtccagttcgaattgtgccagcccgcatgtcggatagccctcgttcagacgcgcgcgtgcagtgcgctcgtcccttgccggatttccaagcgtcagggccagatcatgcatgccgggattatggccgatcaacatgacacagccgaccgtttccggcacgctgttcagaacctggatcatctgctcggatgaggcgagatagagcgcatccatccgttctatacggggagtatgcggccatggctccagcgcctccagagtctggatggtgcgacgggcggaggaaaccagaatgagatccggccgcagatcaagcgcgttgatagctttatgcatggctgcggctgcacgccggccgcgatcattcagggggcgggcatggtccggaagtttggggtcgtcccatgctgatttggcgtgacggaggaggaggagctggcgcatcggcttgcggattgatcccgtttcgtcgcagcgccatctggcgcaggttggatatggccttcatgacggagcatggcctgttccgccgtatggtaaaaaggaatttttgcccttttgaccataaaatagactcctggaaacgaccggaggacaatcaggagtcgatgtctatccaggacagatggccgcctttcccggcccccgtatccagaaaaatcgctgttccgccacgttgcccatacatcgtcagaggacggccgtccgggctgcgattgtcatggccgcagtaaacgatgagatttttcggaatacggtcaacccagcgcagactgcgctccggataaccatcaggctgaagctgaccggtgggttcgccatatagcgcacgggccagcacgccatggacgcgtccatcctgaatgggaaccgggaaagggggggcggtatgcagcatgtcggtatgaaaaccgccatgaagaaagatgcggttcccgctgacaatccaggctggcgcatgggcaatcgcatgaatgatctgcgggatatggagggtatcgatctgcgcacaggtttcttcaagcgtcggatcaggccggacggatcgtccggccagccgcctggccagtctcagatcgtggttaccgagcaggaacagcccgcgcccccgatgaagcaggtcgagcatgatccgcagaacttcgccgttttcaggtccgccatccgtcaggtcacccaactggataatgaaacggtctgtggtgacggcatgggtaaacgcgcgtgcatcgccatgcacatcgccgatgacgcggattggaacatcggcggggggatgccgcggaaaagtactgacggagtccagggctggtgtgtccgtcacggtaataaatttctctcccatacccatcctgcatcgtcgccagcgatctgacagtatggcgatccatgaacagaaacaccatcccggccagcggttgtgcgagccatttcgtatcgatcacgagttggtctcagctgtttcgcatggcgcggctgtttgcagactgcatgggggcagggggcattgaaaaactgaacaaccgcccatgtccgcgcagaaaaatccgtcccccttgtggaaacagctttgcgatcaccggggaggatatgtccagcccgccagtataggtgccgaaggcgggcaacatcagtctctctgccgaaaacacgaaacagggacgggtcagccatgtaccccttaccggcacgctcgctttcgggtggtgatggccgcagaattccagggttccgtccggcactggtgcggcttcgtgcctgaaaatgaaccgtctcaggccatgctcggtatgaaaggtaccacttagtcccttgctggccaccggatcatgattacccagcacccaacggaaggtcgtggattggctgatcagatgcaggcgcgctgcatcctgcggctgcatgcgttccagaccgtagcggtcgtgaaaactgtcccccagcgcaatgacctgcgccggttggtaatgcaggatcaggttttcgagcgcatccagtgtggcagcactgtcccatggcggcagcagggagccacggatggcggcagcagagcctttttcaagatgcagatcggccaccatcaggatccgctcggccggccaccataccgcgcctgacggatccagcagcaatgtttccccaccggcggagatggaagcggggatggagcggactggacgagactgcatggtcagcgacggggccgaatatccggagggagggctacaaacagatcatcctgcatgatttgtccatcagacaatgacctgctggcatatcggggaggagaaacccttttgttgagggccgtctcatcgtccatcatggcttcctcgaccagcgcttcagcctccgccagcaacatttcctccgacccggcggagagaacgctttcacggccgatttccagcagaaccggcacagcaagcggagagacgcgggacagcgccatatgccggatgtgcccccgtgcccggcgcagcagcagtgccagacggccgatatcggtcagtcccgatgcggcatcggcccgggttgcccgcagcaggatatgatcgggctggtggcggcgcagcacatcatagatcagatccgtattgatggtgacctgacgtcggctgcgcttcagccccggctgttgtcgttcgatcagcccggataccacggcgacatgacggaaaatacgccggagcatggagctttccgccatccatgcttccagatcatcccccagtatgtcttcctcgaacagccggtcgagaccggtgggctgccgtgcgctccatgtcgccatcacataatcggtggcgacgaagccgagcgggatcatcccgagccgctccatccgcttcgtcaccagcataccgagggtctggtgggcgtttcttccttcgaagcagtaagccaccatgtaccagcgatcacctcgcggaaatgtctcgatcaacaggtcattacggcccggcagacgggagcggatgcgctgcttctccagccattccctgaccggatcaggcaggtgttgccatccctgtcgatcctgcaacattccgcggacccgattggcgaggctggtcgtcagcggcaatctggccccggcataggccgggaccatcggatcgccatcgcccccttcatcggcctccagcacagtatcatgcagctgaacgaagcgcagcagacgtccaccgaacatgaatgtatcaccggggcgaagctggctggcgaaatactcctcgacctcgccgagtgtgctaccccgtccttccgcacgtttgccccggtttccgcgcaggcgcaccttgatcatcggtgattgcacgatggtgccgatattcatccgccattgccgtgccacacggtcggaacgcacatgcagaaggccttcgctgtcccgaaacagcctgtgccactgttcataatgggacagcgtgtacccgccggtttcaacgaatccgagcgtatcgtcgaaatccttgcggtcgagcatgcgataaggcgctgcctgccgcacttcctcgaacatcgtatccgggtgaaacggggcggaacaggccatcccgagcagatgctgcgccagcacatccagcccgccggggccgggaggatctccatccagttcccgtgcagagactcccatgatcgcggcctcgcattccagcacctcgaacctgttggcaggcaccagaatggcgttgctggcttcatccatacggtggctggcgcgtcccacccgctgcaacaggcgggagacgcctttgggcgcgccgatctgaagaacctgatccactccgccccagtcgatgccgagatcgagcgaggatgtcgccaccacggcccgcaacagaccggaagccatggcctgttcgacgcgttcgcgctgttccagctccagactgccatgatgcagggcaatggggagcgtttcctcattcagccgccacagcgcctgaaacagaagctcggcctgcgcgcgggtgttgacgaatacaatcgtcatggcggccgctttgatccgctccagaatagcgggggctgctgccagccccatatgcccggaccatggcagccggccggatggcaacatcatctccagccgggggggagcaccacccgcttcctcgatgacgattgcatcgccgccgatataatcgcgcagtgcctgaggatgagcggcggtggcggacagacctgacatgcgcagacccggaaccagacggcgcagccgggccaggcagagggccagctgatcgcctcttttggtgccggccagcgcatgcacttcgtcgatgattaccgttcgcaggccctggaaaaacgtgggggcgtcttccagcgacagcagcaggctcaggctttccggtgttgtcaggaggatatgcggtggggtctcccgctggcgggcgcggcggccggatggggtgtcgccggtgcgtgtctcgatccggatcggcagccccatttcctggaccggagaagtcagattacgggcaatgtcggtcgccagagccttgagcgggctgacataaagggtatgcagcccctctggctgtccctttggcagctctgcctgtctggccagactgatcaggctgggcagaaaaccggccagcgtttttccgccaccggtcggggcaatcagcagggcgctgcgatcagcttcggcggcatcaagcatggcggcctgatgccgccgcaacgtccagccgcgccgttcgaaccaggcggcaaaacgaggggggagcgtcgtttgaagcatggcggaaagaatggggttcttatggtcgcaggagaaggggttaaaagagaacgccttacaggcactgaactttcccggtcattctgcgtcatatggccctgccttcagtcttgccggacgtcacgcacagccaggaccggtccatgttcctgatcttctcatgcatctgagcgcgccccatcccgagacatggcttcggccgttgccgcaggggctttactgtgaaccggctgatctgttcatcgacccggtggtgccggtggagcgtgccgccattacccatgcccatgccgatcatgcccgccccgggcatggcgcggtgctggccacgcctgaaacgctcgccatcatgaaaacccgcatgggggtggaacgtgcagcccgctctccgcagccactgtcttatggggaaaagatcacgatcaatgatgtgggactgcgcatggaaccggctggccatgtattgggcagtgcgcagatcgtgctggaatggcgtggcagccgtgtagtcatcagcggcgactacaagcgtgcgcccgacccgagctgtgccatttttcagcctgttccctgcgatgtgtttgtcacggaggctacgtttgccctgccggtctttcgccaccctccggcagagcaggaaatacgcaagctgtgcgacaatctcacggtttttccggagcgaacccatctggtcggctgctacgcgctgggcaaatgccagcgtctgatcatgctgctgcggcaggcgggatgggttgcgccgatctacctccatggagcgttgatgaatgtctgccggacctatgaggcgcttggtgtggggttgggcgatctccgccccgtgacctctgtgccgaaggaggccttgcgtggcgggatcgtgctggcgcctccctctgcgctggctgatcgctggtcgcgccgattgcatgatcctgtgccagttctggccagcggctggatgcaggtcaggcaacgtgcccgcgccaaaggggtcgaactgcccttggtcatcagcgatcatgccgactgggacgccttgctggccacaatccgggacgtgcaggcccctgaaatctgggtgacccacgggcgggaagaagccctgatccatgcggccgggttgatgggggtgaggggccgcgccctgcgtctcatcggctatggtgaggaagatgacgatatcgcggtggcggggggcgggataacaagcagtgagaggacagaggcgattacaacgggcggagagtccgtatgatcgcttttgccgccctgctggagcgtctgatctatacgccgtcgcgcaatgccaggctggctctgctgcaacgttttttcgaaaccgaacctgatccggatcgcggatacgggttggcggcgctgacaggtaacctgtcttttgccacggcgaaaccgggcctgattcgcgcattggcagggcagcgtgtcgatcccgaattatttgccctgtcctatgattatgtcggtgatctggccgagacgacctccctgatctggccggtctctgttgatatccttccgatggcccctcccggattggcagaggtcgtgacgacccttcagagcgccaccagaatagacctgccgcagacattatccgcatggctggactcgtcggatgaatcggtacggttcgcgattctcaagctcgtgactggcaatcttcgggttggtgtctctgcaaggctggccaaagtggcattggccggattgtcacaggggcggatcgagccggatgaaatagaggaggtgtggcacggtctgacacccccctatctgacgctgtttgcatggatcgaggggcatggtcccagaccggacccggccggtgcgcccgtgttccgtcctcccatgctggcccatccgctggagcagcctgatctggagactctttccctctctgaataccgggtggagtggaaatgggatggtatccgggtgcaactcgtttccgtgccggggggaaagcgcattttctcccgcacgggcgatgatatctccgcttcctttccggatgtgctggagaccatgaatttcgacggcgtgctggatggagaactgctggttgcacgggaaggagaggtggctccgttcgctgatcttcagcagcgactcaaccgcaaatctcctggcccggcttcgttgaagcaacatccggctcatgtcaggctctatgatattctgttcgatgaacaggagcgtgatctgcgggccctgtcctttgatgagcgcaggcagcatctcgagcgctggtttgccgttgcggccccgctccgcatggatctgtccggcctgatcaaggtggaaaatgcagaggccctcattgccttgcgggagggcgcgcgtgcggcttcgatcgaagggctgatgctcaagcgtggtgacagtccctacgtgcccgggcggcccagaggcttgtggtggaagtggaaacgtaatccgctgacggttgatgcggtgatcatgtatgcgcagcgtggccatggcaggcgcagcagtttctattccgattatacgttcggcttatggcgcgatgacggtcgtgggcatgaggagttggtacctgtcggcaaggcctatcacggctttacggatcaggagctgattgtgctggatcgctgggtgcgcaaccacactatcgcccggttcggcccggtgcgggaggtcgagaaatctttcgtgctggaaatcgcttttgatgcagtgcaaaggtcgggccgtcacaaaagcggtattgccatgcgcttccccagaatagcgaggctgcggactgataaaccggcgtcagaggctgacaggcttgagaccctggagcgtatgctcacctgaagagagcgaactgcctccgtaacggaaaaacctctgccggcatgaatgcgtaaaagttctgatcggtcgattataatcagggatcggattgtgcggaaattaaggcaggttctgtgattttagagatgctgcactgcaaaaaaatgcttgtgtgaatcgggtaaacaccgtatctacgctcatgtagcgtagcgttatgtcgcagcgctgcttttcttggacgtttcctccctaaacttggcggtgcctgcgtggcgccgccaatttttttgccttgattgcttattcaggcggcgcgggagagaagggcggcggtggcccccagcccgttcatcaaggatgtcatggcctgacgaatcaatgcgaaatgagcgttcctcagataacgctcctcatccatatacaggactcgggcaatttcgatttgcaggacgtgcacgccctttccggggcgtccgtaatgctgtgtgacatagccccctgcataagggttattccgtcgcacggcataaccaaggcgctggagagtggcctccgcagccatggtgatggtattggcgcaggaggttccgtgcaaatcacctaacaccatgtcggcatcgttctgacggcgtggtatccggttgccatgcagcccgacaggggagggcatggaatgacaatcgatcagcaaacacataccgaaccggttgcaggtttcctcaatcagttgtgacagcgcgatatggtaaggttgccagcaatcatggattctggccgcggcttctgaaaacagcagcttgcggcgatagatcggctcgccggaagcgacgatccgggccagcgtaccgagaccggcctcgacccttgcactgccggtattgacccagtcaggcagggtttcctcgaacatggttggatccagttcccacgcttcccgattgggatcacaccacgcacggggaaaatgggcgcgcaggatcggggctcctaattcgggcgctgcaccgaaaagttcatcgacgaagcaatcctcgcttttgcggagggtgtcgtaatcaaggcgggaaatagacagaaaatcagggctgtagagatttccggaatgaccggaagcaataaccatcggcaccgtctggcatgccggccggacgatgctgagggggccttcctggctgatatccagtacccgataatccatactctcgattacgtcctgatgacgatacacacaatcatagcttgcgcatgacgggtttccgcaaaagcgcgtgggaggaaaatggacgcatcgtgaggcatgaagaacgccttgaaatgctttgctgtgttaaatggaagatattgattttgaagggaacaggatggtgggcgcgacagggattgaacctgtgacccccgccatgtcaaggcgatgctctaccgctgagctacgcgcccatcctgcttgtgcggtgcgggccttctatctggcatctggcggacgtgcaagcccctgaagcccatcatttgcacgtccgcatcaattttcatggttttgcggttacagcccgttaaacagcgccgtggagaggtaccgctcggcaaaggaggggatgatcgtgacgatcagcagaccctcattggcgggattgcgggccagttcgagggccgcatgcagggctgcaccggaggaaataccgactggcagtccctccacccgtgccacgcgccgggccacggccagagcatcacgctccgctacccgcatgatgccatcgatttgtgtcatgtccaaaatcgtggggcggaagccgggcccgattccctgaatgccgtgcggacccggttcgtctccggacagaacggcgctttccgatggctcgacggcgatgatgcgtaacccgggcttacgaggtttcagcgcatgggcaattccggtcagtgttccaccggtaccggcaccgccgacgatgatgtcaaccttgccatctgtatcagcccatatttcctcggcggtggtggcagcatgggcttccggattggcggggttgtcgaactggcgtggcatccatgcgccgggggtggcggcaataatggcctctgcccgtgcaatggccccggccatgccttgacgagcaggggtcagctgaacatccacaccgagcaggcggagcattttccgccgttcaatcgacgctccctccggcatggtcacgaccagccggtatccttttgaagccgcgacaaatgcaagtgcaatcccggtattgccggatgtcggctcaaccagcacgctggtactcggatggatcaggcctgcggcctccgccttctcgatcattgccagtccgatgcgatccttgaccgagccgagcggattgaaaaactcgagcttggcagtgatatcggccaccagccggtcctcgacagtcaggcgaggcaggcggatcagaggggtaccacctacaatatcgagaatgctgtcgtagattttgccgcggggttgggggcgacgaagcccgtctgaagaaagagaatcggtggtggacaaggaggctgccctgttgcgagtgccgcgtgatctggctttggcttcgctcggctttccgtcctccgataccgtgccctcatgatttatgccttgtgcatcggggccattctgatcaggcgtggcgcccagagagactgattcattggtcataccggccgatccatatctgttcgtgctttcacttatcgtcataactctatatcaccctttgcaacggtgatttaaggactcgtcatgctgctgcgtcgtgatagggccatggtggcgatttccgttatgctggatgtcggtttccatggcagtcgtaccaatactgtcagtgccgcggatatcgcggaacgtataggcctcgcacgccgggggatggagccgctgcttcaatccctgtcgcgggccggattgctggaaagtgtccgtggaccacgcggggggtaccgtctgggccgtcccaaacgcgatatcagggtgtccgacatcgtggccgtcgctgtggccgatgacggggagggtcatgaaggccctaccggcagattgcaggtcgctgtggttgaccggctgtggacagagctggaagaaaccgtccgtgcccagctggccgccatcacattggatgatctgctgaaaagggcggctgcggcaggcttgcgtcggccggcggcggaaccaattacgtttgttatctgatcgctcgctggtcacgtttccgcccgcatgaggtgtgtcatgttccatacgcatatgcggcatggggctgcaagcgttaaccacatcttttctatgtgatatcggtggaagccgacgtaaaaacgtgattttggtgtcgatactccaggaggactataatgagcattcagcttggccagacggctccggatttcgagcaggacagtaaccagggaaagatccgctttcatgaatggctaggccagtcatggggcattttattcagtcatcccaaagactttacccccgtttgcacgacggaactgggggaagcggcccgccttgcccccgaatgggaaaagcgcaacgttaaagtcatcggcctgtcggtcgacacgggcgaaaaccacaagggatgggaagctgatatttctgaaacccagggccagaccgtgaaattcccgatccttgccgatgcggatcgcaaggtcagcgccctgtatggcatgatccatcccgaagccgatcccaacgtgaccgtgcgtgccgtgttcatcattgatccgaacaagaaggtgcgcctgaccctgacctacccgcccagcacgggccgcaacttcaaggaaatcctgcgcgttgtggatagccttcagacgtctgacaaattcaaggtggcaacgccggtaaactgggaaaagggtggagaagccatcatcccgcccagcacctcggacgatgccgcgaaggaacagttcccgcagggctggaagaccctgaagccttatctgcgtgttgtaaaactgccggaagaggcatgatcacttgccggaataggtggagcaggcggtaacgctggctctgaagcggtaatactgactaatatgggggaaggcgggtaataaccggctttccccccttgtgaattgtggggcggattgtgaaatccggtctgccggaatttgatctgattggggcgtaagccatggacggaaccgtttctcccaagcgcagtggcgtggagcttctgaaggaaaccagccatggcctgcgcggtcgtctggcggaggagctggcggaagggggccttcaggtcagtgaggatggctacaaccttctgaaatttcatggctcctacgagcagttcgaccgcgacaccgcgactgcgcgcaaacagcagaagctggagaaggaatattccttcatgttgcgcgtccgtatgccgggcgggcgcatgaccgccgcgcaatatctggctctggacgggttggccgatgaatactccaacggcacgctgcgtatcacgacgcgtcaggcaatccagtttcacggtattatcaagggaaatctgaagcccaccattgccgccatcaacaggacattgctgacgacccaggcggcttgcggggatgtggtgcgcaacgtgacaaccaccccggccccgatccgggatgcggtgcatgcgcggctggaagcggatgcaaatttcctgtcccatgctttgctgcccaagactcatgcctaccacgaaatttttctggatgaggcggcccgcgccgatctgggcacggaggcagaggaggagccgttatatggtgagacctacctgccgcgtaaattcaagatcggcatcgccaccccctccgataatacgatcgacgtgttgaccaatgatctcgggatcattccgattttcgaaggtgacacgctgcttggctataacatggcggtcggtggcgggcttggcatgacccataacaagccggagacctatccacgtctggggacggtcatcggctctgtcggacctgatgaattgctggctggcgtcgaggctgtcatcaggcttcagcgtgactatggcgaccgcttcaatcgtcgtcgggcacgcctgaaatatgtggtcgatgaccgcggggtggattgggtgaaagccgagctggtcacctattttggcaaacccttcgctgaaccgctaccgatggagccgttccgtatgccggagctgctgggctggcacgagcagggagatgggcggctatggctgggtattcccgttccgtccgggcgtatcgccgatacggatggtgtgcgtctgcgccgggcgatcagagaaattgttcagacatatcaggtcaatgtcacgatgacgggtcagcaggatctgttcctcgtcgatgtcgacccggcacaccggtccgcgatcgagacccatctgcgtgaagcgggtgtgacccttaccgaagatctgactcctttggcacgctggacactggcctgcccggccctgccgacatgtggtctcgccctgacggaggcggagcgggtgagagacccgatggtggccgggctggagcaggtgctggaccgtcacgggctgaaaaacgaacgtatttcgttgcggattacaggctgccccaacgggtgcgcacgcacttatgcgggcgatatcgggctggtcgggcgcatgcctggccattacgcgatctatgttggtggtgatttcgaaggcacgcgactgtctttccgcctgcttgacaggatcaaggaagaacagatcgagccgacactggacaggctgttcgcagcctttgcccgggaccggcaggccgaagaagggttcggtgacttctgtacccgtgtgggtgccgaggcgttgttacagcttctgcccgcggggcatgcctgaatggggcatgcctgaacatagctggatgtcacattcgcgggcgtgttccgtgaatgtgacattctgtgtttgtcatagaactgtcatctgtttgtcattgtcgcgtcttggataccccgtagggtccgcctcgcttcagccggcttgattcgcaggaatgtgcacggttttggagtattggaagcggaaccgcctgaggggctatggcagccatcaggtctgatccgtttcgaaatggtattatccaggaggacgcatgaaattcgctccctcggcaattgctgccgtgctgattggcgctggcttgatcgctccggcttgcgcgcaggcgcagcaggttgtcggcgccggctcttcttttgcagcgccgctttatgacaagtggtcggagcaggcaaaaccctccacaggcgtgtcgctgaattatcaggcgatcggttccggcgcaggtcagactcagattttcaaccgcaccgtggattttggtgcctctgacgcgccggtgtcggccgataaactgcgtgaccacaaactgttgcagttccccagcgctatgggtgcagttgacgtcatcgtcaacatcccgggcatcaaaagcaacgagctgaagctgactggtccgatcatcgccgcaatctatgctggcacgatcacccagtggaatgatccgaagatcaaggaaatcaacaagggcatcaagctgccacgtctggcgatcgcaccggtttaccgcgctgatggctccggcacgaccttcgtatttacagattacctgtctctggttgacagcgactgggcctccaagatcggtcgtgcgacctccatcagctggcccgccggttctggcgccaagggcagcgcgggtgtggctggcaccgttcagcagattccgggcagcatcggctatgttgaggccgcctatgcgacccaaagccatctggtgactgtccagctgcagaacaaggccggcaagtttgtggctccgacccctgccaatttcgcagccaccgctgcggcggctgactggaccaaggcgcagaatttcgccatcgacctgaacgatcaggcaggcgataattcctggccgatcgaaagcgccactttcgtattggtgccgaccaaccccaccagcaccgcaaaagccgctgccgtgctgaagctgtttgactggggctttaaaaatggcgatgctctggcttccgatctgcaatacatcccgctgccagcatccgtgaaggacaccattcgcgccgcctggcacgatggtatcaagggtgcggatggcaagccggttttctgatcaaaccgggatgctctccccgtttcggtgcggtgctctgtagggtgccgtaccgaggtggcaggcttacctgcctgaatgcaggtggcgcacgctattttcgatcatgacaaatggggcgagccttaatcggcgcgcggcagaatggcctcagttcatcagatagataagaaagcggtctttttacatccatccgggccgggtgatggaaaaagaacgccgccctcacagaccggtgacaggatttttggcgctttggtgcgaatagcagggctgttcgtactggctttgctgggtgcgattatcctgatgctgttcatcggcggtttgccggcgttccgggcattcggacttgaattcctggtgtcatcggcctggaatccaccacataacgtgtatggtgcactggtcgcgatttacggaaccatcatcacatcggtgattgcgctggtaattgctgtcccgattgcctttggaattgctgtttatctaaccgaactggctccgcaatggcttcgtcgtccggttgggatcgcaattgagctgctcgcggctgtaccttccatcatttacggcatgtggggctttttcatcattgtccccttcatgaccaaaattcagccttccattatctcgttttttggttcgctggcggatgccgaggaaaacgtggcggttcttggcccggtgacaggctggctggcagatcgctttgccggtcctgcctacgggaatggtattctcacggcctcgttgatcctggcattgatgatcgtgcccttcatagctgcaacaatgcgcgatgtgtttgccaccgtgcccggcattttcaaggaaagcgcttatgggcttggttgtacgacctgggaggtcgttcgctccgttgtggtgccctacacccgggtatcggttgtaggcggtatcatgctcgggcttggacgcgcgttgggtgaaacgatggcggtgaccttcgtgatcggtaataccaaccggatcgccaccagtattttcggtcctggtaatacgattgcatcgctggtcgcgctccagtttccggaaagcaatccgggtggacttcagttttcctctcttttcgcgttgggtttcattttgtttgtcatctcctttatcgtgctggcgacatcccgctttctgatgcggtcgcgttcagccggggcagccagagcatgacagccgtactttccaacacggccacggcgggcgtcaaaatgccccggaatggtcctgtcgcaaaaagccctgctgctttgcgcctcaatagcagacggcagtggataaaccgcattgtcgtcggcctgtgcagtttcgcgacattgcttggcctggctgcgctggcgctgattttgttcacgctgcttaaaaacggtctggcgggtctttcactgactgtctttacccatgatgaaggcgcccccggctcccatggtggtcttcgcaacgccattgtcgggacattgatccagactgcgctgggtacgttgatcggcacgccgctggggctgctggtcggaacctatctcgcggaatacggacgtggctccgtcttgagcagtgcggtcaggttcgtgtccgatattctgctgtcggcaccgtccattctggtcggtctgttcatgtatcagctgatcgtgcggccgacgggagcattttccgggatcgcgggctgtctggctctggcggtgctggtcattcccattgtcgtacgctcgaccgaggatatgctgcgccttcttcccgcccagttgcgggaggccgcggtcgctctcggtgcgccgcgctggcgggtgattactttcatctgctatcgggccgccattgatggcatagcaaccggtgtattgttggccatcagccgtatcgccggtgaaaccgcgcctctgttgttcaccagcctcggtaatcccaacctgtcggtgaatctggcagagccaatggggagcttgccggtgaccatctataaatttgccggttccgcctattcggactggcagcttctttcatgggcaggcgctctgctgattacactgggcgttcttggcctcaacatactggcccgtgccattctgggcagaaggcagtgagacaatggtaagtactgtttcccaggtttcccgaacggcttcccatgatgcgggcggaagtgctgctgccggtctggccgcaatggccgcatcccgtgtcatggttgaaagtcagccgaaaattgccgtgcgcaacctcgatttctactatggctcgcacaaggctctcaaatccatttcgcttgatgttcatgagcgtcaggttctgggcatgatcgggccctccggctgtggtaaatccacattgctgcgtatcctgaacaagatgtatgcgctttatcccggccagcgtgccgagggtgaggtgctgttggatggcgagaacgttctcggcaaagatgtcgatgtcaacgtactgcgcagccgggtcggcatggtgttccagaagccgacgccatttcccatgtcgatctatgagaacatcgcgttcggcatccgcctgcacgaaaagctttccaaggcggagatggatgagcggatcgaatggtcgctgacccgtgccgccctatggagcgaggtcaaggatcgccttcatacggcggccgccggaatgtccggcggtcagcagcagcgcctatgcattgcgcgcaccatcgctgtaaaacctgaagtcatcctgctcgatgaaccgaccagcgcgcttgatccgatcagcactctgaagattgaagagctggtggatgagctgaagcgcgatttcaccatcgccatcgtgacacataacatgcagcaggctgcgcgctgtgcggatcgtgttgcatttttctacatgggcgaactggtggaagtcggcacggcgctcgacatgttcaccaacccgcgtgagcagcgcacgcaggaatacatcaccggtcgcttcggctgaccccgcgggaattgatgccatgaccaaccaactgggttcaccccatattgtttcaagctatgagcaggatcttcaacagctcagtgatatgatcacgcgcatgggcgggatggtggaaaaccagcttgctctggcagtgacgtccatcatcaacaaggatatggaagccgccaatcgcgcgattgatatcgaccctgcgattgatgcgttggaaaccgagatccagcaattcatcgtgcgtcttctggcactgcgccagccggtggcgatcgatctgcggatggtgctttccgcgctgaaaattaccagtgatctggagcgcattggcgattattccaaaaacgttgccaagcgcggtatcgtgctgaaccagttttcgctgcccttcagtctgaccggtctggctcatatgggccagcttgttcagcagaatatgaagaccatcattgatgcggttggtgagaatgataccagccgtgctgaagaagtctggcgctccgacacggcgatcgacgatatgtataatgcgatcttccgtgaactgattacttatatgatggaagatccgcgcgacattacgccttgcacgcatcttctgtttattgccaaaaatcttgaacggatcggtgatcacgccactaatatcgcggagacggtgttctataccgtttccggtcatcctttgccggatgaacggcccaaaagtgataacacgtcctatatggtggcgcgtccgtcgccggatgcgacatcctgacgggtccctgaaatcgtcgagggcgaggagactttataatcatgcgctttgcacaggaagaaacccgttcccgtcctgcggaggctccagcaggccagattcgtccaaccgtgctgattgtcgaggatgaggcggcattggcgacaatgctgcgctataatctggaaaagcagggcttccgtgtcgaggaagcttctgatggtcaggaagcgctgcatcgcctgtcggaagttcagcctgatctggtcctgctggactggatgctgcctgggctgtccggtatcgaggtctgtcgtcagatacgccggaaacccggcacccgtgatctgccgatcattatggtgaccgcccgtgtcgaggatcaggatgctgttcgggccttgaatacaggcgcggatgattacatcaccaaaccgttcaacatgcaggctttgcaagcccgtattcgcgcgttgttgcgccgggccagcccggtcacggcgaagggcatgctgaccttccatgacattacaatggatctggcaacccatcgcgtgcatcggaacaaccgtccgatccatctcggcccgaccgaattccggctgatggaattcttcctgcaacatccgcggcgggttttctcgcgtgaggaactgctggattcagtctggggcaccgatattcatgtggagccgcgcacagtggatgtgcatatccgtcgcctgcgcaaggccgtgaacggagagggtgaagttgatctggtgcgtacggtacgggctgccggttatgccctggatactgatccgttatgagatacttgctctgattgtttagaaaccatctgtgcaaagccgttcctgtcgacaggaacggctttttttctctggttagcgttccggacagtacccttcgacttcgaccagcagctccgcacggcatatatccgcgcgcaggatgcattctgtggcacccggtccgaaagcatcattgagaatgctctgaacagcgggcagatcagaggggtgacgtatgtaggccttcaatctgagtgcccgtgcatccccctgaaatcccttattttgtgctgcttgcatgacggcacgaatattggccactgtctcccatgtctgtgcctcaacatcattcggatgcaggctctggtgcccggtgatggcggcggtgcctgaaatgaacaggtaacgctcatgctctccggtggtggctatagtggcgcgggaaaaagtcgggctgcgcggcccatattgttcaggatagcgataggcgctgatctggcgaggattttccaccggtatgcccgcctgacgccctgccagaacatagaccagtaatcctccgctgccggtgccaagcgcacaggcggctggggcgctggtttcttcccggccacgggcagagaaagcatcaaaccggccctgattgaacaggtggtaccgttctgtcccatcatccatatcatgaatccgcggcatatagtttgcggtcttgagcagatggggaaagcctttttcatcaatgaccgagaaaagtgcctgataggcccggaaacttgcctcccgcagcggtacatcattgctgatacggaccgcgccaaaaaacagcctgtcattttctccgttgacgacctgatcagggccaatctggcggctgtcccatcgcgacgttgcgtcagaggcaagccacagttccgcaccaacccgctcaggccagagaagtggaagatcagccatcagtctcactggcccggtttcccccccgctttccggcagggaagggaggcagttgagaccgatgatccccagtgccgaggaggccgcagcggatgagacagacccgacaaacagagggagagggctataatactgcacggttaacgatgtcatggtgaaggattgcttctgaaaggctgagtgcaaaagaaatggctgcaactcacgatgccatgcggtcgtttcaatgcgcgggccagaattgtggatcgcaggatttttaagtttagcagggaatattctatcatggcatctatcgtttcgcgtcggcttcgtgaaggccttccccatccacgcggagcgatctgggacggagaaggtatcaatgtcgcgttattctccgcccatgccaccaaggtggagctgtgcctgttcgatgaaagcggcacgcaggaaaaagagcgtatcaccctgcctgaatatacggatgaaattttccatggctatgtctccggcctgggccctggcacggtttatggtttccgcgtccatggcccctatgagccggaagccgggcatcgcttcaaccctcataagcttttgctcgatccctatgcgcgggtgcatatcggagagctgaactggaacccggcctgtttcggctatacgatcggctcggaacaggaggatctgtctttcgacgagcgtgacagcgcggcgttcatgccgaaatgcgtggtggtagaccaaaatttcgactggcatgggcaggagattcgccccggcattccgtggggccgcacgatcacctatgaaacccatgtgcgcggttacaccatgcgtcatccggaggttccagagcatttacgtggaacctacgccgggttggccagtaagccggtgctggatcatatccgcgctctgggggtgacgagtgtggagttgctgcccgttcacagctttgtgcgtgacagccatctgctggaaaaagggctgacgaatttctggggctacaacacgatcggtttttttgcgccggacccgctttacgcggccgaccgcaaccgtgtgctggctgaattcaaggaaatggtagcccgcttccacgatgccggactcgaggtcattctggatgttgtctacaaccacacggccgagggtaatgaaaaaggtgcgaccctgtctttcaaggggatcgacaacgcgacctactatcgtcttctgcctgatcagaagcgattttacatcaatgataccggcaccgggaacacgctcaatctgtcccatccgcgtgttattcagatggtgacggacagcctccgttattgggtgacggagatgcatgtcgatggtttccgcttcgatctgggcacgattctggcgcgggagccggatggctttgataccgagagcggcttcctgcgcgccgtggggcaggatcctgttctggcgggtgtgaaactgatcgccgagccatgggattgcggaccgggcggatatcaggtgggcggtttcccacccggttgggcggagtggaacgaccagttccgtgatacgacgcgcgatttctggaggggtgaggcaagtgccgccgcgctggcacccagactgttagggtcccctgacaagttcgatcatcgtggtcgcaagccatgggccagcgtgaatttcgtgacggcccatgacggtttcaccctcaatgatctcgtcagctataacgacaagcataacgaggcgaatggcgaggataaccgcgatggtagcgatcacgatcgctcatggaattgcggtgccgaagggccgactgacgatcaggacattgaaaccttacgccagcgccagatcagaaacatgttgggtacgctgctattgtcgctcggcaccccgatgatattggcaggagatgaattcgggcgcacccaacagggcaataacaatgcctactgtcaggataacgagatcagctgggttgactgggatattcaggagaaggggcattccctgatccggtttacgcagaaactgatcgcgttacgtcaacagcaccccattttgtggcgagcgcgatttcccggtgaaaaccagagtgatgaatccgggatcacagggttgcgctggatatccgcgagcggtcaggacatgacgcaggaggaatgggaggacgggaatacccgtaccttctccatgctgctggatggtcgtgcccagccgaccggggtgaaagagccgggtcaggatgccagcctgttgatcatcctgaatggatggcaggatgttgtttcctttacgctgccggattgtcccggcggagaggaatggagactcctgatcgacacgaatatccctgatgatgatggcggggcgttgttccgggtgggcgatcagtatcaggtgacggggcgttcggtgctcgtgttcgagcattgcagaagctgatccggttgtctggccggtgtgtgcgaatagagcacaatgccggccatgccgatggcgacgatgcttaacccgccaccggcgatcaatccgattggccctgtcagagcgagcatagagggcgcaatcgccaacccggccagcatgccgccattatagctaatcagaaagccacgggccgaagcgggaacgtcatgagcgttcagcacggtctgacgcaggatggcaatgggaatatcctcgaatggccctcccgtaccggcgatggcggcacagatcataaggcctggtgctatccagtgaggaggtgccagtaaagccaccaatgtcatgcaggccagaccggctccaaccaatgccgtgcctccgaacatcatgcaggcggggagggcggggaggggacggttgcccacgatcatcatgcccagcacgttgccgacaccgtaggcggcaatcactgcgccataggatgacaggccggtggctcctggctgcaaccgggtaatcagcagcggcagggccagatagacaatcgcataccatgcaccgcagattgccgggccgataaggaaggaataccagagcaaaggatgtccgcgattggcagtaatggcatgccatggcgtcggtatgtggcgggttggtgcggcatcctgacgaacctgattgcgaccggtcagccagactgcgatggctgaaatggcaaaggtgatggcatcggcagtaaaaaaatgcaccagtggcagaaagcccgccagcatgctgatcatgaccggtccgagcaatctggcaacacggtctgtcatgtccatcagggcattggcggctggcaactcgctctgatctggcaccagttgcggcaggacaacctgaagggccggcctgaacagcgcctgtcccaatgcaatcagaagaatggcttgaagcagaaatggcgctgaaacaccgcccttgatgagccatgcgccgatcagcgcagcaagagaaaccatgcgaatcagatcggccccgatcatcacccggaactgtggctttcggtccgcccaggggccgacaaaaaaagcggccaatagaatacaaaatccctgaaaggcggtcagatatcctgcattggccccaaatgcttgcacagccgcccaggagagagcaacgaggtagagctggtcgccaatcgctgagaacgaaaggccaccccacaggcacgccagcctatgatggcgcaggacaagaaacagtttcatgtcatggtttctggcatgtcggcatgccagcaaaaagggcctcgttttgaagcatacgagacccgtttcaaaaacagcatatagagtgacggcgattagagtgacagcgatgccagtttatgaggtcgccggaaatagtttaacgcagattatggttgatcgaatctgtggccaggtcggcaccgaaattcattgaacctgtcgtctgatcggccgttatctgtttgccaacggagagatcaatgccccgcttgcgggaagacgaaggagcttgagcaacctcctgatagactggctggtcagaacccccgaccaccgctgcaacacgaccaccggcaggagccagattacgcgggggcggattcaggtcgggaacggaggctgatgccatccttgtggctgatccagactgtccctcaggacggtcgtaaataaaaccgtaggtcgggtagacacttccataagtttcggaatgaccgagcgctacacgaaccgaggtccagtcattgttcggggatacgtcgacgacggagatgcctttgctgacaccgccacgggcgccgggaccgcgccagtttgcgtggtcaatcaagacttcacgactgttaataacttgttcaacgacggcgacatggccgagacgcatatgaccgttggcacggaaattgaggatgctgccggtttcgggggcgtttcctcgggcatacacgccttcagcggcatcccaccagtttgcggcattccccttgagttcaatcccggagacagagcgggcatagggaacgcattgaagggcggagaaagatcggtgacgggaggcgtattgaagactgtgttttatatgcaacgatgcatggtgattatgtgacacccctgcttgtcgacccgcaacatgtttgctacgtgcctgagcggtgccggtcataagtggaagggacagcgcaatagctgttccgtaacccaagaccttcttgccggttgcccatgccagcatatgctacccccgttcaccccattacctattcaatgggttagcaacagagttgcgtcgctgacaaccccgtaaattgcgtcagatgacgatcttcttcatgaatcctccatctcgcggtcattatcggggtggagagggcacatgactgcgcctgaatcgaaaaggcaggcctgaaatatatttcaggcctgcctttttcggtaaattttcgactcgttaccggcaggcggtgaccatcacctcgaccagacctttgggatctaccaactcggcctgcacgcaggctcgtaccggggggtgaccaccatgcccggcaatccattcttcccacacggcattgaagccgggacggtcagcgaggtttttcagccacacctgcgcctgaagcagcctggtggcgtcggtgccgtgctgttccagcagggcgtcgatccggtccagaacctgatgggtctggcctgtaatgtcctgagtgctgtcttccgcgacaacgccctgaagataaacgaaaccgtgatactcgacagcggcggagagaatgctgttcggctccgtgcggatgattttgctcatgatgatatttccttgatcaagctgaacgtcgcgcggtcaggtgtggatgtgccacgtccctgatcacggcggcttacatggagttggactgcatgttggtgctgggcagaaggctgccaaccggctgctgaccactgccgccattgcgacggatgcagttgatgacgttccgattatgaccgtagctgtcggacaggccggaggtaatgacgccgggtgccccgatcccggcatagggggcatccatgacgccgccatgataacgatcggcactgtagaccgcgtcaggattctgggcggtaaagatttcatcggcctgtttggcacaggcagcggccacctgggtctgcctggcatccatcctcgcggcgcaaccgctgatcatcagcccgcctgtagcaaccagaagcaggcgtttcagccctgacggcgttgcggtcatgtgttcgtctcctgtttccctgacgcggacgtatgaccgctgcagcggcgttgtaaaccgggtcatggctgctgtctcggccaaactctcccgattacagggaggaagccagagcgctgggtaatgccgccagcctcgactggaacaggggggcatcaaatccggccgtgtcggtcaatatctcggtagcagccagatgcagcaaggcaggatgcaggctgacctcacctttttgaatcgagaaatagggccgcagggccggcgcacggctcatcaggtcgatcaaggcgagcaggcggatcagcagggaaataccccgtgtggtgtccagcccggtggttgcgtcgattgccgaggcccagcagcgggcatccccatcggtcagggccatttccactggtctgtcatccgtcccggcaaagcggaaaaaccggggaggtccccaatgctgagcggctgccgcatcccgtgccgcgtcccaggcattcgccagatcgcgcaccggaaccggcggcagggagggaggcatgcggtcggtcgcgtaatagtgtgcgcccgactcatcttccctgacgtggatacggcgatctttcattctatataaaccgggtttcagtccggctttttcgcaggagcacgggcgggaacagaggcagcttcggccatggaggcaatggctggagtggtgatcctgtcgccgacacggatgtcgtttttctcggtcgtgccggcggccagttccagcgtcgcacggaccgggccgttgctgtcgatcactgagagactgcgcggaaccgtgttctcggcaatggcgtggatcgtgccatcctcgttgatgaacaccatatcgagaggaaccagcgtattgcgcatccacatctggctgtttcgcggcgcgttccagtcgaacagcatgccgccatcggccgggactgatgtacgccacatcagaccgatggtctgctgatccaccgtgtgagcaacctcgactttaaagggcacggaccggccatcatgggtatgcacaatgagaggctcccgcttcatctccggctgtggctttgtatcatccagagcatgggcctgaggagcaaaaataatcagcgggctggcagccagcacactcagcaggaaacgacgcttcacgatccgggttctccgataacggcatgatctgagacggttctattctgtcagacgtttcgcgccaatgtccttggcccagtaatcctcattccgacgatcaggggacggatattgcggcccgctgcggacaggcccatctctgattaaggaaacagcccattgcggaaagagggcggatgaataacgcggacgatcttcacgtcatcagaacggcggttgcatggcaggaagagggtgcttcagtggcattggctacggtgatgcaaagctggggcagctcacccagaccaccgggcagtttgatggctgtggcggatgacggccgtattgcaggctctgtcagcggtggctgcgttgaggctgcggtggtggatgaggccatgacgacattcagcacgggtcgtctgcgtatggttgagtatggcgttacgcaggagagggcctgggaagtcgggctggcctgcggcggcaaggtccgcattctggtggagcctatacagcaggagcatgttcctctgctgtatgccattcgtgctgcatgtgaaccgggagaggaggggatttccttgatccgatcgctggcaacaggaacatggaagcttctcccggtggacgggcaggccggaccatccgtcgtgctgacggagcaggagtttacgcaatcatttcatcctccggcgcgtcttctgacggtgggggcggtccatgtcgcacagatactgacgggactggcgacaaaaatcggtttcgcctgcacggtgatcgatccgcgaccggccttgctgacagcagaacggtttccggatgccaatctgtgtgtggcatggccggatgaagcgatcgtcgcgatgaaacctgatgctcgaacggccgtgatcgttctgagccatgatcccaaacttgatgatcccgcgctgctggcggctttacggacgcaggcattttatatcggcgctttgggatcggcccgtacccactcggcacgattggcgcgattgcgggatgaaggcgtgaatgagtccgcactgggcagggttcgtggacctgccggactgcaattgggtggacggcgcgctacggacattgccctctctattctggctgaaatttcggctgtccgtcatggggctgcgcttgcgatacggcaggatgcggcatgaaattcggacgttttcctccgctggaggcaaccggtgcggtcctggcacatacgcatcgtttgccggatgcggtacttcggaaaggcaccgtactgacgtcggatcacattgctctgctgtgccgccatggggtgtcagagattgtctgcgcgcgactggaggttggcgatattccagagaatgaggccgctcgccgcattggtatcctgctggaagggaacggtctgaaagcaggcagggcagcaaccggacgcgtcaatctgcgtgcaaccgcctatggcctgatcgatattgaaccgattgtgatcgatcggctcaaccgcctgcatccaggtatgaccgttgcgactgtgcccgagcggcatgtgctgcgaccgcgggatattgcagccaccatcaagatcatcccctttgctgtaccggacgctgccttgcggcaggcggaaatccttctgcaaggcaggctgcccttacaactccatccgttccggatgctcagggtcggtctgattatcacgacgatgcccggcacgccgcagacattttacagtctggtagagaccgcaaccagacacaggattgaaagcctcggcggatgcctgctgccgcccgtgcaagtgccgcatgaagaaacggagatagcccgggctgtagaattgttgactgatgaagcggtggatgtgctgctcgtggctggtgcttcggcggtggtggatcgtgaggatgtcgcccctgctgccgtggttttggcgggcggggaggtggtgcatttcggaatgccggttgatcccggtaatctgctgtgcctgtgccggatcgggtcgatgccggtggtgatcatgcctggttgcgcccgcaagctggatctgaacggggtggatcatatcctgcatcggatttttgccggtctcggaactggcccggagcatataatggcgatgggtgtcggtggtctggtggggacagcctcgtccatccctgatctggatgagatgactccggaagactatcatcccatgcagatctcttccgccgttacaccccggattgctgtggtcattctggcggctggtttatcgcgaaggatgggcggtcggcataaactgttacagcccggaccggatggcagagccatgattactcatgtcgtcgatcaggcgctgcaaagccgggcttcggaggtcgtcgttgtgctgggtgatcatgcggaggaaatacggtccgctttggcgacccgcgatctgacaatcatggtggcagccgattacgcgcagggtctgtctgccagtttgcgggctggaatagcggccattgaggaaacggcggatgcagttctggtctgtcttggcgatatgcctttcgtgtcgcatagggtgatggaccggctgatggcggcattcgatcctatccatgccccgatcgtggcaccggtgtgggaaggacaacgtggtaatccggttctgtggggtgccagattttacagagatttaagtcgcttgagcggtgaccggggggcagcctctctgctggatcgctggcagcataggctctgccgcctttccatggaggatggagcctgtttgatcgacatcgacacgccggatgatctggtcagttggacagtatctgcagccatgtgatgctataagccttgcgttattgcgcggctgacaatacggtccgccccgaccggacatgttcatgacggccatggaatcagcggggcgtggcgcagcctggtagcgcgcctgttttgggtacaggaggtcgtgggttcgagtcccgccgccccgattctggatcatggcactgggaatgaggaatcgacgccaatgcgcgcgcgtatctatcagactccgaaatccgccatgcagtccggccgtgcccggagccatgtgtggatgctggtctacaccgctgagcagaagcgcacccccgatgccctgatgggctggattgggggcgccgaaacccagactcaggtgcgtctgcgctttcccacacgcgatgcggcgattgcctatgccgatgccaatggcatcgactatgagattgaaaccgcgcatggccgcaaggtcaggccaaagcagtattcggataatttcaggttcgggcgaatttataactggactcattgagtgtccgcgggcatcccgttcccgctgcgtctgcgcgcccttagctcagttggatagagcactcgccttctaagcgaggggtcgctggttcgaatccagcagggcgcgccaacttggctcattttgccgttcttggagaactatttgaccaccgattttcctcaatcgctgcacgaacgcgtcaccattgataagctttcacgttacgaacctaccgttcgagcagataacgcttgagcagatcctcaagccagtcagcaaaaatctgtaagcggcgagagagatgctgcctgtgcggatagagtaatgtcattggcatggggtcggcgcgatattccggcatgatctcgatcagttcgccagtatcgagatggcttcgcacgtcgtaagccggaatctggatcaggccgaggccggccagacagcacgcgatataggcttccgcgctgttcacggtgacgcgcccgcgcatgggtaaggtgtgcagggtgccgtcttccatccattcccaatcttcaacgcggccactggagggggatgcatagttgacagcccaatgctgcccgagatcgtccagcgcctgtggcattccatgtcgtgccagataagcagggcttgcaacattgatcagcgccaatctgccaattgggcgggcgatcagacccgaatcgctcaagggaccgacccggagcacacaatccagactgtcttccaccaggttcaccgcacgatcggtaaccccgaggtcaatattgatctgtgggtagagatcgagaaattccggaagcgccggcgcgatgatgaggcgaccgatccgaccgggcacatcgatgcgcagcctgcctgagggttgcgccgccatctgtcggaacagattttccgtgtcctcgacatccgcgatcactcgctgacaccgttggtagaaggctgccccgtcctgggtcggagcgaccttgcgggtggtgcgatgtagcagccgggcgccgacacgcccttccagttcctggactgccgccgagacggaggagcgaggcatgccgagtgtatccgccgcacgagtgaaactcgcacattcaaccacgcggctgaaaatacgaaacaggtcgattcgatccacaggtaggagagcctccattatgctgaaattctgacaagtcatgtcaaaatgatcgtctttatcgtccaataccagacgatatggtcccattgggaaagcggtcgttgttttggctgcgtactggcaaaggaaaccaccccatgaccgatcacagcatcaagggtaaaaccgtcatcatcgccggcggagcaaaaaacctgggtgggctgattgcccgcgatctggccgctcaaggcgcgaaagccatcgccatccactacaacagcgcggccacgaaagccgatgccgacgcgacggtggctgcgctcaaggccgccggagccgaagccgtcgccatccaggccgacctgaggacggcgggcgcggtcgagaccctgtttaacgatgccgtcgccgccatcggcaggcctgatatcgccatcaacacggtcggcaaggtcttgaagaagccgatcgtcgagatttccgaagccgaatatgacgagatgagcgcggtgaacgccaaaagcgccttcttcttcatcaaggaggccggcaagcacctcaacgacaacggcaagctcgtaacgctggtcacctcgctgctcggggccttcacgcccttctatgcgagctatgccggcaccaaggcgccggtcgaacatttcacgcgcgcagcctcgaaggagttcggcgagcgcgggatttcggtgatggccatcggacccggtccaatggacaccccgttcttctatggtcaggaaagcgccgatgcgcaggcctatcacaagaccgcggcggcgctctccgctttctcgaagaccggcctgaccgacatcgaggacatcgtcccctatatccgcttcctcgtctccgacggctggtggatgactggccagaccatcctcgtcaatggtggctatacgaccaagtaaatgtcgcgcggcggctgccgagagggtagccgccgtccttcgccgccaagctgttcatgccggtgtggcgcgccatgtaattatatgacttgccgttttcagactatgctccatcgcaagccggtcccgggatgcgttagggtcaggccatcctttatcttcaccagcgaggggagcagggttttgcaagcggatagtcctgaaaacaatatgcgtagcgaactgctcgacgatgtgtatgcatccggtgacctggcagtggcgttgcccaaatatgcatttccgcagcaagagcatgcaccgcgtcatgttttcgcgtcgatccgtgacgaactgatgctggatggcaattcgcggcagaatttggccacgttctgccaaacctgggtggatgacgaaatccatgagttgatgaacctgtcgatcgacaagaacatgatcgacaaggatgaatacccacagaccgccgagattgagaaccggtgtgtcgcgatgctggctgatttgtggcatgcgcctgatccgcgtggcacgatgggatgctcgacggtcggttcgtcagaagccgcgatgctgggcggtctggcgttgaaatggcgttggcgcaaggcacggcaggcggcggggcttcctgcagatcggcccaacctcatttgcggcccggtgcagatttgctggcataaattcgcccgctatttcgatgtcgagctgcgcgaaattccgctcgtgggcgaccgcttattgatgaatgtggaagaagtactgaagcgagtcgatgaaaataccatcggcgtggtccccactctgggtgtgacttttacctgtcagtatgaaccggtcagagagatcagcgatgcactggatcgattgcaggcggaaactggcctcgacatccccattcatgtggacggcgcgagtggtggtttcctggctcctttttgcgcctcggaccttgtctgggatttccaattaccccgtgtgaagtcgatcaacacatccggacataaattcggtcttgccccgctaggcgtcggctggatcatctggcgggaagccgcagatttgccggaagaactggttttcaacgtcaattatctcggtggagatatgccgagctttgcgctgaatttttcccgaccgggcgggcaggttgtctcccagtattataatttcctccggctggggcgggaaggatacacgaaaatccagtctgcctgttacgtcaccgcgcaatatctggcgaagcagatcgcccagatgggcccgttccacatcctgtatgatggagacccgtctaccggcattccggccctgtgctggacgttaaaggacgggaccggcatcggtggctacacgctctatgatctggcggatcggctacgcagccgcggctggcaggtgccagcttattccatgcccgccaatcgtgacgatctggtgatccagcgtattctggtacggcatggggtcggctttgatctggcgaccctgctgatcgaggatatcaggcgctcggtggatttcttcgcgaaacacccggtttcaagaccgatgacgctggaggaagctggcagcttcaaccataattgaccggtcgcgcagcactccctttgccaacggcatggcgatggcggtgcagatcagtgccatgacaatcagggcggagaaagcgtcatcatcgatcagatgtgcggtgcgcagcatgttgacgacgatgacctccatcagccccttggtctggagcagcgccccgagggccagaccaaagcgccaggactctccgccgatacgtcccatcacggtgacgcctgccatttttccgatgacggcagacagcacggctaccgtcagcacgatccagaattcggtggcatgcgggtcgatggaggtacgaagccctgtcagcatgaagaaaaacggcatcagcagagtgatgcaggtggactccagtcggaccagcagatcttcccgcagcgcgacgggcatcgtcgcacctgccataaaagcaccgagaatatattgtagccccagccattcggtcagcaatcctgaagccagcgcataggttccggccacggccataaggcggtcttcatgccccagcagccatggagaagcgcggcgtatcagtttcgacagcccgagaaaccagatcggaccgaccagcaggatcagcagaaaccggtgatcgcttccggctgcaagtaacaatgcgagcagaatccataatccggcatcattggcggcggcaatcctcagtgcgctttgaccgaggcgagaggaggagaggccattttcccgcaggattgccgccagaaccggcagggcggttacgccggcggaaattcctgtggcggcagccagcggaaaggaaaacccgcatgccagcccggcaatgccccccagcagggttggaaccagaatgctgcctgcgatcagtctgatcagcaatcctgactggccgcgtgaactgttgtcgcgcatgctgccgggggtgagatgtagtccggccacgaaaccgaacagaagtacggcgattgccgccagaccactaagtgcgccaaggctggtgctgttgaacagccaggcagaggcgtgaggaaaaaaacgtccgaacaggctggggccgagggcgataccggacaggatctgtaacaccgccagtggtacaatgcgttgcagtttcaggccgtgccatatcaggactggcccggccacaatgatcaggctttggatcagcagcagtgcaataggcgacatgagggaagtggtccggttgtcatctgtgcaggggatagtaagcgtttggcggaatgcttattgcagaaaaggattgcttttccgctctgcaccgaatgtcgagccgggtccatggccacagagaaaggccacctcatctcctaacggaagtagtttcgtgtggatggagttcagaagctcatcagtgttgccatagggaaagtcggtgcgcccgacagaaccctgaaacaggacgtcgccaacaatggcgaaatgcgcaggatgaatcagaacgatatggcccggtgtatggccggggcagtgcagaacctgaaacacatgcctgccgatggagagagtgtccccttcctccagccagcggtcggacgtggcatttttcatgcccggaatcccgtaggcggcggattggcgggcgatatcatccatcaggaactgatcacgccgatccggtccggaaaccggcacagccagacctgaacggtcctgaagagctgttttcagctcctcaacgccgcctgcgtgatcgagatgtccgtgcgtcagccagataccttcgaccagaacgccatgatggtcgatggccgccatgatggaggctacgtctccacctggatcaatcacgacaccccggttcgtttcctcatcccagagcaatgtgcagttctgctcgaagggggttaccggaataaccgccaggcgcagtccgggaggaggagaggggaaattctggctcatgttgctatggcacctgattgcgtacgggtgataggctgagcggataacgctggaacagtaaaaatatcatatggaataatcacccccgcctgagcggggtggaggtccgggcgggaatcgaacccacattcacggatttgcagtccgctgcatcaccactctgccaccggaccatcaagtattcagggcaggggctggcttatgtcctgtgctcctggcatggtcaagaggggtttctgcaaaaccggatgtatcatgatatgaaaccattccagaggtgtgacatgcaggccatggcgcttctacgttcgggcagctatcatgaggatgcaataacggtcacggatcgtcaccatggatagcgcagcccctgtttattccgccgctccgatggagtttcagccccctccgacagatgccagggcggtgatggtggatgggcagatacgtccgaaccgggtgaccgatccccgtattctgacggccatgcgccatctgccgcgggagcattttttgcccaggcatctggccgagttcgcctatattgatgacgacattcctctctccgatgaccgggtgatgctgaaaccgctgatcacggcccgcctgctgcaactggcggctcccgtggcgcaggaacgttgtctggtgatcggggcgggtactggttacggcaccgccattctggcgtcctgtgatgtttccgtggtggcgctggaagaagacgacacgttgcgtgccgtggcccagactgcgcttgggcgccatgccccggtggtcaatctgctttcagggaagctggaggctggatgcccggatcatgcgccatgggatctgattctgattgaaggtgccgtagcgtccattccggaggcgatcgtatcgcagttgcggaagaatggccgtttggtaaccgtgctgcgtccggacggcggtcccggcaaggctgtggttgtggagcagggaacatccgggcctgtctgggtggaatcattcgactgcatgacgcgcttgttaccgcaattccgggctgcccctgctttttcgttttgacatacgggatatctgcggtctccgatatcgtgcgcagaataaaagcagccgcataacgggcggtctgttaaggacaagggtctagagatgacgttgcgtagtgctttgatgctcggagtggtgatttttgaggggctggccgcttttgcaggcactgctcaggctcgcccgccggtgacgctcagggaggcccttgcggcggcttactctaccaatccaacgctgttggcggaacgggcgaagctgcgttcgactgatgaaaacgtgcctaccgccctgtctggctggcggcctacggtaacggtggcggcgcagccgggatatgggttcggtcagcttgctttcggtgcttttggtggttccctggatcagctgcgcaggcaggaacgtccattttataccgtacagggtactttcacccagccgatctatcagggcggcaaggtgacggcgcgcacccatcaggccgaggatacggttatggcggagcgggcaaggctgatcgataccgaacagaccgtgttcatgaacacgatcaatgccttcacctccgtggtgcagcagcagcagttgctggcgatcaatatcaataatgaatcggttctggcccggcagttgcaggcgacgaatgatcgcttcagagtgggtgaaatcacccgtaccgacgtggcgcaggcagaggcggcactggctcaggcccgtgccctgcggcagacatccgaaggcaatcttcagacggcgcgtgcaacctatcgccagcaggttggcgcattgcctgaagcactcgatgcgcctcagccgttgaaactccctgcaagggatcaggatgcggcgaccaagctcgcagccgtaaacaatccaaaagtcattgccgcattgtatgataatgcaaccgccaaggataacattgatgtccagtacgcggccttgatgcccactctggccttgcagacgaccgggttccagatggttggctcatcccagaaaggctatgagtccacaggtggcaccgttgctctggcagcgcagattccgatctatcaaggtggctctgaatatgcggccattcgtcaggcaaggcaggcggagcagcaatcccgcaagcaggtcgatgatgcgcgtcgcacagccgtgcagcaggctacctctgcgtggcagacattgattgctgctcgtgccgcaattcagagtcagcacgcgcaggtccgtgccaacgaaattgctgtggagggggttgagcgggaagcgctggttggcagccgcaccacttatgacgtcctgctgcaacagcagaacctgctgcaatccagaaccaatctggtgaacagcctcgcctcgttgattaacgcatcttatggcgtggcgcaggcggtcgggcagctgaatgccagagatctcaatctgcctgtgccactgtatgatgagacggcctattacagggccgtcagaaatcgctggtttggtgcgggtgatgaggcggttaatcagcccggtcggtaaaactgcggcagtttctctgccatcatatccggcgggcggaagggcaatggatcatgccgttccgcccgatctatatggagggctgatgaccattctcctgtcatgatggccggggccatctgctgagcacgtggaccggtttcccagcctgatttcatcgtgtatgaacgcgccatgctgagcaagaatttcgatcacgctgccaatgagcagcgtatttatgcgggctgggaacatgggggcgcttttgccgccaaccccgcctcatcggctacaccttttaccatcatgattcctccccccaacgtgacgggcagcctccatatggggcatgcgctgacgtttacgttgcaggattctctggtccgctggcggcgtatgcaggggcgggacgtattgtggcagcccggcaccgatcacgcggggattgcgacccagatggtggtagagcgtctgctggcgtccgaaggttcgccaggccggcgtgagataggccgggatgcctttctggatcgcgtctggcgctggaaagcggaaagcggcggcaatatcacccatcagcttcgtcgccttggtgcttcgctcgactgggggcgggagcgtttcaccatggatgagggactttccgccgccgtacgggatgtcttcgtgacgctgtaccggcagggtctgatctatcgtgatcgccggctggtgaactgggatccccagcttcagaccgctatttccgatctggaagtggaaagccgggaggtgcggggcaatctctggcatatccgctatccgttggaggatggggagggcagtatcatcgttgccaccacccgcccggaaacgatgctcggtgacagcgccgttgccgtccatccggaggatgagcgttacacggccttgatcgggaaatgtgtgatcctgccgctgaccggtcgccgtatcccgattgttgcggatacgtattctgatccggaaaagggcacaggggcggtgaaaatcaccccggcgcatgatttcaacgactttgccgtcggtcgccgtcacgatctgccgatgccgtccatcatggatcgcgaggggcgcatcacgctggccgagattacctgtaccgaggcgacagatatagccgatccggcttttgtcaccgggcttgaggggcaggagcggtttgccgcccgcaaggcgattgtggcacgtctggaggagatgggtttcctcgaaacgatcgagacacatacccatcatgttccccatggtgatcgctctggtgtgccgatcgagcctctgctgaccacgcaatggttctgtaatgctgccgagctggcaaagccggctgtggctgcggtggagtctggtgatactcgtttcgtccccaagcagtgggaaaacacattcttcgcctggctgcgggacattcagccctggtgcatcagccgtcagctctggtgggggcaccggataccggcctggtatgcgcctgatggcagcgtctatgtggcagcaaccgctgaggaagcgcaggccgcctatgggggcagcgagaccctgacgcaggacgaggacgtgctggatacgtggttctcctccgccctgtggcccttcagtacgctgggctggccggaggatgactcgatcctctcccgctattatcccacggatgtgctgatcaccggctttgacatcattttcttctgggttgcccggatgatgatgatggggctgcacatacagaaacaggtgccgttccgcgacgtctatattcatggtctggtccgtgatgagcgtggccagaaaatgagtaaatccaaggggaacgtgatcgatcctctggcattgatcgaagcgcatggtgccgatccgatgcgttttgccatctgcctgctggctgggccggggcgcgatatcaagcttggtccgaagcgggtggaagatgccagccgcttcgtcaccaagctttggaatgcgtccgtgttctgtgagcggaacggtgtgaagccggagccgggcttcgatcccgcgactgtcacgttacctttgtcgcggtggattctggccagcgcggatgatgccatccgggcggcgacgcaggcgctggaagcgtatcgtttcgacgactatgccgccacctgctaccgcttcgtctggaacactttctgcgactggttcgtcgaactggcgaagccgattctgttggccactgataccccggaagcggctgagatcaaggctgttgccgcccatgtgctgggggtggtgctgcgtctgctgcatcccgccatgccttatgtgaccgaaacgctgtgggaccattttggctacgggccggaattcagcctgatccgtgcgccatggccggaggtcggcgtcagcgatccggcgcgggaggccgcccgtcaggagatcgactggctggtacgcctgatcggggaggttcgcaccgtccgtaacgagatgaacgtgccgccttcaaccctgaccccgatcctcctgaaagatgcggtggcggagaccgtggcgcgggcggaacggtggcgcgatcagattgcccggctggcccgtgcttcgtccgtgacatcgctggagggtgccttgccgaagggcagtgcccaggccgtgctggatgaagccattctcgtcattcctctggagggggtgatcgatctggatgccgagcggacacgtctgacgcgggagcgcgacaaggcgcgggatgaagccgcgaaagtagtccgcaagcttgagaatgccgatttcgttgcccgtgcgaagccggaggtcgtggaagaaaaccgcgaccggctggcagcgctggaggccgatatcgcgcgtctcggtgccgctttggaacggctttagaagcctttttcgtgcctttctctgcctgtctgtcggcaaagcggacaggcaggcggccggaaagaaatgaagttcggtcagaaaaagccgaatttgcctgtgatgatgctttcacgtcgggccgccacgctttaggttcgccccgccggtggatggaacagacatgacggaacagccagtttataaacgtgttctcctgaaagtgtcgggggaggcgctgatgggcagccgcgaatacgggctggacaaggcgatggtgcagaccattgccagcgacattgccgatgttgtggcattcggcgttgaagtttgtctggtgattgggggtggcaatattttccgtggcgtttctgccgcagccagcggtatggaccgtgcgcagggcgattatatcggtatgctggcgaccgttatgaatgcgctggctatgcaggcggcgctggaaaagctgaatgtgcccacccgggttcagtcggccattccaatggccagcgtctgtgagccttatgtccgccgtcgtgcacagcggcatatggagaaaggccgcgtcgtgattttcgctgccggaaccggtaatccgtttttcaccaccgatacggccgcggctctgcgggctgccgaaatgggctgcaacgtcctgctgaaaggaacgcaggtcgatggtgtctatgctgccgatccgcgtaaaaacccggatgccgagagatataacgaactgacctatctggatgtgttgagccgtgacctgtctgtgatggacgctgcggcgatcagtctctgccgcgaaaatcatctgccgatcatcgtgttcaatatccacgaaaccggggctttcggacgtgtcatccgcggcgaaggccgtttcacgcggatcgtggaaactcagtaagaccaactaccggctccatcgcctgatttttggctggtcatgccggtcggaaacaggcccagaatgaaagaggaagcgaccatggccgccgatctcaatacgctgaagcaggatctgacccgccgtatggatggggcgctggaaacgctgcgtcgtgaatttgccgggcttcgcgccggtcgtgccagcccggccctgctggagccggtgcgggtcgatgcttatggcagcgaggttccgctgacacaggtcggcaatatcggcgtaccggaaagccggatgctgacggtacaggtctgggaccggtctctggtcagcgcggttgaaaaggcgatccgtgattgcgggctgggtctcaatccgcagactgagggccagctgatccgcgtgccgctgcctatgttgacggaagagcgtcgtaacgagctggcaaaagctgccgggcgttatgccgagagtacccgtgttgcgatccgcgctgtgcgtcgggatggcatggatcagatcaagggccacgaaaaaaagagcgagatcggcgaggatgaggctaaaacatggtccgatgaggtccagaagctgaccgatcattacatcaagcgtgtggatgacgcgttggtcgaaaaagaaaaagacattcggcaggtctgatgggtctgtttcagggcatccttcattgatcttccagaaaaaaaccgctcatgcgcctgatctcgcgcctgcctccacgatggagacaggcgtgttgtcgaatggtgctgcgcccttaccggtgcatattggcatcattatggacggaaatggccgttgggctgctgcccgtggcctgccgcgcattgccggtcatcgtgcgggtgcgcaggctgtgcgccgcgtggtgcaggccgcgattgaggcccgcatcggctggctgacgctctatgcgttttccagcgagaactggcggcgtccggcgggggaggtcaccgatctgaccgggctgctgcgtcattatattcgcagcgaaattaacgaattggcggaaaacggggttcgcctgcacattattggggaccgttcccggttttcgcaggatattcagaacgatctggcgcaggcggaaagacggacggctggtaataccgtccttcatctggtgatcgcgctgtcttatggtgcccgggcggagattatcaatgccgtacgcagcgcggcaaaggctttggcggcaggtcatatggtgccggaagcgctcgatgaggcgctgttttcttcttttctttccacggcaggcatgcccgatcctgatctgatcatccggaccagcggggaaaggcggctgtccaatttcctgctctggcaggcagcctatgccgagctggtgttcatggatgtgctgtggccggattttgcgtccgtgcattttcagcaggccttggccgagtttggtcgacgcgaaaggcgcttcggtgcccgtccgctatgatcaccagcaccatatgagcgatgggggaacaagatgaccggacgggcgatgaatgcggcctcatcgtcgtctggaaaatggcgggatctgcgcctgcgtttgctgtcggcggctgttatggccccgcttgcattggcctgcctgtatgaaggcagattgttctgggcagtcctgatgggtatcgctgcgctcggtatctctgttgagtgggtccggctctgcggggctaaggagcgagcatggccgggcagtggtgttcccctgttcactttgctgggtggaggaatcgccgttgcccatcatgtcataaccggtctgattgttctgctgataggtggggctttgattgtgtggctgggcagggcggcacggcatccgctcacgcttggggcgggagtgccttatttgggggcctgtctcctgaccctgatctggctgcgctatgacccggtggtgggaagagcgaatgttctttttctggtcatcagcgtctgggccagcgatatcggagcctatcttgcgggacgtctgatcggggggccaaagcttgctccctccatatcgcccggcaagacatggagcggtgctgtcggtggtgttgttgctgcgatggggacggggctggccattgcaccggtgctgcattccggtcctgctatcggcgcgctttgggtcgcctgtctgattgcggtggtgtctcagggtggtgatctgctggagagcggcttgaaacgccgttttggagtcaaagattccggaacactgattccgggtcatggtggtcttctggaccgtctggatgggttgctgacggcggcgccagtggtggctgtgctggcggcgttgttggggcgaggagtggcggtgtggcaataaccagacgggcagtggttccaggtctgaaagatcgggtcgatgatgcggcacggccgcgcacgatcaccattctcggcagtaccggcagcatcggaacacagaccattgagttgctgggtgatcgtagccgctatcaggtgaaagcgctggtgggcggaaaaaatgccgctttgctggcggatcaggcgctggcgctgggggcagagctggcagtgatcgccgatccggacttctatccggtgctgaaggaacgtctggcagatagcggtattgccagtgcctgcggtcctgatgcggtggtcgcggccgctgcgctggaggctgactggaccatggcggcgatcaccggtgctgccggattgccaccgaccctggaggccatcaagcatggccggagcgttgctctggccaataaggaggctctggtctgtgcaggcgatgtgatgttgcgtgcggtcgaacaggccggagcaaccctgctgccggttgattccgagcataatgctatttttcaggcgttggctgatggtaacatcacacgactggacaagatcgtattaaccgcctctggtgggcctttccggaccgcgagcctggaggagatgaaagcagccacaccggaacgagccttgaaacatccggtctggtcgatgggggccaaaatctccatcgacagcgcgaccatgatgaataaaggcctggaagttattgaagctgcaagattattttctttgactgaagatcgtattagtgtgcttgtccatcctcaatcggtggtgcatgggctggtctattatcaggatggcagcgttctggcgcagcttggatcaccggatatgcggataccgatcgcccatacgcttgcatggccggagcgggtagaaacacaggcgcggcgccttgatctggcagccgtgtcgcgcctcgatttcgaggagcctgatgtggtccggtttcccgctctgcgtctggcccgcgaagttctgcgtgccgggggaggtgctccggcgatctactcggctgccaatgagatcgcagtggatgcatttttgaataaacgtattggcttcctggatattgctgagacagtggataaaacacttcagcatctgggcgcccctgccgtggaaacgctggaaacagtgttcgcggttgatgcggaagcccgccgggttgccgcatccttgacgcagtcctgcgccgcctgagacgaaaaagaggcttttatgctgcctgaaaccatccgcactgtcctgtctttcgtcgtcgttctgggcgtgctcgtgttcgtgcacgagatgggccattatctggccgcccggatcagcggtatttatattgaagcgttctcgatcggcttcggtaagccattggtgaaatggcgggatcggcgtggctgtgagtggcggctgtgctggctgccgctgggtggatacgtgaagatgtacggcatggaacgtccgggcgacaatccgggcgcagatcagccggtcaataccggctcgccacctgtgcagccgcctcggcccggtatggctttttttgaaaaatcagttggttcgcgggcatttgtggtggcggctggacccctggccaatgccctgttggcgattgtgctgtttgcggcgctgttcatgacggcaggacggcagattcctttgccggtcgtgggggaagtgctgcctcaatccgctgcagccgaggcgggacttcagcatgatgaccgtatcgttgctattgacggtatgcaggtcagccggttcgaggatatccagcattctgtggtggggcacccgaaccagcgtctggttctgagcgtcgaacggggcgggaaggaaatcaccattccggtgacgccgcatgccaaggtggcggacggcctcacgattggcgttctggggatcggtgccggtgccgtgactgtggaacgcatggcgcctggacaggccattgttcagggtgtggcgcagacatggacggaaaccggaaatatcctctccggcgtctggcagatgatgactggtcagcgcagcgcgaaagagctgggcggcccgctggcgatcgcgcgtatttccgggcaggtggcgcaattggggatccccagcctgatttccctgatggcactgctgtcgatcaatcttggtctgatcaatcttttcccgatccccattctggatggcgggcacctcgtctttttcctgatcgaggcgatccgggggcggccgatgtcgccccatgcgcaggaatacgggcttaaggccggattcctgctgctggcgaccctgttcatctttgtgacatggaatgatctggcacggatgggtttgtttcactggttttcccatctgatcggttgaaggtatggagagcgttctctcaaagacgcagttgatgcggaatattccgaatgtgcaaagtgtgaaggaagtcgctatggcgtgttgcgctgcactgaggtagctaggccagctgatggttcggcggcctgtgttccgaccgtgctgatttatctgtatggttgccctgtctgcggcaactcgttcgagggggtacgccttgagattgaatcgtgctgcgttgctcgccacgacctgcctgctgccgatggcgctggatcgcgtcgcgatggcgcagactggccgtaattcatcaggagccgtgccaccccatgcaggaggaaagcggcaggcttctgcagttaaagccgcctcccgttccggtttgattgaaacgatccagatagatggcaatcaccggatcgagaccggcacgattctgtcctatatggccgtgcagcccggtgacccgttcgatccggagcgaatcgatcacagccttaagaccctgtatgccaccggtctattttctgacgtgaagctggaccgccaaggcaatacgctggttgtgaaacttgtcgagaatccaattatcaacagggtcgcttttgagggaaatcacaagctgacggatgagcagctgcgcaagatcgtgcagcttcgtcagcgtgccgtgttcacaccgcttcaggctcaggccgatcgtcaggccattttggccgcctatgcggggagtggacggtttgcggcctcggtggagccgaagattgtgcggctgcctgataatcgtgtggatgtgatttatgaaatcacagaaggtgacgccacactgatcagccgtatcgcctttgtgggcaacaaggcttttagtgaaggccgcctgcgggaagttgtggacagccgtgaaacacgctggtggaggttcctgtccagttccgacacctataatccggagcggatcaactacgataaagaactgcttcgtcgcttctacctccagaacggctatgtcgatttcaaggtacgcgacgcccatgcggagctgtcccaggatcgcaaatcctttttcatcacctatgtcctggatgaaggggaacgctacaaggtcggcaagattacggttgaatcgaagctgcgccatgtaaaaggcgatacgctgctgggtgatatctccctgcgaagccatcactggtatgacggcgatgccgtggagcagtcggttcaggccatcagcgatgatgtgcagaaccgtggatatgccttcgttcaggtcaagccgcgcatcctgcgtcatcctgagacccatatcgttgatctggtgtttgacgtgaccgaagggccgcgtgtctatgttgaacggatcgatatcagcggtaatacgcgcaccaaggacaaggtcattcgtcgtgaattccgccttgcggaaggcgatgcctacaatgccgcgaatgttcgccgcagccgtgccaggcttgaaaatcttggttacttcaactcggttgatatctcccagtctcccgggagtacggcggacagggtcgtgctgaacggacgtgtgtcggagaaatccacgggtgaactgacccttggcggcggcttctcgaccacggccggtgcattgctgaacgtgggtctgcgcgagcgcaactttatcggttcaggcattgatgcgggtatcagcggcgtcatcgcgcaggcgcagagccaggccaatttgaacgtaaccgatccatatttcctggatcgtaatctggtcgcgggggttgatctttatcatacctctcttgataaccggtacaccggtatcgctttgtatagcgagcgcaggaccggtgcttcggctcgtatggggtatgcgttcaacgaacatctgcgccaaagctgggattactcgatcaccacccgctccgtttataacgtagcgaccaatgcgagtattttcattcgcgatcaggttggatcatctctgctgtcgcagatcggacagactttcacgattgactatcgcgatagtgtggtgaacccgcataccggtttcgtcgtgcggtttggccttgattatgccggtatcggcggtggcgtgaattatgtccgtggcaagctggatggcagctattacatcccgctggattatttctccggcaatcacctttgggggatcgctctgacggccggggcgggatatctctattctccggatgataatgaacgcatcattgaccacttcttcatgggcggcgccaatctccgcggctttatgtcggggggtgccggtccgcatgactcggtctcccgcgatagccttggtggtcgtttgctggtgacccagtctacagagctacgcttcccgctcccgatttctgccgatctcggcctgtccggtcgcgctttcgtcgatatcggcagtctgacacaggcggccaacaagcgcactgctgctgcgttggcctccatgggcggcactcccggcgagttgaacgatgatggcatcatccgtgtgggtgccggtgtcggggtgtcctggcaaacgcctttcggccttatcaatcttgacgtggcggccccagtgtctaagggaccctacgatcagacccagattttccgcttcggtttcggcacgaggttctagtgcaaacaaaacgtcaaacactcgcctctgccttgttggctgcggcgattatcctgccttccgctccggttctggcgcagggctattttataccgggacagcagaaaggggccgcagccggacccgggcctcgtgcccgtcccgctgcccctcctgtacaggctccccctccctctgacgagatggccgggcagccgcaggagcagggtgaacctcctctgccgcagatcccgctgccgccggtgccggagcttcccaagctgacaaagggcgctcagccccccgccgcgattgtcggtgtgcttggtgtcccggaagtcatgcgtggctcgaccgctgcccagcaggtggagcgggtgatcggtgggcgccgcaatgaactggcggctgatgcccagaaagaacagcaggtgtggcgacagatgcagcagcagatccaggcggatcgaggcaagctgtcggtcgatcagctgcgcaaccgtgagcgtgcgttgcaggaacgtgtgcaggaagcccagcggaaattccgtgaccgcaaccgcaccattcagttggctgcacaggtttcacttggccagatcgagcgcactctgattgcggtcatccgtcaggtggcagaaagccggaacatgaatctggttctgcaccgtgcgcaggtggcgttgaatgtgaatgagttcgatatcaccaaggaggtgatcgaccagctgaacaagattctgccggaagtgatcatcccgccgccgggtaaggtaccgacggaggaagacgcgaagctgccgaagagcgttctggatgcagctgtgaaggtgaatgcggctgatccgtctgagccggcgaagcagaccgatcaggctgcgcctgcatcggcccagccttccgccaagcctccggcaaagaagtaaagaatatcatgagcgtgcaggaagttgtcggcgatccgcgattttttgcgcggagcggtccgtatgacgtcgcagcagtggctgaggcagtgggtgcgtctatcccggctgactgcacgctatccctgacgggcgtggctccgcttcagattgcggggccttccgaagtcagttttctggataaccggcgctatgccgatgcgctggagcagactcgtgccggggccgtgatcatcaaggcggatatggttgatcgggtacctgccggcgtgattgctctggtggtaccggagccttatctggcatgggcccgtgttgcagccctgttttatcctctgccgccggtgcagccaggtattcatccctccgccgtcgtggatgaaaccgcgtgcattgatccctctgcccagatcgggccgctcgcggtgatcgaagcaggggtggagatcggcccggattgccgtattgccgcgcatgcggtgatcggggcaggcgtcaagatgggacgtagttgccgcatcggctcccatgccagcctcagccatgccattctgggtgatcgggtctatgtttatcccggggtgcggatcgggcaggacgggttcggttttgcaccgtcctcggaaggcttcgtcactgtcccgcagcttggccgggtggtgctggagaacgatgtggaggttggtgcgaacagcaccatcgaccgtggttccatgcatgacaccgtgatcggtgccgggtcacgcctcgataatctggtgatgattgcccataacgtccgaatggggcgggcctgcgtaatcgtctcccaggttggtatctccggctcgacgactttgggtgatcatgtggttctggcagggcaggctggactgatcggccatttgaagatcggctccggtgcgcgtatcggtgcgcaggccggggtgatggcggatgtcccggcaggggccgagatcgtgggatctccggctcagccggcaaaggatttcttccgccagattgcgacgttacggcggcttgcccgcagataaggcacatagacgtgccagggaattgaggctgatggaccagagcgtaccttccgagaaccagccggaaaccggcgaaggccggactattatcgacattgcgggtatcatgaagatgatcccgcatcgttacccgtttcttttggttgatcgggtgatcgacatcgtccggggcgagcgtggcatcggcatcaagaatgtcacagccagcgaaagtcattttgccgggcacttccccaatcatccggtgatgccaggggtgctgatcatcgagagcatggcgcagacggcagcggtgttggtggtcgatgccctggggacggatgctgaagggcgcgtagtgtatttcatgtccatcgagggcgcgaaattccgccgcccggtggtgccgggggaccaactgcgtattgagtgcgaacgcttgcagcatcgtggcaatgtctggaaattccgcggcacagcccgtgtggatgggcagatcgttgcagaggccagtttcgcagccatgatcctgcggccttctcctgcccagcaggctgaggcatgatgaatccagtgaccgagttgaagcccgccacgatccaccccactgcgatcatatccccctcggccaaaatcggggcaggggtgagcatcggaccattctgcgccgtgggaccggatgtagagctgtcggatggtgtgacccttgtctcccatgtggttgtggatggtcatacggtgatcggggagggggcaacgctctggccgttctgctctgtcggtctggctcctcaggatctgaaataccgtggagagccgacccgtaccgaaatcggtgctcgcacccagattcgtgaacattgcaccattcaccgtggcacggtcacgggcaccggtcttaccaaagtcggctccgactgcctgctgatggcagtggcgcatgtcgcacatgattgcgaggtcggtaacaacgtcatcatcgccaataatgtggttatgggcgggcatgtgaccattggtgaccatgctggcattatgggggcagcggcgatccatcagttcgtccgcatcggtcgctgcgcctgggtgggtggtgtttccggcgttgagcgtgacgtgatcccgtttggcatggtgatgggtaatcgcgcatggctggccgggctgaatatcgtcggtctgaagcgccggggctatgatcgctccgaaattcaccgtctgcgcgcggcgtttcgcatcctgtatcgtgatacctcagtcgatgacggggtgtttcaggagcgcgtgcagcgtgttgccgcggaatacggcgaggatcgtctgatcgcggagatgctggcatttattgcggctcccagccatcgtggtctgattcgcaatggcgtgcgtgatgacggggctgaaccagcctgatccagccttgcccatgttgctgaggctggtcttgaaggaggtctcatggctggctctttcgtgccggatatgaagatggcattggatgcgccgccggcactcggcatcattgctggcagtggcgatctgccgggtcgcgtcgccgctgctgcgatgcgtgccggtcgggatgttttcatcatcgctgtggaaggccatgccgagcctgaggtggttgggccttatcctcatgcttttgttcgtgtgggagcggcaggacgtattctggctctgttgaaacaggctggatgccgcgatctggtgctggttggaccggtcaagcgtccttctatcctgcagttgcgtccggatgcggaaggggcacgcattctgacacggattggcaaggctgcctttgccggggatgatggcttgctggcggctgtggtgagggtgctggccgaagaaggctttcaggtcatcggtgcccacgatgtgttgactgatattgtcggtccggctggtgtgatgaccagagtggttccggataaaaccgcacagcttgatattacccgtggaatcgcggtggtgcaggcgcttggggcggtggatgtcggacagggctgcgtcgtgcagcaggggattgctctggcggtcgaggccattgaaggcacggatgcgatgctggcccgcagcgcgacggttgcccggccgggaccgggtggtgttctgatcaagctggtcaaacccggtcaggatcgcagggccgatctgccgaccctcggcccgcgcacggtacgggcagccactgaggccgggctgcgcggcattgcgttcgaggcagggggcacgatcctgactgcccaggcggagatggtgcgtctggcggatgaaggtggtctttttctgatcggaatcgatcctgctgcgtttaaaccggacattgcctgaacaggagacgctcatgctgaagggccgcatgcttcacacgatggtccgtgtgcgcaatctggatgccagcgttcgtttttatacggacttgctggggatgagggttttgcgccgcagtgagaatgaagccggacgctacactctggttttcgtgggatatggggcgacgccggatgatggcagtctggagttgacctataattggggtcaggatgaaggctacgatctcggcacggggtatggtcacatcgccatcggtgttccggatgtggcggctgcgtgtgaggcgatccgccagggtggaggccgtgtcacgcgggaggccggaccggtgaaaggcggcacgaccgtgattgcgtttgtcgaagaccctgacggctataaaatcgaactgatcgagcggtcctgaccggaatagtcggtatggcgctgtccggtttcaggcttccgggctgggacgatattgccggtccggctctgggtggtacatcggtggtacggatcggcgtcactggattggcccgttccggcaagactgcctttctgacgtcggtggcggccaatcttctggcgcaaggggccggccttgccgcgctgcccgctttgcagactgcactgcaaggccgtactctgaatgtggctatcgccccatccggcacggacagcatccccagatttgattacgccgcccatatggcgtctcttgcgatggacccgcctgcatggccggatcggaccgatactgtttccatgctcgcgcttgatctgacgatcagtcgctccggtcttgcctcgatgttgccggagcgtcgtatccgcctcgaatgtctcgattatccgggcgagtggctgctggatctgccgatgctggcgcaggattacgaggaatggtccggcgcggtgctgacgcgtctggaagggcaggcagaggccgccggatttctgggcttcgtcaaggcgctgccggtctcggcttctgccgatgaggcgattgcggaggagggtgcgcgtctgtatcgcgccatgctccatcgcctgcgggagcagggtctgacctttcttcagccggggcggatgttgatgcctccgccgggattggagccgccatggatgggattttttcccagccttgcccgtggcgggctgggtggactgctgagcgggcgttacgaccgttatcgtcaggcaatcagggatgaactgatggcgccttccttcggtcatgtagatcggctggtggtgatggctgatctgctatcggcactccatgccggaccggatgcttatgcggatgcggcttctgcactgggcgcggtggcttcggcgttacgctggcgcggtagctgggctgattccattccgttgctgcgtgaggccggacgatttttgccggaatggctccgctcggccctgttgcccggcgcgatcgcacgggctgcgttcgtcgccagcaaggcggatcacgtcgcggagcgtcagcgcggtaatctggcggcgctgatgggcttgctgacggatagcgttccggagcgcttccggcaggaaacggcgcgtggagggcgcacacgtgccttcgccatggcctcggtccgttgcacggaagatttcgtgtggacgctggatggccatcctgtctctgccgtgcgcgggcggctgaacggcagtgatcgcatcactcggtcctatccgggcgaggtgcctgaccggccgcctgagccatcattctgggcgcaccgttttctcgctcccccggattttgagccgatgcgtctgccggcgggtgggcgggccggcattccgcatcttggtctcgatacactcctcgcatggctgctggaggatgtgctgtgagtgatccggtcacgccccgtcccattattgccccacgtgtggaaacagagggtgagtctcctgcatctgccccttcctctgcgcgactgaaggagccggtcttcgcggagcctgaaaccccacccttcatcgcaccgcgtgtggagacagatcaccttcccgccgagcgtctggaacaggcattgccgtccattccgctcaatcccggccctgctctcggcacgctgacgttgatggcgtccggagcagggctgctgggagtggggtttgcggccctgctggcggtcggtttcgtgatggatcagttcgcacgcagtgcatggctgggtggaatcagtcttgcggtttcgctcgccggtttcggtctgctgggggctgggttctggcgggagacacgcggattattggctctgaaggcagttgatcaggaacgggcggccattcttggcaatgatgttgatgccgcgcggaaagcagcacgccgttggtcgcgccatgcgcgtcatggggcggacgttctgcctgccatcgaggaagcgaagtcttctgccgcgattgcctccctgctgcgggcaggcccggtcgcggcgttgcgagaggagagcgatgcgctggcccgtgccgcggcggtgcaggtgttcagtgccacggccgcgattccgtcgcctgcgctggacggtttttttgtggcctggcgtggcgtgcggctggtgcgtcaggtggcggcattgcatgggatgcggcccggcctgctcggtacgttggccctgttgcggcgggtgacgctttcagcggcagcggtggtgacgacggatgtggcactgaatgcggccttgcaggcgctgggaacccatccattgttgcgccacgttgcgggcgatatggcgggtgccggagtcgcagcccggcgtatgctggtgctggcgcgggttacggcggcggcgtgcgatccgacgcagcgtgagaaataggcggcaacgcgtccagcgctgattgcaacatcacggcagcggccattttatccactacggcagcccttctcttgcggccaagatcggcggaactgatcagaagctgatgtacccggctgctggtttcccgttcatcccacaaagcggccggcaggccggtcgcatcagaaagtgcaattgcccaatcccgcgccgcctgagccgccggcccgaagctgccatccatcgacaaaggcaggccgataatcatgcctccggcttcttccttgcgggcgatcgcggcgatttcctctgcattgacgcggagcttgccgcgtctgattgaaccgtatgggctggcgatccccagcaggacgtcggacagcgcgatgccgataatccggctgccgggatcgattccgagcagcctttgattgcgggagagtcggctttgcagatcgggcacgttgaacagggacatgcgcaccgttatggtccgctgcttctgggaagaacagggtttcgatcaaatggcattggacaccggcgtcgtccggcgcatcgcccggctggcacgcattcatgtggatgaggctgatctgggtgcgctgcaaggtgaattgaacgcgattcttggttgggtcgaccaactggaagcggtggatgtcagtgcggtggatggaatcgcgccgatgaccggcccggcggatatacaggcggatggcgagaccagcctggccgttgcgccgatgagggatgatgtggtgacggaaggcgatctgtcggacaaggttctggccaatgcgccggaccgtgccggaccgttttttgccgtgccgaaggtggtggaataatgagcgcgctgaccgatctgaccattgcggaggcccgggacgggctgcgcgcaaagcgtttttcagcgcgggagctgaccgatgcgcatctcggcgcgatcgaggctctcaatccgcgtctgaatgcctatatcaccgtgacgccggatcaggcgcgcgcacaggccgctgctgccgaccgcgttcttgcctccggtgaggcaggggcgctgacaggtattccggtcgccagcaaggatatgttctgctccgagggcatccgcaccacggcaggcagtcgcattctggaaaatttcgtgccgccttacgaaagcgcggtgacggagcggatgctgcgtgacggggccgtgatcctcggcaaggccaatctggatgaattcgcgatggggtctgccaacctgacctctgcttatggtccggtggaaaatccgtggaaacgccacgacgatgatgcggtgctggtgccgggtggttcttccggcggttccgcggcggctgtggccgcgcatctggcgctgggggcaaccgggaccgatacgggtggctcaatccgtcagccggccagctattgcggtattgccgggatcaagccgacctatgggcggtgcagccgctgggggattgtggcctacgcatcctcgctggatcaagccggtccgtttgcgcgcacagtgagggataatgcgatcctgctgcgttccatggccggacatgatccgcgtgacagcaccagcgccatgcgtgaggtgccggatttcgaggccgcctgtcagcgtggcgtcaaaggactgcggatcggcctgccgcgcgaatatgtcgctgatggcatgagcgaggaaatccgcacgctttggcagaatggtgccgccatgcttcgtgccgccggggccgaggtggtggatgtcagcctgccgcatacaaagcatgctctggcttcctactacatcatcgcaccggcggaggcgtcctcgaacctcgcgcgttatgacggtgtgcggttcggccatcgctccagcgataacagggatctgaacgatctctatgagcgcagccgggctgaaggatttggtgccgaagtgaagcgccgcatcatggtcggcacatatgtgctctcggccggctattacgacgcttattatctgaaagcgcagaaggtgcgtgctctgatcgcccgcgatttcgcggaggctttccgctcggtcgatgcgctgctgaccccgaccgccccgagcgcggctttcgcgcagggcgagactatcgacgacccggtggcgatgtatctgaacgacgtcttcaccgtgccgatcaatctggccggtctgcccgccatgtccattcctgccgggttgagcacaaccgggttgccgctcggtttgcagatcatcgggcgggctttcgatgaggaaacggtctttgccgtctcggccgcgctggaacaggcggctgccttcactcatcgccccgctttgcgcgccgatactctgaatgctggagcctgaaacgagatgagctacacgattgagggcgcaaccggcgcatgggaactggtgatcgggctggaggttcatgcccaggtcatcagccagtccaagctcttcagcggcgcggcaacggcgttcggtgcggagccgaactcccaggtcagtctggtggatgccgctctgcccggtatgctgcctgtgctgaacagggaatgtgtcgcgcaggcggtccgcaccgggctgggcctgaaggcgcatatcaatccggtcagccgtttcgaccggaagaactatttctatgccgatctgccacagggttatcagatcagccagtttgcacatccgattgtcggctctggcacgatcgagatcgaattgcaggacggctccacgcgccagatcggggtaacccggctgcatctggagcaggatgccggtaaatccctgcatgatcaggatccgacccgcagcttcatcgacctgaaccgctcgggcgttgcgctgatggagatcgtcagcgagccggatatgcgcagcccggaggaggctggcgcctatctgcgtaaattgcggacgatcctgcgttacctcggcacctgtgacggcaatatggaggaaggctccatgcgtgccgacgtgaacgtgtcggtgcggcgtgccggagagccattccgcacacgctgcgaaatcaagaacgtcaactcgatccgctatgtgatgcaggcgatcgaggctgaggcgaagcgccagatcgcgatttgggaagaaggggaggaggtcgatcaggaaacacgcctgttcgatccgtcacgcggcgagacccggtccatgcgcagcaaggaagacgcgcatgattaccgctatttccccgatcccgatctgctgccgttggttctggatgaggactggatcgaggggctgaaagcgtccctgccggagcttccggatgaaaaaagcgcgcgcttcgtctccgaatacgggctgacccggtatgatgcgggcgtgctggtggcggaacaggccagcgcccatttcttcgagactgtggcaaaggggcgtgatgcccgtctggcggcgaattacatcactggcgatctgttcgccgtgctgaatcgcaccgggcgcagcattaccgacagcccgatttcagcggaggcgctgggcggtctgctcgatctgctggccgacaacaccatcaatggccgtatcgccaaggaagtgttcgaggccatggccgaaaccggagagcatccggcggatattgtcgaagcccgtgggctgcgtcaggtgactgataccggagcgatcgatacggcggtggcgcaggttctggaggccaatcccgacaagctggcggaatatcgctccggcaaggacaagctgttcggcttcttcgtcggtcaggtgatgaaggccatgcagggcaaaggcaatcccgctctggtcaacgaggcgttgaaaaaggcgctcggctgaacagggatatcagagtccggatacaaaaagggccggtcatgagaccggcccttttccgtctggcgatgcctgatcgcgctcagcccagctgggcttcagcgaattcgtaattggccagcttgtccagatagttctggacgtagtccgggcggcggttgcggaaatcgacgtagtagctgtgctcccacacatccagcgccagcagaaccttgccttcatcggtcgcgaccgggtttacgccgttcgggcttttggtcactttcagcttgccgtcggaacccagcaccagccaggcccagccggagccgaactgggtggtggcagcggtcttgaactgttccttgaacgtgtccacgctgccgaaatccgcgacgagcttctgttcgagtcgggtaggaatccggccgccattcgggctgagattctgccagaatacgatatggttccaatgctggccggcattgttgaacaccggggcgacatcggccttgttataggtggccttgatgatctcttcgagagatttgccctgcagttccgggtttttctcgacgaaaccattcagagcagtcacatacgcctgatgatgcttgccatggtgcagttcgagtgtttcctgcgacatgccgttggccgcgagggcattcagcgaatagggcagggagggaagttcaaaagccatgtccagagtctccgttttgtgtctctgatggtcgagccagagctattgtcgccgctttccgccgtcaagcacacaggcgacagaaagacaggtctttcatgtccccgtcactgaatgaacctgttctcagccctgctgcccacgttgtcaggcggtatgatccggatcgttttttcgcgtccttgtttgccgccccggacaggcgtgaaagcctcatgcttctatacgctttgaaccatgaactggttcgggcaagggaagtggccagcacgccgattgttgcgctgatccgtctgcaatggtggcgggaggtagtcgaaggcgtggaaaaacgccacgaactggcgactccgctgggggcagcgctgaaagcgggacaactggatcgggaagggctgctggctctgatcgaggcgcgtgaagccgatacggaggagtctttccccgattccctgacgctatggcattatctggagcagacagccggacaggtcgctgtgctggccgggcagatccttggggcaggcaagcaggaacaggtgcgcctgcgccgtctgggagccgtatatgggctggccggggttgtgcatggggtctgtgcccatgccgcgcaggggcgcgttctggtaccagtggcagagctgcatgcagccgggctggagccggaggcgctgaccagcgcgccgcatgaggcaggcaatattgctgccggccctttgcaggcattggcaaccgaggggcagcggcgattgcggctatgccgtggccgggtgggacgaggctggatggcggcggctttgcccgcagtgctggcccgccgtgatctggcccggcccattttcggtagcattaacccatcgcagcgaggccttggagaccgcctggcggtgctgatggctgcgctaagcggcaggatttaaaccttagcggcttcctcatccagtcgggcaaagacggcgcgggctgttgccagaccattcatggcggctggaaagcctgcatagacagcgatctgcataatgatctcgatgatttcctgccgtgtcagcccgatatgcagtccagcggcaatatgggcgtccagctggggcagcgcattgcccatggcggcaagggccgagatcgttgcaatctggcgtgaccgcaggtcgagggcagggcggtcgtaaatatcggcgaatggaaattcatagatcatacgcgcgaagtcaggcgcgaatgcaccaagcccgtcgacgatgtccaggccgtgctgcccatgcagggtgtgcagcatttttcgcccgcgctggtaacgctgttctttgtcgtcctgatgagtcatggccatcaattcctgtgcatctgaaatctggtgcagcatgaagctgtataacgaaaaaagggagccttccggctcccttttcccattcgctccaatcgcgcgggcgatcaggcggagtagtacatctcgaactcgaccgggtgcggcgtgtgttcgaagcggtacacttccttccacttcagttcgatatagctctcgatctgatccttggagaatacgtcgccctgcagcaggaattcgtgatcggcttccagagcctgcagcgcttcacgcagcgagccgcagacggtggggatgtctttcagttcttccggcggcagatcgtacagatccttgtccatcgggtcgcccggatggatcttgttcttgatgccgtccatgcccgccatcagcagcgcggagtaggcgaggtaggggttggcgaccggatcggggaaccggacttcgacgcgcttcgccttcgggctggtggtgtacggaatacggcaggaggccgagcggttgcgggacgaataggccagcagcaccggagcctcgaagcccgggatcaggcgcttgtagctgttcgtcgacgggttggtgaaggcattgcacgccttggcatgcttgatgatgccgccgatgaagtacagacacagctcggacaggtcggcatagccattgccggcgaagagcggcttgcccgctttccacagcgacaggtgggtgtgcatgccggagccgttatcgccatagaccggcttcggcatgaaggtcgcggtcttgccgtagctgtgggcagtgttgtgcacgcagtatttgtagatctgcatgtcgtcggccatgcgggtcagcgtgttgaacttggtgccaagctcatgctgggactgcgccacttcgtggtggtgcttttctatgaccagacccatctcgcccatggcggacagcatctcggcgcgcaggtcgctgtcgccatcgaccggcggaaccgggaaatagccgcccttgacacccggacggtggcccatattcccttccggatagtctttcatgctggagccggggccttcgacgctgtcgagctggaaggtgccgaaattgccgcccgtgccgaagcgcacgctgtcgaaaatgaagaattcggcttccgcaccgatggagaccgtgtcggccacgccggaagtgcgaacatactgctcggccagcttggcggtggcgcgtggatcacgagcgtagaactgaccggtgctcggctcgatgatgtcgcagaacaggatcagggacggcttggcggcgaacgggtccatgacggccgtttccggatccggcatcagcaccatgtcgctttcattgatggctttccagccggcaatggaagaaccgtcgaacatgaaaccgtcgcggaacgaatcttcgtccacggtggagatatgctgagcggtgtgctgccatttgccgcggggatcggtgaagcgcaggtcgacatattcgaccgcgttttccctgatcatgtccatcacgcgagagacgctgtccggcgtcgagtctttttccgacatactcgccctgttcctctgttagattaggcttctgattgacatgccccggccatagggccgaccgcatgcttgagacagccataaccgggttttgcgggtttgacgcgggcaaacacgtcaccaacctccgtaaaacgccaggctatggtgaaaaattaaccggcaggcaaggcgtgcgggatcagactgctgccgcgccacgctcaccggttctgatccggatgacatcttcaacaggcgtcacgaaaatcttgccatcgccaatacgaccggtgcgggcggcattgacgattgcttccaccgcgcgttcaacctgatcatcttcgcagaccacctcgattttcaccttcggcaggaaatcgacgacgtattcagcgccgcgatacagctcggtatggcctttctgccgcccgaatcctttcgcttccattaccgtgataccctgcaggccgacttcgtgaagggcttccttcacttcgtccagcttgaaaggtttgataacggcttcgatttttttcattcgcgtttccacacggcttcgtgccgacccattttcggccggccttattctaccacattgatccgccttgccgaaatcggaaggcatgcttcgggaaacagatttgcatgcatcatgccaaccggcaactcgacacgattttggcgggatatatcgagatgctttattattgtgcagtctatgacgcctgatcattgggcggtggctgcctgtttgcaaggcatatgatggtctctgacgataatgacctgtctttaccagtcaggtgcgggtgattgccgaccattcgcctgccgcgcatagtctgcgcacagacaggagccgtgccgtgaagccattgaatgccttgatgtcctcccttgaaaccaccgtattcacggttatgtcggcattggcggccagacatgatgcggtgaatctcgggcagggctttccggatacggagggaccggatttcattgtgcgtgccgcgtcagaggctctgctggacggacgcaaccagtatgcgcccatgcctggagtgcctgaattgaggcaggcggtggcgtcgtcggaagcccggcattacggcatcacggtagaccccgattcggaggtgctggtgacggcaggcgccagtgaggctctggctgccagcctgatggcgctgcttgatcagggagatgaaatcatcctgttcgagccgctgttcgatacttacctgccgatcattcgcatgatcggcgcggttccccgtatcgtcaggctggaggcccccgactggtcactgccggagcaggccttgcgggaggcattcggtcctaaaaccaaggcgatcctgctgaacacgccgatgaatccatgcggcaaggtattcggtcccgatgagttggcactgactgcggaactggttcaggctcatgatgcctatgcgatctgtgacgaggtgtatgagcatctggtgtatgctccatcgcgtcatattcctttgcgcaccttgcctggcatgtctgatcgctgccttcgcatcggcagtgccggcaagaccttcagcctgaccggttggagggtcggttatgtgaccgggccgaaatcgctggtgtcggtcgtgatgcgggtgcaccagaatctggtattcgcgattgcccccaatcttcaacgtgccgtggccgtggggctgaatgcgcctgacagctatttttccgaactgtcagacagtctgcgacagaagcgggaccggctgcatgatggtctgaccgaaatcggatttgacgtcatgcccatacagggcagctattttctgatcgccgattatcgtcggctgggatttgaggccgatgacatggcgttctgccgtttgcttgtagaaaaggcgggggttgcggcgatccctgttgcagctttctatgaccgggatgcacctcagggatttgtgcgtttcgctttttgcaagcggaatgaggtgctggatgagggagttgcccgaatgcgcgcctttttcagtcggtgaaggcaggtgttcgggacataaatcgatcctcttctgctcagggggcgttgacgcgggcgacgtgatcggtcaaatacgccccgccccatccggttgcggttgtaaaccggggggtcagcactgggtcatggcgggtgtagctcagatggtagagcgccaggttgtggtcttggatgtcgcgggttcgagtcccgtcgctcgccccagtgccctttcatgctgcatcagcagcatagtcccggcaatatcatcattgatggatgcgtgaggccttaccgatgcgtatcgctgtgctgggtaccggaatcatggggcggtggatggcctgccgtcttgccgatgccgggcatgaagtcacagtctggaatcgcaatcctgtccgagcggctgaactcggtctgccggtggccacatcagcccctgatgcggcacatggggccgatgtcgcgttgctgatggtgtccgacggtccggcctgcgatgcggtgctggagaccgggtttgtcgatactatggcacagaatggcaccgtgctggtgatgagttccatcgagccatggcgtgcccgtgcccaagcaaagaaagtatcgccccggttttacgtcgatgcacctgtttccggcggagagggcggtgcgcggaatggcaccctcgccatcatggcggggggagaggaggcggtgctgaaccgtctggctccggtttttgccgcgctgggccgcatgaccagaatcggtgatatcggggccggtcagcttgcgaaactggccaaccagttgatcgtcggtgtgacgatcggggcggtgtcggaggctttcgtgctggccgaagccggtggcgcttcccctgcgcggttcagggatgccgtggcgggcggttttgccgatagccgcatcctgcgtgaacacgggcaacgcatgctggatgagaattttgttccgggtggaaaatccgcgatccagctcaaggatctgcgcatgattctgcaagaggcgaaaatgctcgggctttcactgccgatgacggaagcggcggccgctctctaccgtgctctctgcgaagcgggggacggcgatctggatcatgcgggactcatccggcagatacggcgcgacagtgcattgccgggaaccgttcagtagcgacgccacgcggcaggtacatgctgttccgcctgtgcgtccggttgggatgcatccagatcattcagacattgccgcatgatcggtgcgcaatacgcatccggtgccccacgggcatctttctcgccgctatagtgaatttgcgtgacccggtcatgatccagccgaaaggtcgcatgacagtatccaccgccagagacgcttaatccacccccgataatcgggagcgtgatattgatgccgccattgccggtagagttggcataatatgtcaaaatcgtggtgtcgcctgcggtgtttttttgatccggtgcgccgagacaggtttgcagatcaaccgccgaaagaccgacaaatcgcgttctcgcccgttgcgcggtgtgagaatcagacagggaacacccccctgacaataataaaagacccagacagaaagccggatgaagaacgcgcagcagcgatgatgacagcattgataagatcaaaatttctatcagcccgttggtaacagacggctatggtcgaagccgcctgttaccagacgcatcagtccacggagcgttgcgtatcgttccgcatccgttgcagtgccgctcaggatgaaggaggaggctggttggacagcggcagttcctgctccaccagtgtcacccagtaggacgcccccagcggcaggatcgcatcgttgaaatcataggcggggtgatgcagaccgggatcggtcgtcgtctttccactgcccagcatgatgtagctgccgggtttgacgttcaacatgaaggagaaatcctctccccccatggagggagcaggcagtttctcggttgtggcaacggcactggcggctttccaggcgcgttccgttgcatcagcatcgttgatggtcgccggatagagcacgtcgaaggtaaaggagacctgcgcaccgaaggccgaggcgatgccgttcacaatgccccgtgccgcggcttccatggcttcacctaagccgggcgtgaaccagcgggcggttccttttaactccacacgttccgggatgacgttataagcgttgccgcctgcgatctgggtgatcgacagcacggccttgtcggttggatcgacgatccgggagacgacggattgcaaccccgtcacgatatgggcggccacgaccaccgggtctatgccacgctggggctgagcaccatgcgcacctttgccggtgacgatgatgtcgatattggcgaccgcggccatgaccggaccgggggccatctggaataccccttccggagaactcggccagttatgcaggccgtagatacgctccatggggaagcggtcgaacagcccttcttcgaccatcatccgaccgccgccgatctgttcttcggcgggttggaaaatcagataggccgtgcccgcgaaattccttgtcgcggccagatcgcgcgcagcccccagcagcatggcggtatggccgtcatgaccgcaggcatgcatcacaccgggattggcagacgcatagggtttgccgctttcttccttgatgggcagagcatccatatcggcgcgcaggccgatggttccccccgccgcacggccatggatcacggcaaccacgccggtttcggcgatcccggtgatgatttcgtccacgccgaattcccgcaatttttgctgcacgaaggcgctggttgcggtttcctccagcgacagctccggatgacggtgcagatgatgccgccactgcgtcatttcatcctgaaaagcggcgatacggtctttgatcggcatgggggtctctccgtggccgggcggtggatcaggcttgagccgggttgaagctgcgcgtcaacccatctttcaggctgatcggctcgatccccagaatgtggcgcatcggtgtgatatcgaaagagcgattttctgtcagacgctgaatttctccttccagcttgctcatgaaagggcggcgggcgagggcgggaatgcgctgccccagcgcaaggccatgcagcatcagcgaagcaggcagcggcaggatcaggggcgcacgcactttggatatccgggcgataaggcggatacactccgcgtaggagaccggctccggccccgcaataacgagtgtggaggcattgttccatgggtgcgacagggcggcgatcaggcagcgtgtgacgtcatcctgataaatcggctgtatcagggcgcgcccgccatccggtatcggcagaacgtgtgttttgtggatcagccttgcaaggcgacgcagcgtctgttcctctggatcgccatagatcatggtgggatgcagcatgacgccgtgtcgccctgattccagaaaagcctgttcccctgcgcgaacccccgcgcaatgcgggtccgtgaaagcagagaatttccttgtgctgcccatcaggatcaggctggcctgttcaggggccgcttcgatgatggtggcgctatggctggcatggctggtagcgacgatcgcgctgacaccatccaatgcatgacgaagctgatccggccgggtgacatcggcccctctgacctgcacgtcattttctgcatgggcgggttgcgtgataccgcaggaaagccatttgtcagggtttctgaccacggggcggaatggcataccggcgtctgacagagcgcggcaaagcgccagaccggtgcgaccggtggcgccgatcaccgccaccagaccggggttcagggtgtgtggtatcatgataccacacaaagaaatgcttgacgttcgggggattgcaggccataagccgccacccgaacgcatgcggttttgtccgccactgccattctcgaggacatcctagatgaagaccaccctctcgctgaaacccgcggaggtgaacaaagactgggtattgatcgacgcggaagggctggtgctcggccgtcttgccgtcatcatcgccaaccgtctgcgtggcaagcacaagccgcagttcaccccccatgtcgattgcggcgacaacgttgtcgtgatcaacgccgacaagatccgcgtgaccggcaataaagccgatcagtcggtcttttactaccacaccggttatgccggtggcatcaagggccgcagcatccgccagcgtcttgaaggcaagcatcccgaatccgtggtcgaaaaggccgtggagcgcatgattacgcgtggtccgctgcagcgtcagcagatgaagcatctgtacgtttatgccggtgcatcccacccgcatgacggccagcagccgaagtcgctggatgtcggcgcgctcaacagcaagaaccggagggtctgacctctatgtccgatacacagacccgtaccctggccgatctgaaggatctcgcggtcgcacagggttcaaccgtttccggtgaagtccccgctgcttcccgtgagccgaagcgtgatgcacagggccgttcctatggcactggccgccgcaaggatgccgtcgcccgcgtctgggtgaagcccggcaagggcgacattcaggtcaatggcaagaaggtcggcacttattttgcgcgccccgtgctgcgcatgctgatcacccagcctttcctggtcactgatcgctataaccagttcgacgtgtactgcacggtgactggtggcggtctgtccggtcaggccggtgccgtccgccatggtatcagccgcgctctggttaactatgagccggaactgcgcagtgttctcaaggttgccggcttcctgacccgcgatccgcgcgtcgttgaacgcaagaaatacggtaaggccaaggcccgtcgtagcttccagttcagcaagcgctgagttccactggttggtgggaaaaaggccgggcagcaatgtccggccttttctttatctcgcctcttttctttgcggggcgggtgcctatcctgcagcggcggatggaagggcatgatcgagatgacacacagcatttttatcgacggcgaaagtggcaccaccggcctcggcatccgcgaaaggctgggcgatctgcccggtgtctccttgcgcagtctgcccgcagagcatcgtaaggatccgaaggccaagcgtgctattctggctgaagtcgatcttgccatcctgtgcctgcctgatgaagcggcgaaggaaacggttgcgctggcggattctcttggaggaaacgcccccaaattgctggatgccagcacggctcatcgtgtggcggagggctggatatacggttttgccgaattacaggccgatcaggaggcgcagattcgcagcgccggaaaagtcgccaatgtcggctgttacgccgtcggcagcatttctctgctgcgtccgctgattgatgctgggctgattgcgccggatcagccgctcagcatcaatgcgatcagcggttatagcggcggcggcaaaaacatgattgaggcgcatgagaaggaaggcggtcccgctttcgagctgtatgcgctggggctggagcataagcatttgccggagatcatggcctatgcagggctgacacggcggccgattttcgtgccttcggtcgggcattttccgcagggcatgctggtttccgtgccgctccatctcgatgatctgccgggacggccctcagcgagcgatcttgaagccgccttgcgtacccattacagcgcggcgaggcaggttcgggtgctggacgtcgtatcgaccttgcgcgcagaagatgcctccggctcggatcatctggaactgcgcgttttcggcaatgaaaacaggcgtcaggccgtgctggtggcgaagttggataatctgggcaaaggtgcctccggttcggcgatccagaatgcacgcctgatgctggggctggagtaggtatcgcgtgattatcgcgtttgaaggcaaaacaccgatcattcatccctcggcctggattgcgccgggggctgtgatcattggcgatgttgagatcgggccggacagctcggtctggtatggctgtgtcctgcgcggcgacacgaaccggatcagaatcggtgcgcgcagcaatattcaggatggcaccatcgttcatgtgaaccatgtctgctatccgactttgattggcgatgatgtcaccatcggccatgccgctattgtgcatgcctgtgaactgcatgatggcagctttgtcggcatgggagccacggtgatggatggagccgtactgggccgcggcagcgtgctgggcgcacgggctatgctgacgccgggcaagataacaggcgaggaagagttgtggatcggctctcccgcgaaactccagcgctgcctcagcgagcaggacaaggccatgttcgccgataccgtaccccattaccttgatctgtcgagacgtcacgccagaactgcgaaacgcctcgacgagggctaagggtcagttgttctgtcagctgccgtaaagtgtatgagggtcgatcagtggttctgtcagggtggtgacggtgccatccttgcccatagcccgatagaaacagctccggcgtccagtatggcaggcaaccccgggctgatcgaccagcaccagcagggcatccccgtcacaatcgacccgtaactcgatcagcgtctgtacttgtccggaggtctcgcccttgcgccacagcccgttccggctgcggctgaaatagcagacccgacccgtcgccaacgtttcctctatagcttcccggttcatccaggccagcatcagcacctcgccagtgtcatgctgctgggcgatagcagtgacgaggccctgatcgttgaagcgaataatgtcgaacacgtcgctcatcgctgcatggcatccagagcccgtgtcaggtcggcgatcagatcctgcggatcttccagaccgatatggatgcgtacggttggtccttcgagcggaatgtcatggctgcgatggatggtgccgtaggtcggcatgatcaggctttcatagccgccccaggaggcacccagaccaaaaatcgagagagaatcgatgaaacggtcgctctgctctgtcgtgaaggaactcttgaactccacaccgaacaggctgggtgcacccgtgaaatcccgtttccacatctcataaccgggatcgcccggcagggctgggtagagtacgcgctgaatctcgggccgttcgctcaggaaggtagcgatatgcaatgcgctctgcatctggtggttcatccgcaccgccatggtgcgcagaccgcgcagggccagccagcaatcatcggggctggcatattgccccagcatcccggccgtgctgcgcacccggcgccaatgtgcttcgtcattgacagtgatagagccgagcaaaagatcactatggccaccgacatatttcgtcagcgcctgaatcgagagatcgattccatgctggaatggctgaaagtgacgaatgccccaggtattatcgagcattgtcaccgccccgtgctgatgcgccagagcgcaaagcgctgcaacatcctgcacctcgaaggtgtggctgccggggctttccagaaacagcactctggtttccggcctgaacagaggggcgagttcatgtgcagtcgccgtagcggtatagaaagttgtttctataccgaattgtttgagcagaccttcgcaaaaatcgcgtgtcgggccataaaccatatccggaaccagcaggtgatcgcctgcgctcagataaccgagtaaaggcactgtacaggctgccagaccggaggatacgatctggcaatgcgtgccgccttcgatttcggcgatggcattttccagcgcgaaatgagtttccgatccgttcagcccgtaggtcagggactgttccagccagcgctttccctcacgacgtcgcgtcgctgtatcgggttgcaggaccgtcgatccgcggatgaggggtgggttcacgacaccggtgtattttgccaccggtcggccagcccgcaccagtctggtatcgggatgttcattgggcgcatcagatggggtgcgcggtcccggacgattatattgcatcacgctgcttctgagtatcggggcggctgccccattccgaccatgagccatcataaatggctgctgcctccaggcccgccaccgccatagcaaagctgagcagggaggctgaaacgccgcttccgcagcttgtaatcactggtttgctgccatcaataccggcggcagcaaaacgctgacgcaaagtctcgggcggcaacagagtaccattggctgccagaacctgattgaaaggcagattgagactgccgggaatccggccggattccacgcccgggcgcggttccgcagcagcgccggcaaagcgctccgcgctgcgggcatccaagaccagctcggccccggatatcagattatccttgatatcgccgatgcctcgtacgtatttcgggcgccagtcggtcaacaaggcagatgcagcgggtaggggagcaatctcgccactttcggtcgggccaccggcccgaacccaggcatcaagcccgccatccagtacggcagcctccagaccaaacagccggaacagccaccagccgcgggcagcccacatcatgctgttctgatcatagaaaacgaccctgctgttgttggacacgccaagtgcgccaagctgggccgcgaactggccgggtgggggaaccatatgcggcagattggtctgttgatcggcaatggcgtcgatatcgaaataaatagccgtgggaatatggctgcgcctgtagtcatcatgaccgttgcggccctgattgggtaaaaattttgttgcgtcgaaaatgatcagatcagccgcgcccatcgactctcgtagccactcagcgtcgaccaaaacaggcagtgttgccattactcgtcccttccgagccactcgcgtataatccggtcacgttgtgctgccagccagagcagggcaaccgtcgttacgacattgctgaactgaccggggatggcggcctcaatcgcctgacgagcatgaacgattcggatacggatgtcctcgttttcagctctcagacttcctgtcctggtatggatcagccttttcagggtgacaccgggctcctccagacattcacaacgggcgatttccgccggaatggctcataccggcaggaatttcggtcatgaccgggtcaagactggcggacagtgccgcaatccgtatctattcgatcagaatgagggtatcgcctgtggggattatggtcgaactgcggatgccttgccacgtcgccagatttcccaattctgcaggctgaaccgtgcgccatcgaagcgccggttgaggaatgagatcggctccacagcatggcgccctttccagacgatactgtggaatttaattcttgtatccgcgtgggagggtaggctgagaaaattgtctggcatgcctttgctgacgagaaaatcgcttggatgggaatggcgattttctcgtcatagcggatggacaaattccacgtacagttcatgcaggatgacgtttggccaggactaccccagcatactccgaagaattttagctccctcatgacctttgattgaatttttccagcacatttcggccattttttgatgggacaccacaatttcctcagcagaagaaatgatcgctaccccttcttgaaggtcgggtgcggtatccgtgtgaaacggattgaggacaagctgtattgttgaatgagaccgtgcgatcaccatacggctgttgatttccccaggtgacagtagtccgaactgcaatcccattggctccgtttccagaaggttggccatgtgctcaacttcccgtcttgccacgacaagggcggatgctttcagttcttccgataaatcgggtccgccaataccctgttgcagcataatagaaatggcagaaggggataacattgcaatgaggttgggtcttcgggcggcataggctgcacgcctttctttcagcgtctttacaagctgctccacgtaaagccggtctgctttcgatcgtccggcatggcgggatatgatggattcggccagaaacgcttctgtttcatccagcatcgtcagatggcacagcgcatctccgacaaactgcaattgggcagcattttcctcaatctggcgggcacgttcgaaatatccgacaggccggctttgatactcaatgctgacacccagcagggaaagaggagaaacctgcaggagttcagccagcctctgcacggtatccagtttgatgacttcacctttttcatatcggtacagcgcggctcttgagacacccagccgtgctgctatctcctctgcgcgtaatccagactccaggcgataggcacgcaggcgctgaccaatttccgagaaacgcataatcaatgtcgggtgtcctgctacgctttgaaagaataatgctataaagagctaataggggctacagaaagattttaaaagtatatcaagttttaaaactatactaaaatacgatataaaaaaatgagatttaaaaaccaaaattgtaacaaaaataagataaaatacttatttgtttaagtgtctctggaaagaatacatttcttaaaaacgtgtccatgaagcttaaattttataattatcccgccacatcaggccatctactgtcgatgttaacggattatattcgcagctaatccagccatggtagttttcatttctgatgattgagaatatctctgtccatgagatatttccggttccaggttcatgacggccgggagtatcagcgatctggatatgccgtgtttggggaagccattttctcagtgattgttcccacatagtgtccgttaaaaataaatgatacagatcaagctgaaggccaatattaggcattcctgttaaggaaattattcttgaagcttggtctgccgtttttagatagtaattattaattgtctggatgctgatgggctcgatcgttattgttatgtttgactctgccgcaaggcgggcagcccatatcaggtttgagacatagcactgttccatggcgacattgtcgtggctggtttcagacaagcccgccatgcaatgaataaacgaacagttcagtgttctggcatagcgtagagccagcaaaaaacctgctctgaactcctcttgccggtgaggaagagctgcaagacccctttcgcccttctcccagtttcctgccggagcgttgataagcaccatcttcagtccggtttttttcaatatcgagccgatatgatccgctggtacagagtaaggaaaaagacattccacacctgaaaaactggctgaagcagcttgctgaaagcgttccagaaaatcaaattcagtaaacagaaaagaaagattggcgcagagagacaacatgtcagaaaaaccgtaccaggattttgatatggatcaacaacgaatttttgttgggattaaaattaaaacatcaactcggatgatgcgttaagtaatgaagcgtttgtaatgaaccgatgaattgtgaaaatttgtttcacatgctagtttcaaatttatccggttgatttatttttgtgacaacaagtataattaatacttctttattctccgtaaggaataccatcccgccgtggatcggctgctcctgtcagatgcccgtctgcttttttgataatcatggagagacctgaattgagccttatgatcgcaggatgatgaccatactggagcaggcgatcagccagtaaggtggcttcagtccctgcttccagatcggatttcagacccgttgtgccgatatggggagccgagatggcctgggcaggagacaggttccatcgcatggacagcagcatggcctgactgacatagctgataatgtggccacctccgggcgatccggtaaccatgtcgagctttccattctgatccagcacaatgattggcgccatgctgctgcgtggtcttttgcccgcctgaacccggttggcaacaggcttacctgcctcttcaggcacaaatgcgaaatcggtcagttcatcgttcagaataaatccgtcaaccaaaagcttggagccaaatacgtcttgcaccgtggtcgtcatggacacggcattaccttgcgcatcgacgatgctgatatgactggtaccgtgctccggttttggtggctgtgtaccctgggcggggggtaggtcgggcatggaccatgatggattgcccgcctctaccgtggagggcgcatggcggggatggatcattctggctctttgccggagataggccgggtcgagaagaccgcggagtggtatctttacaaaatcgggatcagccagaaacaggttgcgatctgcaaaggccaggtgttcggcctgaatgatcagatcggccgcttcggcgctgtcggggcgcagatgccgcagatcgaagccctccagcatcgagagtatctgcaagacggcgacacctccggaggaaggcggtcccatgctgcacactgtccgcattttgacaggcatgcacagggccgggcgctgacggggttgataggaggccagatcatccatcgtcatggtcccggaggccgggctttgccggatcgctgtcacaatgtcggtggcgatccgaccggtcagcaaggcatctgcccctttctcggcaacgctccgcatcgtttctgccagagcgggattttttaatatgtaacccggctcaggaactgagccattgggcaggaaataagtccttgcggcttcctgtaccatcaagctgttctgttcttcccggatttcccggctcatcagtgcagaaaccggaaaaccgttttccgcctgggtaatggtgctggtaaacaaatctttccagagcagctgcccatgcagcttgtgcacagcttcgagcattctcagcgcgccaggtaccccgacggcgcgtcctccgattccggcgctgtccagcgggagcggtttgccggtcgcatcctggaaaatggtgggggggatggcggcaggggcggtttcccgtccatcccagctggtaacctgccgggtggctgcatcgtagtacagcaggaaggcgcctccacccagaccggaagactgaggctccaccagtgacaacatcgcctgtgcggtaaccgcggcatcaatggcattgccacctgctttcagcacatccaatgctgcccggctggcgaacgggttggccgttaccaccatcatatgggcggcggttacatcccgggccagcggaggaaacgaatgaggggcggagggccgatgtgcgggtgtctcggcggcgagggaaaaaggcattatgaaagccacgcagaacgcgagccgtgccaggctttgttttgtgaaaaacagcctgtcccatacctgccgcagtttccgtgtgactgtcatgattgagcactgccaatgaacaaaaagaaagatgactgtggtggtctgtcattaccttctgacagcgtgttttgcagcttacatgcaaacgacagtatctggcagcatgataaaaaggtcctccgtggcggtaaggcgagccgtgacggcctggaggcagagcgtatcgctgcacaggcactggaagcagatggctggcagattttaggtcggcgactgcgtacatccgcaggcgagatcgatattcttgccgagatggacggattgctggcgattgtcgaggtcaaataccggccaaccctaagcgaggcagcccatgcgctgggcccacgccagcgcaaacgtctgattgctgccgcctcgtatgtgctggcacaacacccggaatatggtacggaaggcgtgagattcgacgttattgtggttgatatggccgggcaggtgcgcaggattacggatgcgttcaggctggatgaggaggggtggccttagccacgccattgccggacgcgaaaattgagagcttcggccagatgcaggcgggaaatgtctgcttcctgtgccagatcggcgattgtgcgggcgacgcggatcatgcgcgtcaaaccacgcgccgataatttcaggcgtaggctggcctgttctgcaaaagcggctacctcgggggacagggaagggtctgcaccattctgccgcttgccggattggaggcgtgcggctcgaaactgtcgtgctgcctcgatccgtaccgccacggaggcactgttttcaccaggcggagcgcgcatcaactctgtcggagtggcaggttggacggtgacgacgatatccatacgatccagcagcgggccgctgatccgggcctgatagccatcgccgcaggcgggtgcgcgcacgcattcacgatccggagtgccgagatagccgcagcggcagggattcatggcggcaatgagctgaaaccgtgcgggataggtaatatgtgccgcagcccgcgccactgttgcctgtccggtttccatgggcgttcgaagggcttccagcacctgacgggaaaattccgggaattcgtccatgaaaaggacgccatgatgggcgagggagatttcgcccggtttggcacgcggtccacccccggcaatggccgcctggctggcaccatgatgcggttcacggaaagggggacgggtgatcagcctgccatcccgcagcatgcctgcgatactgtgaatcgtgctgacatccagaatctgcgatggcgtcaggggcggcagcaagccgggcagacgggcggcgagcattgatttgcctgcgccaggcgggccgatcagcagaaggttatgctgtccggcggcggcgatttcgagtgcccgcctggctgtctccatccctttgacatcggcgaggtctgggagtgccgatccctccgcctgaccagccggttctggtcggggcaacgtctgtgtgccgcgaaaatgattgatgatggccagcaggttgggtgcggcaatgatgcgttccgccccggaccatgcggcttctccgccctgccgttccgggcatatcaggccgagaccgcctgcatgcgcaccgatggctgctggcagcaccccgttcaccggctgcaaggctccatccagtgaaagctcgccaaggctggtatatccggcactatcggaggctggcaggatatccattgctgccagcacacccagtgcaatgggcagatcgaaatgactgccttccttgagcagatcggcaggcgcgagattaaccagaatacgccgtggcggcagagccagccccatggaggcaagggctgcgcgtacccgctcccgtgcttctcccaccgctttgtcgggcagacccaccacttgaaaagcgggaaggccgggtgagatctggacctgaatttccacagggatggcagtgatcccggcaaaggcaaaggagtgggtgcggacgaccttgctaccttcacgatggggagtctgtgccattgagagaaccgatttccaaccaaaacaggcctgacatactttcttcgatcaggcgatttattcttcttacagaacaattatggcaggagaaagataaaggatatcccctatcaggctataaagcggtgcggctgacgactcatttttatgataatttggcaaatcctgttgcttcctgtcattggtaacatcgccaaaatcggatgaagcgttaaaatacggcccgatgagaatgctacccgcctggtaaggatctttcctctcttgatgaccattctggttgaatttctgattgtcctgttgctgatcctgctgaacgggttatttgcaatggcggagctggcgctggtttccgcccgtcgcgcccggctgtcggttatggaacagaaaggaattcccaccgcgacactggcacgggaactggcggaagatccccaccgttttctgccgaccgtgcaggtagggattacgctggtggcgattctgtccggcacgtttggcggggcgcggatcgctgatcatctggccagatatctggacatgatccccgttctggcccgtttttccaatgatattgccctgctgatcgtggtggttgtcatcacctatttgaccatggtgctgggggagctggtaccgaagcagcttgccctgctggggccggagcaggttgcagtcagggtggccaggccggtggcgtggctggcgaaggtgacggggcctgcggtgtggctgctgggttattcatcctctgtcgtcctgagcctgttcggtctgacccgttcttcccagccgcaggtgacggaagaggagctgaaagcccttctggcggaaggcacgcaggcaggtgtactggaaaccgaagagcgtgccatgatcgagcgtgtgctgcgcctcgctgacaaacccatccgcgccctgatgacgccgcgaaacgaaattgcctggatcgaccggagcgatacggaggcagatatcatcgccgcagtgaaagaagcacctcattcccgcctggtggtctgtgagggttcgatcgacaatgtggtgggcgtggtgcaggccaagcatattctcgatcgccttctggaggggcagcctttgtccatcggtgcctccctgcgtcagccgatggtggtgcctgataccgtgacagcgctgggcgcgctggaaaggctgaagagcgatactctgggtctggcgctggtcatggatgagtatggcagtttcgagggggtggtcactgccgcggatgtgctgaaagccattgtcggtgaggccggagacagcaccggaacatcctcccagactcctgatgcgctgccaggtacgatggttctggacgggatgatggcggcggatgagctgaaatcccgtctctccctgccggaactgcctgccgagggcagctatcacacggcagccgggctggtgctggcgatcttgcgacgggtgcccaaaaccggggaccggatcgcctttgccggctggacgttcgaggtgctggagatggatggtcgccgggtcgcccggctacgagccagccgcgatacgcttgctgagggatgacgctatcggccctgttgaggcatccccgctgtttcatcaatctgaagggcatgcggcaaagccagccgggctgcgcagcaccttacataagcctccgagtgcgtgctttcaggaagcacatccagcagcttcacggtgtcaacaggctgaagcggtctccaacgctgctatcgtgacatccagaagccgatcgatcacatgcggttcctgtgcgcctgcaatggcatgatgatggtcgaacacaaaacagggtacgccagtgatgccgagccgatgagcctgtgccgtggcaagctgaatttcgctgcgcccttccgggccgcgcagataggacagggcgtcggtccggctgaatccggcctcggcagcgatatgcgccagttcatccagatccccgatatcccgcccctcggtgaagcaggcggcaaacaggcgttctaccatgcctccggcggcatcggcaggacgggcggaaaatgatgtgttgaaattactcaggcccgcgctgctatgggagaggtgataagccgtggcttgctccgcgacccatcgcaccagccgatgggcatcaaaactggatggcagggtgttgatcaggtcgaagcgaaaactgatcccttcccgacgccctaacgcggtgatggagcggtgcagccgttgcgtgcggtcttctgtgcctggtctacggatgatatggtcggcgcgtcccgcgctgctgtgcttcatgtccggattgagcaggaaaggcctccactcgatcacggggctgatatccgctcgtctggcaaggcattcacgaagtcgcctgacacccagatagctccaggggcatatcagatcgaacacgacggcgatcgccagaagtgcgcggggaggggcgagcatgttcacaggagtgagtgtaacgcattcctcagtctgctcaaaagatataatgctctcagcagattgttttatataagattttttaataatccgatgcttgttgtgctggcgtcaaagcagtccgatacaggacattcttctagcagggttgatcacatcatgaccgaatttccgcctcgtctgattggcgatatcgggggcacgaatgtccgtttcgccctggcgatgggggaaggcgttattgtgcatgaacacaagctgcctgtcgcggaattcgacagtctggaactggcggccagaacctatttgcaggcacgtggttcgctcagccaggaggtggaggaagcggtgtttgccgttgcgacaccggtgaagggcgatgaaatcgcttttaccaacaatccctggcgtttctcgattcgttcgactgaagcggcactggggctgaagaggctggaaatcatcaatgatttcgtagcccaggcggcctccatccgggtaacgcctgatgaggaaatgacgatcatcaaatcaggtgaggtcatggagcatcatcccgcagtagtgattgggccggggaccggtctcggtatggccttcatcctgcgtcgcaaggatggagaagagatcttggccagcgaaggcggccactgcacgttcagcccgcgtgatgaaacccagaccttcattcgcgatcaactggcgcgcgaatacggccatgtctcgtcggagcggctgctgtccggtccgggtttgctggctatggccagagcactggcgcagcgtgcgggcatttctctggcgcttggaaaaccggccgatgtcacaaggctggccgagcaggcggcctgtcctgtctgccgggaagcaatcaaggttttttctgccgtgctcggctcggtggcagcggatgcggtgctgaatttagtggctattggcggggtgtatctgattggaaatgtcagcaaaagtctgcgcgccatgatggatttcgatgcgctgattgaggcgtttctggaaaaagggcggtttcgtgccctgctggatgatgtaccgatcatgcaggtaatgcgctccaacacaggtcttctgggggcgtcggcctggcgcgggcgctgaaatcacagactcgtttcagatggagtcgaggcgctgggtaattttattgcgtgttattgggtcaggacgaatgtcccatgcggaaactcaataataaatgaaacgcaatgcatgcatgaatttttgatattgaatgcctctcctaaatagtctcatgctccccttgtcgcttcgtcccgaccagtgacggaacaggggaaggaatattccttcccctactgccaccggacaaatggatgaggttccagcaagggagtgccattcgatggccatgcaactttcttcttacgcttccggttttatgcacagccccgtgcgcagcagtgtgacagcgtcttctccggaacagaaagacgcgctgaagcaagctttgctgtttgtttttgcaattcagacaccgatatgggcagctctctatttgctgttcagcgctgggctgtaagagaagagagaggaagacttatcttttcccccttcgaccggagcttttagttgcctggcgatctttcctgcctgtgggcagagttatcgaggtcggcaagacggtaggccagggcagaaagaagccagatcacaataaagacgccaacgatgagaaagccgaaatcggccagatcatcgttcagggatgcaatatcttgccagatcgtcccgcggagatgcagatgcgcgccgatcagaccgagtgtttcaaccgatccgatgagcagggctacagtgatggatatggccgtcatggtaatattgtaccatagtttccgctgcggattgctgaaagcccatccgtaagcaccagccatcaagctgctgtcgagcgtatcgaccagcgtcataccggtggtaaacagggctggaaagatcatgatttcccaagccgggatacctcccgcacgctgtgtggcggtgatgccgagcagcccgatttcggtggcggtatcaaatcccagcccgaacagcacccccaacggatagaggtgccatggctggctgatgcgctcgaacaccggacggcagaggcggcttagaaggctgcttttgtccagcgcgtcattcaatgccgcctgactcattgtttgctggcgagcgttacgaaactgctgccacagcgtgcgcaggatcatcagattggcaacggcaatacacagcagaaatacggccgaggtcagtgtgccgacagtgccgccgaaaaagcgaatattctccagtaaagtctgaaattgctgtgccgagactgcaatcagcgcacaggccagcaccacaatggtggagtgcccgagcgagaaccataatcctgtgcggtgaggctgaatgcccgcctgcatcagacggcgtacggtattgtcgatggcggcaatatgatcggcatccagcgcatgccgcagcccgaaaatccaggccaggaatgctgttccaagcagtacaggtcgggtggcaaaagcctgccaggcgatcagccagaccagcccgttcacggcgatcaaagcggtatggagcaggagaatgctgcgcgggatggtacgaagataaagaaagaatggcggcatggggtcatgcaatgatcccgccgccattcttgtcaactatggatgcagaaaagcggcgcctcagcgctttctgacaaactcggcgcggagcaccaatcccttgatcgtatcgtgtttgcagtcgatttcctgcgggtcaccggtcagacggatggatctgatcacggtgccgcgtggcagggtctggttggcacccttgactttcagatccttgacgagcgtcacgctgtccccatcggccagaatattgccgactgcatctttcacctgaaccgtttcatcctgcacgggggcagcagctttccgggcggcttctgcggcactgatccactcgccgctggcctcgtcatagatataatcttcgttctgatcgggcatcgtaaaattcacttcttcaaagacggatagggttcaggactggcgatccggcagggaaaccaggccatccagagcgtcaacatcattcaaagcagcgcttttctctgctcgactgagagaggtaagcgcgtgagtcagtgtatcggcctccgcaattttgacgcgggccaccaggatgttggcatcgactggatcaatgcgcggtcggcgcggggggggcagcattgcccgatgtgcggccagcagggtctggtcggtacggagacggatgacggcttccatctccggagcatcggcaagggaatgatagatctctccggcgcgaaccagagcacgaggaggattgcattcctcggggatcagcagcaggcccagccgacgcagagccatcccggcggcgcggtttccggtcaggctgacaagggggatggccagcgccatgccgaccacaaccggcgtcatccacagaaaaagcgggaaggagacgagcatggctgccccgcccagcaccagaccgaagacggtatgctgccagtatgtctgaatgaccacacgcaggggaatgctgccgtcgtcccgtctctgtgcgttccagccgctatcacgcccggcgagaatggaggcgacacccatggactggatcagcatggcaatgggggcgatcaggccgccaatgaccgtctcgatcagcatactgaggaccagacggatcgccccgccgcagccgcgtcgctcggaaccattcagcatggtgacgatgcaacccagaactttgggggccagcagtaatcccatggtgccgatgaacacatacatggccagcacggggtcgacggaaggccagtgggggaacagagcccgtccctgatgcgggaaatactctggccgcacaaaaatactctccagggagatcagaatgcccagcaccagaaacagcaaccataaaggtgccgtgatataggagccgatccccattgccatatgcacccggctgatccagtgcagatcacgggcaggcagaatcttggcgtgctgtagattcccctgacaccagcgacggtcacgaatggcgatgtcggtcagggaaggcgggctttcctcatagcttccggccagagcaggcagcatgtgaatggcccagccgccgcgccgcatcagcgccgcttcgacaaaatcatggctcagcacatggccgccaaagggcttgcgaccgctcagatgcggcagccctgcctgttcggcaaaggccttggtgcggatcaccgcattatggccccagtaattgccttcggagccatgccaccaggcaatgccatgagcgatcagcggaccatagaccctgcctgcaaattgctgcatgcgggcgaaaagagtgcggccattgacgatcacgggcagggtctggatcaacccgatgcgatcatgctgttccatagcggcggtcatgcggacgatggtgtcgccttccatcacactatcggcatccagcaccagcatctgacggtacgcaccgccccagcggcggacccattcaccgatattgccggctttgcgctcgatgtttttggcgcggcggcgatagtagatgttttcgccgccgcccacccgttggcgcagggccagaaaagcctgttcctcctcaatccacacgtcagggtcggtcgtgtcgctcaggataaaaacatcgaaagccgccatgcgtccggtggcctgaaggctctcataaattccctgcaagccagcggtcacgcgggccgggctttcattatagcagggcatcagaatggcggtgcgatggtgcagctccggcaacggtccatcacgatgtacgcccagtcccagcccgccatcgcggcccagcatggaggcgaaaccacccagcgcactcatgaaagacaatgcgatccaggcgaacagaatcacgaacagcacgaccagcacgacaccgagtgtggttgtaacactggcattcagcacgcgattcatttcataggccgcgccaatggtcagcagcactgtgccgagaaaaacgaacagacgccgcagcgccagaccacgcggtgcggtcagtggcctttgcccggccagagggccggttgcgggtgagtccagccgttgcaccggcatatcaatgggggattctgacggtaagaaggggggcgagccgattgccgacatgatcacggcgtccaacggaacatccagctttcggtcagaggctgattatccttggataatctggcggtgacctcgaccagtttctcaccgccggggaccagctcaaaaccgatccgccaaccgccaatatccggattgggttcagagaagatattgcggatttgtccggcagaggcatgcacctccacattcggcggctgggctgtggtgagggatttgaccgcatcgccggtgaagtcgatcacatattcgcgcccctgcttgtcgtcggccaggccggaacgtgtatcggcaacccgcgccagcttggtgggccagggcgtatcccagccccaatgcatgcgataggtgaagttatactcgcccttggccgccagtttttccttgggccgccagaagctgacgatattgtcgtttacctcattcggagtagggatttcgaccagatcgatcgatccctgtccccagtcaccgatggtttcgatccacaggctggggcgcttttcatagcgcagggcgagatcctgatagtcggcaaaggcacgcttccgctgcatcaacccgaagccgcgtgtattgccatcggcaaacgcactgaactgaagatcacgggggttcaccaaaggacgccagatctgatccccattgccgacccagatcgacagaccttcgctgtcatgcgccgccggccgccaatcatcgacgccttcacggtcgtcgaagtcgaaatcgaacatgctggtcatggtcgccagaccgggctcagtaatatcgacgcggggataaagggtgctttccacatcgaacaccgttgtatcacccggatggatggtaaagcggtaagcccctgtggtactgcgtgtgtcaagcagcgcatgaacgacgatgctgtggctgtccgggcgcggcttttccagccagaaagtgcggaaggcggcgaattcctcgcctttgggattgccagtgccgattgccagaccacgggctgaaagaccgtaaacctggccttttgcgaccgcacggaaatagcttgcccccagaaacaccacgcattcatcataataatccgggcggttgatcggggcatgaatacggaacccggcgaaacccagattgccggtcacgcgcagtttctggtcttcatactcgaataggtcgggattgaacgcgacagggcgtgactgcccatccgagacctcattgatctcgaccttctgctcgaacaggtatccgcgatggatcagttctacacggaacggcagattgtcgttccgccacagcgcgcggtctttctgaaagcgaatgctacgccactggtcccagctcagcttgctgacaacagttggaagattggtctcggggggctgatagggctttcggctcagttcctgcgcaatccggcgtacagttgatgcatcgaacggggtggaagcgggctgatgaggagcggattctgctgcggcgggattggaatggctgccgagggcggcaatcattgtaagagaggcagagcctttcatcagggcacgacgctgcacgaatcttcctttcgacagattacgatggaccatttagtcagataccatggtcctacacgaaacaggaagaagaggcatcagcccccaatttaagtggggcctcagttcgggccgtgctgtcaagcctcagctgcgttcttcgtttccgctgccgctggcacggggtgcccttgcccgcggctccatctgtcgccgcgtgaagaaggtggcgatatcggcaagctccagaaattcatcagcctgacggcggagatcatcggcgatcatagggggggaggttcggatggaggaaacgacggaaacccgcacgcccttccgttgcacggcttcgaccacgcgtcggaaatcagcatcgccgctgaacaggacggcatgatcaatccggtcggcgatttccatcatatcgacggccagctcgatatccatattgcccttgattcggcggcgaccggaggaatccgtgaattctctggccggcttggtaaccagattatagccgttataagcaagccagtctgtcaacggcttgaggggagaatattcttccgtttcaagaacagctgagtaataatatgcacgcacaagttgagagcgactgcggaaagttgacagcaaattgcgatagtcgacctcaaagcccaggttccgggatgccgaatagaggttagcgccatctataaagagcgctattctctcggtcggtaggaaatgcatactcttgaatatccttggcttataagacggcatgatgaggttcagccgtgtggcggaatctttaccatgtatcggtgctatgctgacctttaaacgacaatgaggggcatttacaatgcacaagcctgcagcatacggcgatttgatgagcatataaaaatgattttaatagcactcggggcaaatctgccgaattcagatggtatgccagccatcgaaacctgccgccaggcggtggcacggctgggcgagttgcccggtctgactctggaagcctgctcccgttggtatctgacggcaccgatgccgccttccggtcagcctgattacgtaaatggtgtagcccgcctgtccggtgaaatcgatcccgagcgccttttggcatggttgcaggagatcgaggcgcgcaatggccgtgtccgtacggttcccaatgctcctcgcacacttgaccttgatattatcgatatggatgggatggtcaggtccgcccctgatcctattctgccccacccaagggcgacagagcgtgcttttgtcctgacgccgctgcgggatgtgtgtccagactggattgatcccgtcagtggtaaaacggttgatgatctgctggatgcgttgccgccacagggaataagaccggctgattctgactgatccgtttcagcggaaaggctgatccgcgtcagcagatgcctgctccggttgcctgggaagggaggctgctttataggtaatcccttcgcttcagtaagtttgtgttttgggaggtcgccgcatggcgcgcgtcaccgttgaagattgcgtcgaaaaggtgcccaaccggttcgaactggttctgctggccgcccatcgtgcccgctgcatcagccgtggcgaggaactgaccattgatcgtgacaacgataagaacccggtggtcgcactccgtgaaattgctgatgagacggtgaccaccactggattgcatcaggatctgatgaagtcactttcccgcgcgccggagccggaacccgcggatgaagaagtcctcgatctgatcccgaccgagcagaatatctttggcctgcaggatgtttctgccgaggaagaagctcattccagtgcggccgatctctcatccgatgagatggaagctgcgattgaggccgaacttggcggtcgtcgtcgctgattgatgggctgattacggcattattaaccctgatttgctgaaatcattgcgtcgcgtgcaagggacacccttataataaatgttcaacgggtgtcctgagtcgtacggagtctcgtccggcctgggccagagcggggccacagaatgacgcagagcatgggagccggctttttcagccgcctgacgcgccttcctgacggcgtggcgggtgaggttgggcagccggcccgtccccgtatcgtgcggcagttcgagctgaccgaaaaagtcctcagttatgcccccaatgctgatacggatctgatcgacgccgcctatgtgctggcgatgcgtgcgcatgggcagcaggtacgcgacaatggcgatccctatattacgcaccctctggcagtggctgatattctggccggataccggctggatgtcggcagcatcatcaccgggctgctgcatgacacgattgaggatacacagctaagccttgcccagatcgaggagcgtttcggaactgaaatcgccggcctcgtcgatggtgtgaccaagctgacccggttggaactccagtccgaccgcaccaagcaggcggaaaatttccgtaagctcgttctggccatgagcaaggatatccgcgtgctgctggtcaagctcgcggaccggctgcacaatatgcgcaccctgcatttcgtgcgctccgacgcgcgccgccagcgcatcagccgcgagacgatggaaatctatgcccctctcgccgaccgcatcggtatggaggaggtgaagaccgagcttcagactctggccttcgcacagctggagaccgaagcctacgacaccatcatggcacggctgaacttcctgcgtggccgcggggccgatgtgatcgaggaagtgaaggccgagcttcgtcgtgtgtgcgaggatcatggcgttacggtgatcgaagtcacgggacgggaaaaatcccctttctcgatctgggaaaaaatgcagcgccgcagtgtggcgttcgagcagttatccgatatcatggcgttccgcatcgtcgtgccgacgcgggcggattgttacgccgcgctgggtgcggtgcacgcgacctatccggtgattgccggacggttcaaggattatatctccacccccaaggcaaatggctatcaaagcctgcacaccggcgtcaccctgcgggagccgcgcaaccagaagatcgaggtgcagatccgcacccgtgatatggatgacgtcgcggataacggcgtggccgcgcactgggcctataaagacgggcaggagatgctgcccagcgaagtgcagcgtttccgctgggtgcaggatctgctcgaaattctcgacaattccgcagctcctgacgagtttctggagaataccaaactcgaattatatcaggatcaggttttctgctttacgcccaaaggtcagttgatccagttgccacgcggggcgaccccggtggatttcgcttatgctgtgcatagtcagatcggtgatacctgtgtaggcgcgcgtgtgaatggccgtctgctgccgttgcggcacgaattgcagaatggtgatcaggtcgaaattctgacggcccgtggcggcacccccagcccgcaatgggaacgcttctgcgtcaccggcaaggcgcgggcacgcatccgccgctatgtgcatcagcaacagaagcaactccatgtggatgaaggccgtgccatgttggccaaggccttccggcaggaagggttggatggtagcgagaaggtgcttgatgcagccctgaaaacgctgaagcagcctacgctggatgatctttataccgctgttggcaatggcaatatcgggccgaaggaggtggtgcatgccgcctatccggaattgcggcccgctgcgcgtgcgccgcgtatgctgcatggcctgccgccgcgtccgtcctcccgtccggctggtcgtgccgagagcggtatggctattaccggcctggtctccgggatggcggttcattatgccggatgctgccatcctctgccgggggatcgtattgtcggcatcgttgccactggcaagggtgtgaccatccatacgcgggactgtccgacgctggaaagttttgcgtccacgcctgagcgtttcattgatgtggactgggacagtgccatgatggaacgcggcaatgagggcaagcgcggtgatctttatacgggacgtatcagcgtgatcgcctccaatgagggaaatgctctggccaatatcaccaacgctatcgccaagcaggacggggcggtgatgaatttaaaaatcgttaatcggcagcaggatttctttgaaattctgattgatgtgaatgtgcgtgatgtacgccatctttctcatgtgattgcgggtctgcgtgctgcgtcgagcatcacccaggtcgagcgtgcacggagttgaatacacggatgatgacggcatgatcatcggcattggctcggatatctgtgacatccgacgcatcgaaacagtgctggaacggcatggggagcggtttctgagccgggtgtttaccacggcggaaagggccaaggccgaacgccgtaatggccgtatgcgcatgggaacctatgccaagcgtttcgcggccaaggaagcctgcgccaaggcacttggcaccggttttgccgggggggtattcatgtctgatcttggggtcgtcaacctttcttccggccagccgacactgcgtctgacaggcggggcggcggcaaggctgagtgctatgacgccgtccggtatgggggcgcaggtcctgctgacgatgacggatgaatacccgtacgcctatgcgcaggtggtgatttcggctgtgcctcttccgacctctctcattggtggccgggggctgccttgacaggcggggaggcgcccggcatcccttgcgccctatccatgcggcttacaataatatccggacaaccataacgatgtcagaacgcaaatccggcttctggagcaatgtagtcgtgatcgtctacgcagctctcattgccattggttttcggactttccttttcgagccttttaatattccctccggatcgatgatcccgacattgcaggtcggtgattatctgtttgtctccaaatatgcttacgggtattcgcacttctcgctgccattttcgcccgatcttttttccgggcgcattttcggcagcttgccgcatcgcggggatgttgtggtattccgcctgccgaccgatacgtcgaccagctatatcaagcgcgtgatagggctgccgggtgatacggtgcagatgcgcgagggccacctgttcatcaatggcacagaggttccgcgtaaggaacatggcgtttacaccattgagggtgagggcagctctccggtaccggaagaagacaaattatatgtcgaggatttacccggtaagagcgggcaaagcggggtggatcatttgatcctgaaacgctcggatcatgaaatgctcgacaatacgccggaattcaaagtcccggccgggcatttctttgcgatgggtgataatcgggataacagtcaggacagccgggtcatgtcggtcgtcggatttgtgccggtagaaaacctgattggccgtgcagagtttattttcttctccgtgcatgcaaccgccccctggtatcaggtgtgggaatggccgttggaaatccgctggaatcgtttgttcaggagcatccactgaacgccgtccggtcggttcagatgaggcatccatgagcgcgacatcagccagtcaatcgaaatatgccgggattgctgaccgttccctggaggctgctgaggctctcctgagccatcgctttgcccggcgtgatctgctggccgaggcgctgacacatcgctccgccgtcaaaataatgcatggccaaacggggcagagcctgccgcgtggcgccgggtccaatgagcggctggaattcgttggcgaccgggtcctgggactggtggtggccgaatggctggtggagcgttttccgttggagcaggaaggcgaattggggcgccgtttagcgcatctggtatcccagccggttctggccgggatcgccgaacaatccgggctgccgcaaatcctgtctgtggcgcccggtgaggcaaaggccggtgtccgcaagctggcaactgttttgtccgatgcgatggaggctctgatcggcgcactctatctcgatgcgggcctggacccggtgcggcagtttatccggcgccattgggagccggtgatgcagcggcagacagaaccgccgaaagatgccaaaacagctttgcaggaatgggcgcagggtcttggccttcatctgcccacctatcgtctggcacgtcgcgagggaccgccgcataacccggtattctgggtggaggttttggtaggtgatcatgtcgggcaggggcaggcgggcagcaagcgtgccgccgagcaactggcggcgcaggacttgctgggccgtatacgagacaagacaggaccagatcgggatcggaacggatgagcggcggtaaagagagtgcagacgatatgagcccccctgatcccacccggtcagacctccatgaagggacattttctgctgaaaacaggctgggcggctctggcaagacacggtgcggttacgccgctctgctgggtgcaccgaacgcgggtaaatcgaccctggtcaatgcactgaccggtgccaaagtgtcgatcgtctcgcccaaggcgcagacgacccgctttcgcgttctcggcatcgccatgcaccagacggaagccggagagacatcccagattctgatggtggatacgcccggtatcttcacgccgcgtcgccgtctggatcgggccatggttgccgcggcatggaccggtgttcaggatgccgatctcggtctcttgatggtcgatgcccgtgccggtctgaccgaggatgtgcgggcgattatcgagcgtctgggcaaccggcgcacctggcttgtgctgaacaaggttgatctggttcccgcgccgagcctgctcccgctggcacaggcgttgagcgatctggccaaattcgaggaaaccttcttcatcagcgcggcgaagcgggatgggctggacatgctgctgacagcgctggcccaggccatgccgcctggtccgcatctctatccggatgatgatctgaccgatctgccggaccgtctactggccgccgagatcgtgcgcgagcagattttcctgcaaacccatgaggaaatcccttattccgccactgtcgagacggaggcgtttcaggagcgtcccgacggctccgcccggattgaggcgacagtttatgtggcgcggcccggccataaggcaatcctgatcggggcggggggcagccgcatcaagcagattggcgcacgggcgcggcaggaattgtcgtctctgctggatcggccggtgcatctgttcctcaatgtgaaggaacgggctggctgggatgaggaaaccgcccggctgcgtgcgattggcctcgaagatccgggctgagtgtctctccggttgcagaccggttacagagggatggcctgatggaatggacggcgccctgtatcgtgttgagtgcccagccttacggtgaggcagactgtttggctgcggtcttttccgaggatcaaggactgtatagaggactggtccgtggtggtacatcgcggcagcgcggcggtatctggcagccgggcaacctcgttatggcacgttggacggcgaggttggccgatcagcttggctccctgacggcggagttgatccatccggctgctgcgctggccatggatgatccccttaatctggccgtgctgcggtccctttgcaccgttgcggaaggcgcattgccagaccgggaggcacatcccgccgcttttatacccttgcccggtctgctgacacgcctctcgcttggcggggggcaggtggttgaggatgccatacgatgggaagcgatcttgctgcgggagcttggctacggcctcgatcttcagcgttgtgctgtaacggggcaggtgagcggtctgcattacgtctcgccgcgtacgggccgcgctgtctcatcagacgcggcagagccatggctggaccggcttttgccgctaccggctttcctgttgcatcaggcggaaaccgacagtgatccggtcgcctggcgggacggattacggctcaccgggtattttttatcgcgggatgtgttcggaacccggcatcgccctcttcccccggcgcgcatgtcgctatacgaccgtatcgcggcactgacggaaacggaacgtgaacatgcctgacgacatgataggccgggttgaggataccaggctggcggatgccttgtcggagcgatatctggcgtatgcactgtccaccattatggcgcgttccctgccggatgtccgtgatgggctgaagcctgtgcatcggcggctgatttacgcgatgcatcagctgcggcttgatcccgatgccggcttcaagaaatgcgcccgtatcgtcggggatgtgatcggtaaatatcatcctcacggcgattccgcggcttatgaggctttggtgcgtctggcccaggatttcgcctcccgttatccgctggtcgatgggcagggcaatttcggcaatatcgatggcgatggggcggcagcctatcgctataccgaggcccgactgaccgaagtcgcccgcaccatgctggaaggcattgatgacgatgcggttgatctccgcccgacctacaatgctgaagaagtcgaaccggccgtgctgcccgctgcttttcccaatctgcttgccaatggggcggcagggattgcggttggtatggcaacgtcgatcccgccccataatgccggacaggtctgtgatgccgctctggcgctgatcgagaacccacaggccgatacggcgatgctgctggatcatctgaaaggcccggattttccgaccggtggcattctggtggaagatcgtgcctcaatgcttcaggcctacgagaccgggcggggtggcttccgtgtccgggcacgctggcacaaggaggatggtcgtctcggcagttggcgtatcatcatcaccgaaattccctatcaggtgcagaaggcccggctgatcgagcaggtggcggcactgatggaggagaaaaagctgcctctgctcgccgatatccgtgatgaaagcaccgaaaccgtccgtatcgtgctggagcctaaatcccgcaccatcgctcccgatgtgctgatggaaacgatgttccgtgccaccgcgctggaaagccgtttcccgctgaacatgaacgtgctggacgccacccgcaccccccgtgtgatgggggtgaaggaggttctgcggcaatggctggatcaccggcatgaagtgctgatccgccgctccacccatcgtttggcgtcgatcgaccggcgtcttgaaattctggatggcttcctgctggtttacctcaacctcgatgaggttattcgcatcgtacgggaggaagacgagccgaaagccgcgttgatcgcggcattttccctgaccgatatgcaggccgaaagtgtgctgaacatgcgcctgcgctccctgcgcaagctggaggaaatggagatcaggcgtgaacacgccaaactcagcaaggaacgcaaggatctggatgcgctgctgaagagtgaacctctgcgctggaaacgcattgcccatgaagtggcagcggtccgggatcagttcggcagtggcaagctgggtgatcgccgcacggatattgcaggcccccccgccacggtcgaggttgcggccgaagcctttgtggagagggagccgatcaccgtcatcctgtccgaaaagggctggatgcgggcactgaaaggccatatcgcggatacggtcgagcttcgtttcaaggagggagatgccctgcgttttgctctgccctgcgagactacggaccggctctgtctgctcgccaccaatggcaaggcctacacgctgaaagccgccgatctgccgcgcgggcgtggtgacggccagcccgtgcgcctgctggctggtttcggcaatgaggatgacgtcattgccctgctggttccgaaggaagaagcacgctacctgctggtctcgtcagcggggcgtggttttgtaatccgtggtgccgatctgctggcggagaagcgcaccgggcgccaggcgctgaacgtcaagccgggtgaggaagccgctttctgtgtgccggcagagggtgatcatgtcgctgtgatcagcgagagccggaaactgctggttttcccactggaacaggtaccggaaatggcccgtggggctggcgtgatcctgaacaagggcggtgcgccacgcgacatcatggtgcttacgctggctcatgggctgagctggatgtccggagaaaaacagcgggtggagcgcgatctttcctactggctcggggcgcggggacaatctgggaaggttccgcccaacggattcccgaaatcgggccggttcaggaactgaattttattcctgaccggtggaaaacccggtggcggatggtctgaacagtggccgggtctgttcttcctgttcctcaatatcagcctgtgtgagaggtcgccatgctccacgggacaggatttctgccggttgataggctgatttataggccattttacggctgttcgcgacccaatagcccagatagagatagggcagtccttccgccttcgtctgtgcgaccatggacaggatggcgtagctgcccaacgagcgctgcggcagatcgggatcgtagaagctgtagactgcggacagcccgtcattcagccggtcggtcagacaggcacagagcaggacatcatcctgatccctgaattccagaatgctggtctggatcggcgtatcctcgaccatggcgcggtaatcggtaaaacccatcgccgccatatcgccatcaccgtgacggcttttctggtaacgctggaacagcatgaactgctcgtgtgttgcttgtgcgggcacgtcgaacatctcgactccggcattggtgcggttgatgcgtcgccttgtgcgggtcagacggaaatcattgaccgcgatccggatgggaacgcaggcattacagccctgacagaccggagcataagcaatgttgtggctgcgccggaatcctgcacgcgacagccggttatgcagagtttccgcatccgggccggtgatttcggtgacgaccttccgctccatgcgcccgtcgagataggggcatggcgaggcaccggtcgtatagaaaaactgcggccgatagagtggtttgctgtcattcatggggcattggccgggatcagatgcagaatggcttctatatgggatggctcctgcccgagcgggagggtctgtccatcccgccaaagcggaatgaaatctcgcgcatgggggctgaacacattacccgactgtccgggggcggcgatgaagcggctgcgcgtcagatcagccagatcgtaaaccccgcgataggaggctccatgcaagtcctcaaagtcaccatcagccagagtatgatcggcgccgatggcatgggatgtgccggcccgtccgactgtactgtcatcaccgctgaccgaagcggaggcctgcccgaccagtttcagcactggaatgcggctgagcagaggatggcggaatgtgacctgatgagcctgcccccattgccactctgccgcgcgagggccgtagagtgctttcaactgatgcacggtctcctccagggtccgggtgagctgttgggtgcagtctgatccgtcgcaccagtgggcgccggcatccgacaacagccacgcgctgaattccagcgggggaacggcagcatccggcaccgggacattggcctttgcgagtacggcgctgcggaaacgatccatccaggcattgaaaatgagtggggcagggctggactcggacatggtgccatcccatccggctagcaatgacagggccgtttcggtatcgccttcggcccggataagccgcaggcgaggtaacagcgtctgcgcaaacaggctgcgccgatcggtttgcatcgtgacaaaatcatccagactggccttacccgctccatccagcatttgccggatacggttggcccgccattctcccaacccgtcgcggcccagaaaagcctgattgccgaccggatcggaagttctcagccgttcattcgcgttgaccaaccgcccggaggagggggcgaggctgtgcggcagagcatctccgctgattgtgccggtccagtcatgcgagccatctgcaccggggacaggccagctgccatctccctccttgcgtagcggcaggcgaccggttgtaaagaccccgatcgtgtcatgatccgcaatcagcaggttctgtaccgggctggagatcagcggtgcagccagcgatgcttcctgtacactttgtgctttgttgagcatggcaagcccggcagaggccgtatcaccccgcatcaatccggttgcggacagggccatgaccggacccgaccggccagccagatcgctgatgacggggccatgccgggtttctcgcacggtcagggttacatcggtggcaccgcgcacatggatgatctcctgtcgcgtttcataagccagttttccgtccgggctggcgtaatgtccgggatcgagttcggtttcgatgaacagatcctgcgtatcggcgacgctggtggtgaaggtccaggcaatccggccattatggccgatgatcaaaaagggtgttcccggtgcggtcgctccgaccagaacatgatccggtgtctcgatccgggcgagataccacagacctggcagaccaaacgacaaatgcgggtctcctgccagaagtggtgctccggtcgcgctatgggcgccgtccacggcccattcattggacgcggtggagggcagggtgaatcgcgcgccctcctgtggcagcatagccagaaggtggcgggcagcctccgcaaagcggggagacaaaagcgcggcatcaacaggtttttccgtgctccctgccggccatagctccatgatgcggtctctgggtatggtcgctgccagttccgcacgcgccagttctgtccggtaattgccggacagatagagcatcatgctcttgccccagagcaggctgtccaccggagaccacggttcgggtgcactgctcagcaggaattcaggacttgagaaacgacctttttcctgaaaacgggcattaaccccgttcgcataggcaaccagcaaagccttcgtggcaggcggcagcgtctgcagatcggcctcggcgcgatggcgcagccccagcgtgcgcatcagcctgtcaagtggaagtgtggccgtgccagcaagctccgaaagcctgcccgacgcggcacggcgcatcagatccatctgaaacgcccggtcacgcgcatgcacatagccgagggtgaaggcggcatcctcatccgaccctgccttgatccatggaataccgtgtgcatcaaactggatcagggcttcctttcgcagcaggccggctctggccgtatgatcctgtgcaggcagggtaagccacaccgcaccagccacaagaccggcagccagcgcgatcatcacgcctgaaatggccagagtgcggcgtatcatccgcatcaaggctctgctcccggcgctgtttttgtcccgacacacacggaagcatttcccatggtgcagcgcccctcttataagacgtttcgcgcaaggatggaccgcgcatcgtcttatgggcaagcaatccctttcgaataaggattccgtactgcgtgattccttcatgaaccagccgcaaacacggtttgtccgctatctgctcaaaggtgctttttaccggctctcttatcgtgcgtgggggaagcccgatctgccacccctgatatgtgtgcatgcgctgacccggaatgctcatgatttcgatgtgcttgcgcgcgccatgtcggatcgtttccatgtcatctgccctgatctgccggggcggggtgcctcggactggttgccggatgcctccttgtatgagccccagaattatgtgactgcgcttgcgcatctgttgggggggatagaacaaccggtatcgtttctggggacttctctgggtggtctgtgcgggatgcttctggccagttcgctgggtcatccgattgaaaaactggtgctgaacgatattgggccccttattccgggacgctctttgtcacgaattcgggattacatgctgcgcgcaagaccggaattcccggatatgtgcggtctggaggcctatttaagacaggtgcacgcaggctttgggcctctgaccgatcgccagtgggaacgtctggcccgtcacagtgcccggactttggcggatgggcgcgtcgccttgcattacgatccgggcatcgcccggccaatgcgctccatgctggcgatcgacacgaatctctggcgggtctgggagaagatcagggtgccggtcatggtggtgcggggggaaagcagtgatgtgctgctgccggacactgtcgagcgtatggtgcggggcggtgccaccagtctggaggtgccgggatgcggtcatgcacccgccctgatggatcggcccagcattcaggcgatcaggcggtttttgctgggatcctgatgctgacagaaaaccctcctgactgcgcttccgaagtgcggtgatctgctttagagggggcatccgtcgagcgacacttgatttgtgacgtcaggagcctgtgtttccgcgttcatcacggaataagaaaggccggaccctgcggatacgggagagagaacgcatgcctgttgctattttcgtcaatgctgccggggctcgtcaggaagtagacgtcccgaatggtgtcaatctggttgaggcagcgattgataagggtgtgcaggaactggcagcgatttgcggggggtatctgcaatgcgcaacctgtcatgtgtttgtggaggaagattttctgaatcgtctgccgccgcgttcggttgatgaggattccatgctggacagtacagcagaaccaaggcgggagaacagccggctggcctgtcagatcgtgatgaatgacacgctgacaggtattgtcgtgcatatgcctgaccgacagatgtgatctgcctggcgtagctttaatgccctgtgctggacagcagattgatggtcaacaccccggcaataatcagcccgattcctgccagcgcggcggcatcgagtttctggcccagaaacacgacgccgatcagggcgatggctgccgtgccgatgcccgaccagaccgcataagcggttcctaccggcatcgtgcgcagagcctgcgccagcatgaaaaaggctgctccgtaagcgagggcgatcactgcaatccagcctggtttgctgaagccttcggattgtttcaacccgaccgtgccaatcacttctgacagaatagccagaaggagccatgcgcctgctggcatgtcagccctccttcagtcgtctggcagcttcaggagcgaaataagtcaggatgccgtccgctccggcccggcggaaggaaagcaggctttccagcaccactttttcccggtcgagccagccattccggatcgcggccatgatcatcgcgtattcacccgagacctgataagcgaaagtcggcatgccgaaccggtccttgatccgccggataatgtccagatagggcatgcccggtttcaccatgaccatgtcggccccctcctgaatatccagtgcgacctcgcgaagtgcctcatcgctattggccggattcatctggtaggtttttttatctccccgcaatgcgccgcctgaaccgaccgcatcgcggaagggaccataaaaggcgctggcatatttggcggcatagctcatcagtcgcgtatgaataaaaccttcggcatccagcgcctggcggattgtaccgatgcgcccgtccatcatgtcggagggagccagaatatcgatcccggcccgtgcctgattcaatgcctgctgcaccagtgcctgaacactgtcgtcattatcgacatacaggatttcgcccggcagggttttctgtgccctcagcacgccatcctgaccgtgatccgtataggggtcgagcgccacatcgccgatcagcccgagttggggaaaatgctgcttcagcagacgtgtcgcctgacagatcagattatcgggattggcggattccgtaccctcggcattcttcaatcccggtggagtggcgggaaaaagagcaatggccgggattcccagccctgcggccggcccgacatgatccaccagccggtcgagcgaaacccgctgcacgccgggcatggaggtaatttcagtgagggcgttgttaccgtcctgaatgaagatcggccagatcagatcattgacgctcagcgtgtgctcggcaaccagacgcctggtccagtcatcgaccctattacggcgcagtcttgtggtcggaaaagagccgaaggtcacgctaagcctccaatgacagggcagaccgggatgacaggactaaaaatgctgccatcctttccgttcgaatggcatgacgcttccatccgatgcaagaacatgcacgccgggtttttgaccggagcgggcatggaaccgtccaatcctctgtaccggaataccgagagagtctgcgcgttgccgcagcgggaccgtgcaggagggtgaaacggccatgacgagttcataatcatccccgccggagaggcaaagcggcagatattccggcatgtgcctacgcgccgcatcggaaaggggaacagtgtcggcctcgaccagcgcatcaagacccgatgccgtgcagagatggccaagatcctgcaacagcccgtcagaaatatcggcggcggcctgcaccagactctgatcaatcaaccccagtctggggcttggcaggtgatagcgcccggccagaaaatcatccgggtcggccagcccctctgtcagtgccagcagcccgagtgcgccatcgccgatagtaccggtgacccatatctcatcatccgggcaggccccctgacgcctgactgccttacccggttcgaccgtaccgatgacggtcagggacagacaggccgggcccttgatggaggtggtgtccccgcccaataaagtgataccgaatatgccctgatcttcagccagcccggcagtaaaggctgtgaaccatggggccggatcggtcccgcgcggcagtgccagcgtcatcagatagtgcagcggtgcggcccccatcgccgccagatcggacagattgacccgcaacagcttgcgggcaagcagatgaggatcggtgcctggcagataatgcaccccctccaccatcgcatcggcagccaacacaagggagaggccggggggtggttgcagcagggctgcatcatcggtgaggttcagcccccccgctgcggcaagcggtgccagataacgggcgatcatgccgaattcgccgttatccggagggctgccgtagaaggatgggggaggggctgtcaccgttcagccttgctgacgctctccggcaaactcttccggtcgcaactggcgggccagtgcgttgaggatgccattgaccatgcgtggctcctccccctgaaaaaagccgtgggcgatatccagatattcgttgatgacgacacgcggcggtggaccgtctttcattcgtaattcgcaggcaccggcgcgcagcaaggcgcgcagcaccggatcaagtcgcgccagcggccattcggcaggcagcgcggtgatcagcaatggatcgatcacgtcctgttctttggtggccgcacggacgatgcgtgagaacagtggtacctcggcatccggaatacggccatcctcgaaaccatcctgacccggcagcgcgccaaggcggaaacgaacaaactgctcaatgacggcttcaaggctttcctgagcctgctcgccctgaaacagggcctgaacagctgcaacgcgagaggccgtgcgcggacgtgtgcgacggttcataaagacttctccacgcgacggcgcagggaaatctgcttcagggctgcaacggcggcctcggcacctttgttatggctgtgcattgcgctgtcagaaggaggcgcggaacggtccagagcctgctgtagggtcgagacggtgagcagaccattgcccagcgccagcacatcatccaatgccacgcgcatcaggccggccatcgcttcgcggcagatatggtcgtaatggtccgtatcgccttttaccacgcagccaagcgagatatagccatcgtagcggttattggcagagcgctgcacgatcgcgattgcctgaggtaactcgtaggctcccgccacatcggtgatctcgtaggtggctcccgcttcggtaagaatacgtgccgcgcctgcggtcagcccgtccacgacatcggtatagtaaggcgcacgcacgatcagcacatgcggaggcgctccgtcgatgacgggtgcggtgggaaagggggcgtcctgggtgctcatccgccgtgatggtccttcagatggcgctgttcgacgatattcaaaccgtatccttccagcgcgacgatgttcagatgggtattggatagcagaatcatgtccttgacacccagatcactcagaatctgcgcaccgattccatagctgcgcagggaggctgtggggcgcccggaggaggcaagcccggcgacacgggccgacaaacctgtggaactggtgttccgtaaaagaacaaccgcgccctcgccgagatcagcgatcatctgcatggcgctgtgcagggaggagctatgcggtccgcccagcacatcatccaccagatcgaccgcatgcatgcgcacagggaacggccgaccaggctccggagaacctttgaccagcacaagatgttcctcatactccaccgtattggcatagacgatgatccgccacgtgccgccgatttcgtggtgcagggtgttttcagacacctggcgcacgagtttttcggtgtgatggcggtaggaaatgagatcggcgatcgtgccgagcttcagattgtgatgctgtgcgaaggagaccagatctggcaaccgggccatggtgccgtcatcgttcatgatttcgcagatgacgccagacgggtagagtccggccagccgggcgatatccaccgcagcttcggtatggcctgccctcatcagcgtgccgccctcgcgggccatcaaaggaaacacatggccaggggtcacgatgtcatcccgggtggtttccggattgatcgcggtggccacggtatgggcgcggtcatgcgcggagataccggtgctgacgccatcccttgcctcgatggagacggtgaaggccgtctggtgacgcgtgccattggattggctcatcagcggcagaccgagctgttccacacggcgtctggtcaaggcgaggcagatcaggccgcgtgcgtaacgcgccatgaaattgatggcatccggtgttgcgaactgggccggaataaccagatcgccttcattttcccggtcctcatcatccaccagaatgaacatccggcccgcgcgggcctcttcgatgatttcactggccgggctgatataatcggtcaggctggcacgggcgatggaggcggtggccacttggctggcctgctgtacgttcgtcataaagcggctttcagttcatcttccttccgtcccgaggtcatgggtaacgctcaggcggtcaacatagcgtgcaagcatgtcgatttcgatattcacgcggcttcctgccaccagtgttccgatggtcgtgacggagcatgtatgcggaatgacattgacgccgaaaacgtcattctcaacctcgttcacggtcagggaaaccccgtcgaccgcaatgctgcctttctgcgcgatatagcgcgcaagatgggatggggcacggaagcgcattctggtggagccgtgttccggcagaacgaagataacctccgccaccccgtccacatggccggagacgatatggcctcccaactcatccccgattttcagggcgcgttcgaggttgatcatgctgttctggtgccagcttcccagcgttgttttggaaagcgtttccgccgatacctccgctacgaaagcggtatccccggcaaactcaacgactgtcaggcagcagccggaacaggcaatggaagcaccggtaaccgcccccgtcagaaatccttccggcgtggtgatggtcagccgcatatccgaaccgccttccagcgggctgatcgtggcaaccgagccgagaccggttacgatgccggtgaacatgtctcttcctttctcaattctgtcaccatatctgtgccgacagccttggtcgatacggcgtggaagcgcggcatgaccgaaagggtgggtaggctgagcgctcccgtagcggcgtatccgtctgcgcctatgatggcaggggcatgataccagacgatatcgtccacatgctcctcgcgtagcaaggaggcggcgatttgcccccccccttctaccagaatccatgtcagcccggcttcacccaatttttgtagtgcggtgcgcatgatcagccgccctgtttcaggggcaactggcactggcaggactttcgcccccgcttgctccagcgcggcacgccgagccggatcggcgtcatcggcacagagaatccatactggtcccgctccatcgtgcagcatgcgggcattcaggggcatccgcagccgggaatcggcaaccagtcgtaacagcggagtctgtcgtgccccggtgaggcggcaggtcaggctgggattgtcggccagaactgtcccgataccagtcaggattgcatcatggcgtgcccgtaccgcctgaacgtgatgccgggcctgtacaccggtgatccattgactttctccactggcggtggcgatgcgtccatccagtgttgacgcgagtttcagggtaacgcggggacgcccatagcgtaaacgatgcagaaaccctgccgtcacctgtgcggcttcttcttccagaacgcctgtgcgtacctcaatcccggcttcccgcaaccgggtgatgccgccaccatccacgcgcggatcaggatcacggagtgctacgacgactcgcgctataccggctgcaatcagcgcatcggaacagggtggggtgtgtccgtgatggcagcagggttcaagagtgacataggcagtggcactctgcgccagagttccggcctgagccagcgcctgcggctctgcatggggtctgccaccatgggcggtgacaccccgcccgacaactctgcctttatgcaggatgacacagcctacggatgggtttggccatgtttcccccctgtgccgtgccgccaacgccagcgccgcacgcataggcggcagatcgggatcgtcaggatgactcatcggattcttttgacgctgcctgtccgccgaggaaagtctggaaatcgcctgcatcgctgaaattccggtacacgctggcgaagcggacataggctacatcgtctacctccttcagtgtctgcatcaccaactcgccgatcagcttgctgggaatttcggtttctccgctgctttcaagctgccgtacaattccggtgatcattttttcgatccggtcgggatcaatgggacgtttccgcaaggcaatctgcaccgaacgggtcagcttgtcccggtcgaagaccacacgcctctgatccgtcttgaccacgatcagttcccgcaattgcacccgctcgaccgtagtaaagcgctgcatgcaggccgtgcaggagcgtctgcgccgtatagcggtgccatcatcggtgggccggctgtccttgacctgggtatcctcgtgtccacagaacgggcagcgcatgggatgcgatattccttacaaaaaacgccgccccattccccggctgcgggagaatcgacccgcaggatcaggaagtaggacggcgtgtaatctatcgcaccctgccgtatcgatcacctgcctccgtcatgacggaggcagatggcagggaagcggggtctcgaagcaggctctcagtgattgcgatagagcgggaaacgcttgcagagcgccttgacctcggcgccgacttcctgctcgacggcttcgttggagccgttttcgccagccttggacaagccttccaccacgcggtcgatcatcagcccgatctcgcggaattcagcctcgccaaagccgcgggacgtgccggccggcgtgccgagacgaatgccggaggtcacggcgggcttctgcgggtcgaacggaatggcgttcttgttggtggtgatatgggcgcggccgaggctctcatcagtggctttgccggtcacattcttcggacgcagatcgaccagcatcagatgggtgtcggtgccgccggacacaatggccagcccgcgttccaccagcgtggaagccagaaccttcgcattgttggcaacggattgctgataggtcttgaagtccggcttcagggcttccccgaaggcaacggccttggcagcgatgacatgcatcagcgggccaccttgcagaccggggaacacggcggtgttgaatttcttgcccagctcaaggtcattggtgaggatcatgccgccacgcgggccacgcagggtcttatgggtggtggtggtgaccacatgcgcatgcggcagcggggacggatagatgccggctgcgaccagaccggcgaaatgcgccatgtcgaccatgaaatacgcgccgacttcatctgcgaccttacggatgcgggggaagtcgataaagcgcggataggcagagccaccggcgatgatgatcttcggcttgtgctcgcgggcgagggcttccagctcctcataatccagcaggccgtcttccttgcggacgccgtactgaactgcgttgaaccacttgccgctgacggtgggggccgcaccatgggtcagatggccgccagcggcgaggctcatgcccagaatggtgtcgcccggcttggccagtgcgaagaacaccgcgccattggcctgtgcgccggaatgcggctgcacgttggcgaattcgcagccgaacagctgcttggcgcggtcaatggcgagctgctcggcgatgtcgaccgccgcgcaaccaccgtagtagcgcttgccgggataaccctcggcatatttattggtcaggacggaaccctgagcttccagaaccgccgcagaaacgatgttttcgctggcgatcagttcgataccgtcttcctgacggtgaaattctttttccagggccgcgaacaggtcgggatcagtatcggcgaggcgtgcgccgaaaaaggcatcaagggcggatgcggacattgtattcatccttggacggtcatgagagcaacttgattgcgtcagctaacacaatcgggacgtgtttggaaacaccgactatccttgcgcccgataggcgctgtcgatcacaggaagacgattataaaattccctggacaggctgctcagacatttccgacatggagaggcggttccgcatccataaggctttatttgtgctgaggagtcctccctctatgtcttctcctgatgcttcaatcacgggcaggcctgctcatagcctgttttcaagaaaaccgattaccgaaattgatgagcataagggtgagctgaagcgtgccctgaatgcctggcatatgatcgcattgggaatcggtgttatcatcggggcagggctgttttcactgaccgggcttgccgcgggtgattatgccgggccggcagtcgtgatcagcttcatgatcgctgccatcggctgcgggctggccggatgctgttactccgaactcgccagtatgatcccggtggcaggaagtgcctacacatatgcttatgccacactgggcgaactggtcggctggatcataggctgggatctggtgctggaatatgctgtgggcgccgctaccgttgcttccagctggaccagctatttcaaggtgttgcttgcccagttcgggcttgccctgccgccacgcctgaccgcatcgcccttcagcattgtggagctggcagatcattcccatgtgcacgggctgatcaaccttcccgcttttatcgttgtcgtggcggtgtcggtggttttgatgcgcggtgtgaccgggtcggcatggttgaatgccgtcatcgtcatgctgaaactcaccatcgtcgtgctggtgatcgtgctgggcgcatcctacgtgaataccgcgaattacgtgcctttcatcccggagaatacgggggagttcggccatttcggattatccggcgtgatgcggggtgcggcggtgatcttcttctcctatgtcggctttgatgccgtttcaactgcggcgcaggaggcttataatccccaacgtgacgtgccgctgggtattctcggttctttggtgatctgtgccattctctatgtcggcttcggcctggtgttgacggggatcgtcaattatcaggaactcggcgttatggtggataaaatggcgcctatttcgaccgccatttccagaacgccttatgaatggctgaaatccgccatctatgtcggtattctatgcggctacacgacagtggtgctggtactgctgatggggcagagccgggttttctattctatggcatcggacggattgttgcccgctatttttgcgcgcgttcatccgcaatggcgcaccccgtggctcaccaatctgctgttcatggttttcgcgggtgtgatggctgcttttgtgcccggctcgtggctgggagaggcgacttccatcggcacgctgctggcgttcattctggtctgcatcggcgtgatggtattgcgcaggactgatccggaccgtccacgtcggttcagaaccccttttgtcccgcttgtaccgttggtcggaatcctgttctgcggcgcgatgatgctatcgctggatatctggacatgggttcgtctgatcgcatggctgatcatcggactggtcgtgtttttcggttacagccggaaacggagcttgctggcgcgtcaggcggccatgaatgaggtgggctgatgtcaataaggaaaaggccggtgaaaaccggcctttctgatattgggatcgtctgaagaaaaagcagagcgggaatgatcagcgatcaccaccgaaccgcccgccaggtgcattgccgccgccaccgcccatgccgcctgcattgaaacgaccgacattgccaaacaattgctgcatccaggatgcctcgctgcccggggatggggttgcacgccggaccatactgacgggcgccgcatcatccttgccatagagcttgatgttcttcagcacaccgttctgatcgaacgagaccgtgaccacgttttgctggagaatgtcgttggtcccggcaatctgcatttcagtggtctgggtgatatagacccactggttattatcgaacgtggcttttgtcgtcggagagccgagcagagaagccacatccgcctgggtcgaggttccgggggtcagctctttcagcagatcgacatcgaccttattgccgcgaacgactctgtccggggcgaagaagctgcatccgcccaacagcgtggcggacagcgtcagcacggcaagagtgcgggatagggtggctgtgcggcgcaagacgtatcctcaatcggaatcggcgttcagcggaggtctacagacgcatgatggcctgccccttcggggtgtcatgcttggccgtttctgtcaatcacactgttgcgcgagcgatccttccaataagacacccaggcattccgcccgtgtggaaagggctatgaaaaaatggtggcagggcctgctttgccgtcagcttccaggtattctgacagtgctttatctcaggaagacgaatcgcgatgcagcccgaattttccagactgatccagcctgataccattcctgcgggcggcaggacggtcgatatcaaggcgcgtgccgaggaatgcgaagctattgccagccgactggggctggaggcagtggccgggttttcctgcgccttcgttctggaaccgcagcgcggcggcgtgattcgtgcccatggccggatggaggctgccgtcacccagacatgcgtggtcagccttgagcctttcagggcgaagatcaaagagagctttactctgcgtttgacgccggaacacaagcttaatcctgatttcgatatcgaggaggaagaagacgaagttccctataccggggatcagatcgatctcggtgaagtggcggtggagcagctggctctcaccctcgacccttacccccgcaagcccggcgtcacttttgaatcaggagaagacgaggcagcagacgatgaatccgcagagcaggccgaatcatcccgggagaatccgtttttgcgtctcgctgcgctgaaaaagccggtcaacgatctttaaaggggccgatgagcatggcttctgcgcattcacgcatttgaatcgaacagcgatctccgctacagagcgctccatacagtgtctatgaccggtcatggcagcccggttctggacgctgagtgtttttcttgcggtgtccgccggtctctgctagacgccgcgcctcacgactttgccgaactctcaaggggtttcgccgccaatggggcggttacaccccgtttgataataagaagggccgttccatggctgttccgaagaagaaaacctcgccctcacggcgtggcatgcgtcgcagccatcaggcgctgacgggtgaagcctataccgaatgctcgaattgtggcgagctgaagcgtccccatcatgtctgcggccattgcggccattatgatggccgtgaagttgctgctgccggaaattccggtcgtggcctgaagggcgtggtgcgggtctgatcagacccgcctgcatccggccattcggatatccggttacagtcagtcaggcagtataagggcatcagacgtggcctccaaaacggcggcagaccatttcaatcgtgattctttcgttctcgcaattgatgcgatggggggagaccacgcgccagagatcgtggtcgaaggcatggccatcgccgccgaacgccatccggatgcgcgctttctgctggttggggatgaaaccctgctggcccctttgctggcacgctggccgagggccgcttctgtttgtaccgtccggcacgcgcctgtaaaagtaacaggcgaaatgaaggcggccgctgcattgcggctccgggactcttccatgcggatcgctatcgacgcggtagcgcatggtgaagcatccggtgtcgtctccgcaggcaattcaggcgcgttgctggcactggccaaaatcattctcaagactttgcccggcattgatcgtccggcgctggcggctatcatgccatcggcgcggggcgatattctgatgctcgatctcggcgcgaatgtgctgtgtgatcctcgcaatctggttgaattcgcgatcatgggtgatgtctttgcgcgcagtgtgctgggcctgacggcgccgcgtatcgggcttctcaatgtgggatccgaggagcagaaaggcgacgaccgcattcgcaccgccgccgagatgttgcgcacgagccatctggcacagcaattccatggctttgtcgaaggccacgatattgcaggcgggacgaccgacgtcgtggttgcggacgggttttccggcaatatcgcgctcaagaccgccgaaggcacagcaaagatgctgggtggccttctgaagcagatatttaccagtacaattcttgcgcgtctgggctatctgctggcccgcggcgggttggagcgtctgcgggaatggcttgacccgcggcgttataatggcgcggttctcgtcggcctgaatggtgtcgtggtcaaatcgcatggcggaaccgacgcgcaggggtttgcacatgcggtcgacgtgggcatggatatggtatccaatcgttccagtgatcgcatccgtgaaggaatcgcaaaactggtcgaactttccggagcagcgcatcctgcccgggataaggatggaacagctcaactggctgaagcccgctagattttgcgggtaggaaacggaaaagagaaacgcgacgatgaagcgttccataatcgccggcgtcggcgcgtatttgcccagcactgtggtcagcaacgatgaattggcaaagcgtgtggacacgtctgatgcctggatccgtgagcggaccgggatagagcagcgttatcttgcaacggctgatgaaagctgtgcctttatggcggcccgtgccgctgagcgtgcccttgcccatgccggaatgacggcggatgacgtagacgctattctggtggcaaccagcacccccgatcaggtctttccggctgttgccgtacgggtgcaggctttgctgggggctaaaagaggatttggattcgacctttccgccgcgtgcagcggcttcgtgtatggcctgtccatgggtgatgcgctgatccgcagtggtcaggccaagggcgtgctggtgatcggggcggaggttttttcccgtctactggattgggatgaccggcgtaccaatgtgctgttcggggatggggccggagcggcttttctacgcgcatccacggataatgatgatccagcgcgaggcattctgtcgacacatctccattcggaaggagaattcggcgatatcctgttcattgacggggctaatggtgtcgctggtcatcccggcaccattgttatgaatggcagggaagttttccgccacgctgtcggtaaaatggcgcaggcggttgaggaagcaatggccgccaatgatctgaccccggccgatattgattggctggtgccgcatcaggccaatttgcgcatcattgaggcaatgggcaaaaagctggatctgccgccggaaaaggtggttgtgacggtcaaccggcatgccaacacatcggcagcgtctattccgctggcattgaatgaggcggtccaggatgggcgtatccagcccggctctgtcgtgctgatggaggcgctgggtggcggccttacctggggttccgcgattcttcgcatgtaatcataaagcctgtgccatctgcttatctgttgctgagatgcaacaggtaagtggtcatgcaagtgtttgatcctccgagatttgttgactgtttgcatcgacctccgtagcgtgtctgcatgcataccgtgacccgcgcgcatctggctgagacgatctatacgcaggtcggtttgtcgagaaatgactcggcactcctgcttgagacagtgcttgagcgcatgtcatccgcgcttgaggctggagaatcggtaaaaatcagcgggttcgggacattttctgtccgccagaaaggtcgccggatcggtcgtaatcccaagacggggattgaagtaccgatcatgccgcgccgcgttctggtcttccggcccagtcaggttttgaaagcacttgcaaacggactgacaccgccagccatcgctgatactggggatgacgaatgaccactgctgtggacggcttcccggagcaggggggaaatgagacagggccggatcatgatccggcggatgaagcttccagagcatcaaggctgcgcaaggcccccaccgcttttcgtacgatcagcgaggtggcggatgagcttcatattccccagcatgtgctgcgtttctgggaaaccaaatttccccaggtcaaaccgctgaagcgtggtgggggacgccgttattatcgtccggatgatattgcccttctgcgccgtatctcggatttgctgtatattcaaggctataccatcaaaggtgtacagcggctgctcagggaaggcggcggccggctgtcggataatattccacccccgcgtgctgatgaacgcgcggatatcgacgctggaaccgggcaggggggattatcctcttccgtttcctccgggcgtccagtgcaggtggaggcttcttctggtgagatttctcagactcagacatcttctgcatctgaaacggccatggaggcagagatcaaacgcctccgtgttgctcttcagcaaactcatgacgcgttgctcgaagagcgcagcagggctgatcatctccgttccctgctggaagcattaatcgatgagttgggtgatattcgtcaggttttgccataagcaataaccttgacgatttttgtcgggctgtgcggtgtccggtgaggactgaaaccctctgagcattctccccatgtatgtttcttgggttcgctctcttgcgaaaggaacgtccccctgctacacggcacccacattgacgggcagtagcgcagcctggtagcgcatcagtctgggggactgggggtcgtgggttcgaatcccgcctgcccgatatgaaaaaggccggttcttacaggaaccggcctttttcattggatgatgcctcagtcgcgatgccagctgaccgggatcggggacgtggcggaatgattccagacctcgtgcccacgatactcgatggtgcaggccggcattgtcagtgtggcaagcaggcgattacccgtgaattgcccctgaaagacattgctgccgattgtttccttgaaaaaaccgttctcgttgatcagaggcgtaaaaaccagaccggacgagtaggcataggtaatggaatgatcgccgacggtgaatatgcctgcgtggggcgccatgcagccgggcgaagctcctgcgatgatacgggcatgtgccttgtaactggcatcatgcaagctgagcgggtaataaactggcttcccggcccgtaaatcaggatcgggttgggaacaggcggatagcccgatcagaaggattgcaatggcggctggcttgttcatggcagtctgtcctcggctgacgggcagataggcggcagtatccggcagcagagccatgattctgaccgatcttgttgtttcattacctcggtggaggaaaggcggcaacggcctcacgaagggaaagccatgacagaagaaaagccggttgtggtttatgccacctgcgctgatgaggaagaggcgcgccgcatcggacgggccttgattgaggcttgtctggccgcctgcgtgaacatgcggccccatacagcgatttatcgctggaacggccagattgaggaaggagctgaatttggtcttctgatcaagacgaccgcctcacagcaggaggccgcgatggctttgatcaggcagatgcacagttatgagctgccgggcattctctgtctgcatgtggcgggaggagatcccgcctatttgcaatggatatgcgacaatgcaggtggtcagcggtgaggatggcaatctcaggccggtatcatgatgatcacggccgcctgggcggcgatgccctcctcacggcccgtaaagccaagtttctcgctggttgttgccttgactgaaatcttgtcgatggagactcccagcagctcagccagacgggcgatcatggccggcgcgtgaggcgtaattttcggcttttcgcagatcagcgtaagatcggcattggccagaaaaccgccccgcgccgcgatgcgctcagccgcatgacgcaggaagcgggcgctgtccgcatctttccagcttgcttcggtcggcgggaaatgccgaccgatatctccctcagccagcgcaccgtaaatggcatcgcacagcgcatgaatgccgacatcagcatctgaatgtccggccagtccctgatgatgtggaacctcaataccgcatagaatcagcttccggcctgtttcgaaggcatgcacatcgtaaccggtgccgatgcgcgggatcatggagatggacatgctacgctccactcgggccagatcggccggataggtgactttgatattgtcttccgccccggggaccagagccacggaatgcccggcctgatccagcagggcggcgtcgtcggttgcgcccccgggatggtcccggtgaagtgccagcagaacggaaaatttgaacgcctgcggcgtctgggcacgatacagcccctcgcgagggacggttgagtcgataatattgcctgccgcacgctttagcgtatcggcgacggggacggcgggaatggcaccgtcgtggatttgcagagcctcgatcagatcttcaatggtgtgatcgggaaaataggggcgtgcggcatcatggatcagtacgatatcaggtgcatagggcaccaaagcttccaaaccggcacggacactgtcctgccgttcttttccgccatcaacaatcggtagatggtccagaccctgcagaaggggtgcgatatcgtcagcacacccgaccggttgcagcagatcgaccttcgccgacagacgctcggctccatgcctgatcagcggctttccgcctaccggcaagaattgtttgggaatatcgctgccgaagcgtgagccactgccgccagctacgagaatcgctgcaatacgcatgcgcggggtgtgttccggtggcgggtttctgtcaaccagtgatgtcctatccctgacgatcagttagaaaggggtatcatagaagcaagcgatgaaagaagtattcaggctattttaataataattacactaatgatatattaattatggcattacagagtgattgattttttgaaagatttatcacgatagtgtttgttgtttgttataagaaagtatctgatatagagcatcctatcggtgtactgtctgcaacattttggatgctctgccgacgcattgactaaggattatttaattattttgaaatctgccatctctgtgttgcttgttgaggatgacggtggcgtacgtgacgtcattcttgcagggctgtcgggccgtggatttgtggtggctgccgctgaaagtggcgagtccgctctggaagtgctcagagaacatggtggctttgatgtggtgatcagtgacatctgcatgccgggtatgtcgggctttgatctgcgtcagaaagtcatggcgctttatccagacacgtattgcatcctgatttcaggttatactgactgtgtgtcagagcctgttcccatcctccgcaagccattcaggctttcacaactggaggacaggatcagattgtggcagatggggagtcagcagcaataacgtcctgggtcaggcgttattcctttagctgcgccggatagtctcagcggcggcccgttataacccccaccagaaagccgatccctgctgcaatgccgagtgctgtcatggggtaatcagccgtaaagcttttgacagtatcacaggtctcagccagtgcgctttgtgcctcaccatatctctgtcgagccttgccgtggatctcggtttcagtatctccggtcagccggccgattccttcctgtactttgccggccagtttttctgccttgccttcaaattcttcagcttgagacatttattttgttctctctctgttcttatgggccggtcctgtcatcctgaccgtattctgctctggcaacgccgggcctgtgggcaggttgcgtgacaagacaatatgataaccccgatcattgcctgtctctatggggtgacagaatgcctttctcgttgcatgctgtctgcgaagttgtcgggcattgatgttcggcgcgggataaacgtcacaatataaacagagcactttgtgccagcaggggaccgtaccatggcagacagtccattgaatgaagtcgcacatcatatcgcgatccggccgcaatacgaaaatttcatcggtgggcgttgggttgcaccggtcaaaggtcagtatttcgacaatatttctcccattaatgggcaggttatctgcaagatcgcccgctcatcggctgaagatatcgaactggctctggacgccgcccacaaggcgcgggaaggctgggggcgtacggcaccggctgagcgtgcgcgcgtcctgctgcgtattgccgaccgtatggaagaaaagctggagcgtctggcgctggcggagaccattgataacggcaagccgatcagggaaacgactgcggccgatattccgctggcgatcgaccatttccgctattttgcaggcgttttgcggtctcaggaaggctcgatcagcgagatcgatcacgataccgtcgcctatcatttccatgagccgctgggtgtggtcgggcagatcatcccatggaacttcccgctgctgatggcttgctggaagctggcgccggctctggcgggcggcaactgcgtggtgatgaagcccgccgagcagacccccatgagcatcatggtgctcatggagatcatcggtgatcttctgccggaaggcgtgctgaacatcgtcaatggtttcggtgtggaagctggcaagccgctggcccagaacaagcgtatcgccaagatcgccttcaccggtgaaaccaccaccggtcgtctgatcatgcaatatgcctctgaaaacctgatcccggtgacgctggagctgggtggcaaaagcccgaacatcttcttcgaggatgttgccgccgaggatgatgatttcttcgacaaggcgctggaaggctttgccctgtttgcgctcaatcagggcgaggtctgtacctgtcccagccgcgctctgatccatgaaaaaatttatgatcgcttcatggaagctgcgacccggcgtgtgcaggcgatcaagcagggcaacccgctcgattccagcaccatgatcggtgcacaggcctcgaacgatcaattggagaaaatcctgtcctacatcgatatcgggcagcaggaaggtgcgaagctccgcaccggcggtcagcgtgtgaggccgggtggcgatctggataacggtttctatgtcgcgccgaccattctggaaggccacaacaagatgcgcgtgttccaggaagaaatcttcggtccggtcgtagctgtcacccgcttcaaggatgaagcggaggcgctctccatcgccaacgacacgctgtacggccttggggcaggcgtgtggagccgtgatggcaaccgtgcctatcgcatgggccgtggtattcaggccgggcgagtctggaccaactgctaccacctctatccggctcatgcggccttcggtggctataagcagtccggcatcgggcgtgaaacccacaagatgatgctggatcactatcagcagaccaagaacctgctggtcagctatagcccgaagaagctcggcttcttctgatcctgcccggctacactccgggccagataagtcatccggcccggacaagcggggaggaaaggcaatgccaatggttgatcgcgtcacaatcaccccggccgcagcggaggtaatcgaccgcttgaggggcattcatggggatctgattttccatcagtccggcggctgttgtgatggcagcgcccccatgtgctacccacgaggcgatttcagggtcggtcagcaggatgtcctgctgggtcgtatccatgactgtgatttctatatgggagccgcccagttcgattactggcgtcatacccaattgattattgatgtcgttccgggacgcggctccggtttttcactggaagccccggaaggggttcgttttctgaccagaagccgcgtctttaccgatgatgagtggcatattctggaagcgcagggcgatccgccgcgcggagcgtccaactgagtgtcagaaacgaaaaaagcgcccggatacgttccgggcgcttttttgtgcgggtagccgacttatttctcggcgaaagctttttcgtagacgaaggcaccgggggaggagttgttaccctcatccagtccttctttttccagcaaactcttgatatcggccagcatcgcttcactcccgcagatcatggcgcggtcatgttccgggtccagacggggcaggcccagatcctgataaagcttgccgttttccatcaaggtggtcaggcgtccctgattacggaacggctcccgcgtgacggtgggatagtacagcagcttttcccgcgccagttcaccgatgaattcgtgttctttcagatcgttttccagcagctgggcataggcgtgctcgtcggcaaaacgggtgccgtgggtgatgatcaccttctcgaaacgctcataagtttcgggatcgcgcaccaggctgaggaacggtgcaagaccggtgccggtcgaaagcagatacaggttgcgtccgggccgcagattgtccagcagcagagtgccagtgggcttgcggccgaccagaacctcatccccgacctgaatatgttgcaggcgggaggtcagcgggccattcggaaccttgatgctgaggaattccagatgttcctcgtaattcgcactggccacgctgtaggcgcgtagcagaggcttcggcttttcgtcctctgtcatcagcccgatcatcacgaactggccgttctcgaaccggaagctcatgtcgcggctgagggtgaagctgaacagccggtccgtccagtgatgcacgctcagcactttctgggcggcgaggctcgcggggatcgacgccgggtcgatcagagccggcggccgggcagcgtcgatcacatcggtcacagcgttcatggggcctccctgttcatatcagtctttctctccctgaacacagagagagcagccaatggcatcttcgcaccggcgacacaataagatgcgaatcgttcgcaaatactgtaccgtgcaggaaaagacggcaagtagccatccatctctatgacgacaagaggaatttgcgcggaatctgttcgtgcagccctgctatccacagaacggaggcgttcttaaatgaattccccgcgcaggaagcccaatgcagggaccggacgccatgctttcggcagatcagcgcgccgtataggggccacggtatagctgggcagcggctggcggcaggatcgcagaaaaccggtataggaccgcacctgctgtatcctccagtcccggtcttgaagggcggcatcgcggctggggaatatctccgcgatccttctgcgtcgcccgacggaggcgatgacggcccagagcgtatcatcccgtctatgtgtaatactgatgacctggctcaaggaaccccctgaatggtggccgacgatagagcggttcatcatgaagtcagtcgatagctggcttcaagcataaagccgggctgctattctttataataggcggcttgggggaattccttgaggcgaagcgccccggtggaatccacactgagattgatcgtatcgaacggcgtctgttcatccgcagtatcagcggggtcagagtccagggtgatcgcccgcccgtcagcatgccagtcacccatattggcgcgatggtaggacccataagacagatcccactggaaccgcccatccggatgcagcatcagatcagaatgtgcctgaggaataccgcgtaacacatagcgtcctgcaaaagcctcttccgttttgccggcaagagcagtctggcttgctgaaatcatcagaaagacggtggtaatcaggcaggagcgcatcttgatcgtcattattgtcagtcagcgatcatggcagacaaagccacgttgcaggacgacaaagggatgaacaataaaatggggacaggcagggggaaaatggtgcccaagggcggaatcgaaccaccgacactgcgattttcagtcgcatgctctaccaactgagctacttgggcactgccgctaccggcggggcaggagttagcgcagcccgaagccgggatcaagatgggtgacgacaatatgacgcttttattcgtcgtcggatgattcgggctgctctgccgggggaccgggaattcgataatcttcctgtaaccagcggccaagatcgacatccgcgcagcggcggctgcaaaatggcatatagctgtgatcgaacgtagaatcggagcctgatttgttgcagatcggacagcgggaggcattcattgcaacatgatcctcagagtcgggggtggaaaggctgatggaacagcccatgggatcgaaaatacggtcagtctgtttccggacagatagcccgatcccctcgcaaagcgggatcagagatcagaatcggcagcagaccggtctcgtgccggaactcctccaatgcactgctatccctgctcaaggcctcgtgaaccgcgggagaaagacgcaggctcggctgtctgccgggatttttgatgctccagcgccatccctgtcgcaaaacggccaaagccgccgcgtgcgggccttgcagcatttcatgcaaaggtggacggagacgctggcgtgagatttccgcgaaaccgagcgcggtgaatccgtgcagacggggatgaagcgggtcttcggccaatgcttccgtcagaggggcggcaaaactcggccttttgcgggcctgaacgcccgccagatccagcaaaatggcacctgacaggtttcgtaaccgtatctgccgggcaatagagggcagaatcgcgtgattgatctgcatctgggcgcgatttttggagtctcgtgccgcactggccgaccccgcatcgacatccagtgccaccagtgctgcggtcggctgaacatgcagcatggccccccccggcagcagggcatcaggggtagcaagggctgcgatatcggcttgcaaagcctcatcccagaccggctctacggccatcctcacacgctccccatagattggccgcagggaggcgaacacagcgtggttatcaacgaggattatggcaccaggaaaggcgacggcgagatcatccagcccggtcgggccgcgatggagcaggaggggagaggccccctccggcatgtcatgcgccggggccggtatggtggccagtctcggtccttttccacctgatgccgatcgggtcacccggacaaaaacgggttcccctgttttgggcagagaggcatggcatgcgctgtcaggcagaaacccttccgcaccatcaggcagagccacgaatgcgcccgccatggcggaaacccgcgctatgacccggccacggtacatatccccgaatccatcgggccgaccgggccggtcgatcatgaaatcaagcagttgatcgttctgtgtcagggcaacccgacgctcgccgggcgagcaggagactcgaaggaaaagggaaagcggagattcggataatccgctcatctcagagcgaacggaaacccagcccgcgcagcagctgggcggtctcgaacaaaggcagcccgacgacattgctgtagctgccggacaggaaacggatataggcggccgccagaccctgaatggcataaccgccggccttgccgcgccattcgccggaggcgatgtaggcttcctgttggagatcagtcatccggttgaaagtgacggcgctttcgacgattcgctcggcccgtttgccgtcgggggcaatcaccaccaccgtggtccagacatgatgacgccgaccggagagcagcgtaaggcattgccttgcctcggcctcggtttcggctttcgggagcgcgcggcgaccaaccgcaacaacagtatccgccgcgagaataaacggggcagccaatggagcgtcagattgttccctgagcacgcgaatggccgtgtccgccttgccttgggcaagacggcgggagagaaggcgtggaacctcccctttaagtggaacctcccctttaaggggtgtttcgtcgatgtcggttgcaagggtcagggccggtatgaccccgatctgggccagcagggccgcccggcgaggactggcggaggccagtacaagcgggcacgcggtggccggttgatccggcatcacgtcaggaacccgcccgcttatttgaagcggaaggtgatgcggcccttggtcaggtcatagggcgtcatttcgacgttgacccggtcacctgccagcacgcggatacggttcttccgcatcttgccgctggtatgagccagaatagaatgctcattgtccagcttgacgcgaaacatcgcgttggggagcagctccatgacggtgccgctgaactcgatcatgtcctctttagacatcagaactcttcaattgtgtcgattgcgggcggaacatggggcgtggcggcctccacgtcaaggaaaccatgcggggggcaggtccgcgctgggtgcctgatggcagaaaagcaacagcaaacaagcgtggcagggatcactgccccagtcgcagggcgatgcttctggcatgggcctgcaaaccctcggcctccgccaatgtcacagcggcgggaccgatgcgctgcaatccgctttcctcggcggcgatccaggtggtccgcttcagaaaatcgaacaccgacaggccggaggcaaagcgggccgtccggttggttggcagaacgtgattggggcctgcgacataatcccccagcgcttccggacagaaactgccgaggaaggctgcgccggcatggcggatacgggcaaacaggccggcaggatcatcggtcatgatctgaagatgctccggagccagacgatcagtcagccgggctgcttcatcccagtcccgtgccagaatgatcgcgccgtgatcgcgccagctggccccggcaatggtggcgcggggcagggagggaatttcctgttccaccgctgccgccacagcgtcggcaaaggccgggtcgatggtgatcagaatggattgcgcggcttcgtcatgctcggcctgtgccagcaggtcgacagcaacccggcgcggagactgggccgcatcggccagcaccacgacttctgacgggccggcgatactgtcgattcccacccgcccgaatacctgccgcttggcttcggcaacataggcattgccgggaccgaccacgcgatccacccgcccgatcgtagcggtaccataagcgaaggctcccaccgcctgagcgccgccgatccggtagatttcagagacaccggacaggcgcgccgctgccagcaccagaggattcagcaccccgtccggcgcgggaacgcacatggcgatgcgctccacccccgccacgcgagccgggattgcattcatcagcacggaggatggataggccgccttgccacccggcacatacagcccgaccgcatccagcgcgttccagcgcatgccgagggtgatgccatcctcatcatccagcagcagatcgcgcggcatctgggcgcgatgaaaccgctcgatgcgctttgccgccagcgccagcgcttcggtctggtcggaggggacgcgggcaatggcggcgttgatctcagcctcctgcacccgcattgtctctggtgtcagggtcaggcggtcgaaacgggcggtgtattccagcaccgcgtcatcaccgcgtgcggcgacatcggccagaattgcggccactgcctgatcgacggtggcgccgctttcacggggggaattcagaaacgctgcaaaacgggcctcgaaatccgtggcgcgcgtatcaaaacgctgcattctggctctccgctcaggcgttcagggcggcgcggaagcgggcaatccagttgccgattgcctccgggcgggttttcagggcggtgcggttgacgatcagccggctggtgacatcggcgatgacctgcgtttccaccaatccattggctttcagggtggagccggtctgaaccagatccacaatcacccgcgacaggccgaggctcggggccagctccatcgcgccattcagatgaacgatttcggcctgcacaccgctggcggcaaaatgcctgcgtgcaatgttgggatatttggaggcaacccgcacccgcgaccatgtgcgcggattgtcctgcccggctgttgccaccggctctgccacgctgatgcggcaggcaccgattttcagatccagtggcgcgtagatttccggatagtcgaattccatcaatacatcggcgccgcagataccgatctgtgcaccaccgaaggcgacgaacgtggctacatcgaatggacgtacccgcaccacgtccaatgccggatcatgggtcggaaagcgcagacggcggctgctttcatccgcataatcggcggcgggatgaatcccgaccttatccagcagaggctggcattcggcgagaatacggcctttcggcagggccagcaccagcggtgcatccagcatggcggtgctatccccgccccctgccgacacggcggtacccggagaatggaaagaggtgccgggagcgtcaccggctgtcagcggaacggtcatgcgcgccgtctacaccggcagacgcggcgggaaaaggccgcatgacacctgattgcgggctatcaggcgcaatacagccatccggtcgcctctggcctgatggagagagcgggtttatcccatcctgaaccagggcggagacagcaatgaccagtctttatgattttcaggcgaccatgctggatgggcaggtcgtaccgctgtcgcgctggcgtgggcaggtggcgctggtcgtcaatacggccagccgttgtggctttaccccgcaatatcaggggctggaagcgctctaccagcgttttgccgcttccggcttcgtggtgctgggtttcccgtgcaatcagttcggcgcgcaggagccgggcagcagtgaggagatcaggactttttgtgatacgcgctacagcgtcagtttcccgatgtttgcgcgggtggaagtcaatggcaccaacgcccatccgctgttcgattatctgacccgtcagcgccgcggcctgctggggacacggcgcatcaagtggaatttcaccaaattcctgattggacgggacggcgtgccggtggcccgctatgccccgtcctgcaagccggaaaagctggaaaaagcggtctaccggctactctgacggatcagaactttacattggccgcgaatgtgatcgtgcgtggcagccccaatatccattgctggctgccataagtggtgacggcataggcggtgtcgaacaggttggagacccgcgctgcaagactcaactgatcgaccggctgccagttcagacccagatcgaccacggtataggccgggcgcgcattggcattcgcgttgtcggcaaacgcccgcccgacaaagcgcagtccggcctgcgcctgccagcgtggtgcgaatgcccattccgtccagagattggcggtttgcagggggacattgggcggcgtgttgccattgcgtgagaccggaacaccgccggatgtttccgtaaaatcgtcaaaccgcgcctgaaggatgctgccattggcattgacgctccagcggggggtgatggaggcgctgacattcaactccagcccacgcgaggattgctgcccgatctgctgggtgacgccgggattattcggatcggccgaaagcagattatcccgcgtgatgtcataggcggcgaaggtccattgcagcctgccatcggccagatcctgcttgatcccgatctccccctgacggccatgcgacaggtcaaaggcggaattggcgaggtttgtggtgatcagcgtgctggtggggggcagaacgctggtcgaatactgtccgtagagagacagagtctgcacgggctgatagaccactccaacgcgccatgtcggagcatcataggttttatcgaatggcttcccggtggtgggcatcgcgttatgcaggtccagatgatcgaaccgcaccccggccagaatagagatccggcgcgtgatctgaagtctgtcttccagaaacggtgcaacctgccaggtggtggtctgaatatccttccggtttccggccagattgatgaagaaaccgggattgatattgtcgagcggaacctgtgacatacccccgaacggtgcattactgaaccggctgaagctgatgtagtttacctccatcccggcaccgagcgtattgccgagaccgaacagcgtatggcgccaggtgccatccagccggtcgccatattgttcctgctggtgcgtcagatcgagatagccgtcccgctgcaccatattgctggcaggcagagaacgataattctccgcattcacccaatgccggtttgtggagaggcggtaggcgatgttgcgcagggtcaggctggcggttggtgtccattcggcatggagattggtccagtcatcctcataatgcaggatgctgttctggacgttatagttctggtcgcgcagggaacggtccagcgatccacgcaccagtggaataccgtaataccgcatcggatcctgcatggcatgatcatgagagaccgtcacagtgaaatcctgactgggccggtagcgaagtgcgcccttcatatccagactgtccgaattgccacgctgaacatagccgctggacatctgcccggcgatatccagccggtagctgatggtccggctcagcgatccaccactatccagcgccagacggcgggtgaggttggtatccaacagcgctgcgacctcgttgcggatttttccctcgaaaggctggcgggagacgacgttgaccactgctcccaccgcgccctcgccgtagatgacggaggccgggccgtgcagcacttccagccgctctgtgctccatgtgtcgaaggggaaggtgacggtgccggcaccgggatagagcctgacaccgtcgaaaagctgcatcaccgcggcctgaccggtgaagccgcgagcgctcagcgcggtgccgccattgcccggcgtgccgatcatggtgatgccagcttcccggctgacggcggcatcgacgcgcagatcgccacgggcgcggatcgtgtcgccctccagcgtatcgacgctggccggggtctccatgggcgtgagacccagacggcttccggtggcgttgggctggttcagggagagtgtgccggtggcttcactcgtcacggcctgcccttgcactgacagggcaggcagggagctactctcctctgccgcaaaagccgcaggcgatggcagcaggcaaggtgttgcaaaagcaagcggccatagtctggaaaatctggttctggtgattttgtggttggcatgggcgtaccatgccgctccggaacgcccggagcgtcggaactggtctttcgtcatcatgtcccccatctccgggacaccccgcccggatggttgtgatccattgacgacggcaggtctcctggctcgcgatgtggaaacggcatacttccagccttcccggatcattccgatccagtggcagcccatcccggctggaaaccggagaggggcgcggaggatacctcatcgctgacagttgcgggggcagctgccgacttgccacccgaaggcagcgcacggcattccctttctcgcccgctcgcgcgggaccgtcgcgaacggttttttagcggaatgttacgggaaagacagcagcaaaatcttgctgctccaaggattttcaggcggtggcgggcttacgcagaagcatcacaatctgatcggtgatcagcgcatcccgatgataggcctccagcaaatgaggagggacttccagatcggtcgttgtccgatagtccctaatcacctcgaaacctgttgcttccgcaagactgcgtagttgcggagccgttacgcggttgagggtctcaaatgtctcccagagggctgcgcgttcggtcgcggtatctgcttcagggggaatatagacggcccatgcattacggacctgtgctgatgtttccggcgcattgaacaggcgtcgccggaactcatctgactgaagggagaggtgcgcccaaggttccaccagccagggcatcatgtgggaaccattcggagaataatacagcggatcaatctgcagaaaaaaatggccgccaggattgatgacatcgaagatcgactgcatcgcggaagacagcaggtcttgggaaacatgctcaaacactgaccagctgtagacaacgtcaaacatcccgaacgcttcaagactggcacccggagcaattttgcgcaggtgaaagtttgggggcagtttagaaagaccgagttgcgtccgcgccagaggcaggcactgctcgtatacatccagaacctccacacccaccatgcgctgaggctgcttgcggagcacggacccaagcgccatggttccttccccacatccaaattccagaacatcttttctgtataagccgccactttctgtcagccagtctgaaatgatgtccggcacagtgacaaacttggtatgatacagggggtcccgtatattttcgatcagctgttcgatctgcatcattggctccagaaagagtgggcagttgacagatgcctacccgctgatccgctcaatatccgcgccgcaggccgaaagtttttcggctacactctcgtaaccacgatccagatgatagacgcggttgacgatggtttcaccctccgcggccagcccggcgaggatcagtgacagggaggcgcggagatcggttgccatgaccggtgcgcccgagagttgggatactccgcggacgatggcggaggccccgtggacgttgatgcgggcacccatccggttcagttccggcacatgcatgaagcggttttcgaaaatggtttcggtaaccatggaggccccttccgccacggacatcagcaccatgtactgggcctgcatatcggtcggaaagccgggatagggctcggtcatcacatcgacgccatgcagaccgttgcggcggctgaccaacaggccggagtcctgttcctcaatctcgactccggcctcccgcagggtgcgggcgactgcccccagatgatccagccgggcattgcgcagcagcaggcggccaccagtaatggccgcagcgcaggcatagctgccggtttcgatccggtcgggaatgatactgtgttcagcgccatgcaggtgctttacgccttcgatccgcaattctccggtgccgatcccttcgattttagcgcccatggaaatcaggcaatgggcgagatcctcgatctccggctcccgtgccgcattgcgcagggtggtgatgccgtccgcgaggcttgccgccatcagcaggttttccgtagccccgaccgagggcatcggcagcacgatatccgccccgcgcaggcgaccctgaacccgggcgtcgatatagccgctttccagagtgatgacggcccccatctgctccagccctttgaggtgcatgtccaccgggcgtgtgccgatggcgcagccgccgggtagggagacgcgggcttccccacagcgagccagtagtggtccgagtaccagaacagaggcccgcattttccgcacgatgtcgtagggggcttcggtattggtgatctggccgccaagggaaaggatgcgacccagcggatcgagccgttccacagcgatgccgtgttgctcgatcaatgctttcatggtgccgatatcggcaaggcgcggaacattgttcaggaccagcctgtcatccgtcagcagaccgcaggccatgaccggaagagcggcatttttcgcgcctccaatagcaatttccccggccagcggatgcccgccgcgaatcctgatccgatccatattcttcagtcagctccgttcatgacgcgcattcctgccgggatggcagatgagagtgcctggtgagggtagagcaccttacatacggggaagggagacgccccgttgtcccatatatttgcctgccttgtcggcatagctggtctcgcagtcgctgtcgccgcgtagaaacaggaactggcaaatgccttcgcctgcgtaaatacgggcgggcaggggagtggtgttgctgatctcgatcgtgacctgcccctcccattccggttccagaggggtgacgttcacaatgatcccgcagcgtgcataggtggatttgcccagacagatcaccagaacattacgcggaatccggaaatactcgacggtatgggccagtgcaaagctgttaggggggataatgcagaccgggcctttgcgatccacgaagctggccgggctgaacgccttgggatcaacgacggctgaatccacattggtgaagattttgaactcatccgctacacgggcatcatagccgtagctggacaggccatagctgatcacgccgtcacgcttctgcgtttcgacgaacggctcgatcatgccgtgaccggtcgccatctgacgaatccagtgatcgggcattatggacatggcgatgaactccccgcacgcatcgtcggggtctatctcacccgcgttgcggggacaacagggggctttcttcggatgtctcgccgggcgccgttacagcagtcgtgagggagggggaagcagcctgacgggcgcgttgctgggccttgcggcgcagaagattggcacgaagagcctctgcctcccgcgcgcgtctttgggcagagggttcgggtgggcgtgcggaagcgccttcacggtcatcggggtgatgctcacgctcggtcatagcgggctttttgcgcggcgttctgacaaaatcaaggagtccagtcgtcgatattcgggatggtgtcggagagcagggcatcctgtgatgtcatggcactcccctgataagtctggaatgaggtgttctgatatggcttggccacaggggaggaaatgcgtaccggcaccccgaagatgctgaaatccggctcatcatcatctgtaacggggctctgctgggtggaggggatgttcatcccttgcccttttccatctgctgaaatggacgtgctgtgctttgcgcgtgcctgcgcgtcaggcgctgtggaaacaccacaggccagaaaggtcagggctgccagtgcgatgggaagacgatgtgccaccatgaggggcctccgggggtgtctatctatgtctgagtcttaaatagtattgcggcagctacgttgccaattaaaggcgcgtaaaaccataaaaatatattttgttaaaatatgtcaggtgttggcatgacgctttacatcaggcctgggccatgcagagggaaagaaaactatacagaataaaactgtgccgttgtcggaggattaatgccatcctgcacaaaacattccggagcattctgtcgatgagcggttcctttcctccttcaccatcttccggcccggttttttcagggctgtcgcgtgccggctcgggcattcttactctggaaggtatcctgttgctcattctcggcatcggagccttgctggtgccggttctggcggggatattcacagccggcatgatcggatggcttctgttcatcatcggcgcgataggactgatcagcacgctcgccagccgtcctcatctgcatctggcaggggggcttctgtcctcgctggctgcaattctggtcggattggtcgtggtgctgtttcccgccgggatggctgtagccctgtcctggctgatcgcggcatggcttatgatggacggcgtatcctcaatcatgatcgccacgaccgcacgccagatcaacgccggacggtggtggtggctggttatctccggtattgtcgactgggtgctggctttgatgattgctttcagtagtgcgacaaccggtattgcactggtgggcacgttgatcgggatcgatctgctgatcggtggtgtagcgatgctgggtctggcgcataatctgcgcgccggaacacgctgacggtcaatggagacggtttatgctgcgagcgtattcttgtaaaaacgaccgtctttcatgataattttgaaattcctgtctggattggcaatcagcgtaatgtctgtaagcggattgccatccaccagcagaagatcggcataggctcctttttccagcacgccgattttgcccggataagggctgcgtggcccgcataattgcagcaatgtgccattggtaccggttgccatgcgcaggatgtcagcattgccgtaccagcgcgtcagcgtggtcagaatggcaccctgatttttggtcatggccggattgaacaggatatccgtaccccatgcggtcttgattttatagtgtctggccagttgatatgcgcgatccgtgccagcaaacatggcaagctgtttggcgcgattttttgatccttccggatggggattggcaaattgattgtcgaggaaagcctgcaggcagagccagacatctttttccgccagcaatcttgcagttgcttcatccatcaactgaccatgctcgatacagcgtacgccgctatgcaccgcggtctggatcgcgcgggaggtgtaggcatggacggttacatacgtatgccagttctcggcgcaggcaacggcagccctgaattcggcttcggtatactggctgacatcaagcggatcataatgtgatgtcacgccgccgccggctgccagtttgatctgactggcaccgagcatcaactgctcccgaacccgcttgagcacctgatcgaccccatcggcgatcatatcggcgcccagcgtttcgctgtgggagaggggggctgccggcggggatggtatttcgtatggaaaacggaaatcaccatggccggaggtctgtgaaatcatcgcaccggatggccagatccgaggacctgcattcagcccgctatcaatagcccgtttgagtgcaaagcttggaccggccatatccctgatgctggtgaagcctcgcaacagggttctgtgcgcttcctccgctgcaatcagagtgatgtagccgatatcggctgtcatcaactcgctcatgggcaaggctgccatcatgctgtgccaatgtgcgtcgatcagacccggcatcagtgttccgccatggccatcaatgatcgtggctccgtccggtaagggggcgcctgcctgctcgatcgtatcgatcagattgtctttgacgacaagttgcagccctgattgtagagttttggaaacaccatcgaaaagctggatattcctgaacacaaccggggctgcgggaggggcgggaatcgcggctgaggcttctgtcaggtacagagaggctccgcccagtatggcggatgcaccggccagaaaagagcggcgagagaacttcgcttcaaccagcgcattgagcctggcaaatcccgggctgtgacagagacatggtccggtttctgccagatcgacagtgtcacatcgacgcatggccatctccgggctgatgtggtcggcaagagtctccagccaatccttagaacaaaggggaacatatagttcccctccgcaaaacagtcagaacaacagaggcatttttgcagacagtcgggggttgttccctgtttcaaccgggtgcgcagtcatacgcacccgactgaatcaaggatatcggattcaggcgcctgcgacgccttcaccgaccagtttctgcggatcgaccacccgattgaacgttgcctcgtccactttgccggatttgagtgctgcttcccggagcgttgaaccatcagcattcgccgcttcggcgatatgggccgcattgtcatagccgatgaccggagacaaggcagtgaccagcatcagcgactgatcaacgctcgcgtcgatgcgtgcgcgattcagctctgtgccctcaatggagtaaacgcgcatcttttcgcacatatcgccgaggatacgtgcggaatgcagtacattgttgatgatgatcgggcgcatggcattcagttcaaaattaccctgactgcctgcaaacgccaccgcattgtcttcgccgatcacctggatgcagaccatgaccatggcttcacactgggtgggattgaccttgccgggcatgatggaggaacccggctcgttctgcggcagcagcaattcacccaacccgcagcgtgggccggaggcaagccagcgaatatcattggcgatcttcatcagcgcgaccgccagtccacgcagggcagccgaggtggccaccattgcatcaagcgatccctgagccgagaacttgttcggcgcggtgataaagggtttgcccgtcagttcagcaatcgtctgagcaatatcatgcccgaagcccttcggcgcattcaggccggtccccacggcggttccaccggcagccagcttgtacagacccgctttggaggcgacgacattggcaatggcatcccgcacctgttgggcgtagccggaccattcctgaccaacggtcagcggtacggcatcctgaaggtgggtgcgacctgtcttgaccacgttcatccactggctcgccttggcttcaagcgaggccgcgaaggcttcagcctgcggcagcaggacggtatccagttccagtacggttgcgatatgcattgcggtcgggaatgtgtcgttggacgactggcccatattcacatggtcgttagggtgaaccggagcctgcgcacccagcgtgccccccagaagctggatcgcacggttggacaggacttcattgacgttcatgttcgactgggtgccggaacccgtctgccagacataaagcggaaaattgtcatccagcttaccggcaatggtctcctcggccgcctgaatgatgaccttggcacgccagtctgcaagccgtccggccttggtattcacgatggcggctgctttcttgacgtaaccgtaagcgtgataaacttctttcggcattttatcgttgccgatcgagaagtgcttcagcgacctctgtgtctgggcaccccagtaccgatttgccgggaccatcacggtacccatggaatcaaattcctggcgctcaccgggggcatcaaggccgatcgggacgtctttatagacaggattctggtcagtatcagacgaggaggggggattgctcatgtcggtattttttcccactggaaattagcggcctatcgaggatgccatgaaaatatagtagcgtaaattgctgcataatcatggctttctaaaaagaaaaatttataaaattcagcactcccttatcgtcgtacaggctttccttgtgccactatagataaagtcacgctccaaattattgttaacgaaaacttacaggatatgctggtggctattcaccctgtctggagaagaaataacattctggatgatggaaacacggatgccacagcattggttgctgatattgcgaccatcgtgcatacgaatggtcaggaaagcgaagagaccatccagctggtagcccgccttggtgccagtttcggtcaggtgatgtcagtcatcccccaatggggatttctgttgctgcgcaactcatcggctgtagacaattttcatccgcatattctgcctgccacgcctgatgccgttgtgatcgacagggttgctgcaaccagtcaggtggctgaggccctgatcgaggggcgcgttgatcctgaaaccgccaggcgacagctggccaaagccagaaacctgccggtttctccagatcatttttttgcgctcgcttgtgccattggggccgccgcgctttccgttacattcggtatatctcatctcctttctattattctgacgggcttgagcgcaggaacaggggcttatctgcgccgttttattgcccgggcagggggaaatgggctggtgcagagtttttgcgcagccctgctggctggcgtgatcggtgctgttgcaacacgactgaatctgagttcagaactacgtctgatcgcggtatgtccatgtatggtgctggttcccggaccgtttcttctcaacggaacactcgacctgctgggtaaccggatgccccttggcatagcgaggctgagtttcgccgggatgattttgctggccatcagtgccgggctgctgaccggattgttcctgtgtggcgtcaccttgccccctatgcctgccagccgggaagtggccctgtggataaccgctttggcaggaggagtcgcagcggcctgctacagtatatttttctcaatgcctcttcgtctgctgggctggcccatcattacagcaattgcggcagacactgcccgctggatcgcaatggccctgttcggggccgggccagtcattggcgccagcgtggcgggatttgtggcctccattgtgttgatgccggttgccagacgccatcatattccgtttgccggaattggttttgcatcggtggtgtcacttatgccgggtgtttttgtgttccgtatgtttgcagggcttttggctttgcagcatgcttcttccgcagacatgaccaccctgctggagggaacgctcacggatgggctgacggcgtttctggtggttgctgcgatgaccgttgcaatcgtggtgccgaaacacacctatgacgcatacagggcacggcacattgcgggatgaccgactgcgtttttgttcaaatgttgtgtcgtgcgactttgatttttatccattttgtaagcagctaagtgaggcagcgatatgatccgatgcgtcagaatgtggaccggcccggatggcaattcactcttcgaggaaggagtcatcaccctcaaggagggcgcgcgcggtgactttgtggggcttccgatcaagactcaatatatctcctttcaggagacaaaatccggtggatcctatgagtggcatcaggatccggtgccgcgtttcgtgatcactctttccgggacgcttgaatttgaaaccaaatccggtgcgaccttcaccatacgcccgggcgatattctgctggcgcaggataacagcggctctggccataaatggcggctgatcggagatgatccctggcgccgggcttatgtggtttatgaagagtcggaagatctccgtttcactcccgtgcctcacaaggaatcggctgaatgaccagctctgccaatttacgtcctgatattgtcctgatcggcgccggtatcatgggtgcaaccttcggcaccctgctgaaggaactcaacccgtcctacagcatgatgatgttcgagcgcctcagtgattgcgggcaggaaagctcgcaatcatggaacaatgcaggtacggggcatgcggccaattgcgagctgaattatacgcctcagcgccctgacggtacggtggaaattacccaggctctcagggtcaatacagagttcgatctgtcgcgccagctttggtcctatctggtgacgaagggagccattcctgatccccagtcctttatccatccgtgcccgcatatgagcatggtgtggggcgctgaaaacgtcgcttttctcaaggcgcgttttcaggcgatgtccgcccaccattgctatcatggcatggagtatacggaggatggggcacagatcgaaaaatgggctcccttgaccatggaggggcgtgatcccgccgagcctgttgcggcaacgcgtattattaccggcaccgatgtggattacggctccctgactcatctgcttgttgctcatctcaaggcgcagcctgacttcgaccttcattataataccgaggtagagggactggatcgggagccggatgggcgctggcgtgtcaccttcaaggatgtcaatagcggggaacgtcattctgtttccgccggcttcgtctttatcggtgctggcggggcttcgatcgatctgctgcaaaagtcgaatattcccgaaggaaagggatatggaggcttcccggtcagcggtatctggctgcgttgcgatgtggatgcggtcacacagcgtcatcatgccaaagtgtatggcaaggcttccagtggttccccgcctatgtcggtgccgcatctggatacgcgcgtgatcgacggcaagacgtctttgctgttcgggccttatgcgggtttctctacaaagttcctgaagcatggatcgctgaccgatctgtttggctcgattacccttcataatatcggacctttgctcgatgttggtcgacataacatagagctcactgagtatttgattgcgcaggttctgcagacgcatcatcatcagtttgaaatgctcaaggccttcttcccgaatgcgaaacgggcggactggaaagaggccgtcgccggacagcgtgtgcaggtgatcaagccttatccggatggcggtggctttctggagttcggcaccgaaatcgtgcctgcggcggatcattcactggtggctctgctgggagcatccccaggcgcctccacggcggcggctattgcgctggaggtgctggaagcctgctttgcggaccgcctgaccgatgatgcgtggctaccggccctcaagcggattattccgacctacgggatcgacctgcgtgaggatgctgaagcctgtcgtgccagccgggctgcaacggcttctgttctgaatatcgataacatctgatatggctgccccggataaaccaattcctgtttgtccggggtatgtctgttggattgcggccaatcgcgctgatcgagatgctgcggccagcaaattctttgcgcgctgatacgcccaagtcccctgatcgagtcctttgtacctgcacagcccacataaaacggtttgtagacatccgaccggaacgtcgtgcaccccggaagcccaggaagcgatggcgggccgcgccagacccggatgagcactatgtctacgctatagccctctagggcctgttagcgcctgaagtaggctctatgtcgctgacttttccgaacaggagaagcgtgcagatgctgagcgacgagcaatgggctgacttggaaccgctgatcgaggtgtgccgcccgcatgccaaggtgccgagcccgcacatgcggcggacgatcgacgcgatcctgttgcgtcatcagaacggggcgaagtggcggtctctgccggcggagttcggcccgtggtggatggcggctcagaccttcatccgctgggcgcgactcggcgtttgggagaagcttctagctctggttcaagaacgcggcgtcaggctgggcatggtgttcctggacgacaccaacgtccgagcgcatcagaaggcagccggtgccagccgaaagggggatctgcatcgggccgagacggccgtgaagcgcttggccgatctcgtggcggctatggcaccaaggcctgcgtgatggccgacggtgcagggcgcgccatcgccttccgcctcgcacctggccaggcccatgaactgccgaacgccgccccgctcctcgaccgcctgccgggcatgcccaaatgggtcgtggccgaccgcggctacaccagccatgccttccgccagcacatctgggacatgggcgctcgtcctgcgatcccgccgcttcgccacgaggcgaccgtcgcctgcccggactggatctacaacaaccgcaacagggtcgagcgcctttgggctcggctgaaggaatggcgcgccgttgccacccgctacgagaaaaccgccgtcagtttcctcggcgtcctctgccttgccgcagcgctcgattggatcaagcgctaacaggccctaaatccctcatcaggtggaacccgcgtccgatcgtgcttcaacggatcggtttggcacggcccgaccgtccggtgatattccttgacaggaatgacagcttgaagcgacgtcggaaacattcccgcttctccatgttcggcgagccgtcttgggaaatgccaatcgggaacagcttttgagaaaacgagggctgcctggcgcatacgaggaggatttttcccctacgttctcgctgtttgttcgtcgtctaaccgcgccggttgcaagtgcttttcgagatatcgcggccggaagcatggtcgtcttcgcggtcggtataggccgccgcatgatggggcttcgcgggttttcgagatatcgcggccggaagcatggtcgtcttcgcggtcggtataggccgccgcatgatggggcttcgcgggtgacccttcctatgttttcgacgcacttgatcgccaaagggtgtctggtgcaacgaacgtctcggaatgggtcagcctacgtcccggcaggacgtctcgttggcgccttgcgacgctggcgagctggggatcaaatggtggcaggcgtgctccggaacggttcgccggtggtcagcatggtgtgcatgatgacggcgagcttgcgggcgacggccaccgcggcgcgcttgaagccgagccgctctcgcagcttcagaccccatgtgcgcagatcggattgtgcccggctgcgggtgagcagcgatgtagcggcctcgtagagcaacccccgtaggtggctgtcgccccgccgggagatatgcccgtcatagtcgacctcgccggactggtagcgccgggtcgtcagtccgacccaggcaccgacggatcgagaccgcctgaagttgtccggttcctcgatcgcggcaatgaatgaggtggcggtcacgacaccgacgccggggatggacatgaggagttggcaggcatcgctgtgccgggcgtccgccagcagcgtgcggctcaactccgcggtgcgcaggcgaacggcacgccaggcttccatcaacgggcggatgatccggccgagatcggcatggtcggccagcagcgcttcgacctggcgctcgaacttgccgccggtgaccagcggcacgacgaggccgaacgtcttcatcaggccccggatctggttcgacaactccgtcccgatccgcaccagacgggtccgcgccgccaccagcgtgcgcgtcagcatgctgtcgaagctcttgacgcgaaccaccttgtagaacccgacctcggcaagatgggccaggccatcggcgtcgttggcgtcggtcttgttcgccgccatgtcgagcgcggccttggcatggcgcgcatcgatgcagatcgctggcagcccttccgcgctgagcgcatggaagaaccagacggacagtggtccggtctcgaacaccacccgcctggtggcaggcgcacgttcgcggatcagcgccgcaatcgtcttcggatccgacggacacttgccgcgccaaacccgcttgcctccccggcgaatggataccgcggtctctttcagcgaaacgtcgagcccgatatactcgttcatggctgttctccatcagatgcttgggcccggcttccggtcgtgagcccgttcttccatcttatcggggaacagccaccagcatccatctcgtgacagcccggagtaccgctcccgcgattaccccatgtttttgggagcgcgctggtcgctgccctttgtagacagcgactattgctggatcaggcgaggtccacgaccagcttatagccggaaatgccgtcgcgctgggcctcgatcgccggctggaacgcctctaattcgcgcccgacgatgcggggctcaggtgccgcaacatatctgccggaggccagcgccgatggcaggaaatctcggtagatcatcgggccgacctcgttatcgcgcaggctggtgcagaagatcgcgttgacctccacgccctcgggcacctcgatctgcggtggaagcgtggcggtgacgaagcggcgtccgtcggcgcggctgacgaccgcgaacgtgctggcaaggttgccggtggcgtggaacgcgcccgccagcgtcttgcccgcaagcgcggccacgacctgctccacggcatcggccgccctgtgatcgatcacccgtgtcgccccgagccggcgaacgaggtctgcattgcgcggcgacgcggtcgcgatcacctcataaccggaagcggtcgcgagttgcaccgcattgcagccgacgctcgacgacgctccccagatcagcacgacctcaccgctggcctgtggctcgagcgtggggtggcggaggccgagctgatccgcctggtagaggccgactgccgcggtgccgatgccgagcggcagaaccgcagctttggtcgcgtggaggtcgtcggggatcggcgcggccatatgtgccagcaccaccgtgtgctgctggaaggcgccctgcgccggctggttgaccgtggtgccgaccgcctggcccaacacccggtcgccgaccgcgaagcggtcgacgccttcgccgaccgccaccaccgtaccggcgacgtcgctaccgacgatcgcggggtagtcgagccacggcagcatggccatgtcctggagcagatagtcgagcggattgatgcctacggcctcgttgcgcaccaggatttcgcctgcgccgatcgccggcacctccgccgagccgatggcgagtggctcgcccggcttgcgctgccatgcagcgttgttttcggttgtcatggaattctctccgtcgcggtatctcccgctcaagatacggcgcctggcgttgcccgcaatggcatcgtctggcacacgttgttaccatgagatcaacaataggtatcggctcccatcgcgagctcctgacctttatggccgtggcaagcgagcgcagcttccgcggcgcggcgcgcgggggtatcgccatcggcgatcagccggacgatcggtcagctcgaggcgctgatcggggcgagactgctcaaccggacgacccgaagcgtaagcctcacgtcggcgggcgaactgctgctggcacgactgtcgccgctcatggcggcgatcgacgaggctgtgaacgaggttgcggcgacgagcgccacgccgggcggcaccgttcgcctgaacctgccgcggatcgcggcggaactggcgctgtcgccactgttcgtcgccttcgccgaggcgtttccgaaggtcacgctcgacctcaccatcgacgacggcatcagcgacatcgtcgccgacggcttcgacgcaggcatcaggatcggcggacggctcgtgcaggacatggccgcggtgccgctgacgcccgacatacggaatgcggtcgtgggctcgcccgcctatttcggcaagcgcccggcaccgcagcacccccgcgacctgctgcatcacgcctgcctcaactatcgctgggcgaaaacgcacgaggtctatcgctggcggttcgaggagaatgggcgcgcgctcgagctttcggtcgatggcggcctggtcgccagcgatacgggcgtcctgtgtgatgctgccctggcggggatgggattggcttgcttgccggaccttcttgtcgccccattggtcacctccggtcggcttgtgcgagtgttggagccctattgtcctattcaggcggggttctttctctattacccactgaacagacatccctcaggcgctctcagagcattcatcgacttcgctcgcgcgcaggccccgatcgcctagtttctgacgcgaacgacaaggacgatccagaccgtgatcgcagtgtgctttcgcgcggtagatgccgacgaatacgccaatcactggttccaaccgccgatcgcggcgatggtctgtccagtgatccacgacgcccgggatgaggcaaggaacaccaccaggtcggcgatctcttccgggcggcccagccttccccaaggcagcgtcgccaaggtcttggcataggcttccggcttcgtttggcggatgcggtcccactggccgcccgggaactcgatgaaccccggcgagacgcagttcacccggatgttcttggtcgccagcgtcaccgcctggatgccactgtagtggatcagggcggccttggccgcgccataggcgggggtggtaaccgaggacgccgggatcatgcccgacccgctgccgatgttgacgatcgccgcgccccccgctgcttccagatacggcagggcgtatcgcgacgcgcgcaccgcagccatgatgtcgacgtcgaagctcgccgtccagttcgcttcgtcgtctccgaacccgtaaccggtcgcgttgttgacgagcacatcgatgccgcccatcgcgtctgcggccgcttcgatgaaggtgcggatctcttcgtcctgtgaaagatcacagcgaaacgccccggttacatggccatgctccgcgattgcggctcgggcatcttccagcgcctcggcgcctcgcgcgcagatcgacaccgccgcgcccgcctccgcgcaagcgagcgcgatgctgcggccgatcccgcggctcgccccggccaccaccactttcctgcccgtcatgtcgatacgcatcgtcatcaatcctccttcgagaccgtcgttctcgacacgtttcccgctatcctgtcagttccgaccccagcaatcggctacaccctcaggaacgcgtctgacgccagttcggccctgtccggcggcatctgcgatgcgcgatgcgcgccccggcgtgctgaccagcacgaacggtacggcaatcagattgaccgccatcaccgcgagccagatcgcacccggccaacggtgctggacggcgaaataagcggcggagaatccgaggggggcgataatcgaggcgaggctgaccgaggaggcgagcaggccctgcaactgcccctgacggcctgtatcgacctgttcggtggcgagcgcctgcaaggcgggcgtgccgatcccgccgagcgcgaacaggggcatcagcgcgaacaccatccaaccttgtgtcgccaacgccatgccggtcagcgccagcgaagagcagccgagccccgctaacaccgccttgcgctcgccgagccatctggtcgccggaccgggcaggaacgcttgaacaagcgtttgccagactccgaatgcgccgagcgacagtccgacccaccagccattccatccgaaggcatcgtacccccacaaggcccagcagacgctgtacgcttcccctgcgccgctcagcgcgaaatagacgaggaccagcggcagcaggctgggcatcgcgaacagccagcgcatcggcgccagcgggttgagcgccacccgatcgaacggatgagatgacggcgcgtgtgtttcggggagcgcgaccagcgcgagcagcaggttcacggcggtgaaccctgccgccgcgatgaacgggagccgcacccaatgctcgcccagcacgccgcccagcaccgggccaacgatgaagcccgcgccgaacatcgcgctcaccagcccgaaccgacgcgcacgctgctcggccggcgtgatgtcagtgaggtaggcggtggcgaccgacatgttggcgccgctcagcccggcgacggcgcgccccagcatcagcatccagaactgcggcgccgccgccatcgcgaggtagttgaacgccgcgcccgccagcgaggccagcagcaccggccgacgcccgtagcggtcgctcagcacgccgaggacgggggcgaaaacgaactgcatcgccgcgtagagcgaggcgagccatccgacgtagcgtgtgacgtcgctgaggtgagtgacgttctggatcagccggggaaggatcggaaagaccagcccgatccccgccgcgtcgagcgcgacggtggcgtagatgacggcgagcgaccgccgggtcgtggcagcctcacccgacattgacaaactcgcgggccaggtggcccgatccatcccatgcggatggatcgacgtgccggatgagcggatagcgaacgagacaatgaccgaacccgaccaaaccctgcgtagcgaccgcctgtcgctcgtcccgctcgaacacagtcaccgcgccgcgctgctggcggcagccggcgatggctggctctgggagcttcgcttcaccaacgtgcccggttccgacacgatcgatgcctatgtggacgcggcgctgacggggcgcgcggggggcacggtcatcccctatgtcatcgtggtggacggcgaggtggtcggcagcacgcgcttctggaagctggatcgggcaaaccgcaaggtggagatcgggcatagctggatcgcagcctcctggcagcgtagcttcgtcaacaccgaagccaagtatctgatgctggtgcacgccttcgagcgtctcgattgcgtgcgggtgcaattcactaccgacgtcctcaacgagcgctcgcgtgccgccatcctgcggctcggcgcggtcgaggagggcatcgttcgtcacgagcggatcatgccggacgggcgcaagcgcgattccgtccgcttcagcatcatcgacgatgaatggccggacgtgaagcgcgggctggaggcgcgacgaggccgatccggccgcgcgtcgaccctagccaccgggccgccctaaccgcgccccgcgacgagcctggcgaagaggtcggcgacgctccggggcgcctcggagccaaagaacagcgagagattaccggcagactgctgcgcgatctcgtggctgcgcgggaacatcgccgtctcataggtagtaaaggcggcttccacgtcgtcgccgtgttcgaggattgcttgagcaagctcggcaccgtctagcatggccaagttggcgccttcgccagcgaacggcgacatgagatgcgcggcatcgccgaccagcgtcacgccgggcatccgcggccactcgacatcgggggcgagcgcgtagatcggacggatcgtcggcgcggcggtgctgccggtgatgaggtggagcaggtgcggtgcccagccggcgaactggtcggcgacgaaggccagccccgccgccctatcatcgaaatcgaccgagcgcacccattgctcgggccggttgagcgcgacatagcccgtcacgctgccgtcgccgtggcggtgcgcgatgatgcccttgccgggctccaccgccatcatcgtgccgtcgccgatggcggcgatgctggccgcatcggcgggatcgcctgcgccgagcgcgatctcgatgaagcaggtgcccgaatagatcggctgcgcgtcgtagatgagcggccgtacccgcgaccaggcgccgtccgcgccgaccagcaggtcaaccgtggctgacgagctgtcggcgaacgtgatgcggtggcctccatcggtcgacgtgaaggacacggccttgcgatcccagcggatcgtatcgacggggagcgacgccatcaacagcttgcgcagatcgccgcgctcgacctccgggcgcgtcgacgcctcgctgcccggcgcatcgaacagcacattgcccgcgctatcgacgacgcgcttggcgtcctcgccggggcggacgagcgtcaggaaggcgtcgtagaggcccgccgccttcagcgccggctgaccgctctcctcgtgcatgtcgagcaagccgccctgccagcgcgccgtcgccgacgcttcaccctcgtaaatgacagcctcgacaccatggcgatgaagaaccctggcgagtgtcagccccccaaggcctgcaccgacgataccgattgtcttcttcatgcacgcgctcccttatcggctcggcatcacatgatgccggcgatcgttaccggaagacgctggtcgccttgcatgagcgacgtatctgcggcggtctgaatgccttttgatccaagacgccgtttttcgcgacgccaacctcttatgtaagtccgaggatgccagcaaggctcgcgtcgcgtccgcgcaccaaggttacgatggcaaccccgtaggagcgaggccggctcggcttgaacggctagccattcgcgggcattctcaagcgccggccatacacgggtttcgagaagccactggtttccccgatacaggatcgattccaagaacgcctgcgccgtcccgccgggcgttcgtttacgggaagatttctatgtgacgaaggcgatgggctgcatatcgccacgcagcccatcgatcggttcaagcggccgcagcttcgatcgcgggctgaagagtttcgatgaagtcctccatcgtcgtctcgcgcatatccacggccttcgcaccgccacctgccactacagtcacgtcggcgatgccgatcacgccgagaaccagacggaggtactgcgtcgcgatgtcgcggtcgcggatcggcgagccttcggtgtagacgccgcccgacgccatcaacaccgtggctttcttgccggtgacgaggcccttgccgtcgaagccgagcgtcatgcccttgcgcacgatgctgtcgatccaggccttgagtgcggccgggacgttgtagttgtagaccagcgtcgcgaccacgaggtggtcgcaggcgaggagttcgccgacgagttcgtccgacagtgcaagctccgccttcatctcgggcgagtgctgctcggacggggtgaaatacgcttggagccatggcgcgccgatgaactgaagatcggtctccatcaggtcgcgggtcgtcacctcgccgtccgaatgggcggcctgccattcggcgacgaagccgcgcgtcatgttgcgcgagatcgaataattgccgcgtgggctggtttcgacgacgagaagcctggtcatgggtgttccttcttgagaacggatcagccgaagcggaagccggagatcggcttgccgagcgcatggccgtggaagtggacagtgccggcctcgcccgatgccgcgccggccgccaccatcagcggcaacaggtggtcttcatggggctgggcgacgcgagcgtatggtgcgtcttcccagcggatcagcgcctcgtcgcgcgtcgcgccgtcgatcatcgcggcgcgcagccaggcgtcgaaggcttccgccttatcgtccaccgccgccccgccgaagaagccgcgcatgttgtggtaggtctgaccgctgccgaggatcagcacgccctcgtcgcgcagcggcttcaacgcccgcccgatcgcgaggtgagcggcgggatcgaggccacgctgcatggagagcagcaccacgggcacatcggcaccgggcagcatcaccttcagcggcacgaagatgccgtggtcccagcctcgcttatcctcggcgccgttggcgatgccggcctccgacaacagctcgcgaacgcgtgccgccagatcgggttcgcccggtgcgggccagttcaggcgataggtgtagtcggggaacccgtcatagtcgaacagcagcggcgggcgtgcaccagcgttgacggtcggtacggcttcttcccaatgacccgagatggcgaggatggcacgcggcggctcttccagcgtcgccatgaagccgcgcagataggtttccagctcgcgccaggtgtcgcgcatcggtcccggctccaggaagaagcagggtccgccgccgtgattgatgaagaaggtcggttgcatgatccccgatatggcggctggacggagctagcgggagcgataaagatgtgatgatccttatcggctgaggtgatggatgatcggtagccttactctcgaccagctccgtgtcctcaccacgatcgcggacgcgggcagcttctccgccgccggacgcaagctcggccgggcgcagtccgcgatcagccaggcggtcgccacgctcgaagacgtgcagggcgtgatcttgttcgaccgatcgggcttccggccggtattgaccgatgtgggccgtgtgctggtggcacaggcacgtaccgtcctggccggcgccgcccagttcgaggccgtggcagcgggcacgcgcgagggggtcgagcccgaactggcggtcgcgatcgatccgctggtgccgaccgccgcgttcatcgacagcctgcacgcgctgcgcgctgcgtttccgttcctgccggtaagcttttcgaccgaagggctcggtggggccgagcgacggttgcggcgcggggatgccgcgctcgcgctctgcatcctgctgcctggcgtgcccgaagatgtggtggcgctgccgttgctcgggatcgacctcgtgccagtggtatcgccagcccacccgttagccggattgggccggtctgcgacgcctgccgatctggaggagcatgtccagctcgtcctgtcagacccggccgctccggacggtccgagctatggcatcatcggcaccaggccctggcggttcgtggacctcgcgcggcgactggacttcctgttggcgggcctgggatggtgccggatgccagagcatcttgtcgcgccatacctcgccgatggccgcttgctggccttggcgatcgaaggcgacccggcccgcgcgactggtccgctcacgatctacgccgctcgcatgcgggatcgcgcccttgggcgagcgggaagctggttgctgaacgagttacaggctcggctcgcttgatgacgaatcctgtttcatgatccgattggaaatacctggatcgtctcgaccgcacttcgcttgtgggaacgcgccggccggggaaggatgctgtttgatgcaagccgggcttcacgctgcctcagcctgtttgaaagacgatgcgctcgcgctcacccttgccccatgcttccgctacatcggcgagcgccacggcacgatagtcgagcgtcaggcttgcccctgccgcagccgtgaacatgcgtccggccgcagacatcatctggccgagcgagagactgccgatcccgcttccgagcagctcgatccgcgatgaacgcaggatgccggccggcagcgcgatctcctcgccggtgatcgatccgatctgcgtgaagcgcaccggcacgcccctgcgaccggccgcagccgccagcagcagcgcacgcgcgctcggaccccaaaggtaatccagaaccacgtccacgccggcgccgaaatgctcggccgcggcggcttggatagcctgctcgttgccgtcgaggcggatcgtggcgtcgacgccgagcgtgtcgagaacggcctggttgcgtcccgtcgcgatcacgcggcgcgcgcccaggtggcgggcgatggcgaccgcaagccgaccggacgcgccggtcgcgccgttcaccagcaccgtctcgcccgtttgcaacttcgcccgctccgttagggcaccccatgacgacacgccggcgttgccgatcgccgcagcggtcaggtcgtccacgtcgtcaggcagggccagccattggccgttcggcaccgtcacctgctcggccatcgagccttgcggcgcccgcggcatgacgaagaagacgcgggtgccatcatccagccgtccgacgccatcgaagccggcgatgaaggggaaggagccgcccgaggtgtagtgcgtacccgccgcccgaccccgcgtcagcggggtcaatgccgctgcgacgacatggatcgtcacctcgccctctgtcggcactggtgacgggaaatcgccatagatgggcacctgccctgcgtgttcgacaattgcggccttcatgttctgtctccgggtttggatcagggtcgggaaagggtatcgtcgcggccgcgctgggacgcgcggacgcagttcgccgcgtgggcgatgaggtaggccgggcccgttgcgcggtgtcagggtcggatggttttggtgatggcagcgttgagccgcccggggtcgtagtggcgctcgatcacctcttccctgaggccgagtccgcgcagcaggaacagcacggcgctcgcggtcagctcctcacgggtcatgccgtaatcgatcacctcttcgcctgacaggctgacgaggtggagggtgttggcgaggtggtggacgaaccacagctcgccgcgaccggcgtccgcgcccgcatgcaggtcgccggcagcgcgcgccgctaccagacagtcggcgaacagatcgacccatgggcgaacgtgccggtcaaggaaatcggtcgcgaaacgcccgtcatccagcaggctcgcggtgacgaggcgcttggtgtcgtcgtgcgcttgccgctcgccaatgccggggaagacggcctgcaccagtgtcgccacccccatgaccagcgtcgctgtcgatggctcggcatcgtccagcaggtgatggccgacctcctgcgcctggacgcaatggcgttcgagctgggcatagagcacgtccttggtcgggaaatgccgaaacagcaggccttcggacacgccggctgcgccggcgatgatcctggtggtggcgcccgcccgcccgagacgcgcgaagaccggcgtcgcggccgtcagaatggcgtgtttgcggtcgagggccgacaaacgtgaggctgttttggacatgacttgaatataagtaagtgagtacttacttgtcaatgccgattgagcgcctcgcgacgtcggtggcggatcggtacatgaaggcacggtccgccaaagagaggctcggtgccgcttgaagccatcccccggaacgcctaaattgctggtcgcctaaaaagaaagcgatgcgggtatggtgacaacctgcagtctctttcggagacagtcacgcttgagcgggtgatgctgctcttggccatggccggacacagcgaggattggacttgtaacggttttgtgccggtcacctatctcattaagccaccttggcttcgaaggcgagcgggctgatgccgcccagatatgaatggcggcggcgggtgttgtagaatccgttgatgtactgaaagatggcggcttctgcctgacgccgcgtcggccagctctgccgccagatgagttcggccttcagggatttgaagaaggtctcgacggacgcattgtcgtagcaatttcccttgccgctcatcgatggacgcagaccgtaggcctgcagctttttctgatagtcgtaagagcaatattggctgccgcgatccgaatggaaaaggcagccctcaggaggctggcgcaggcgcaccgccatatccagcgccctgatcgccaaatctttcttcatcctgtcgctgactgcccagcccacgacgcgacggctatgcaggtccagtataacggcgaggtagagccagccttcggatgtccagatatatgtgatgtcgccggcccatttacggttgggagcatctgcggcaaaatcgccgtccagccagttcgctgcgacacccaggcgatggtgactatcagtcgtaaccttgtgcttgcgcgtgcggactggcttgatcccgttgatcttcatcagccgcccgacccggcgctcgccaacatcgagccccacctccttcaactccatcgtcatgcgaggacggccttagctgccaaggctcagcctgtactgttctcggatatgggccagcactttcatatctgtccgctcccgccgactgatcgggcgcgagcgccaggaacgatagccgcgttcactgacatccatgacacggcagagcagttcaacgggccaacggtgtcgccagctatgcacaaacgcgaacttcacggcctttggctcgcgaagaactgcgtggccttttttagcacttccctctcctcccgcagcacacggttctcaaggcgaaggcgttcattctcacgcgccagttctgcctgcggcgctaccaccaggtcagatggccgatactgtgacacccatttgcccagcgtcgacttcccaatccccaaatccgatgcaacccggtcgcgcggcaatccgctggtcagcgcaatccgcaccgcctcctgcttgaactcttctgtgtgcttgatcatctcgtcggtctcctgttgcgagctctaatcgctcacgtgaccggcgcaaaaccgttacaagtccagaaaccggtcgtgccggtaacaaccgaggtatccaccgcgccggccgatcctatgcgcgaggcgctcgcccgctgccggttcatgggggaagtggcgacgcgcgatcccggttgtctgaagacatgggccgataatcggcgccgatttctcggattggagcgtgccgccgccccgcagccgaacggggagagatgagcgatgcagggcactggtgccatcgacagcttcctcggggtcttcacccgctacatcgacagcggcttcggccttgtgtcgggcgaagtcgcgttcatcgcgacgacgctgatcgtcatcgacgtgacgctggcggcgctgttctggtcgatgggcggcgaggacgacatcattggccgcctcatcaggaagacgctgttcgtcggcgtgttcgcgtacatcatcggcaactggaacaacctcgcccggatcgtcttcgacagcttcgccggtctcgggctgaaggcgtcgggcaccggcttctccgccgccgacctgatgcggccggggaaggtcgcgcagaccggcctcgacgcggggcgcccgctgctcgactcgatctccggcctgatgggctattggtcgttcttcgagaacttcatccagatcgcctgcctgctgttcgcctgggcgctgatcctgctcgccttcttcatcctcgccgtccagctcttcgtcacgctgatcgagttcaagctgaccacgctcgccggcttcgtgctcatcccgttcggcctgttcggcaagaccgccttcatggccgagcgcgtgctcggcaacatcatctcgtcgggtatcaaggtgctggtgctcgccgtcatcgtcgggatcggctcgacgctgttctcgcagttcaccgccgggttcggcggccggacgccgaccatcgacgacgcgatggcgatcgtgctcgccgcgctgtcgctgctcggtctcggcatcttcggccccggcatcgccaacggcctcgtctccggcggtccgcagctcggcgcgggtgccgcgatcggcaccgggctggcagccggcggcatggtagcggccggcggagccgctgccgccgcgcgcggtggcgcgtccaccgcctatcaggccggtgcggccggacagtccggtatggccagcgtcgcctccggtctcggcaacgtcgccagcgcgggcggaaaggcagcggtatcgcccctgaagcgcgccgccggccgcgcggccgacagccttcgctccagcttccaggctggcagccgcgccgtgagcggcgatgccgcgccggatggtgatggcggcgcgtctcccgcagctccagcggagggcggccagcccgtatgggccaagcgcatgaagcgctcgcagcaactcacccacggcgttcaggtcgccgcgcacgccgtgaaatccggtgatgcgcatggcggcggctcttccatctccctcaatcaaggcgaccgcccatgaatatcttcaaacgacccgccgcgcattacggcaagaccccgcagcccgagactccgtaccagcgcgccgcccaggtctgggacgaccgcatcggctccgcccgtgtgcaggcgcggaactggcgactgatggcgttcggctcgctggcgctctccgccggcctgtcggccgtgctagtctggcagtcggcgagcggctcgatcgtgccgtgggtggtgcaggtcgaccggctgggacaggcgcaggcggtggaaccggccaccgccggttatcgcccgaccgatccgcagatcgcattccatctcgcgcggttcgtcgaggaggtccgcagcatccccgccgacgcgatcgtcgtccggcagaactggctgcgcgcctacgacttcaccaccgcagcgggggcgcaggcgctcaacgactatgcccgcgccaacgacccgttcgcgaaggtcggcaagcagcagatcgccgtcgacgtgtcgtcggtcatccgcgcctcgcccgacagcttccgcgtcgcctggactgagcgacgctatcaggacggcagcctcgccgagacctcccgctggaccgcgatcctcaccgtcgtcgtccagccgccgcgcgacgccgaggcgctcaggaagaacccgctcggaatctacgtcaacgccatcaattggtcgaaggagatggggcagtgagcgcgcctctccgcagactcgccgcccccgccgtgctgctcgccgcgacgatgctcgccggctgcgcgaccacgcagaagccgcctgagatcagctacgatgccgaggtgccgccgctgccgcccgtgccggtgatcgccgcgccggcacgaccccagccgctgcacgtcccgccgccgtggacgccagcacgaggtggtcaacctgccggcacctcgaccgctcgcgtcgagaacgccaacgccgccgcccgcgtccagccgcgccgcgagggctattacaacgccatccaggtttacccgtggtcggaaggcgcgctctaccaggtctatgccgcggtcggacagatcaccgacatcgcgctcgaacccggcgagagcctgaccggcgccggcccgatcgcggccggcgacaccgcccgctggatcatcggcgacaccgcccgctggatcatcggcgacaccgcccgctggatcatcggcgacaccgagagtggatcgggcgacacccgccgcgtccatgtgctggtgaagccgacgcgcgccgacctcgccaccaacctcgtcatcaccaccgaccggcgtttctacatgatcgagctgcacgcaggcgagcggccctacatgccctccgtcgcgtggagctatccggccccgctgccttcgcagcagccggtggtgccggcgacgccgatcattccggcagcggccgagcgcacctaccgctacgcgctcaccggcgacgcgccgccgtggcggccggtctcggtctacgacgacggccggcacgtctacgtcgagttcccgcgcggcatcgtgcagggcgagatgccgccgctgttcgtcgtcggccccgagggcgagccggagatcgtcaacagccgcgtccacggcaatgtcctgatcgtcgaccggctgtttggcgccgccgagctgcggctcggcaagggcaatcgccagcagaccgtccgcatcctccgcaccgatgggaggccatcatcatgagcgccatcgatccccagcagaacgcaccgacccagccggacgccgacaacgacgcccggccgtttaccggcgagccggtcgcgccgatgcggctgcggcccgagccgccgcgcgtcacgcggctgtcgcgcaaggcattggcggtgctcggcagcgttgccggcgtcggtctcggcggtgcgctgatctacgcgcttcaggtccagcatggcggtaaaacaccagaagaggtctacgcgaccgataatcggtcgacgccagatggcctgaacgcgctgccgaaggattacaccggtccggtgctcggaccaccgctccccggcgatctcggccgcccgatcctcgacgcgcagaaccgcggccagccggtgccggtgtcggcgatcgatgcgccggctggacccagcgcgcccgatcccgaggtcgagcgccgccgccaggaacgggaacggcgtcggcaggaactggaggcggcccgcaccagtcgcgtcttcttccagtccggcgcgcaggccgccacggcgatggcaggtggtggaacaccgggcgacggaatgccgaacctcgtcggcatgggagcgtccggccagacggccacgcccaccgcgcaggaccggcagctcgccttcctcaaccaggccgccgaccggcgcactgtctcacccgaccgcgtgacgccaccgccatcgccgttcgtcgtgcaggccggcgcggtgatccccgccgcgctcgtcaccggcatccgttcggacctgcccggccagatcgtcgcgcaggtgaccgagaacgtctacgacagtccgaccgggcgcctgctgctgatcccgcagggcacgcggctgctcggccagtacgacagcggcgtcggtttcggccaacggcgcgtcctgctcgcctggacccggctcatcttccccaacggccgctcgatcgtgctggagcgccagcccggtgccgatgcgcaaggctatgccgggctggaggacggcatcgaccatcactggtgggatctcgccaaggccgccggcctgtcgacgctgctatcggtcggtgcgcaggccggcacgtccggcgagcagggcgatctcgtccgctcgctgcgccagggcgcgtcggacggcatctcgcagaccggccggcaggtggtcggccgccagctcgacatcgcgccgacgctgaccatccgccccggcttcccggtccgcgtgatcgtcgggcgcgatttgatcctcgaaccctatggagccgtcccatgaccaagctgaagctcggcccgatcgccgacgacaagcccgtgaaggtcacgctggaactgccggcggacctgcaccgcgatctaaccgcctatgccgaggtgctcgcccgcgagagcgcacaaccggcagccgatccggtgcggttgatcgcaccgatgctggagcggttcatggcgaccgaccgcgcgttcgcgaaagcgcggcgcacgatccgcgcgcccgacgctgcgatcggctgacgcgatcgaggtatcgcacgatgcccacttcaccgcgaagaacgagacggcaggatcgcagggcgggaccgtgccgcgacgaaccacaggatactgcatcgacatccgtgcccgaccgtcaccctagctccacccgtcgcgcaagccatgtcgccggcgtcctgcccgacgatctgtacgactactatgccgccgaacccgatccacggcgggggccagcgcccgccgccgaggcgaagaaatggcgagtcaccgacgactggcccgagcgcgtgccgatcacggaggccgagatcgaggtgttcgagcgctggttcgccgacctcttcgacgagctgttcggaccgaccggccgatagcggcgcgcgacggacgccacctgctgccgtcatttccctggaaagtgttgtctgttgatgataatgatcttggacagcatccggcccgcctgacgctcgcgtatggcccggccgctgccaggacgggagacatgcgcaccgtgacgacgctgacgatcggcatcgccgacaccgatgagatgaaggcccgcgcccggcgcatcatgcagggcgaggagcagcccgcgccgggcgagccggcggtctggttcggctcgaccgagtccttcgcacgcattctctccgccgccaaccgcgagatgctccgcctgatcgccgagcgcgagccggagtcgctcgacgcgctcgtcgcgctgaccggccgcgccaagccgaacctctcgcgcacgctgaaagccatgatcgcccacggcatcgtccgcatggagcgcagcgggcgcaagctcgcgcccaaggtcatccccgaccgcgtcgtgctggcgctggagctgatcccgacatcgaagaagcaaggagaccgcccgtgaacgccgagacgcccgtcatcgcccagcgcgccgcgctctacctgcgcgtctccaccgtccggcaggccgagcacgacgtgtcgatccccgaccagaagcgacagggcgaggcgtactgcacgtcgcgcggctaccggctggtcgacaccttcatcgaggccggcgcctcggccaccaacgaccgccgccccgagttccagcgcatgatcgaggcgggtacgtcgaagcccgcgccgttcgacgtggtcgtggtccactcgttcagccgcttcttccgcgatcacttcgaactggagttctacgtcaggaagttggcgaagaacggcgtgcgcctcgtctcgatcacgcaggagatgggcgacgacccgatgcacgtcatgatgcgccagatcatggcgctgttcgacgaatatcagtcgaaggagaatgccaagcacgtcctccgcgccttgaaggagaacgcccggcagggtttctggaacggctcgctgccgccgatcggctaccgcaccgtcgcggccgaacagcgcggcgccaagaccaagaagaagctggagatcgacccgctccacgcggacacgatccgcctgatctaccgcctcgcgctcggcgccgaggccgatcacagccagatgggcgtgaaggcgatcgtcaagcacctgaacgcccgcggcatcttcacccgcgacggcgggcgctggggcatcggtcaggtccaccgtatcctgacgcgccgcacctatatcggcgagcacgagttcaaccgccgctccaagaccaaggagaagaagcccgacgccgaagtggtgacggtcgcggtgccgccgctgatcgagcacgccacgttcgacgcggtgcaggcgctgatgaaggcgcgcaaccagaagaccgcgctgccccaccgcgtcgtcatcggcccgacgctgctcaccggcatctgcttctgcggcaattgcgggggcgcgatgaccatccgcaccggcaagggcgggcgctaccgctactatgcctgctcgatcaaggcgcggcagggcgagaccggctgcaagggccgcgcgatcccgatggacaggctcgacggcctagttgcccgccacatcgaggaccggctgctcgaccccgatcggctggaggaactgctggaaaccatcctcggccgccgcgaggaacagtccgagcgacgccgcgtccacatcgccgagctgaaccgccgcgccgccgaatcggagctgcgcctcaagcgcctctacgacgcgatcgaggcgggcgtcgccgacctcgacgatccggcgctcaaggagcgcatcgccggcctgaaggtcatccgcgaccagtcgcgcgtcgatgccgaccgggcgcaggcgatgctggagagcaccggcgagcgggcgatcacgccggagatggtcgggcgcctgtcacaggccgcgcgcgagcggatgcggctcgacgggggcggctatcggcgggatcatctgcgtgcgctcgcccagcgtgtcgaggtcggcgacgacgaggtccgcatcatgggatcgaaaagcgacctgctcaggacgctggtcgcagcagaaggagggaaatcggcggctatcggcgtgcccagccgaggaccgaagtggcggagagggtgggattcgaacccacggtacgcttgcacgtacggcggttttcaagaccgctgccttaaaccgctcggccacctctccgttgaggctctcctatcacagggttgggccgtggcaaagggtgggaacgatgctgaattgcatcatgttggttgaaaccgtcattccgtctcttttccatgcaacgaaggatgggcagaatacgcttcggactgttatcagcgtgtatttcatgacctgatccgtcaccctttcatgagccgaaaggaagacggccaggtcgtctgggcctgagtagttttaaggaagatggaatgaccggttgcaccagaagcgtgtgggcgacagtggctgtggcaggtgcgctggcaatgcccgccttgttcggtgcttccgctgctcaggctactccgaagccggataatagctggatcgtcaatgtcgacatcgaaaacgatgccgtcgccgggactgatcgttactatactgccggtcagcgggtcagcgtggtgatgccgagtgatctgacccccaaatgggcatcccgcgttggtcgcgccctgtggggtgatggtatgcagcgcattgccgtgggcattgaccagtcgatctttaccccttccaacactcaagtaaccaacccggacccgcatgaccggccctatgccgccacgctgaccgcgaatttcaacctgattcaggacaaggataacaatcgcagcattcttggcctcgcgctgggtgtggcggggccctcggcattggggcggcaggtgcagaacggcttccatgacctgatcggtgataccgagaacaagggctggggctatcagatccgcgatgagccgattatccagttcacctccgagcggacctatcgtctgccgatgtataaattctgggggctggagacggatgccctgccatccctgaccttcggtgtcggcaatctgcgtgtgtacggccagaccggtgtgctgttccgcatcgggcaggggcttcagagcgatttcggtcccaaccggatcagaccgggcctgacggggggggatgcctacaccccgaccggacgcttcgcttggtatatctttgccggtggggacgggcaggccgtggctcatgacatgacactggatggcaatacctggcgcgacagccgccatgtctcccgccagcctttcgttggtgaactggaagccgggctggcaatcatcgcctatggtatgaaggtcagctacacccacgtcgtccagacgcaggaattccatgggcagcatggtggcctgttccagttcggcgtcttcaatctctccacgcggttctgacggctgattttaatctttgcctttgcttctcgctctggtgatgaggcaagggcgatgcgctgcctccgtcctgtgatagggccagtatgatgtgtattccccggcgctcttttctgtctgctcttccagctgcggcatgtctcggcgcagccggtgtggtttttccttcaaatcaagctgaagcgcaggatttccgcggttttattgccggggtgaaggcagagggcaggcgggcaggcatctccgatacgattttggcgcaggcgttgaacactctttcccccaacacgcgggtgatcgagctggaccgcaaacagcctgaattcaccatgacctgggaacgctatcgcagcacgcgcctgtcggaaaaacgcattgcagccgggcgggagcaggctgcccggaatgcgcagttgttgatgcaggtggagaacgcatacggtgtggatcgcggcgttatcctcggcatctgggggctggagaccaattacggcgcttttcagggtggcttcaacgtcattgaggcaacggctacgctcgcatgggagggccgccgtgcttcttttttccgggcggagttgatggcggcgctgaaaatcctgaaccatggcgacatcacgatgccacgcatgcagggaagctatgccggggccatgggacagccgcaattcatgccgacctccttcaaccggtatgcggttgatttcgatggcgatggccgtcgcaatatctgggacagtgtaccggatgtgttggcctcgattgccaattacctgctcaaatccggctggcatcaggggcaaccctgggggacgcaggcgattgctccggcgacgatcgatccttctgtggctggccgtgaaaacagattgagccttgccgaatgggcacggcttggtgtgacgcttggtaacgggcagaggcttccggcgtctcccctcccggcctccctgattttgccggatggaccggggggcgaggctttccttgcttatccgaattttaacgtgattcggcgctataatccttccgacttctatgccattgccgtggggatgatcggggatatggtgatggcgtgacgatacggtcggatctggaaaaaataggcaacgctgcactctggcggaagctgtgcgtgttcgggagtgtcgtgggactcgccggttgcgtgcgtggtcatgccccgccgccagcgccgcatctgactgttggtgcaccctatcaggtcggggatgtctggtattatccggccgagcagatcagattgacccagaccggtctggcgacggtggatacggatacttcctcgcggcttacagccgatggtgagcgctatgatccacaggctctggcggcagcacatcagacgctgcaattgcccgccatcgtgtggatcaccaatctggaaaacgggcggagcctgcgtctgcgcgtcaacgaccggggaccggcctcaccatcacgtctggtgtcgttgacgccgcgggcagctgaattactgggcattcagggggcgacgaaaattcggctggatgttgatgaagcagcctcaacccagttgcttgatcatttccgctcccctgccgatggggtaaagatgcaggccgcgccgcggcaggatgttgcgcaggaaagcctcgctcccccatccggagcatccggctctgccggtatccagtccacgcctgctccgactattcagaatcaggcagagaccagtgcttctgatattggtccgctgccggaacaggtggagcagggggttccaagccccggcaatctgtatatcaaagcaggggtttttggtggcatgcgggctgcttcgattcaggcttcccggctgggagcgataggggcaagagttgaacgtgccagggtgaacgggcaggaacgtaatacggttttgatagggccgttcgccaccattgccgaggcggatgcagcgctggatcgtgctctggcggcaggcgtgccggatgcccgcattgtcgttgccaccgatagccgtcagttgatcgactaggagtttgccagacgtgtccagctatcctgatctatcccgccgcgcgatattgggtggtgttgccggtgctgccatgatggcaggcggcgtatcagaggggtgggcacgcggcaaggcaggcgcgtctcatcgtaaaaaagacgcggccaaggcggcagaggctacggcggaacctcagggatcacctgcgaacacgccgttcgggccttatgacacggtggcgaaatgggccgttgtggtcgatttcaatacgggtgctaccctgttggataaggaggcggatgtgcagatgccgccttcttccatgaccaagctgatgaccgcctatatcgtctatggcgagttgaaggccgggaagctgcaaatggatcagatgcttcctgtcagtgaaaaggcatggcgtctgcaaggttcgaaaatgtttgtgccttatccgggcagtgtgaaggttgaggatctgatccgcggtatgatcgtggattccggtaatgatgcctgcatcgtgctggcagagggtatcgccggatcggagcagcaatttgtcgatctgatgaaccagaaagccaaattgctggggctgaccaacagcaatttcgaaaactgtaccggcatgccttccgccaaccaccatatgtcggtgcgtgatattgcgacgctggcccgtcgcattattcaggatttccctgaatattatcacttcgattcggaaaagacctttaaatacaataatatcgagcagcagaaccggaatccgctggttcagaaaggcatcgctgacgggttgaaaaccggtcacaccgatgctggtggctatggcgtttgtgccagtgccgagcgcaacaaacgccgcgtgattctggtggtgaatggtctgacaacctcccatcagcgggcgtcagagagcgaacgccttctggaatgggctttcagtcagttcgagaatgtgacgctgttcaccgcaggggacaccatcgacagcgccccggtttatcttggcaccagcaagaccgtgccgctggtggggggcaaggatctggtggtgacgatgccgcgccagtggcagaaaaaggcgaaaatctccatttcctatgatgctccggtgcgtgcgccggtgacaaagggggccgcgcttggaaccctgaccatcagtggagatggtgtgccaaatctgactgtacctcttctggcaggtgctgatgtgccgcgtctggctcttccgtcccgtgcgatggcggtgctgacccattatgtcaccggcagctgatttttccgcaggcacgcctgtatccgagcatgtcggaccgcgatgagagcgtatcatcacggtaacctgcgggaggcgctggtcagcgtcgggcttgagttgatcgccgagcgcggcaataccggctttaccaatgccgagatcgcgcgtgccgttggagtcagcccggcagcgccctatcgccatttccgggaccggaatgagctgatcgccgaaatcggccgccgtggctatgccctgttcgaggaagcgttgatcaccgcctggaatggtggccgaccggacccggtcagtgccatagaacagtgcgggcgggcttatctgtctttcgcccgtcaacaccgggcttactataccgctatgtttgagccgggttttgcgttggaagaagtaccagccctgctgacggccgctgaaagagctttcggcgtgatccgcatggcgacagagcacgcctgcaccacattgccacgtgaaaagcggcctccggctttgatggtggcgctgcatatctggtcgatggcgcatggcatagcgtcgctttttgtgggcagacaagaccacacgcgccggaagctgccgatgacgccggaggagcttttggaagcagggttgctgatctatctccagtcgctgggtttgcagaatagtggagacgtctcttgaaacgcggttttccttgcccatctatgtgaatgtgacttacattcacatagaaagtgtcagatgaggggcatgtccatgtgggctgaacggattgacgttttcggcaaggcgggctggcttgccgtgatcattctgggcttcatgctgtggtggccgctgggattgttggcgttggggttcctgagcgcgagcggtcgtctccatgcctggaaaacggcccgggctgaagggggcggctgcggttggggtagcccattcgcatatggctgtgccagccagacgaccggagaaggcgtgaaagaatttttctcccgcgcatgggcgcaaaggggttctggccgagggagtgaccgtcagactggcaggagcggcaatgaagcgttcgatgcctatcgggaggaaacactccgcaggctggaggaagagcagcgcgaatttcaggactatctgcaccgcctgcgtcaggctcgggacaaacaggaatttgaccagttcatggccgagcagcgtaaccgccgtcaaacgagccatgctcagggtgatgaaacgcagtcggcagaaaacattgagcatcagcctgcaccgtaatctgtttccatctgacgaatgccagctgatgaatgaataacgagcgggtggtccttggccggactgcccgttttgattctgctttcatgcagacggctgccagtgcatatcaggctcatgccaagtacagacgccctgaatcgattttcatcctcttccggccgtttcatcactctggagggcggtgagggggcgggtaaatccacccagacccgcgcccttgcggaggcgctggagagtttgggcatcagaactcttgtcaccagagaaccgggcgggacagaaggtgcggagcagcttcgctccctgctgctgtatggcccggactgggatggtctggccgagaccctgctgcatttcgcggccagggcgcagcacgtcgccagaaccatccggcctgcactggaacagggtatctgggttctgtgcgaccggtattatgattcgaccatggcctatcagggatattgtcagggggcggacaggcagcggattgcagcgttatcggcatggctgggactggacccggaggtaacattagtgctcgatgcgccggtcgaggcatcagtgcagcggctggctacacgctccggcaccctgaccgtggctgaccggtacgagcgtctcggtaagccgttttttgagcaggtccgggcggcttttctggatattgccgcgtccagcccgcagcgttgcgttgtactggacgggatacgcccccctgccgaggttacccgtatggcgctggccgcattggcggagaagctgggtgatccgcgtctggccccagcggcgggggttgcatgacagaggaaacacctcgtcagacatcgcggctgtatggccatgaggcggcagaagccacccttgcttccagtgtccgttcagggcgcctgcatcacgcctggctgctgaccggccccgccgggattggcaaggcgacgctggcgtaccgatttgcccgttggctgctggctggagcaccagaggggggaagttcacaacatgagaagaaggcggatagcccgttatggctgtcgccggaacatcctgttttcaggcgtgtggctgccgacacccatgccgatctgttgagcattgaggctggctgggatgagcgccgcaagcgccagcgcaccgaaattgtcgtcgatgacgtgcgggagattgcctctttcctccatctgacaccggcggaaggcggctggcgggtcgtgatcgtcgatggagccgatacgctgaaccgtcatgccgccaatgcgctgttgaaagtgctggaagagcctccgccaagagcgatcctgctgttgagttgttcttctcccggcaggcttttgccgacgatccgctcccgctgccgtatgctgcggcttcaggcgctggaagctgcgcccatgcaggatgtgctggccaccctgctgcctgatctggcggcggctgagcgcgatctgttggccgggcttgcggagggtgcgccgggccgtgcgctgcaactggcgaaggaggacgggctggccctgtcccgtctggcagaggatattctgcgtgcccctccatcagccagccatcggtacgatctggccgatatgctgactaaaggggacacggctttttcaaccttcatgctgctgctgcgggccacattggccagaatggtgcggcaggcggcgcgctccggcagtgggtcggatgaattcctttgccttcgcccacttgatgcgtggagcgacgtgtggcacgcgctgggacgtcttcaggatgagaccgagcgtttccacctggataaaaggcaggcgatattcgccggcctcagccttctggacccgtcatgaacacccgttactattgcacaaccccgatctattacgtgaacggtgccccccatatcgggcacgcctatacctgtgttgcgactgacgttctggcccgctggaagcggctggagggcagggaggtgttctttctgaccggcacagatgaacacggccagaaggtcgagaaagctgctgccgatgccggggtcgatcctcagactttcatcgacggtatggccgatggtttccgcgccatggctgagaaaatgaacacgtctcatgaccggtttatccgcaccaccgagcctgagcacaagaaagcagtggccgccctgtggtcgaggcttgaggaacgtggagaaatttatctcggcagctatgaaggctggtacgcggtccgtgatgaggctttctatggtgaggacgaactcacactgaagcctgatggcaagcgctatgcaccgaccggtgcgccggtggagcgggtgacggagccgagctatttcttccgtctgtcccgctggggcgatgcattgctcaagctttatgaggatcagcccgatttcattgcaccgcaggcccgccggaacgaggtgatcagcttcgtcaaacaggggctgaccgatctttccatcagccgtaccagcttctcctggggggtgccggtgccgggtgatgcaaagcatgtcgtgtatgtctggctggatgcgctgaccaattatctgacggctgttggctatcctgacgaaacctcccccgcctggccgttctggccggccgatctgcatatggtcggcaaggacatcctgcgtttccacgcgattttctggccagccttcctgatggctgcgggcctgccgctgccgcgacgcgtgttcgcgcatggctggtggacggtcgagggcgagaaaatgagcaagtcgctcggcaatacgattgagccgggtgcgctggtggatgagttcggcctcgatccggtccggtttttcctgctgcgggaagtgccgttcggaaatgatggcgatttcagccgtcgcgccatgatcgggcggatgaataccgagctggccaatgatctcggtaatctggcgcagcgaaccctgtccctgatcgcccgcaactgcgatggcgctttgccggcacggggggcggagaccggggaggatgccaccttgctacgtgatgcggcctccctgccggcgaaaatgggtgcgcagatcgaccgtcaggcgtttcatgaagcgctggaggaggcatggaaagtcatccgtgccgccaatggctatatcgaccgccaggcgccctgggcgctgaagaaaaccgatccggacaggatgcgggatgtgttgcgtgttctggccgatgtgttgcggattatcgccacggtgatgcagcctttcgtgcctggcagcgccgcccgcatgctggtgcagctcggcgtgcgggaagcagccggggagcaggttccgtttgctgcattggagacgcatctggaggagggtactcgcctgccagcccctcagggtatcttcccccgttttgttgatgaggctgtttgagccattatgctgatcgatagccattgtcatctggattacttcgaggccgagctgccggatctgctgagccgtgcgcaagccgccggggtcgaggagatggtgacaatttccgtgcgcctgtcacagacgccatggttgatcgcctgtgcggaagcgcatccgggggtctggtgcaccattggtgttcatccccagcatgctcatgaggaggccatgccggaggtcgccgagctggtggccctgacccgacatccgaaagtggtggggatcggtgaatccggccttgattacttctatgaccgggcgccggtggatgtgcagaaggaaagcttccgtcggcatatccatgcggcgagggaaaccggcctgccgctttgtatccatgcgcgcgatgcggatgacgatattgccggcttgctggaggaagaacaccggaacggggcctttccttttctgttgcattgtttcagttccgggcgtgggctggcggaacgggcggctgcgatcggtggttatttcagtctgtcgggtatcctgacttttccaaaatcgactgacctgcgcgccattgttgccgatctgccttctgatcggctgctgctggagacagactctccctatcttgctcctgtgccgcatcgcggcaagcgcaatgagcctgcctatatggcccgaacggcggaaacgctggcttcggtgcgtagtgtgtctgttgaggagatcgcagcgctgaccacggccaatttccgccgtctgttcaaaaaaacaacatgatgcgcgtcgttattctcggctgtggaggctctgccggagttccccagctcggtggtgaggatggcaggggggattggggagcctgcgacccatccgaacccagaaaccagcgcacacgctcgtcaatcctgatcgaacaggatggacgacgcctgctgatcgatactggccctgatctacgggcacaattgctggcaaccggtatcgcgggcattgatgcggtgctgtttacccatgcccatgccgaccacattaccggactggatgatgtccgcatcctgaaccgcctgaccgggaagcccattgacgcttacggcagcccaaaaacgattgaggaactgacgcttcgcttcgattatgcgtttcggccatggaaaccctcgggattttaccgccccgtactggtgccgcatcaggtggcggccggacaggacctcaccatcgccgggttcccggtgacgctgctcgatcaggatcacggctatgtccgctcgctggggcttcgcataggccggtttgcatactcgacggatgtcgtggccatggatgcggaggtgctggatcggttgaaaggcatcgacacctgggttgtcggatgctttcagcgacagaaacacgcaacgcatgcccatattgctctggtcgctcaatgggcggcccggatcggggtcaggcgtaccgtgctgacccatatgggctatgatctcgactgggcatggatgcaggccaatcttcccccgggtcttgaaccaggttttgacgggatggagattcatcccgcctcctgactctgccggcagggactaaccgaagcggcgctgccaggcgcgggggatcagcaccgttgtcgtggtcaggatgagggataccgcgaagcacgcccaaagaccatgccgcccgtaatgttcctgaagggcggcgccgatggtggcaccgaccaccagccccccccatgggacgatctgcgccaaccagtccagattgcggtcgcccatcatgaagcgccccagcccgcgcccgaatttcgacaatgcgccgctgacataggtcagcgccagagcgaccccttcgacattatcaaccacgttgttgagcgcgcccatcgcaatgaccgcgcaaaccagagaaggtgtgcccatttcatcgcccggccagccggcggcgatgcacagcagggtgctgatgaacagcatcagtactggaatccgcaggcggcgcgtggagtagctcagcatcataccgagagcgttaccgaccacaaacatggcgatgaccagcgcaagacgctcgaaccgctcaatattttccagactgagcgccacccccatccgtgtggtattgccgctcatgaaagacatgaattcatcgaccgacagaaagccgatggcatccgtcatgcccgcgagcatggagaggctgaagacaagtataaaaccgactgtggcacgcatgatgcgcacgacgcgtggcgtaagagcgaacggcataaaaatggctccgaaaggcgttgatccgtggtttcagacagtcttcctgccattgaacggccgggatatacgggtaacgcctgacgaaagaatggcgctcacgtaacaaaatatgtcgcaccacgttttttttgcctgaccgggtcagcgatccgtcagacgcaactcgatccgccggttttttgccagatcagcttcgctatctccctgggagacgggctgataatccgcgaaagcgtcagccgagacatggttgccggggacaccctgttcgatcagcagccgggccacattaatggcgcgttgagccgatagctcccagttggaagcgaatttgccattgaccattttctgccgatcggcatgcccatcgacccgcagcagccagttgacgttgggcggaaattttttcgacagctggatcagcgcggcggcgatatccttcacctgctggcgcccttgttcggtcagatcggcattgccggatggaaacagcacatcactctgaaacacgaagcgatcgcccaccacctgaatcccgggtcgcccggccaggacttcccgcaacttgccgaaaaactcgctgcgatattttttcagttcctcgactttctcggccagtgcgacgttcaggcgcataccgagatcggcgatggtgcggtctttggactgggactctttctccgatgcatccagggccgactgcacggcggcaagttggcggcgaatggcttccagatcgtcacgcagcctgtccagagcggtatccttgctgtggatggtctggtccagttcagcaagctttgcctcggcgcgttttacatcctgatcacgaccggcaagctggctttccagacgggatttctgctcggccagtacgacggtctgtgtcctcagacgggccatatcggcttctttcccggccgcttcattgcgtaaccgttcaagagagtgtgcaagctgcgtgctgtgttgctgctccagcgcgaattgacgagaaatgatggccagctgccggttcagctcatcaagcctgtgttccttaccggccagcgtgtaggacagaaaagcctgtgccagaacaaagaccagcagcacaaagatgatgaccatcagcagggtagacagggcatctacatagccaggccagacatgaaggttttcgccgctggtgttgcgccgccgggaaagcgccatctcagccctgcgcgtcgtctgccagcgcgccgaccgtgcgggtcaggatgcgcagatcgttgcggagttcggcagtggattgaatgcggccctgttcggcctcgatcatctgacgctgcaacagtgcttcgacagcgcgcatatgggtttgcagcagttccgacaggctgcgctcttcatcgtatcgttcattcagagtgcgcaggatcggggtaagctgattctgggcctccgcaattttgaccatcatctgctggccggtacgcactgtgtcggagagtgatccgatccgctcggtcaatgcaagcagggcctgatgagaggcctgacggttttcctctccccgcgcgagagtctgttgaagccgttccatgttttcggcggtctgttccagcagggcctgtacatagaccggcacgctgccttcaccatctgccccgagcgcgccggaggaaagacgggtcaacccggccagccactcttccagctcattgaagaagcgattttgtgcctgtccggcggtcagatccagaaagcccagcaccaatgcgccggacagaccgaacatgctggcggagaatgcggtgcccattccggcgatcgggcgggccagtccggatttcagctgctcgaacatcatgttcacatcaccggatccgttgaccgacatcccggagatgacgtcactgaccccgccaatggtgcgcaacagcccccagaacgtgcctagcaacccgaggaaaatcagcaatccggtcatatagcgggacagttcccggctttcatccagacggctggcaatcgtatcgagcaccgatcgcatcgccgaggcggaaagggtaaagcgtttttctcccgggcgtgtggtgctggcggccctggtcaccagcatactggccatgggggcgagcagacggggctggctggcgctgtccggtgcctgatcgcgccggaaggataccagccagcgcacttcaggctccagccgggttacctgccggaggttccagataatgccgagcagaaggatcagcaggatcagcccgttcagatacgggttatgcagaaagatcggcttcagcgccggttccagcgcaactgcaattcccccgacagcagcaagaaacgcaagcatccggagaagatatgcaaccggcctgaccatattggaagcacgtgtcgagctggtcgcgaggctcattacgggtgtccttgcgccggaagaggttgttctggcggtttactgtcaggtttggcgtcagattggggaggagccttgctcggctgggttcgaataatatcggctctgtccgcaggacctttgccgatattgctgccgagagcgcggacaaaaattttggttgagggcatgcccgccgcaatcagggcgcttctgatggtcagggcgcgggacagggacaggcggcgtgcggtggatggatcgtcagcggtgccgggggcataagcgaggatggtaacgctttcattcgacagcttgctgacttcccgggcagcctcccgcaacgcgtcattggtggcggggctgatgtcggaacgacctgggccgaacataaccctcaatccttcaccggttgtggacagcccccccggtgcatccgcagccacgacaggtggcggcacgggcggagaggtatggtcgggtgctgaaggcaggggcggggtaataacaggggcaacagggggtgttgccggcatttttaccggaggcggcggtgtcgccggttttttagcattctcttctttcgaagaagtcttcttaccggatacagctttgtgtttcttgctgtttttggtgggtgacggatgcttggtcactgcttcgtcggtctgctgtcccgtcaccggcttgccgtccaactgatccagagcacgcgtatcgacttgtgcttcggcatgcgcttcatgcaatggcgcaggcacgctcattgcgagcgtgaccgtcagcatggttcgggagaggctggagaaaagggaatacggcatcatgcgcttcatggcggtattcatatcctgctctccagaccagactcaatccatggaacagcgatgaatcaacttgtacgggatgcggctaccccatcctgcacgatatcaagcagtttggaatgcagatggccgttgctggcgacgacatctccggtctgaagcggatcgccacctgctggatcgacggcatagccacctgcctcccgtaccagcagcagcccggcggcaacatcccaaggtttcagtccaagttcccagaatccatcatagcgccctgccgcaacccaggcgagatcaagtgcggcagagccgaagcggcggataccggccacctgcggcatcaatgtgccgagcgtgcgggcaaaagccagacggcgtggggcgctcacggcggcaaaaggaatgccggtggcaaacacggcatcgtgcagctcccgtcgtgcggagacacggaggcgacgctcgttcagaaaggcgcctgcgcctttttccgcccagaacatttcatcaactgcgggagaatagaccacggcggcggccagctcggtgttgccatcgggaagacgccgttccagcccgatgctgatggcccagtgcggaatgccgtgcaggaaattcgtggtgccgtccagcggatcgaccacccagcgccatgtccagttatcaccacccgacgcgccgctttcttccatcagcagggcgtaaccggggcgtgccttggtcagatcgtcacggatcgactgttccgagcgcagatcggcctgggagacgaagtccgacggccccttcacgctgacctgtagctgctccacctcgttgaaatcgcgcagcagccgcttggcggcacgctgggccgcgttctgcatgacggtcatatgaggggacaggcgtagggccatgatgcgttggcgctccgggcggagaaaaaaacaaactcgggatgactcgatacgccaccccgccgtgcctgaaaagcatcggcgcggcaggacgggcatcatcatgcagtgcggatattacttcgcacgttccacataggtggagtcttcagtgcggaccacgatgcgttcgccggcctcgataaagggcgggaccatgacgcgtacgccgttggacagcttggcgggcttataggaagaagacgcagtctgccccttcaccaccggatcggcttccacaatttccagcgtcacctgagcgggcaggtggatggccaccggatcgccttcgaccagatcgaccgttacctgcatgttgtcctgcaggaaggccactgcgtcccccagaatctcggcggggatcagtgcctgttcaaaggtttcagggtccatcagaaccagattgtcaccatcggtataggaataggtgtaatccttttcctcggtcatcagacgttcgaccgtgtcggcggtgcgccagcgttcattggtcttgttgccggttttcagatcgcgcatttccacctgaatgaaggcaccacctttgccgggggtgatgatctgctgcttcaggacggtccagcggcgtccgtcatgctcgatcacctgaccggcacgaatcaggtttgcctgctgcttcatggcattaaactctcgggtggatgtagacgagtgtccgggacggaaatatcccggacgggcggctgtctagaccgaaccgccagaaccggcaacctgttatgacggttagggccgttatgcatatgggatcatcggcattgaggacttcacgccgggcaatgttaccacccccagcccggtccccacatgccgccgccccacccccagccccatggtcctccgccccatggcccccagccgaaggaggcgctttggtaggcgagggcggtagactgcgcctgattggccaggcgttgctggaacgtcatctgctgatagcggctgaaagaaggctgatcaccgacgaacaggcatttgcacaccaccggatcagcatacaggaacgtcatcttgtcgccggatggctgcatgacgatgcggttggggggcagggtggcaaggctggtctggcgttccggcgtattgacgggtttgatgacaaagcccgctgcagacataagggtttcctgattgctgatgatctcctcctgagtggcacagccagccagcaggatgccaagagcgcaaggcagcaataaaacagagaggccgcgcagggcaggatgcttggatgcagtcatggcaaagcctctccagacaaaatgtggcggtggccattgatgtcgcggacggagccatctgactccagataatccggatcgacgggtactttcccatatccgccgggaatgtcgatgacgtaagtgggccatgcaaggccgctgatacggccacgcaaggcatgaaggatggcgcgtccttcctcgaccggtacgcggaaccttgctgtcccgggggcggcatccagttggtgcagataatagggcttcacccgaagacgcagtatgcggcgataaagcgcttccaacgcttccgcagaatcattgacccctcgcagcaggactgtctggctcagcacggggatgcctcgacgttggaaagactgaattgataaagctgcaagatcagtcagttctttaacattatttgtatgaagtaccagaaacatggctttatccgtttccagagcatccagcatggcttgcgtgacaagagccggatcagccaccggcacgcggctgtggatacggatgatatcaatatgaggaatattatttaattcattgataataaaagataatcttcttggagaaagcatcagcggatcaccgccggtcagaatgacctcccttatctggggatgaccagccagccagtcgagagcaatccttagctgttcctcggaaagcacgcctccatccggcccgacatgctcccgccggaagcagaaacggcaatagaccgggcagatgagcagtggcttcaacagggcacggtcaggataacgatggacgatgccgggcacgggtgacagggcatcatccccaatgggatcaacattttcatagggggcggtgatcatttccgccggatcgggaatcacctgcaggccgatcggatcgtgtcggtccgtgatcagcgcctgcatcgcggggggaatagcaatagcatattgcgcggcgaccgcctgtaacggtgcctcgtcatcaatcagcccggcccgtcgcagatcagccagactacgcaggctgcgtggtgtggacgaaggacggcgttcagtggcgtgtttcgtatcatgacatgaaccatcgggcatgaagagcatctaggctctcagacctcttccggcaatgagcctgggctggcaaagagttaatatggcaagaccgacctggcatccggaccgctttgcggaccgtcttccctttctgcaccgccgtgctgcactggcacgtgccgtgcgggcgttttttgaggcgcgctcctatcttgaagtcgagacgccctgtgctgtccttgcacctggtgaggaagtccatcttcaggcattccggacggagcggatcggagtggatggggtagtgacgcccctctggctgcataccagtcccgaattcgccatgaagcggttgttggtggccggggcggggccgatttttcaaatggccagggtctggcgcaacggtgaaggcagcgcccgtcatgcggcggaatttaccatgctggaatggtaccgtcccggcagttccatgaccgatctgatcgccgagacgatggaattgctgtgttcggtcctgccgcctgtcgtatcgagcggcggtgtaatcacccgcatcgaggagccggaaatcctgaccgtggccgaggcctttacccgctatacgggtgccgatgtgctcgccacggctgataatgctccggccctctctgaagcggccggtgtgaggttgcgtgagggagaaggttgggaggatctgttctttcgcctgctgcttgacaggatcgagccgcatctggggcgggaacgcccgactttcctaacccattggcctgtggcgcaggcagcgctggcccgaccctgccccaatgatccccgcgttgcagagcggttcgagctgtttgtctgcggtatcgaactggccaacgcctttgtagagctgactgatgcggaggagcagagacggcgcttcctgatcgaccgcagcaggcggcaggcgctgggtggacagacctggccgctggacgaggattttctggccgcgctcgcctttggaatgccgcaggcggcggggattgcgatgggatttgaccgtctggcgatgctggcctccggcgcggaccgtatccagcaggtgcagtggttacccgaggaatagatcgggacgttacagatcgtcggtcagagcggcctgaatggcggtattcagcgccttgaccccggcatcggggccatcaggatggttccagaccgcgccgatgacagccagaaaatcggctcccgccttgaccagcggggcggcattggttgggtcgataccgccaatggcaacgctcggcagctccatcatctccgaccaccaggtcagcagatcaggggttgcctccggcacgacctcttttgaagtggaggggtagaatgcgccgaaagcgacgtaatcggcgccagcttcccccgcgctcatcgccagatcgcgactgccatggcaggaaacgccgagagtcagatcacccagcagtgcccgtgccgcgatgacgtcgccatcttcctgcccgatatgcgcaccgtcacaaccagttgccgccaccagatcggggcggtcgttcaggatgacggcaacgccgcgatcatgggcaacagggcgcaaccggtcgatggcatggcgcaatgcatcatcatcaaggtttttaagccggatttgaagcgcaccgacatcgcccgcgtccagcgcacgggcgagcgtatcggcaaagctgtcggaattgagcgccggaggcgtgatcagatagagcctgcagcgctcgtccatcacttatcaggccttgttctggaagatatcaatgatcttcccaagcagttccagagcttccgcacgcgggcgctggaaggtgttgcggccgatgatggaaccgttggcaccaccatcccgcaaaccgcggatggtatccagcagctggtcggtgcccgtggtttcgccgccggagaacacgacgatgcggcggcccgcaaaggaagcctgcatcacgtgctcgacgcgcttggccagagtggagcggtcgatgttctgggtttcataggttttctgcgcggctggcaggctgaccgcatcggtcggcggcttcaccttgatgatgtgggcgccgagcagggcggccatatgcgcggcataggcgcagatatcgagtgcggtctcggcctttttgtccagttccggaccgcgcggatagctccataccaccacggcgagaccggcggatttggcttcttcggccagttcacgcagttcttccatctggtcgaacgcatattcgctgcccggataaatagtgaaaccgatggcggaacagcccagacgcagcgcatccgccacggtgccggtgacggcctgatccttggtaacggcgaggctgttggaagaattgaccttcaggatcagcgggatggagccggcataggtgcctgcgccggcctcaatcatgcccagcggcgcggcataggcgctcagcccggcttcgatagcgagatcgaaatgataatgcgggtcgtaggcaggggggttaggggcgaaactgcgggccgggccatgctcaaacccttgatccaccggcagaatgaccagcttgccggttcctcccagacgcccttccatcaggatgcgggcgaggttggttttagttcccggattgtcgctctcgtatttatcgaggatcgatttgacgacaggcgtgatacgcatcgggccgttctcctgcttgggctttgtcgcgctcgtagcccagcggagcgcgtctgtcacgccggggtcttgagccatgtgagcagcgtttcaagagtggtgccgtttcgtccgcccttcaatggcagatgaaaggccggtggcggtgtggagatcacgggaatccgtgccgactccgccatgaaaccgatggccgtactggcgggggaaggagagagaatgagcatcagaggcggggactcgcccgattgccatgtcacggtttcgtcaacgggccatgtcgcccgcaaaagggctgccgccaatcctggtgcattcccgcaatccgcgagcgactgaaaaggaatatcgggaaactccttgccggcggcctgcatcatagccagccaccaaccgcatccgccggatgccagtgcccccggtgtggagagcaagcctgcaccggtttgcgcgacagaggcatgccgaagtgtccttctgatatcttccattccatggacaatgactgcgccgaaccgaatcatgcttgaccttcaagcggttggctggtttcaacgcaagacaggaataagtaggcggcggaggatcaatggccgggaagattgatgcggtggaagccactgcgcggatcgaggctgctctggatcgcctcgccaatacggccagggggcagccattccctcagcagggacccgatcccaggctggaggatctcgctgcgcggatcgattatctggtgacacagttacgtgaggtgctggccgaggacaggccggccgcactgcctgaactggaaacaacgtcgcccccggttgaggcagtccctcatgaagcgccgaatgatttctctgccgtagcagaagccggcaacatggcggctcctccctcaccggcatccgcacctgctcctcaggcatatgatggttcataccattcagtcagctatgggacgcctacggaagagggggggaattttaccccacctcattataattcatggcagtaagccgggacatttcaggtcggggctcgactcattgggcaccagactccatggcagaggctgatggctgccagtctctgggagggacaggcaaatggcgcaagtgacggtgcgcatcaatggatacgcttacacagtcggctgtgaggacgggcaggagcatcatctccaggccatggcacagcaggtcgaggaccggatcgacaatatcaagtcgcaaggcgggcagagcggggaagcacgcttgctggtgctggcgtctttgatcatggcggacgaaattcacgatctgcgccgggaagtcaggcagctgcgccaggatcccagccgtgccacctacggggagacacggcatgaggagggcgtgcctgccgtgcaggatgatccagcctttattgaaaggctgcgacgtctggccgagcgtgcggaagagattgcggcttcgctcaaccaccgttaaaaagggctgtggagctgcccggtgcgtcaggcacattaatcccccgggccgataagcattccctcgggaactggcgctgtcatggccgtggtcatgataaccggtgcccacctgctctagcaggtctgaggaggatgatacgccaacggccagggtggctcccctttttcttttttcgcactatggcgcggttgtgatggtgttggctgatcaggacatgtcccttgcggggcgtaagcaggccctgcgccagcgtgcctacgccttgcgcgaatcgctcgatcccttggccgggatagcgctgggtgaaaatctgctccgcgaccttcctcccctaccaggccatatcgtgtcagctttctggcctcttcccggtgaacttgatctgcggcctctgatggcggcgttgtatgcgcgtggacatcggatagccctgccggtgacgacgaagaaaggggaaaagctgattttccgcgagtggactccgggcgtggcaatgatcgaagggcgtttccgcaccttgcaccctgatgggcctgagattgttcctgaaacggtgctggtgccacttctggccttcgaccgcaccgggaaccgacttggttatgggggtggttattacgatcgcacccttgccgcactgccttcggtgcaggccatcggctgcgctttcgcggcgttcgaactgcaagacgtgccggtggaggcaacggattttccactccgcgccatcgtgacggagcgggagacgatcctctgccctgatcgacagccggattaggtcagcactccattgatcggggtaagaggctctggaagctcttgaacccccagggcttcgagcaaatcaatctcgatgccacgcacgatcgcattcagcggcagatcgttctgatgcaggccgaaaggctgttccagttcgtcgctgagcgcatccagtccgaaaaacgtgtaggcaagcacgccggtcaacaatggagttgcaaaaccgagggtggacacgaagccaaatggcagcagcaggcagaaaatccacgcggtccgatgcagcagcagcgtgtaggcgaaaggcgtgcttgccgagacgatccgttcgcagccgccctgtgcagcaccaatggcatggaggcgtgtctccagtgtcatcatggtgatgtctgatatcagaccctgacgcccccattctgcgacgtcttccatgatgctgcgcaaaattgcttccggtcggttacgcatgggaagcagggtggtatgctcctgagccgagagataacgcctggtttcatcaaggccctcttcatcccgtagccttgctttcagcaggtatgcataagcgatgcaccgattcaggacatgcgtccggccgcgatgcgcggtgggaagaaaagcgatgacatcccgtgccagggtccgcatctcgatcacgaccgcaccccacagtttccgtccttcccaccaacgatcataacaggcgttgttgcggaacccgaggaagatcgacagagccagtccaaacagggtgaacggcacattgctgaattcgggataggcacccggatgggcatgcagaataatggccaggaccgtggagatcgccatgatcaacgaaactttgggcaggatgaccggcagcaccgatccccgcagggtgaacagcatcagggcgcgattaggctgtttgacgatcatgggatgtacgctttaccggctcttcgttccgatagacaagcagcgctggacaatcagggggcggcgtggcacgcgaagcccatgcgcattgtatttttaggtgacgtggttggccgttcagggcgggaagcggtgctgcgtgtcctgcctgatctccgcagccggttgcagaccgatctgatcgtggtgaatggcgaaaatgcttcccacggttttggtctggcgccggatatggctcgtgattttctcaatgccggcgcggatgcgatcacgctcggcaatcatgcatgggaccggaaggagctgattcccttcctcagtcaggaaaaacgggtggtgcgcccgctgaactttcctcccggcacgcctgggcagggcgccgtggtggtggagctgtcagggggacggcgggcgctcatcatgaatgtgatgggccgcctgttcatggacccgctggattgcccgtttcggctgacggcacaggagttgtcacgctacaagctgggtggtgttgcggggggcggcagtattcaggcggtcgtgatcgacgtgcatggagaagcgaccagcgagaaaatggcgttcggccatagtttcgacgggcaggcgacgttaatcgtcggcacgcatacccacgttcccacggctgaccaccagattctcccgggcggcacggcctaccagaccgatgccggcatgtgcggtgattatgacagtgtgatcggtatgggaaaggaagctgcggctagccgattctggcgcaagacacccggtgagcgtctggcgccgtccgaaggagaggcgacagtgtgcggtgttttcgtggagagtgatgattcgaccggtcatgcggtcagggtagaacccatccggatcggggggcgtctttcacagatgataccgagcctttccgcataggcccgatacagcagcaggaacggctggcggtttaccgggcaggataatctgctgtagacccggcccacggcttttatgacacagtgacagaaatgcgggattgcggcgatggccggccatagtcagttcaaaaatatcatgcaccgcaagggcgcgcaggatgcgcgccgggcgcgggagtttgccaaagtcatccgggaaatcacggtttcagcccgttcgggcctgcctgatccggcctccaatccgcgccttcgtgccgcgatcagctgggcgcgggaggttaacatgcccaaggatacggttgaccgcgccatcaagaaggcgaccggggccgggcagggcgatgattacgcggaagtgcgctatgaaggctacggccctgccggcgtggcagtgattgtcgaggccctgaccgataaccgcaaccgcacggctgccgatgttcgttcggcattcagcaaatatggtggcgcgctgggggaaaccaactctgtctcctttatgttcagccgtgttggcgtcatccgtttccctgcctcggcaggcagcgctgatgacatgctggaggccgcgatcgaggccggggccgataatgtggagagtacggcggaaacgcatgagatcaccacctctgtggaggatttctttgccgttcgcgatgtgctggaaagccgtttcggcgcgccggaagccgcaaagctggactggcgtcccggtaccacggtgacgctggatcaggacaaggcctccagcgtgctgaagttgctggatgtgctggaagacaatgatgatgttcaggcagtctatgccaatttcgacattccggatgatgtgatgcaggctctgtcggcctgatgctgtcagcttctcctcccgctcaggcaacggtccggatgctcggcattgatccgggcctgcgctttaccggctggggggtgatcgaggcgaccggaaaccgcttgcgccatatcgccgatggcgtgattgcgacggacagcaccgagagtgttcccgcccggctgcgtgttctgcatgacactttgaccagccttctggtcacgtaccatccggatgaggcggcggtcgaggaaacttatgtcaaccgcaacggcacggcgacgctgaagctgggctatgcgcgtggtgtggcactgctggctccggccctgagaaatgtgcccgttgcggaatatggcgccaaggctgtgaagcttgccgtggtcgggacagggggggccaccaaggatcaggtgcagatgatggtgcagcgtctgctgcccggcgccacgctgaaacgggccgatgcggcggatgctctggcggtggcaatctgccatgctcatcaccgggccagccgttccgcatgggcgcgcggtgctgtgatggcatgatgacgggaaggaagcaggacttatgatcggtcgcctcaccggactggtggatgggctggaggaggaccgctgcctgatcgacgttaatggcgtgggatatgtggtctatgcatcctcccgcaccctggcggcgctgccccgtgcgccggaggtggcgcgagtgctgatcgaaacgcaggtgcgggaagatgcgatcaccctgttcggctttatcgacacggcagagcgggactggttccgcctgctgaccaccgtgcagggggtcggggccaaagtggggttgaatatcctgtcagccttgtcggcgggtgatctgatttcggcgctgatggccggtgatcagcgtgccctgacccgcgccagcggtgtggggccaagactggcggcacggattgtctcggaattgaaagacaaggtgggtgccatgccctccggcccgatgacgatcggcggcgtgggggtgctcagtgctcccgcaggcggtgtggagcaggatacattatcggcgctgctcaatctcggctaccgcaggccggaagcgctggcggcgatccgccgggtgcgggaggcgttgggcgaagaggcagggcttgatgccatcctgcgccagtgcctgcgggagcttgcacccggttgaagggaatcagcgatgcagcagccctgcatcgcgccttgcatgatcccagccgacctcttccagttccggtgtttcactctccttcaccggatagccgacgcacagataaccaatcagctgccaatgggcagggacatccagcagggcgttgatcggctcggggtcgagaattgacacccagccgacgcccaccccttccgcccttgccgccagccagaaggtgtgaatggccatcacggtggagtaggcgagggtttccggcatggtctttcgccccaagccatgcccttgttcgggatcaggctcgcagaacaccgcgagatgaaccggcgcatcgtccagtccagccagtttgagccgtgcgtaaagccgggcacgcgattctttaccatcgctttgcagggctgacagggcatcggcattgctggtttcgaaattggcacggattgcggcccggcggactgcatcatcgaccagtacaaagcgccatggctcgctcaacccgacggaaggggcaagacatgcttcggccagcaagcgaggcagggtatccactggcaagggctcgcgccggaaatggcgcacatcgcgacgccagcgcaaaagacgatgcaattcctgcctgaaggcggaatcgaaagagaccggatccgtcatctatatgccaacctccctgaaaagaggatttaccccctgttcgttcttgtttttgcgccgtatccctgtccagattgcggaggaaggattcgtccagcacagtgtagcggccatgcctcatccataaaaccgcataacactgatcatttgttgttttaaccgcttcgctgatcatccgggaaacgatctgccttatgcctgaacacgatcctcatcaggagaaccggaccgtcagcagtgtccggttggaggatgatgcggcggaagcctccctgcggccgcagtccctggctgaatttatcggccagcgggccagccgggaaaatctctccattttcattcaggccgcaaaagcgcgtggagaagcgatggaccatgtcctgctgcatggcccgccgggactgggcaagaccacgctggcgcagattgtctcgcgggagttgggggtcgggtttcgcgctacctccggacctgtgatccagcgggcaggggatctcgcggcgattctgaccaatcttcagccgagagacgttctgttcattgatgaaattcatcgccttcaacccgcgatcgaggaagtgctctatccggccatggaggattttcagctcgatctgatcatcggtgagggaccggcggcgcgctcggtgcggattgatctggcgccttttacgctggtggcggcgacgacgcgggccgggctgctggcgacaccgttgcgggatcggttcggcatcccgctgcgcctgattttctatacggcctccgagctggaactgatcgtgtcgcgaggtgcagaaaagcttggttttgatctgagccgggaaggggctgcggaaattgcccggcgctcccgcgggacaccacgtattgcgggacgattgctgcgccgggtgcgggatttcgcgatggttcagggtgtctcccctgtcgaccgctccaccgccgatgcggcccttcagcggctggaggtggattcgctggggctggacgcgatggaccggcgctatctgcaccggatcgcggtgcatcatgccggtgggccggtcggggtcgagacattggcggcggctctggccgaggcgcgcgatacgctggaagatgttatcgaaccttatctgatccaggaagggctgattctgcgcaccagccgtggacgcatgctgggtgaagcgggctggcggcatcttgggctggtgcctcccccatcggcagcgggtggccagccggatatgctgaccctgttgcatcgcgatggcagtgcagatgaataagccgtaggaaattatccatgatcatggaaggccgccatcactatcctgtccgcatctattatgaggacacggatgccggtggcatcgtctatcacgccaattatcttcgctttgcggaacgggcgcggaccgaaatgctgcgggattgcggcgtgccccatgcggaattgacggacgatcacggcctgatgtttgtggtgcgtcgcgtgaggatcgattatcgcagacctgcgcttctcgacgatcttctgacggtggtaacgcgcgtcgaatcgatgggtgcggcgtcggctgagttggaacaaagggtggaagggccggagggcgaattgcgggccttgctgcgtatcgggttggcctgcgtaaaaattgatgaccagaaaccggcccgcgtgccggatcgctggaaagaggcattggatgaattgtcgagatcgggtaccagcccggttccgaccttgggagagcaatagtggaccgcgctgtggaagcgaccaatctggcaggtaacgccgccgctggcggcgacctgtccttgctcggcttgttcctgcaagctgatgccatcgtgaagatcgtgatgctgctgcttttgtttgccagcatctgggtctgggccgtggcaatcgacaaatatgtcagcctgcgccgggccaatagggccgccgatgcgttcgaggaccgtttctggtctggcggcagtctggacgagctttatgaaaccgaaggcgccaagccgaccaatccaatcgccgccgtgttcggtgccgccatgggtgaatggcgacggacggcacggattgccgggaccgatttcagccgctccggtgtgagggagcgtaccgatcgcgccatgggtgtgaccatcgggcgggaaatggaccggctggaacgctggatggtgtttctggcttccgtcggctctacagcgccgtttatcggcctgttcgggacggtgtggggcatcatgaactccttctcctccattgccgccatgcacaacaccaatctttccgtggtggcgccgggcattgccgaagctctgtttgcaactgcaatggggctggttgccgctattcctgcggtgctgatctacaacaagctgagcaccgacatggcgcgtttcgcagcaaggctggaagcgtttgcggcggaattcggcgcgattctctcccgtcaatccgaagagcgcccgtgacctgagcagggctttgctcagcaccacgtcgaatgtcagcaaggaatttatcatggcgatgtcagtaggcggcggtaacggacgcggaaaagggcgttaccgccccatggccgaaatcaacgtgacgccgctggttgacgtcatgctggtgctgctgatcgtgttcatggtgacggcaccgatgctgacttccggcgtcaatgtcgatctgcccaagaccaatgccgcaccggtcaatcaggacaacaccccgctgaccgtgtcgatcaagccggatggcagcgtctatttccagaacgatcaggtgcagcttcccgagttggtcgccaagctgcaggccgtggcgcaggacaacaaggatcgccgcattttcgtgcgtggcgacaaggatgtgaactacggaacggtgatgcaggtgatgggcaccatcacgcagggcggttttaccaaggtggcgctgctggctgaacagcctggcccggcagtggctggttcggacgcaaaaactgcgcctgctgcctcttctgccaaacccggcaagcgttgattctctgaaggtgatggcaaacacacgatgagggtgttcctgcgggatatggtcatggccggagcggtggggagggtgccatgcggcgcatgaacccctcgctgagccgtggggctgcgatttcctttgccgttcacgtgctggtgctggccattatcatgatcgggattccgtttacgccgcccccatcgccgccggaagacaaatcggtcgaagtggagttcgaagggccggcgcaaacggcgcggaaagcggagcaatccggtcaggttgctgcgccggctgaccgggaggataacgacgaaaaggaaacggcgactcagccgccaaagccgcagccgacggaacctccacccccgccacctccccctccgccgcctccgccgacctcggcgcctgctgcgccttcgccggtgcagccggagccgcagcctccgcgtgaggaaagcccggagccgtcgcctgtcgcaccgcctccgccgcctgcgcctccgcggccggtgcagcaagcccagcctgcgccgccatcgccgattcctccgccgccgaagcctgtggaggcgccgccgagcaagacgcatcagccgaacgagaccaaaaatccggctgctgacagcccggccaatgaaaatacgctggagaaggcgctggccaagcttcagaagcagaccaaaccgccgacggctcaccccaatcctgcatcaggggcaaggcgaaatggcggagggtcaccgacctctgatgacactgcctcgctcagtgccgtgcagcgtggtgcggtgggtgatcgggtgcgcgaatgctggaccattgatgccggggctgagaacgtgaaggatttctcggttatcctggatgtcgatacgcgtccggggggtattgcttatcgcgccacgatcgatccggcagaagcgggtaaaatgagtaatccggtgttccgtgcctttgctgaacgggccagacgggcggtactggacagccgctgtgcaactttaccattgccgtcggagctggccggaaaaccgtcatctttcaaattccgtttcagaccatgaaccagccgggcttggaacgtgacagacttggaacgtgacaggcttgatgctctgccacacaaatgcctgcctaacagggcaagatccttccaggaggaatcgcaatgacgcatgaagaccgtatcccggaccgcatagccgagcagcttatggggctgcggcggcgtgatatgctgggcttttccgctgcggcgcttgccgcaccgctgggttttgcaggtcccgctatggcccagcaggccgcgggccagtctgccgtcattgatgtggatcgcgcccggactgccccgatcccgatcgccattccgtcttttggaggcggttcccagcttgcgcaggatatggccggtgtcatcgctgccgatctggaacgcagcggactgttccgcatcgtggcacccggtgcctatcctcagcagagtggggatgtgccaaacttccagagctggggagccatcggtgcgcaggcgctggtgacgggcaatgtttccggcagtggcggcagcgtgcgcgttgaattccgtctgtgggacgtacttccgcagcagcagattcagggtacagcttacaccacgacatccggtaactggcgcaggatcagccacatcatcgctgatgtgatttatgagcggatgctgggcgaaaaaggctatttcgatacccggatcgtctatgtctccaataccgggccacgcaccaaccgcacgaagcggctggcggtcatggatcaggacagtgcgaataaccgctatctgaccgatggcagctggatggttctgacgccacgttttcatcctacgcgggatgagatcgtcttcatgagctatgccaataaccgcccgcgcgtttacacgttcaaccttgccacgggcggccagcggatgctgggcgagtggccgggcatgacctttgcgccgcgtttctcgcctgatggctccagtgtggtgatgtcgatgacacggggaggcggatcggatatttacgtggtcggccttggtggcggtggtcatcgtcagcttacaaattccggctcgattgataccagcccgtgtttcagcccggatggcagccagatcgtgttcaactccgaccgggggggcgatcagcaactttatgtcatgggggccgacggctccggtgtgcggcgcatcagcttcggcagcggacgttatgcgacaccggtctggtctccgcgcggtgatctgatcgcgtttacccggcttggctcttcggcctggaacatcggtgtcatgaaacccgatggctcaggtgaacgtattcttgcgcagggatacgatgtcgaagggccgactttctgccccaatggccgtgtgctgatgttctggtctgcttccggcggtcggcagaagctcgtttctgtcgatattactggctttaatgaacgtcctgttccaacaccgaccgatgccagtgatcctgcctggtcgcctttggctggataagattaaaatctggagagaagtcgtttaggtgctggtgaagatattgaccgattgcgtaatgattcgataatccgcctggcaagacgtggcgggatcaatcctgttcgcaaaaaaaccgggaacgcacgtaaacagcctgtcaatttgtgtagggatacaaaagcaatgaactacaagcttttcggcgcgatggccgttgtcgcccttctggcggcgtgctccggtagcgatcagtctgccaatcagggcggtgcaggtgcttccaccactgcgaccggtgttgttcctggcagccaggaagatctggtccagaacgttggtgaccgcgtattctatgcgttcaaccagtcttccctgagcaccgatgcccaggggactctggatcgccagtctgcctggctgcagaaatacccgcaggtgagcgtgcaggttgccggtaactgcgatgatcgcggcaccgaagaatacaacctcgcccttggtcagcgtcgtgccaatgccgcccgtgacttcctggtggctaagggcgtcgcctcttcccgcatcaccaccatcagctacggcaaggatcgcccgaccgctgttggcgatgacgaacaggcatgggcgcagaaccgtaacgccatcacctcggttcactgataacaggatcgtgtcgttgtgaaggcagcagggctcttcaccctcttgccttctggcggcagacaggatcaggtcaggaagcagtgcttcctgaccttttttgtttcccggaggaattccatgaagcccatggctaggccgttgctggctgcgatccttgtggcgggaccagcttttctcgctgcccctgatactgcgtctgcgcagatagagagccgcgaaggcattgccctgcaaaaccagattctggagcttcgacagcaattgcaggagctgggcagtcagggccgaggcaatatcgttacgactgctcctgtccagtcgcagggcaatgtgaacggtgatctgctggctcagcttctccagcgggtgcagactttggaagaacaggttcgcacggtgcagggtcgtatcgacgatctcgataaccgcatgaaaacgcagtccgatgagctggccaagcagatggaggatctgaaatatcagctggggggggcgaatggtagcaatgcccctttagccgcaccccgcgctagcggggcgcagagtgctgaaagcaggccggtaactgcgccgccgccacagacggtggcgccggcaccgacgccccagctttcgttgcaggcaggatattccgcactggcgcgtcgtgactatgcagcggccgaggcagccgcgcagcagattctgagtaatcctcgccatccccatgcgtatgatgcccagtatttgttggctcaggctttggccggacgacgggactggcaacaggccgccctgacctacgatacggtctataagcgcaacaagacgggggcgcatgcggcggaatccctgcttggactggccaatgctctgggggctatcaatgagaaaccagctgcttgcgcgacgattgccaaacttcagaaggaatttccttctgctgcaaccggtaccaatgtgaaggcggccaggctccgctatggctgttcctgaaaaccagcaatctggcttggagactgaaagtcggtatcatgatcgggtcacgccatccgcgttcgcggaggcaatggcccggattgtgccaccggtatcgcagcgggtcgctgtggcggtgtccggtggatcggatagtctggctctcgccctgttggcagccaggtggcagaggtcccgcggtggttcggttctggcactggtggttgatcatggactccgcccggaatcggcttttgaagcgcagctcacgctggagcggctgaaaacacaaaaaattgaagcccgtttactccggctgaccacgctccaaaggggcagcgcgatcgcaagccgagccagagccgcccgttatgatgcgttgattggcgcttgccggaacgaaggcatcattgatcttttgctgggccatcaccggcaggatcaggctgaaacgatatggatcagacaacaggccggcagtgccgtcatgggcctggcaggaatggcactgctccgggaagcagctgatatccgcctgttgcgtcctctacttgctttcaacaaagcgtctctgaggaatgtggtacgcgattatggtctggactgggtagaagatccgtccaatcactctcctgccgcagggcgcacacaggcgcgagaagtcgtggagcgggatggcccgcagcaggaccagctgctggaaatggcccatcacgcagccatgaccagacgtgtgcaggagcagacgattgcacaggaactcgctgcaactgtgtcttttctgcccgaaggatatgcgctggtcagtggaaacactctgtcatgtccctcccttgcggctgttctggcggcagtcagcggaagaaactaccgcccccgtcatgcccggctgacgcctttccagcatggcttgcgacccatgacgttggaaggcatccgggtgctgcctgcgggccgcctgcctggagactggctgatcgttcgtgagcatgctgcgcaacaggcccccattgttgcaaaagacagagggctttgggatcagcgtttccgtatccacgatccgtcgggagatgcagaggcaaaaggcttgtccctcggtgcgcttggcaaggacgcgaagctgttccgctcacgcgatggccttccttcggccattttgcagacactccccagctggcggcatggagagaaactgatagcggtgccgcatcttggtatcttgagaagcgatccgggtgcgacaatttgtctcagcccggcgcagccagccactggagccttgtttcagcctgctatcatgggctgaagggtccgccaatccgcagttattagtggcaagggggtgcgctggataaaaagagtgcttatgttggcacagctgacaaaatccctgagcggatgcaagcagcagatgatttcattttagggcctgctttcgccccgggacgcactgatgatgggtaatttcggccgtaacctggccttatgggtggtcatcgctctgcttctggttgtgctgttcaatcagttccagccgggtggcggaaagccgccggaagcgcagatcgcctactcggacttcattggcgaggttaatggcggtcgggtacggagcgtcacgatccagggacataatgtgtccggttcgatgacggacggcaaagcattccagacctacactcccgatgaccagagtctggtgcagcatctgaccgacaagggtatcagggtggtggccaagccggaagatggggatgtttcgccgttcctgcattacctgttgtcatggtttccgttcctgctgctgattggcgtatgggttttcttcatgcgccagatgcagtccggtggcgggcgggccatgggttttggcaaatctcgcgcccgcatgctgaccgagaagcaggggcgtgtaacctttgaggatgtcgccggtattgacgaagcaaagggtgagttgcaggaaatcgttgaattcctgaaagacccacagaaattccagcgtctgggcggcaagatccccaagggtgttctgctggtcggccctcccggcactggtaaaacgctgctggcgcgcgccattgccggtgaggcgaacgttccattttttacgatttccgggtccgactttgtggaaatgtttgtcggtgtcggcgccagccgtgtgcgtgacatgtttgagcagggcaaaaaaaatgcaccctgcattattttcatcgacgagatcgatgcagtcggacgtcatcgtggtgccggtctgggtgggggcaatgacgagcgggagcagaccctgaaccagatgctggtggagatggacggcttcgaatccaatgaaggcgtcattctgatcgctgccaccaaccgtcccgacgtgcttgatccggcgctgttgcgtcctggtcgcttcgatcgtcaggtggtcgtgccgaatccggacgtggccgggcgggagaaaatccttcgcgtgcatatgcgcaaggtgccgctggccagcgatgtcgatcccaaggtgatcgcacgcggcacccccggtttttccggtgccgatctcgccaatctggtcaacgaggctgcgttgctggcggcgcgtctgtcccgccgcactgtctccatggccgaattcgaggatgccaaagacaaggtcatgatgggggctgaacgccgctccatggtcatgtccgatgccgagaagcgcatgacggcctatcatgaggcaggccatgcgctgtgcggtatctatgagccggacagtgatcccctgcacaaggtcactattattcctcgtggtcgggcgcttggtctgaccatgaacctgccggaaggcgaccgtctgagctactccaaatcctatttgctggcgaaacttgtgctgacaatgggtggccgtgtcgcggaggagctgattttcggccccaatcaggtgtccaacggtgcttccggtgacatcaagcaggctacggacatctcccgccgcatgatcacggaatggggcatgagcgataagctcggcatgattgcttacggtgataacagccaggaggtctttctgggtcattcggtgacccagtccaagaacatctccgagcatacggcccgtgaaatcgaggccgaggtcaaacagatgatcgaccgtgcctatgcgcgcgcaagggaaatcctgacccagcatatcgatgaacttcatctgctggcccaaggtttgctggaatatgagaccctgtccggtgaagaaagccgcatggtgatgcgcggcgagaagatcgaaaagaaagttgtggatgaaccgatgccggaaacacgtcggtcttctgttcccacaacaagccgtccggcgacgcctccacccggtgaagggtttggggcagccactcagccgggctgacaggctgagatgatgcgccatcaggaggcgggagcacataaggacattcttgctcccgtcgagccgcttgggctgttgaatgcagaggcagcgcgtctggctgtatcgtcaggtgcggcggtgccttttctcggcggtccgttggcattttctctatatagaaaaggtgattccgtttttcctgcgagccggctggaagaaccggaaaggaagagactgacagccctccgcccccgctgggccggttttgcgcgaccggccattatgggcatcatcaatgtcacgccagacagtttcagcgattccggtgatcgcttcgatgttggtcgtgccgttgccgatgcagaagagatgctcgctcagggggccgatattctggatatcgggggggaaagcacccgtccgggcagtgttcccgtgccccctgaagaagaacagcggcgcattttgccggtcatcagcgctttggcagccagaggggcggtgatttctgtcgatacgcgcaatgcctccaccatgcggaaggcgtttgatgcgggggggcgtattttcaatgatgtctccggcctgacgcatgattctgcttcacttcgtcttgcggcggaggctcagtgtcccgtggtgctgatgcatatgcgcggtacaccggcgacgatgatggatggcgccaacaccgcctatgaaaacgtggtcgaggatgttttttacgagttgcagcatctgctgaacgaagctgaaaaagcaggtatccgtcgagataatatcgcccttgatcccgggataggctttgccaagctgaaccgtcacagcgtggctttgctggatcggttgcctttgcttgctacactgggttgtcgcctgctgattggcgtatcgcgtaaaggtatgattgcggcactggccggggacaggactattcctccgaaacagcgtatgcccggttcggtggcagttgctttgcacgccctatcgcgaggggccgatattttgcgggttcatgatgtggccgaaacggtgcaggccgtcaaaatctggatgggattggaggctggttgaagcgatgaataccgaaacccgtctatgggctgatggcttcggctttgatccgacatgacgcagaaacgtctcttcggaaccgatggcattcgtggtacggcgaataccgcccccatgacggcggaaatcgccctgcgggtcggacaggcggcagggctgctgtttacgcgcggcgatcaccggcaccgggtgattatcggcaaggataccagactgtcgggatatatgatcgaaccggcgctgacggctggtttcattggtgcgggcatggatgtgaccctggtcgggccattgccgacaccggctattgcgatgctcacccgctccctgcgggctgatcttggcgtcatgatctcggcatcccataatccttatgaggataacggtatcaaattgttcgggccggatggtgaaaaactgtccgacgcgaccgagatggaaattgagcgactgcttcatgccgatctgtccggccagcttgctgcgcctgccgcacttggccgggctgcccgtcttgaagatgcagcaggacgttacatcgaaagcgccaagtcaacctttcccaaatcgcaacgtctggatggtctgaaaatcgtgctcgactgtgccaatggcgcggcctatcgcgttgcgccgacggtgctgtgggagctgggcgcaacggtgatcccgctgggtgtcagtccggacgggttcaatatcaattccggctgtggttcgacggctccggattatctatgtgctcaggtggtgaagcacggcgctgatctgggtattgcgcttgatggcgatgcggatcgtctgctggtctccgacgagcgcgggcatctggtggatggggatcagatcatcgcattgattgccagaagctggtctgccagcggtcgtttgcgcggtgacggcgttgtggcgacggtcatgtccaatctggggctggagcgctttctgaaagcaaacgggctgatcctggaccggacccgtgtcggtgaccgctacgtggccgagcagatgcgggcaacaggccgcaacatcggtggtgagcagtctggtcatgtcatcctgtctgattatgcgaccaccggagatgggctgattgctgcgttacagatcctgtccgttttggtggaggagggaagaccggcctctgagacatgccgggtatttgctcctttgccacagaaactgaaaaacgtgcgctatcatcgggataatccgcttcttcatcccagagtgaagcaggcgattgccgatgctgaaagcggcttgaacgggcatgggagactgctgatccgacgcagtggaacggagccgctgatcagggtgatggcggaggcggaagatgaaaccaccgtcatccgtatcgtcgatgagttatgtgatattattgctgtgtcagcagagtctgaaacacaggtgcatttgtcatgaaagggcgtgtgctttcagtggctggctcggattccggtggaggggccggtattcaggctgatatcaaaaccattacggcgctgaatggttatgctttgacagcattgactgcgttgacggcgcaggacactcagaatgttcatgccacgcttccggtgcctcccgattttgtggctttgcaaatccgttttgctctgggtgaccctggtgtcgatgctattaaaaccggaatgctggcaaacgcagcgactgtgcaggtggtgctggatgagatcaaaaactctgccagactgatgactacccggcttcctttggtggtcgaccctgtcatgatcgcaaagggaggagaatccctgcttgatcctgaggctgttgcgctggtgcgagagggactggtacctgcggcttctgtgctgacccccaatctgccggaagcatcagccctgacaggattatccgtgattgatgaagccagcatgaaacaagccggtcagtttttgcttgagaaaggggcccgtgcggtattgctcaaaggtgggcatttgcaaggaccaaaagtcgttgatctgctcatgacacaggatggcgtcaaacgctacgaggcacccagaattgagacgaggcatacgcacggaaccggctgtacgctggccagcgcgatcgcaaccggtctggcacaggatatgacgctggaagatgccgtgacccgcgcgatcagctatgtcagggcggccatgatcagggctcccggttttgggggcggccacggtccgctgaaccatgccattaccgtcaatcgtctgacgcgctgggattgagattctcgcagctttaagctttccaaagaccggcagcatggtcggcagcatcaacgcccgcaaccggctgcacgtatggatcgcttgccgcctgccatggttggttagtgggtatggcgtgcccaaggccgggaacaagatgcagtgataccagcgtttcaccatctcgttgccagttgattccctccagccttgcagcctgctcaggtaacatctctgtctgcatatgatgcggaagacggtgtagactgagaaactgccttgccagcaatccggcattcaacggtgaaactaccccgtcaaccagcccgtgccagatgctgatgcgcggccagcgcgctacattggatggtgcaaggactcgtgcgcaggcttccagatactcatcactgtaaacgggcaggccttttttcatcagcgacagggcaccagcaggtgttttgacgacattgatgggcaatcccgcaaacagcatgccggacgcaaatatgtccggataggttgccagcatggcagcagccatggctgcacctgcggataatcctgcaatatgtatccggtcaggatcaaccggatacgttgtgcaggcgtaacgtatcatggaaagaatcgagatggcttccctgccatggctgccaatatcttcaggccgaaaccagtggaagcatccagccgtatgattggttctggactggacaggtaaaataagaggtgcattgaggcgttccgccagggtgatccaaccggatgcggcggcaaatgcctcggcattttgcccgcatccatgcagcaaaatcagaagcgggcagggtttcttttgttgtcgagaggacggaggatagacaaacatattcagtcggcccggatcaggaccgaaatgatcgatcctgacaggcctcttttccagcaaggtggcttgctggatgagcggagacggcgctgccttttgcaacagttccgctgcatgacgcgctgtccgcacccatgatcgaatcagtttcatgtatcaggaacagccgcggctcgatcggattttttcactgagtcggaagttgtttccagtaggatttgaaaaacccccggctgtccagcttggcctcatgcggagaacgcagtggctctttccctttgcaggaccaggtgaagggagaattgtggccaatgacatacatagggacgaaatccgtatccggatgtccctggcaccattccgtaatgggaccgggtgtaccaagggttacatccgcctttccacagggcagattggctcctgggctgcatatccacacggcatgatccatgcagcgccattgcagcatggaagaggcatgcggtttcagatcgaacagtgcatcccccttggtatgaagcgaagaagggatcgggcgtactgtatcattggtgccgatggatttgcagtacgccaccggatcctgaacaccgtctgccgccctggccatgctggaaaccagtgtcagaaggctgatggctgcaagggaggattttaaaagaaccattacactgtctgctttttgatcggggcgacgaattgaggctccgtgtcccacgggaacaggatccatgtatcctgagacacttcagtcacgaatgtatcaatatcgtctttaccgtcaggcttggcgtaaagacaggcgaaatgtgccttgggcaataatgtccgcactgcacgcagtgtggtgccggtgtccaccagatcatcgatcaccagaaaaccggtcccatcaccggccgcgtcaggcattttggtcactacaggcacaccgcgtgcttcatcttcataggtcatcaccgacacactttcgaccaggcggcattccagttcccgggcgataatggcagccgggatcaggccgccgcgagtgacggcgacgatcccctgccagggctgttcgatcagccgccaggccagcgccttggcatcccggtgaagctggtcccatgtgactgtgtaatagcgttcggccatcggatgatccgtgttgcaaatgccacggttctgtccgggctggacgattttggcggtgccggcagaggcagacaagtccggaatggaccttcctgcccgaagcattgccatccatcatacagggcggcacaattccccaatgcgcgattttcattttcccggccgcagcccggccattggcggcgaaggaatggccgcgacctccatgcctgctgcgactcttgcagcgctggatgtgctgaaaagcggtgggaatgcaatggatgccgcgattgcagcggtcgccgttttaagcgtgatagagccgcaggccactggaatcggtggagactgcttctgcctgtacgcccctgccagcggtggagtgcatgcgctgaacggctctggtcgctccccggcggccctgacgctggaggcgctggagaaacagggcatcgccatgctggcgccaacctccgcgcatgcggtgaccattcctggttccgtggcggcgtgggaggctctgctgaccagatttggcacgaaagggctggatacgctgttgcagcccgctattgcgttggctgagcagggcatgcgggttcacgcccgtgtcgcgctcgactggagccggaacgaggacaagctgcgcaatacaggggcctattcttttctgcctgacggccatgcaccatccatgggggatctgtttcgtcagcccgctctggccgaaacgttgcgtgtgatcgcaaggcagggtgcacgcggattttatgaaggtgcgattgctgccgatatggtggccacattgcaggccaaaggcggcctgcataccgaggaggatttcgcggccggcctgacagcaccggaatttgtcactccgatccatcgggcatggaaaaactatgaggtctggcaatgcccgccgaacggatcgggcctgttggtgctgatgatgctgggaattctggaggggtttgagcatccgccagaaggtccattgagcgcgttacggttacaccggcatgccgaggcagcgcggatggtctatcgcgaccgcgatgcgtttctggctgatcccgcgcaggttgctgtgccgctggagcggctgttgagtgattcttatctcaccgcgctccgtggcctgattgatgaccagaaggcaacgacaaccctgccggctgcgggtgaaacattgctgccgaggcatcgggacacggtgtatctgtctgttgttgatcgctacggcaatgcgtgcagcctgataaactctctgttcaacgattttggctcgggcattctggccgggcagagtggtgtattgctgcaaaatcgagggcttggattccggctggaacgcggacatccgaactgtgtcggtccgcgcaaacgacccatgcatacgatcattccggggatgctgatgaaagatggtcaggctgttatgccttatggcgtgatgggcggccatttccagccgatggggcagaccctgtttctgaccaacatgctggaattcgggatggatgttcagcaggcgctggactgcccccgtttgtttccgttccggggcaagctggaaatcgaacgcggtattccggtcgaggcacgcacagcgctgaccgcgttgggccatgatctggaggaaatcgagttcccgcatggtggcggacagggcatctggatcgatcgccagcgcggtgttctgctgggtggatcagacccacgcaaggatgggttggcgatgggctactgaatcgctctcgccagtggaaacctggccagcaccgaaaaattccggtccggagtttcctgccgataaacacagagcgcatcgaccaagcggattttgtccaatgcggctaagaaatatttctcagccgcagactggatttctggaatggcagagacaggcaatttttcactgagtgtcatgtgaaaacgccactcatccagcacatcgggatagccccattgctggagcatggcctctctggccggtgaaagcggccattgcctgcgtctggcgagttcttcatctgtgggtggcgcccggaaggggtcgagcgcgatgacacagtgatcacacagcgcccgtaatgcggatgagggactctgttcggtcagagccataaaaccctgcactgtggtgacgctgagcgctggcataggaaaaacagggatcatgcctgcaagggcttctaccgctgccagaaactccttttcgtgatatccggccttcagcctgatgggaggcttcaaggtcgcatggaacccgtagcgacgcggtgaagccgtcagggcggcccattctgcggatgacaagccgggcagggcaggctgaagcagggtctcgtctgtgagcggatcacgacccagccagcggcatcccgcctgccatagcggatcggcgggatcaggggcatagtagatcgcgtatcgcgctatgttggcagtggtggagagcatagttatcacgcgacgcgctcgccctgacgccatacggcccgcaccacgggtgttcccagatgtacatggacccgcaccagatcggcccgaagccccggggcgatccttccacggtcgtgcagccctgtcatggtggcaggggcttcggtgacaagccggatcgcggcgggaagatcaagacatgcaatggaagccgccataaaggctgcttccagcatcgcaaaaggcacgtaatcagaggccagtgcgtcgatcagcccgttctgaagcagttcggcgacggagacgttgccggaatgcgatccgccgcgcacgacattgggagcaccgccgataatcgccatcccggcggcacgggcggcctgggcggccaccagactgaccggaaactcgctgattttaacaccatcggccgtgttttcagcaatttcctcttcggtgcggtcgtcatggctggcgagggctactccccgtggccgtagcaagtcgagaatcgcattacgattcggcctgcgcaatgtgctgcgtctggcctgtgcctgttggatctggttttcagtctcctcgacggaatatccatcgctctgcaggagtgcccggtagcgggtcaggtcggaatattggccataaccgggaacatgatccatcaggctggccagtttcagtctgggatgctccgccagtggcctcagcatatccagcgtatcgggagcaggcatctcacagcgcagatgaagaaaatgctccgccttgagcatgttgccggatgtcagggtatcgagatccttcaccccatcccggcaggtcagcattctttcttcctcgaagccgagattaccgaggcaaagactatcgaacacggtggtgataccggccgcgacacattgcgcatcatgagccagaaacgccgacacggatggaaaacgggcattttgccgcggcaaaacctggcgttccagattatcggtgtgcagatcgatcaggcctggaatcagcaggtcaccttccaaatcttccccttctttaccgagggaggaatcggagccgatcgaagaaataacaccatctgcaatggtgatggaggtctccacgacgcgatcagggagcacgatccgggcattggtcagcacaagggaatgcatctcccctaggtgcaccagaatccctgtatccgccaagatcaagaatcacgggaaataataaatcctcgtccatcataaggatttatcagcattaagatcaattttgggggaatgaagcactggctcccggagtaggactcgaacctacgacccagcggttaacagccgcttgctctaccaactgagctatccgggaacagcgtggcggtcatatagccgggtcgatccggcttgcaaagccctcttcgccaaaaaatatgacattcaggttttgccggggatgggctggcaaaaaataagcgataccggtattgtccgactgcccgttatggttcaggtgatccagcctgtggtttcggattgatggtccggacaggccggatcgcggcaggggcgagagtggcggaacggtagacgcagtcgactcaaaatcgaccgccgcaaggcatgggggttcgaatcccccctctcgcaccaatatcccggccaaaaccttccggcatgaagggagcctgcagcatgcggcatttcatcagcgacatgcgctttttcatggatcgtatccatcgaccacaggccattctgctggctatctgtattgtttgcgccacgatctcaatcgtcacggcatctctggatggtcctatctggatgacaacattgttcggcgtaccgtgtccgtttctcttttttgttgtcattgccatgatcgtctgagcggacgttgatcgcttcatggcacgtattgcgtatgtgaatggccgctatcagtcactccggcaggtggccgtctgtgttgaggatcgcggcctgcagttcggcgattcggtatatgaggttatctacgtcgcccatgggcggttgatggatgcgggactgcatctggcgcgtctgcgccgctccctggatgcattacgtcttccgttcgtatttcacgaattatctttgatggcggtgttgacggaagtcgtcaggcgaaaccggctctcttccgggctgctctatatccagatcacccgtggatatgcgcccagggcgcatgcgtttcccgacggtcaggcgcagcccacgatgatcgtgacggcccgatcagtgacatcctgcccggctcataccgaaggctggggtgtttccgccatcactctgccggatgatcgctgggcgcgttgtgatatcaagactaccaacctccttccgaatgttctggcgcggcagcaggcgagggaacaaggcgctgcagaagcgattctctatgaccgggacggaaacgtgaccgagggagccgccacgacggtatgggccgtgggtgcggatggtgtgctgaggacaagaaatctggattgttccgtgttgcctggctgcacgcgggagattctgaaaacggatattcttccagctctcgacgggttgtccgtgcgggaagaaccgatcgcgcttcatgagctgaggactgcgcgagagatttttctgaccagtgcaacgagcttcgtgaaaccggtgctgcggctggatggtttggcggtcggcgatggaacgccaggccctgtggcacgccatctgctgcatcatctgtcgcttcatttcgacaaacaggtaccatgaccgacgatcgaccggatgccatcctgtgggactgggacaacactctgatcgacggctgggctgcgatcgcctctgccctgaatactgtgttccgtcatttcggacgtccggtctggacagtaaccgagacgaaagcacaggtccgaggttcagcccgtgatacctttcccgctatgttcggaacacgatgggaggaggcgcgggatattttctatcatacactttcggccagtcacctcgatcatctgaagcccatgccgggggctgaggacatgctgcgtgcagcctccctctggccgcaggcggtggtatcgaacaaggcgggagattttctgcgtcgggaagtcgcccatatcggatgggagccttttttcgatgcggtgatcggtgccggggatgcagcggcggacaaacccagtgcggcccccattctgatggcgcttgagcgcatgcgctataccgggaaacgtagcaaggtctggtatgtcggggatactgctttggatatgcaggcagcccgcgccgccggatgcactgccattcttttgggcgatgccgcccatgacgggggaattgcccgggctatatttgatcatcatgttcaggatgggcatgcattggctgccatgcttactgtattgcatggcaggccctgacccagcttgccagcgctgcggatgccccgcataatcagcttcagccggtgcgaagccgtatcattccacgggcaccttaaaacaacaaaaaaagaagggaaaacagagccatggccagtgaaaagtcccagaacgttcaagatgtctttctcaaccacgtgcgcaagagcaagacaccggtgacggtatttctggtcaatggggtcaagcttcagggtattattacctggtttgacaatttctctgttctcttacgccgtgacgggcatacccagcttgtctataaacatgcaatcagcaccgtgatgcctggtgcacccattcaattgttcgacgcgaccaagccggaaggcgatttgggccgtgatacggctgcctattccgacgagtagaatgccgcgtcagaggatatggcaattcaagatttttcttcgactgaccattcagccaattctgtctcctccggcccggccagggcagcggtcattctcccatgggaaaagccagagcggggggataaggtagaacggctggacgcaggccgcgctgccgaggctcggttggccgaggccgtggggcttgcagcctctatcggcctggtggtggtgcatagcggtgttctgccgctgcgtgcgcgtcgcccttcgaccctgctgggcgagggacaggtacaactgaccggccaggcactggcaggtcaaaacatcacggttgttatcgtcgatgcagccctgaccccggtgcagcagcgaaatctggaacgggcctggaacaccaaggtcatcgatcggaccggtctgattctggatattttcggtgagcgtgccgctacacgcgaaggtactctgcaagtcgaactggcacatctggagtatcaacgctcccgtctggtgcggtcctggacccatctggagcgtcagcgcggtggtttcggctttctcggtggtcccggtgaaacccagatcgaggctgaccgtcgtctgattaccgaccggatcgtgaagctgaaacgcgaactggaacaggtgcgccgaacccgtggcctgcatcgcacggcccggcagcgtgtgccttttcctgtcgtggcattggtaggctacaccaatgccggtaaatccacactgttcaatgccatgaccggttccaccgttctggcaaaagaccagcttttcgctacccttgaccctaccatgcgtggattacgcctgcgttcgggacgtcgtgtcatcctgtcagatacggtcggtttcatcagcgagctgcccaccgaactgatcgccgctttccgtgccacattggaagaggtggccgaggccgatgtcatcctccatgttcgggatgtttcgcacccggatacggcggcacagcgtcatgatgtgcagctggttctggatggaatggtccgtgatcatgatctggatgccgattggcgcggcaggatgatcgaggtattgaacaaggctgatctgctcggcggagttgagcatgtcagcgtggcgccgggcagtgtggctgtctccgccatcaccggcgccggactggatgagttgcaggctgttattgatgccagaattgccgccggccttaccatcgcgcattattctgttcctgccgcggatggtgcggccatggcatggctgcatgagcatggagaagttctggaccgtcaggatgatgctgagaatggcatgatcgccgttaccgttcgtttgcgcccggctgatcaggcccgttttgaacgtcttcataaagcgcgcccggtagtcgataaacaggatgcttcaagccaatgacccgtctgaccgtcgcgcagattgagactgtcgccggtattctggccgaggcatcagttcgggagattatgccccgtttccgtcggctgtcagcagagtcggtgcggatgaaaaccggcccgctcgatctcgtgactgatgcggatgaggcagcggagcaatggattacacaggcattgctgcgacagtttccatctgcccttgtggtcggtgaagaggccgccgccaaaacgccgtccctgctgaatgcactggcggatactgatctggctttcgtggtagacccgatagatggcacttccaattttgcggcaggtttgaccctgttcggctgcatggcagcggtgctgagtcggggtgagatcatggccacgatcattcatgatccagttagccgcgataccgcctttgcttttcggggagagggggcatggatcagctttccggacggcacgcgtcaggatctgcgggttgcggtctcggtaccggttgcggccatgaccggcgctgcatcatggcgctttatggccgagccactgcgcagttccgtctgtcagggtatggcgcaggttgcacaaagcttcgattttcgttgtgcagcccatgaatatcgtatgctggcaggtggccactgccattttttattgttcaatcgcctgatgccttgggatcacgcccctggtgtgttgctgcatcaggaagccggtggatattctgcgcagttcgatggtcgaccatacagcccgctacggcatgagggcggattactttgtactcccgatgccgaaagctggcatcgtctggcgcaggcattgctgggtcagggctgagaaacttcgcgttcccgctttttgacagcctgccactctgcctccatggcatccagcccggcatcggccggagacaaccctttttgggccagtgatgcttccactgcgttgaagcgacgctcgaattttgcattggcagcccgcaggacagtttcagggtccaggcgcagcttgcgggcgaggttggccatcacgaacatcatgtcccccagctcatctgccagccgttcaggatcggccgagggtaattcggcacgcaactccgccgtttcctcggccagtttttccagcacggcattggcatcagaccagtcaaagccgacccgtgcggcccttgccgtcagctttgcggctcggctgagggcaggcaggttggtcgatatacccgccagcacacctgtttccgccttggccagccgttccgcctgtttcctggcttcccatgctgccgttccgtgaccggatgtggcagggtcgcaatcctccggtgcgaacacatgagggtggcggcgaatcatcttgtcagtgatgccctgagtgacagaagcgaagtcaaaactgccttcttcggatgccatctgggcatggtagacgacttgaagcagcagatcccccagctcatcctggagtgccgcgcggtcaccacggctgatggcatctgccacctcataggcttcctcaatcgtgtaaggtgcaatggtggcgaagctttgctggatatcccatggacagcctccctcaggatcgcgcaggcgacgcatgacgtttagaagggagccaatcgcggcagccggatcagtgttcgacatgtaataacgccagaaaaacttcgatcatgatcagcaggatgacggcgacttccagcatttgtccacggctgccggcagcttcttcatagagggccgaatacgtatcccgcacgatgtccaacttacgatccacggctgcactgacggccttgacgcggaaaagatcaagggccgcgccataaatacgagccagatagacgtcttccgtcacctgaagcgcattatcgacccgctcggtcagctccgtcacctctgccaccagcgtatgaaagcgccgggccagagttgcaaaacggcggggtgcatacatatcgaaccgcttccgggctgcttctaccatattatacatacggggaagctcggcatcgagcagctcgtcatagaaccgcatctccagcagctgggcattggcgacttccagcacatccagaatatcactgtcacctcgggcatcgataatgaaagctcggtcccaggtcaggatgaccagatcatcttcgtaataggaaaagcgctggcgcagcagatcacgccgtgcctgttgggagagagggcgggtttcgccggaaagcagggcggcgatgtcaatttttgtatccagcgcgtcaatactgatcggttcattgaaatggcggacaaaagcgatttggtaatcttcctgcaaagagccatctgtgggttttttccaacagggcaaaagggttttacgcagagtagacaggatatcgcgccagaccgtcgctgtttcctcattatccagaaccgtaaatatgccgtcatggagcgccacgaaatcctgccagagcatatccgtgacaggccgccgtatttcaatgacgagagcgccaaaatcatacaaccggacggcgaccgccacttcatgcgttgccaggccaacaaccagatgccggattccgagatcaatggtcagtggaggattgccgaatgataccgctttgggagaggtcgtgctgaggctggcacgggcagggcgtgacctctcatctgattggcgttgcagccagagtcgttctgcctctttcaggtccatttcgtaggcgacgtcgacaagacgcaaggcaataatatcgcccgttactgtcagaccggaagaagcggagaccggtggggcagccggaaaaagcattgcagagtctgaaggcgacatggtggctggcacgtagtgaaatccggaactgtcacaaagcagcacgttgtattgtgaacgcgcaacaggtcatcaatcaagtgtgcttcttgtgacagttccggagcaagcggctaacgactgctcaatccagatcctgtgcctttccagcgtcgcggtggttagggtctttcccttccagacgcagcagaaagcgatgatagcgttccatcaccacatcttcactggtgccgctgacggctgcggccgttgccagcaaggcagcgatcagatcacttgtttgtggggtcatagcggcacctttttttgctgtttcgttctttccagaatggacaacagatgccggaacgacaattaaataaggttatatttcttttttaagtattgtgataacggctgctcgctctatttgtcgtgggtacgctctgcacgttcccagaacgctttcatcgggccagtatctggatcatgccctgtgacacgttgggcaaagcgcagatagcgctctatgaccagctcttcactggcctgcccgatcgtcgccgcaacggtcagcagcgcggccgtgacatttttatcatcgctatccatatcaattcccttatctaccgttggctgactgtgtgccagatcagggtgcaaatgcaaccagctactgcatggcggtctcacttttagctgtcagatcagggttaccgctgtgcagcacgggataaggggtaccgctgagcttgtgaaagcaggctgcaatggctataagggcgcatgagccggtcagaatgggcacaaatgcaaagctcatatccggatttagagcgaagataacaagcggattggccccggctggcgggtgggtcatacgcagaacggtcatcagggcgatggccagaccgacaccaagggaagcagcccaccatgtgttcggtagaatagccagtaacgccagaccagtcagcgtggatacaagatgaccaccaatgacgttgacgggttgggataatggactatgaggcaccgaaaacagcagaacgctgctggccccgaacggtgcaattaacatcggcaattcagaataggctgcagctgctcctatcgagccaactccaagcaatcctccaatacctgccagaatcgcggcgcgggctggctgggagggttggtggcgaataagaaaacgacgcatgcccgagaagaccctgcaaaagcgaacatttttggtgcaaactatgtacatttttatagcagggtgaccaatttatatcaaatgtcgcaagcgctgtgataacggtccgggttcaggccggaatgatcagatcaatgggccgcgtatcgcaagcgatgacgctccagcgtttttctaaccccttccagtgcctgcaagacttcttcctgaaaatcagtcccctgcaaatggtggatgtcgctatgtgcggcacagacaacgggcgtatcccgccactgccgtgcaaggccggaggcccagcgtatatagcggtcagcagcatcggcgtttttctgcagggcttttcccagcaaaggatgaaaagtcagctggggagatggcagaaaccgcctgaggataggaggtattttcacaacattcagagtatcatcaacgtgcacgatgccgctggtgcgatgccgtgccagaacagaagccgtatggacccttgggttggttgaaataaaatcgattccttccggcactgagaattcgagatcatcgccaaaaagctgttgtacctccctgtcttcaatcaacccggtttcccagttaagatctggccaaatttcccggtgtcgccgtgtcccatacaggcgggcatggggaaaaagccgatggatggaagcacaatgaagtgtgtggaaaggatgaacattgaggatggcatcgatagcttgcccatgatctgtcatctcggacagagcttcatagtgctcgccgctgatagtgtagctatcgagcaggatgaagtgcccgctccttctgcgtatcactgacatatgggtgcctacatcgtataaaccagccagtttgaagctgccccttacagtccagaagtcggagcttatctgcttcatcgatgaatgccgcctgatggtgaatggacccaagcggactgcaacagtgtataattcggaaagttgcataagaatttttgttcttatgctggaaactaaagttggtatttctttataagaaaataaacctaaattttattgcatatattttgaatataacaaaataatttatgaatatctttctcatcttgcgcagaaacacggtatcttattaaacgagcggcagaaggattatacgtgaaacagtcagcccctgcctatctgatagattattttcggcactcccgggtggcgctggcgttggcggcacctgacgggaatcatgacctactgtgggtcaacgggccattcagcgccttgaccggatatagttcggccgaagtcattggcaagaattgccggtttttgcagggtgatgctgacaatgaggcaggaaaagcaaaaataagacagtttctgcagaatcatgatcaggccagcgtaagaacgccagttattaacttccgtaaggacaaggttccgttcgttaatctgctctctttatcccgtctgcaaggggcggacggaacgactaaatacattttcgcatctcagtttgatgtcagccgttcccatcctgatcttcttatcaactatgacagggaactggcagccacactgggtggtttacgttccattgagaaagatggaggcatcgtggttcaagggacagtgctgacgatcgccaatacctcggccctcgttgcccaggccaagatgacgctagcggagctggaaaacgtaccagatgcatgacaactctctggcggccgacagaaaagggaacaaaaatcaggctgcctcctttcccgttgtcgggataggcgcctcagcaggggggctggaagccctgcgcgacatgctttccactgccacgctccctaccgggatgtcctatgttattatccagcatctggaccctaaccacgaaagcatgctggctcagctcctggatcgcaacaccgccctgcaggtgattcagtgtgaggggggagagaaaatagagaccgatattgtctatatcattcctccaggtcatgggcttgtcatccgtaacggtattctagagctcactcaatttcagcagccgcgtggattgcgtcgtccaatcgatgattttttcctgtctcttgccagtgatcagcaggaaaatgctgtctgtgttatcctgtcgggcacgggaggagatggtacaaccggattgcgggccatcaaggaaaatggcggactctgcgttgtacagcagcctgagactgcccgttatgacggtatgcccctttcagcagtgggaacgggtcttgtcgatttcatatgccccgccggcgaaattctgaactgtataaagactttcttcaatcgacgaatgactgatcagctggatattgaaaccgtgatcgtggctgatcacgtcgatgaattatgccgtgtactgcgtgctaatacagggcatgattttgcaggttacaagcgttcaaccctgattcgccgtgttgagcggcgtatgcacgtgttgggaatcaacagtggtcgtgcttatgtaaaccggatcagagaggatgtcgtagaacgtgaggcattgttccgtgatcttctgatcaatgtgacccgtttttttcgtgatccagaagcattcctggcactgcgcagccaagtgatcgagccattgctgcgtgagcgtgcggccgatgaggatatacggatatggattcccggctgctctagcggagaagaagcctacacgattgcaatcttgtgcgcagaagcagcgcgaaccactggtcagccattggccgtgcagatttttgccacggacatagatgaacaaatgttgtcccttgccagggaaggttcatatccggcttcggctttgatagatattccggtggaactgagagaacgttatacagttcctcatgcagagcggttttcaattatctccccgattagggatatgatccgtttttccaatcacagtcttataaaagatccacctttttcgagaatcgatctggtttcctgtcgcaatttgctgatctattttgctgaccgattacagcagactgtcattccacttctgcattatgccatccgcgcaggcggctatctttttcttggtccatcagaaagtgttgggcgctttgaacatctgttcccgatcattaaccagcatgcgcacatttttacccgtcctccgggggcaccgaattatccgattgatctacctgccaacttgcgtcagcgttcttccataagggaaagaggaggtaagggtgataccagcgcgctcggagacgaaagtgcagcgataagacgcttggtggaacgctatgccccaccaagccttgtggtggatcccgatggaggcattctggcggcgtatggtaagctgagccgttattttgaatttccagtgaccagaacaggcggaagcagtgcaatcaatctggcccgcccagggttaagggatgtcatgggtgcgcttctgcgtcaggggcgtgaccaaaaacggaacgttgttgttcgtgatgttgctgttgaaaccgactttggtacacagcctgttgaagtaacctgtgatcctttaaacgatggatgtctgcttttcgttatccgtgatagtgggccgttcaaaccactggaagattctgaagtctatgaaattcaggtcgaggacgatcatcgtgaagccctggaagatgaactccgcttgacacggtatcgtctgcgctctgcagttgaggaactggagaccgcaaatgaggagcttaaaagctccaacgaagaaatgatgtcgatgaacgaggagcttcagtcaacaaacgaggaacttgcaaccgttaatgatgagttaaaaagcaaggttcatcagctgactgtcgcaaattccgatcttcgtaatttctttgaatctactgatcttgccgtggttgtgctggatgcagaccttaaagtgcgcagttatacagaggcagcaacaaggattttccctttaaagccctctgaccgtggccgtcctttgtcggatgtggccagcaggcttgcgacaatcgaatatttcgaagatgcgagggctgtggcctgtggcgctgaatccttgcaacgcagggtgacgacgcgggatggaaagcacatttattccatgcgtgttcttccatataatactcataaaggcactgtggatggtgctactctagtgctgactgacatcaccgatgcgcttgtgatggaacggcagctggccgcagagcgcgagcgtctggatatcgccatcaaggcagcagggatcggtatatgggaatactgcccggaaacgggtgaaaccgtaatcgatgaggttgagcagaagctgttcgatgtcgatggtgtagaaggcggaaaaatcagttccttgctcgaacgtatccatccagaggatattcgagccgttgaagcagcgttgcgacgagcctcttccggcaacggagattatgaagcaagtttccgtatcaggactaaagatgatactaaacgctggataaaaggatttggccgcattattgccggtagtgctcccacgcgtttggtgggtgtttctattgatgtaacgcctgaatacacgcttgctgaaacgcgccaccttatgctgcgcgagatgaatcaccgtgtcaaaaacctgtttgccgttattgctggaattgtaacggctgtttcgcgcggtcacgacaatgttccgacctttgcacgcgatatacgtgatcgtatcgcatctcttggcaatgcccattcactggccgcatcaggaggtgagccaaaggctattgatcttcaggagttggtagaggtcacgctggccccttatcgtcatgacacaaaaatagatatttatggcccttccacgctgattgatcagtctgctctttcttcctttgcccttattttacatgaatgggctacgaatgcggtgaaatacggcgctttggacggaaaggatggtgcatccttatccgtcacatggaaacggtctgaaaatggcctgcacctgatatggaatgaacatcaggtaaaaccggttattgaatctgtaaaaagagggttcggatctctgctggtcgagaccagtgtgcgtcagttgcgtgggcagatagaaagatcaatagatgagagtgatctgttcatcactcttcaacttcctcatggcgtactaagcaatggctaagctcgttcttctggcagaggacgagatgtttattgctctcgatcttcagataacccttgaggaagctggctgcaccgtcattgggcctctggcaacactggatgaaacgctcagtgcactggatgatttgaaagacacaaaactgacagctgcgcttctggacgtccggcttgcggatagggatatatttcctgcggctgatcgattacatcaagccggcgtacctttactttttcattctgctcatgcggatgagcatatcctccatcaacgctatccggaggcagcaatttttccaaagccatgtacgctggatgagttgtatcaagttattcggcgtatagtggaataggaaaccaatacagccagataatgcctgaagaaggcgaggggaggataccatgctgcctcccccaaagaaaaattctttcatacaaaatacagttgatcttaaacacagcgcttctcaacaggaatttcctttgaaaagcaggattgtttttatcctgcttttctcaagctattcttggttgagaagtgaagcactcaagctgagcgcttcgccatgaaggctgacgcattcttctgatggataacatgttccatcagtctcttacggatgctttccaacataatgccatcgaccacacgggttgcgtagtagttggcactgataatgccattccgcttcctgctgcgcttttggattttggaagccccctcaccagcgtaggtgtgcgcgttgtggaacatcttccggttgttgtcctccacataggtttcggaggcagcaccctcggcaatcaccacatcatgcgtatcaagctcgatatgcacgtagctcactgtctccacatgctgttcctgaatgatagagacaccattcaccagacgaccggctggaaccagaacaccatcgatgaacatcgcatggagtggggagaccagcagatcccgcttcggcagaaccccgtccaaagccccctgacggatacgaaccggcagcacatcaagacgacccttgataaagcgaccgttgtagctacggcgtccaagccagcggatcggacgcaccgccccactcgccgtgatcacattgtccccgatctgcagatcttcaaccggaacctcaccacgatccgtcaggatcagcgtgccatgcacatagcagggcgtgccgtcatcatagaccgttacgccattcccgccctgagcctgacgcatcttatagttctgatcatgcgcgttcggatcaagcttgatcgagtaatactgggtcttggtcccgtcaccggcaacatgagacaggatcaggaagacattccccccactgcttaccacatccaccacatcggaagcctgataggccaatccagtcagggtgatggattcaccgttaccaaaatcggaaacagtcgcggccaatgctgtgcctggcgtgctgatgataatgtttccggatgcagcaccagcagagcttgttccccccatagtgatggtgttggatgcagccagcgcttgcgagaccgtcactgtgccggtcgtctgcatcaggatattcgtgttggtcagcgtatccgccaacacccatccatcacccttcacattgatggtctggaagccggtatattgtgtgccaaacccactcagcgtggtgccattaccatccagctcaagcacgttgccggttccggcagccgtcacctggccaacaatcgtgctgctgccgctaattgccagacgactattaccagcaccgaagttgatcgcagttctggctgagccctgggtcagaatggatccggagttggtgactgtgccaccccctgccagaatgacagcctggctaagcgcgccaattgcactgattgttccagtattattgatgctaccagcccctgtcatgctgataccagttgattgaccactccccgctatgatcaatgaagaattagtgattgtgccggatgccattacaatgccggtattatttccccctgcagcggaaatagttccggaattcacaattattccaccattagccatgctaaggccggtggctgcagagcctgtctgtatgatttgtccgatatttgtcagggtagagctagcagccagagaaataagtgccgtaccggattgtgcaccttgaatggtgccgttgttgataatggcggcagatgttcctgtgccgaaaatagcggaggacagcgtgccatttgacaagatggctgatgccgcattggtcattaccgagctggcagccaaggtcatggcaccagagaaagtgccagcgttaattgctattcctctgttcgtaaaattgtttccggtaataattgtattggtgcccgagagggtccaggtagccccggcatcaacaacggcattctggaaaccgacgtaattccttcccagtccggtaatggtccctgctgctgttccggacaacagctccagcgtattggttccggcggcattggcaacagccgttcctgtaatacgggatgtaatgcccagctgcagagtatttgcgtttgtgctggccagatagatggctgcaccaacaacgccattccctgtgttggcggctgtgccggcggcagagatagtgccgaaattgataatggtgccacccacgttgagaacaacaccaattccctgcgtgcctgttgcggaaataagcccggtgttcaggagtgtgccaccgcgtccaaggcggacagcagcgatatctccgacgcttgcagccgtgcctgtttgcagaatggtgccggagttgttcaggaaatctgaagcatttcctcccaatataacggcatgaccaaatgaagtattgttggttgaagcggtgatattgccctgattgacgagagtaactggagcagttgagctagggctgaaaaggacgacgccgaactggccaccgctaatggacccgccagcctggttggtgatgataccgcccccaacggctgtaatggctgctgtgcctgcacttccaccggatataaaaccagcattaatgaggctcaggaagccgctggcagtaataccattgaatgctccagtgatggtgccaccggcctgattgctgacatatcctgcatttgcgaaggcaacggcaacaccagcagagccagtggcactaattttgccggaattaacaacggatactgtgacgccactgctggcactaccatagatgccataccttgttccctgaatcagggccgccgttccggtattggtaacagtgccgccgttattcagataaacgccatctgtctgaccagtaatggtggcgctattcgtaacaccaatggcagcgagcgaaccaataacacccgagtttccctgaatctgcccgctattggtgagggtgcccccattgacgagcgaaacagcaacagaggccgcactgatggtggcaccggcattattgacaaccgtgcctccgcttgaaatctgaacgcccgcggcgtccgtgctggaagtggatgaagatgtaatagtgccactatttgtgatagtgcctgttccatctacgaagacaccatatcttccagcctgaatcagaccgctattggtgatggtagcggtgatagatggccaagaactgataccaaatcctccgctggattgcagagttccggtattgttaacaaatgctgttcctggtgtggtgacgaccgcgccagcgagagcaacggccgcaccgcccgttcctgttccgcctgtgataaccccgttatttaagacggttccattgatgatctgggcgccaaaaccattgcctgactgggcctggattatgccgccagcattattggtcacattgcccgagaggaggatcgcccacggatttgtaccggtggcaataattctgccggaattgattacgttggctgcattacccccaatcagggtattggccgcacctgaaatggttgcggttgctgcgttgctgagcacgcttccattgatcaaagagacagcggcacctgcgatcaatccggtgttggtcagggtgccgctatttaacaagcgggcaaaactgttgtttgcagttccttgtagaacccagtttgcatttgcatcaattgttccggtctggaaaccgaggaagttggaggcattgaccgttccggttgatgttccggacaacaactccagcgtattggtgccggcagaattggcgctagcagtaccaataatcgttgatccaacacccagccgcagcaagttaggggcggctgtgccagtcatgttgatggcaaggcccgctccattggtaagattggggggcgaggaggctgcagagacggtgccaaggttggtgattgttccaccgacattgagaacaattgcattggccagagaattcgtgacaccaatgaaaccggtattggtgatagtgccacctgctgcgaggcggactgccaccaagtcacctgcgccagcagctgtccctgactgagtgatggtgccggaattgctcagactatcagacgcatttccactcagaaaaacagcctgaccaaatgtggcattactggcaccaaggatttggccagcgttaataaccgtgttcgcaacgttggtactggacagagaaatgccaaactgaactccggaaattattccgctggtcgcattggtaatactaccaccattggtggatacaactgcactgctggccgttgtatttcctatagttccggagttagtaagtgttataaatcctgatgcagtaatgcctgcagaggtcccggcaatgattccagcagactcatttacaatggtgcctcctccaagagccacgccatatgttttgcccgaaatcaggctgctattgataatattaacattgattgatgaagcggcagagatgccccacgtcccgatcccgttatctgtaatagatccactattgtttatggatacagtattgccaccgcttaaaataataccagctgatccacccgtgatataggcaccagcagcatttatgattgttccattatatgccagactaatgccgacaccagacgtacctgttccaccaatgatagcattactaccgttgttgatagttattgcatcaggaacggtcgtgccaacgacagtagccgtggcataaataccagccgtgccacctttgattactccgccagcagtacttgatatggttccgccagcaagcagacgaataccgtctgcaattgagccttcaatgtaaccggaattattgacgactgctgggctgccgccaaacagaatgccacggaaaccaccggtaataccaccagaattattaattgtgccgccaccagcgatagatgcgccgtatccattggtgccgttaccggacagagtaccactgttggtaattgtaacctgttgtccggcaattgctgcaccaccatcgttaaacactgcaccgttttgattggtgaactgcccccctgaaagcagactgaccgatccattgatcgtaccgtagttatcaagcgatccactattcgaaatgaggccgctgttattcagggtcccccggttttccagcgtgccaagaatgttcatggtcaggccggaggcaatagtattcgccccggatgcggtccaggtggcacctgtatcaatctgaacattgacgccgatatactgggtgccgattccagtaattgtaccggagataattgttgttgtaacggggtttgtagcgctttccagtaccaaccagttctgcgttccgctaccggaagttccaccaccggaaactatgcctgttactgatgccgtgggggaaagtatcagacgattggcacccgaattcatgatcacggcggtaccgttagaattcgcactcagggtcccgagattggtgagcgtaccggctgatcccagggtcaatgcaccggtgaaggcagcgttgcttgcgtttgtgaggttggctccaactacagaaaaggtttgtgtattggaaaccgagttattgcctgtcaactgccaatttgaaccagaggttgctgtgatctggttaaacccggtaattgtcgagccaagacctgaaagggtagggggtgcgttggtgccagtagaggcgcctataagattcaagcgattgatgctgccctggccaactatagaaccgataattgtctgaccagcattcaggttaagtacattaactcctactccgatatcgccaaggttaacagctgtgcctccgttattggcaataatcacaccaaagttattaatagtattgccgattgacccattttggtcaatcatggagacagcaattcctcctgatccagtaatggtcccgctatttgttagaatagcactattgaagccattgactgtacctattatagaaccactatttgtaaggcttccgcctgcgagaattgcaatatttccattaattgctgcacttgtctgattattcagggtcccagcggttgacagctgtgagtttactgtcagtgttcctctgtttgtaaaattgcttccggcaataattgtattggcgcttgccacgcctccgataaaccagttagccccggtatcaacaacggcattctggaaaccgatgtaatttgctcccagcccggtaatggtcccggttcctgttccggacagcagctccagcgtattggttccggcagcattggcgacagccgttcccataatggtggatgcaacacccagctgcagagtatttgcgcctgtgccagccagatagacggctgcaccaacaacgccattccctgtgttggcggctgtgccggcagcagagatagtgccgagatttttaatcgtgccgcccacgttgagaacaacaccaattcccagggtgcctgttgcggaaataagcccggtgttcaggagtgtgccaccgcgtccaaggcggacagcagtgatatctccgacgcttgcacccgtgcctgtttgcagaatagtgccggagttgttcaggaagtctgaagaatttcctgccaatataacggcatgaccgaatgtattattgttggttgaagcggtgatattgccttgattgacgagtgtagcgggcgcagttgagctggtgctgaaaaccatgacaccgaactggctaccactaatagttccaccggccagattggtgacaataccacccgcatcggatgaaacgccgtatcccccagcaccgctagcagatatgcttccggcattaacaaggctcaggaagccaccagtaacaataccaaaggtagttccagagatggtaccatcggccagattgttcacataccctgaatttacgaaggtaacggcaacgccagcagagccagtggcactaattttgcccgaattagtaacggatactgtggcgccactgctggcactaccatagatgccataccttgttccctgaatcagggccgctgcgccggtattgttaacggtgccgccgttatacagataaacaccatctgtctggccagtgatggtaccgctgttcgtaacaccaatggcagcgagggaaccaataacaccccaactcccttgaatctggccgctattggtgagggtgcccccattgacgagcgaaacaccgacagaggcagcactgatggtggcactggcattattgacaactgtgcccccgcctgaaatcagaacgccggtcgcgccggtagggccattggctgaaatactgccactggcattgttggtgacagagcctccattactaaaggaaacaccaaccaatccgccctgaatctggccgctattagtaacagttcctccaccagcaaatgatatgccgactgaagaggcggtaatgactgcaccgccggcatttgtgaccgttcctgcattcgaaatcagaacgccgatcgcggatgaaatagtgccactggcattattggtgatagtgcctgttccagctaagttgacaccatatcttgcaccctgaatctggccactattagtgatggtagcagtgacagctgccgaagcagtgataccaaatcctccgctggatagcagggttccggtattgttaacgactgctgtagctgatgtagaggtggctccgccaacgagagcaatggccgcaccaccagttgctgttccaccggtgatagtaccgttgtttaagacagtcccagtgctgatctggacgccataaccattgcttggcagggcctggatcacgccgccagcattattggtcacattccccgagaggatgatcgcccacggatttgcgccggtggcaataattctgccggaattgatgacggtggcattgactgcgtcacccccaatcaggacattggcagaaccagatatggttgcggttgctgcgttgctgagcacgcctccattgatcaaggagacagaggcacctgcaatcaagccggtgttggtcagggtgccgctatttaacaagcgggcaaaactgttgtttgcagttccttgtagaacccagtttgcccctgcatcaactgttccggtctggaaactgaggaagtttgaggcattgaccgttccggttgatgttccggacaacagctccagcgtattggtgccggtagaattggcgctagcagtaccattgatcgtggatgcaacacccagctgcagcaaatttgtgcctgtgccggtcatattgatggcaaggcccgttccattggtaagattgggggccgaggaggcggcagagacagtgccaaggttggtgattgtgccgccgttattgagaacaatgcccatcccggttgtattcgaaacactgatcaggccggtgttgagaatcgtcccacctcttataaggcgaacggcagcaaggtcaccggtgcttgtacctgtccctgtttgctggatagtccccgaattgttcagaaaatctgaggagttacctgccaacaggacagcgtggccgaatgaagtgcctgtggaagctttgatgagtcctgcattgataatggtcgcagccgttcccaagctgctgtaaagcgtaatgccgaactgactgccggaaatggttccagtgcttagattgctaacaaagccgccattattcgtagaaattccctgaccgcccggcgctgtggagcttatggtcccactgttgataacagtgccggttcccaaaaggttgataccatacgttgtgccggtgacagcaccgctattggtgatggtccacgctattgtcgtaaggctgctttgaattccgatgccggccgtattgccaaccgcagtccccgcctgaattaaaatcgggttcgtgtaggcgggcgtgacaagagtaatgccggatgtagtggatgtaagagttgtcattcgatccgcctgactgagcctgaaatgttaatttctttataagtgcttacttccatagcaaaaaaataaaagtgtgtgtagcaaaattattgtttttatttgtaaaatcgaagtataaattaaaatcgaaacgtatatatatttatttattataatatatttaatcccaaaatagatatttgtcataatttttttataaaatgtatttttgtatttttaatgagagaaaatgtattctgttgaacctaactttacagtacaggagtcgctggttaacgttactctcatcgaaaattctgaagaggcttcatccagcccgtgcccgttgatttcgtaggcataccggcgcaaaaagccgatatgaatcaggcagccttttttctttataattcagccacccacgggcgggagccgttcaggcctatcgacccgaagcacgttaaaatatacgtgtgcggaccgaccgtttatgatctggcccatatcggtaatgcccgcagcatggtggtattcgatgtgctggcaagggttctgcgcagactttatccccgcgtcacctatgcgcggaacatcacggatgtggatgacaagatcaatgcccgcgcgcgtgaaagcggggtttccattgatgaaatcaccgcccggaccacggctgatttccatgccgatatggccagcctcggcaatctgccaccggatatagagccgagggcgaccgcccatattgctgaaatgattcttctgatcgagaagctgatcgctcaggagcatgcttatgagacgcatggcgagggggagggacatgtcctgttctccgtagccagcgatccttcctatgggtctttatcgaacagatcaccggatgaactgttggcgggtgcgcggattgatccggccccttacaagaaagatcctggtgacttcgtgctctggaagccatcagctgacgaccagccgggatgggatagtccatgggggcgtggccgcccgggctggcatattgaatgcagtgccatgtcctggcgctatttgggcgaagatttcgacattcatggcggtggtggagacctgatctttcctcatcacgaaaatgaatgtgcccaaagccgctgcgctttccctggcagtcatttcgcccattactggatgcacagcgccatgctgcttctggatggcgagaaaatgtccaaaagcctcggcaacgtgctgaccgtacgcgatctgctgggtcaggcggatggtgaggcgatccggctgctgttcctgaaaacccattaccgcggcgtgctggatttccgctatgaggcattgaaggaggcgggtaaggagcttgatcgcttctaccgtgccttgcaggcgcacccggctctgcctgatctggacgagaccgtggagaatccggtgctggaggcattgcgggatgatctgaacacgccgcaggctctctccctgatgcatgggctggcttatgccgctttgggaggggatgcgcttgcggccgcacagctgaaggaggggggcatgctgatggggctgttcacgcgggaggctgaggcatggtttcagcgtggcatcaatccggacgagattgcccagcggattgcggaccgtcttcaggcgcgcaaggatcggaatttcgccgaggccgatcgtatccgcaatgaactggctgaagcgggtattctgctggaagatgggccatcaggaaccacatggcggcgggccagctgattttttcctctatacagtataaggcacactcagattatgactggacgagacggcggggcaccgcttcaaccgcgtgacccaagcccggtcattatcctcgtgcgcccgcaactggcggagaatatcggctccacggcgcgggccatggcgaattgtggcctgttccacctgcgtctggtctcgccgcgggatggatggccgcaggacagggcatggcgcactgcatcgggggccgacaacatcctcgattccctcactgttcatgagacagttgaggatgcggttgcagatctgcaccgcgtgtttgccacctgccccagaccgcgtcatatcgtcaagactatcatgaccgcccgcggggccgctgctgatatcgtgcttgcctgtgagcgtgggctgaaaaccggtattctgttcggtccggaaagggccgggttggacaacgatgatatggcctgtgcggatacgctggttcgctatccgctcaatccagatttcatgtcgctaaatgtatctcaggcggttatggtcatggggtatgaatggtggatggcacaggatgccacgccatcacgccagttgatgaccaacgaatcacatgtggccacaaagggggagttgaacaatttcctgcgtcatctggtcagggagcttgatgagtgcggatttctgagaaatgaacagaaacgctccggtatgattcgcaatatcaggcacttcttcctgagaggagaggtgacggagcaggagttgagaaccctgcatggcattgttcatgagctttcgcgtgggcgtgggcgtgggcgttaaattttttccccaatgattaattgtaacaaaatatcgataactgtttgatatgcaccacaaagagtcctgaggcttttggatataaaaatttagattttgacaaaagtagattggctggatgatctttttaaaagatttacaattgaacgaaatcttgtaaaagtattgtctaaagcaccatcaatttcgggatgtattgctctccttgtcctatcattatgatccctgctttcatggtaagaaaatccttgtcacggggggggcaggatttctcggttccagcctctgtgaggctttagccagaaagggcggagagataacggttctggatagcttcatgccggggagtggcgccaatatggccaatctctcgtctctggatatcactcttgtccgtgcttctttggaagaagccgacctgcataccctgtgtgagggagcagatttcatattcaatcttgctggtcagacgggccatctggcggcacagcttgatcccttcgccgacctggctgtcaatgctatggcacagttacgcctgattgcagcggtgagagacgtggcaccgggggcggttatcgttcatgcctcgacccggcagtgttatggccgtaccggtggtgcgcctgtcgatgaaagccatgtttcggcaccgcaggacttcaacggtgtctccaaactggcgggtgagcaatactggatggcggaaagccgtgtgcatgggcgcaaggtgacggcactgcgtctgacaaactgctacggtcccagactgcgtcttcaggatgggcggcagacctttctgggaacatggctgcgccatgtgcttcagagccagccattcgaggtctggggtgggcagcaggtgcgtgattttacctatgtcgatgatgtaacagcggcctttatggctgctgcaaccacgccggactgttttgggcgcttgtttaatatcggggggtatgaaagtgcttccctgctgacattggctgaactgctggtcgaggttgcgcctttcccggtgcggtatacggtcaaggaattgccggaagagcgggccagaatagatatcggcgcctattgtgccgatgatcgtgctttccgtggggccactggctggaaaccccggatttctctggcggaagggttaaggcagtcactggaatggtatcggccgagagtgcaggattatgtctgaccctgtgattgtgccgcaggctgatccgcgcgccttctaccttgcatatcgtgcggagattgatgctgctatttccggtgttctggcgtctggaagctatattctcggggaacaggtctcggcttttgaaaatgaatttgccatatggcttgggcgttcccatgccatagcttgtggcagtgcgaccgatgggctggtacttgcgctgcgtgctctgggggtcggggccgggtgttcagtggccacggtttctcataccgccgtggcggtgattgcagcgattgaaatggcgggggcacagcctctgttgctcgatatcaatccagccgattactgcatgaacgtggatgagctgacgaaaattctctgcaagtcaccggatggggccgcccccgtgcgggctgttatccctgttcatctctatggccagtcagtagatatgacggcgctcatgctggcggcaaagcaggccgggattccggttattgaggattgcagccaggcgcatggtggccgccatcatggtaaaatggtgggcacctatagcactctgtccgtttttagcctgtatccgaccaaaaatctttgtgcacttggcgatgcagggattgtcagcacagacgatcctgacattgcagagactctgcgacgcttgcgccagtacggctgggggcaggaaaggcaatcggaattaaaaggcgtcaattcccgcatggatgacattcaggcatccattctgagtattggtcttgcctgtctggatcaaagaaacagccaacggcagatgattgcacggtcctatgacgctaccctgcgtgatattggcggccagcccccctgtgttcgccctgggaatacgcatgtttatcatcagtatgtcatcagggtacgggatcgggacgttctgagagatgagctacagcggtcaggcgttcagacagcgatccactacccgtatcctgttcatagccagcccgcctatcggaacaaggtgatgctcggtcctgcccgctgtgtggaaacggttaaagcagcagataccattctcagcttgccgatgtttccggagctggaaagcggacaggtggagcatgtctgtgccatgctcaggaagttttctcatctgattcggcaggatgattgaatgatgcgctctctggctcttttcggtgcaggctctgccttggcggtggatgtcgaggaaagctgtcgccggaatggtatcaatctccggattttagtccgtaataccgaacacacggcgcatcctgatgtggaagccccatccatcactctggaggagatcacggatgatctcatcggaacggagtggctgatcccgctttttaccccggccaaccgcaagaaagcatggcagcatgcgacatcgttgggattgaacagctttgcctccctgctggatgcttcatcggtgtatccctcccgcctgagcgtggaggagggggtttatgtcaactccggctgcacgatcggggcatgttcccggctcggtcggttttcattgatcaaccgtggttgctcggttggacatcatttgtcgctcggggctttttcctcgatcgggccgggggcggttctggccggtgaggtgaccgttgaggaagaggtgatgataggggcaggcgccattatcctgcccacagtgaggatcggcgcccgtgcccggatcggtgcaggggctgtggtccgcaaggatgtgcctcccggcgctttggtggcagcccccgatgcgcgcgttctgctgcgaacacgcggggggtaggcagatttatcgcctcagcctatgcagcaaatgacgcagcggcgctgtgtaacgccatattgtggaatcaagcatagcctgatgctgcctggtcagcgcctgtaactgctcttcgagtaagtccagcttttcctgtgaaggatctattgatacgggcggggaattttcagtcgcaaaatggcggaagacatccacttcaccggtaagccacttgagaacttcgtacccgtcctgtgtctgcacacaggcatgggccatttccatggcaaacaggcgacgccccgcattctgagatctgaccgccatatcaacgaaatcggccagcaagccccgatgatcaggcccgtgatcaatgcccagcgtggcccggaaaatctgcctctgccaggaccggtcgagtgttttgagatgacgcagaacgaggggcgtttcccattccgtgcgtaatattgtgctccggctgggcgcactcatattacgcgcaccctcccgtatcctgaaagctgtcagttcttcattcagaaaagcgatatcgtgtccgctgaccagcatgcgggtccacatatcaaaatcctgcgaattggtcagtcgcggatcatagtaaccaagcgtctcaaacacgctgcgccggatcattgcggttggggcacatagacagtttccatgaagggcgaaacgtcgaagccaactggtggaagaaaaatccggcatctgcatgggcgctgtaaaatccagaaaactttcagttttctgtccatgctcatcaactgcaacaggcagaccgaaaacggcggagatatgagcattctggtcaagaaacgccacctgccgtgcgagccgctccggcaaggcccagtcatcggaattgagaatggcgatatactcgccccgcgcccttttcaggcagtgattcatcgcggaggaaatgtcgacattgctcgtcagtgcttcgacatccagacgagtgtctgaaaactgacgaatgaccgacagggtaccgtcgcttgatgcatcatcagtcaggatgatttcaaaatcctgaaagctctgatcgaatacgctttgcagggattgggcgacatactgttcgtgattatagcttttgatgaccactgaaacacgcggcgctgtctgtggccttgcatgcactgtcggaactgaaatccgttcctgcccctcccaccacaaaggacgctcgccggaatgcgccgccacgaaatccggcccggacagatcgtccgaggttgcgaccatatagtcccattccttgcgccgtttttcttcgttccagcgatagcgatgcccccagtcattctgcacatcgacggagccaagacgggcgccttgttctttctgtctttcagcatttctgtcatagccaagatgcttgaaatgccacagcatcagttcatcccgtgcgggaaggcgaatattgccctgtggctgagccgaatggcggccttccgcaaagccggtttccataatggcatcgggattgaaaatgcccagcttgttgaaaaaccgcctggcacgccccgatgtgactttctcgaccagcagcccatcatccgagggaaagttttcgctgttcatgtcgaaaccaagggcgggaatacaggtaacgccttcagccttgcgtgcctgaagatagcacgtcatcggctggcccttgacccatagatgttcatcaatggcggtgatgacgacccagtctgccttgccccggctttctttccaggcgttttcatgcattgccttatgggacagtacgaaagagtcggtatgaaccctttcgaaacgcctcaactcgaccttgggatgggcttccaaaatctccagcgatccatcggtcgagccatcatcgtaaataacgtaacgatcgacccaggaatcaaaatgccggaagaaaaatccaagcatatctgcttcgttccagcaaacagtatagagatcgaccgtcattttgcgacgcccctgattatctttatttcaaagcaggtatagcgttagcaacgaacattccgcaacgatgagcaaaatgttgaggaaggttcaagtcgatgcgttaaaacaagatcaatggactgatagtccaaccctcctttggaatttcgtatttctcaatccactactgctggcccaacaacaatatgcaggcagactcgtgagttcaccacgagcctgcccgacacctcaattcgtgcgcatcacatccacaagattgtcggaaaagctgggcgcgtggccaagatcggagaaggcagcactgctgatactgttcacggttccatcattcaattgccgccaatatcccagcgttgtaacgacaatgccgggattgacgtcgctggtgatacgagccatggcccggaaggcaccccggtcattcatgaccttgacacgatcaccatcctcgatgccacgtgcctgcgcatcggagacattgatcaacacgaactgctccccctgaccacggattttctgttccatgttagcatagcaggaattgagaaaaccgtggcttttcggtgaaacaatcgaaagcgggtatttttttgccaactcagttgcagccagaggattttcccgtgcaccgagatagtctggcagagggtcgaccgcttcgttgggttggaacgcttcgtacatctgacggaacggggcgggcacaaaattgcgtgctccgtcgagcatgaaatggcattttccggttgcagtcgggaagttcccgtctttatgcggtgccctgttatcagccgtgccgacattcagccgcgcatagccatgctgcttcagataggccagatcaattccttcacaggcgggtgatgaccagtcgacaaaattttgcagacattcttcatcagaccacaggaaattggcatccttaaaaccgaattttcctgccagacggcgaaagatttcgttattcggcagcgcttcaccaggtgcatcagcacatctggtcgtgtaggtcagatacagatgcccccaggaaaggatgatatcctccatttccgcccccatcgcggcaggcagaagaatatcggcataggaggcggtgtcggagatgaaatgctcggccgataccagaaacagatcctccctttgcaggccctgcacgattttgtccgtctccggtgcctgggtgactggattagcattccaacacatcattgacatgatcggcggatcgagcggtatctcaccagttaacgccttgccgagttccagtgcactgaccacgcgtgttccttccgggatcagatcaggcctgcagatgacatcgaatttgtaaggatgctcccacaccgcgaactgcgtcattccaccgccgacatgccgccaggacccggtcagtgccggaatacaggcaatggcacgtacagcctgaccaccgccgtaatgacgttccagcgccacaccgatgcgaatggcggccggttgctctgtcgcgaggctccgggcgagcttgcggatatcggcagcggaaacgccggtaatggtttccgcccattccggggtgcggtcggcagcgcgtgctttcagttcgtcaaatccgaccgtatggttggcgacatagtcatgatccaccagatcctgttcgatcagtgtgttgatcagggccatggccagcgcgccatcggtgccggggcggggagcaatatgccagtccgcgcttttggcggtgcgggaggcataggagtcgatcacgacaaccgtggccccgtttttctgtgcatcccggatgattgcccagtgatggaggttggtgctgatgctgttacaggcccagatcacgatatattttgaatgaatatagctttccggatcgacgcctgctgtcggcccgaccgccataagccatgcggtcgatgatccttcaccacaaaaggtccgttcgcagactgtggcaccaaggcgattgaaaaaggcatccccgccattcaggccctgcaaaagcccctgatgcccgagatagctgtagggcatgattgcctgaggcccgtattcggtcatgatggcctgccagcgggagacgatctcgtccagtgcttcatcccaactgatccttgcgaactggcctgatcctttcggcccgatacggcgcatcggatacagcacacggtcagggtgggcatgccttttctcgtaatctttcactttaacgcagagtccgcctctggtcattggatgatcagggttgcctcgcacagactgcaattgtccgtccttgacgtcgaacagcattgcgcaagtatcgggacagtcatgcgggcaagcgccgtgaaatgttttaacctcgtctggtcctgtggcggcaatcatggggacgtctccgtatttttaaagtatttcagcatgttgtgatgccgctccctgaaccggcatcggtcatgaaactcttttcttgcacggtagcctcaatagcgcccgcccgaccagccataatcagatatcgggggtgccatgtgctggataaatggccatgatcttaataccgattttaagaaaaaccctcttttaatcagaaacaaaagggataggtctttgttcataacaacaaaacaaacacgaggagttaagccatggacaaggtcatgaatattcaacgcatcgctgcaatctgcgccattggtggtgttgcgctgttcggtctgcctgctgcgtcccatgcgaccggagcggcagccatgagtcggacgggctatgcggcccagagcaatattgagcctgtttcagcgacgatgaatgggctgaagcagcagggtggatgccgggaaaaagaaatgtggggtccgtcaaaacggccggaagttgagcaggtttgtacaggccgtgcttcgcaataaacgggcacctgaaaccagcggatagaaaaccagattgcgcaagccagcctgttcttatctaaagatcagactatgaaatattggctgggggacctggattcgaaccagggctgaccgggtcagagccggtagttctaccgctaaactatcccccagcggctggtggcgggctattagcatcggttttacggcagggcaagtccctgccgtcacgctttttttatacagctgattttgacctctccccttgccgccgcccactgtggttgtaggtatcccacgcccggcatgcggcattgagagcatctgaaaaggcgaaaggaaaaaaatacatcggggcgtaaacggtttatactccaccgatggttaacccttattcacccttctccttgaatttgccaggtgccgggtctcatcgacaggcgggggcttctgcctatgctgcgctcgatctgggaaccaataattgccgtttgctgatcggcactccggccggtggcagtttccgtgtgctggacagtttcagccgtattgtccggctgggggaagggttgcagacgaccggcaggctcagcccgagggcgatggagcgtaccctgtcggccttaagagtttgcgtcgcccggatgcaacgcagaactttgtccggtgtgcgggctgttgccacggaagcttgccgccacgctgttaatggcagggatttccttagccgcgtacaggctgagaccggactcgactttgacgtgatctccacgcgcgaggaaatcgaactggccctggaaagctgcatccccttgcttcggcgtactgaggcgcggcggatcctgctgttcgacatcggcggaggctctacggagcttgcctgggtacggattgatggcaattgcccggttctggttggaactgtttccctgcctgttggcgtcgtgcgtctggccgaacaatatggggatgcccggttcagcgccggcgcttttgaggaaatggtgcaggatgtccggcagcgtctggaaacgttcgaggatatccacagaattcatcctgaaatccttcacggtggcgttgccttgctgggtacttccggcactgcaaccacgatcgcgagtatctgtttcgacctgaacaggtatcgtcgatgcatggttgacggagcggtgatgagcctgacgcaggcggatcaggcagtgcagattctgcgggcgcttggtggggcggagccgcagggggaaggattgcgcaaacacccctgtatcggccctcaacgtgctgatttcgtgctgcctggttgtgcgatctttcaggcgatccggtcgctttggccgacgacttctgtcattgtcgcggaccgggggctgcgggagggaatgctgctgaggatgatgcatgaggccggtcatggcggcagacgcggcagaagaaagcgcaatcccgcaattccttcttcacgctccgggttgaccggctctggattggaagggcccccttctggcatatcaacacgaacgaagccggtttaagacggaacagataatgagcggtggaaaaacgcagcctcctacgggaccgcgcggcaaggttgtgatgctgaaaacggcccgcaagcgtagcgtggcctcacaacgctggctgacccggcagttgaatgatccgtacgtagcggcagccaaggcacagggctggcgctcccgtgcagccttcaagctgatcgagctggatgacaaattcgggctgatcagcaagggcagccgggtgattgatctgggcgcggcaccaggtggctggacgcaggtagccatgaagcgcggtgctgccgtggtggtcggcgtggatcttctaccagtcgatccggtgccaggcgcgacgctgatccagggcgatttcaacgatgatgacatgccggcgcgactttcctccctgatgggtggcaaggccgatctggtgatgtccgacatggctcccaacacgaccggccatgcggcgaccgatcatatgcgtatcatcgcgttgaccgaactggcgctgcatttcgctttcgatgctctggccccagggggtgcctttgtggcgaaagtgtttcagggtggatcggaaaaacagttgcttgaacccatgaagcaacgattcgcctcggttcgtcatgccaagcctgcttccagccggaaggaaagcagcgagctgtacgtggtcgcaaaaggatttcgtcccaacgggttgcaggactaaggcgtgcaggcaacccgtcgtgccccagacgcggggcaggcagaatacggaatggcttgcccagatacgggcaggggcgttaagggagcgcgccaaggcgcacccgcccgtccgacaggatgaaaggtccaggccatggcttccgatgacgtttctgatcgcaactccagccctcaggctgctgtctctccggtgtcccggatcgaggaagccctggcatttgacgatgtgctcgtcattccatcctattcacagattttgccttccagcgtggtgactaccacgcgcctgacgcggaagatttccctcaatattccgctggtatcgtcggcgatggatacggtgacggaagcgaatatggcgatcgccatggcgcagcatggcggcattggggtcatccataagaatctgactatcgaggagcaggcgcagcaggttcgccgggtcaagaaatatgaaagcggtatggtggtaaatccgctcaccatccatccggaccagacgttggccgatgcccgcgctttgatgagcagcaaccatatcagcggcgtgccggtggtggagcgggaatccggccgcctggtcggtattctgaccaatcgtgacgtgcgcttcgccaccgatccttcagtgcgggtgtatgagctgatgacgcgggaaaatctggtgacggtttctcccggcaccaatcccgaggaagcacgtacactgctgcatcgccaccggatcgaaaaactgctggtggtcgatgagaattattgctgtgtcggcctgatcaccgtgaaggatatggacaaggcgcaggcctttccgcttgccaacaaggatgcgctgggccgtttgcgggtcgcggccgccacaggtgttggtgaggatggtttccgtcgtgctcaggcattgattgatgcagaagtggacgtcgtggtggtcgataccgcccatggccattccgagggcgttctggccgccgtagcacggatcaaaaaagtcagcagcgatgtgcaggtgatcgcgggcaatgtcgcgacaccggaaggtgctcaggcgctgatcgacgcgggggcggatgcggtcaagatcggtatcggtccgggcagcatttgcacgacgcgcgtcgtggcaggcgtgggtgtgccccagtttaccgctgtcatggagactgctgccgtatgccgggcggcgggcgttccggccattgccgatggtggtatccgtacctctggcgacgtcgtaaaggcaattggcgcgggggcggattgcgtcatggtcggcagcatgctggccggcactgacgaagcacccggcgaggttttcctatatcaggggcgcagctataaatcctatcgtggcatgggtagcctcggcgcgatggcccgcggctcggcggatcggtattttcagcaggatatcaaggaccagttgaagctggtgccggaagggatcgagggccgggtcggctataaaggccctgtggctgcggtgctgcatcagatgaccggcggtctgcgggccgggatgggctatacgggcagcgcttccatcaccgatcttcagcgtaatgcacgcttccggcgtatcaccggtgccgggttgcgagagagccacgtccatgacgtggcgatcgatcgtgaagccccgaattaccgggtcgattgatgcgcatctcttctcctgacccggctcgcatcctgtgacgccttcagcacggcttgccgcggcgatcacgttgctggaggaaatcgaggccgctccccgccgcccggcggatgcggtggccaatgatttcttccgtgcccggcgttatatcggtggcagtgaccgccgggccgtctctgctcaggcatggcaggtgctgcgtgcccgtcgccggatggggtggtggctgccggaggctccgccgcgcctgctggtggccggtcatatgttgctgaccgggtggacgctggaggctgtgacaaaagcgttctccggcggccagtatgcgcctgcacggctgacagagacggaacacacagccctgcgtctcctggaggggcatacgctcgatcatccggagatgccggatgcagtgcgtctggaactgccggactggattttgccccggtttgtggatcgcttcggcccggctctggctgctgaactggcggagatggagagtgaggcgcctctcgatctacgggtcaatctgcttaaatcggatcgtgataccgcccgtagcgcgttgcgagcagaagggatcgaggcggagttcaccactctatctccgtggggtctgcgcgtgcatggccgccgtccggtgacgaccggtgctgcatttcgccaggggttgattgaaattcaggatgagggcagccagttaatcgcggcactggtcggggctggcccggatatgcgcgtggtggattattgcgccggagctggtggcaaaactctggccatggcgatgacgatgctcaatcgcggccatatcgtggcgtgtgatacttccgaacctcggttggagggggcggtgcgccgtttgcgacgggccggagtgcataatgttgagcgccatctgctgacagccggtgataaatgggtcaagcgccgggccggaagctttgaccgcgttctggtggatgctccctgcaccggaaccggcacatggcggcgcaatccggatgggcggctgaggctgaccgagactgatctgctcgaactggtgccaaagcaggcggacatcctggatcgagccgccaccttgctacgtccgggcggcaggctggtctatgcaacctgttccgtgctggcagaggaaaatacccggcagattgaggctttcctggcaagacggcccgaattccggctgatgccgctgcggcaggcttggccggatgctccggcggcgctgacaggggatatgctcagtctgacgccacgcagcttcggcacggacgggttcttcgccgcggtgcttgagaaaccggttcctgcatgatcgccatccgccgcgcccgtccggctgatgcgcctttaatcggcgctgtgcatgtcgcggtgtggcgcagcgcgtgtccggggattgtgccggatgaccatctcagccagatgtccgtgaccagactggcagcctattatgatgccgctatcatggccgggcagggcgtgtttgttctatgtgcatcgggtgaagacgtcccgcttgcttctgctgggaaaagtggaaacataccaaaggggccgcgtgtcatcggcttctccacggcgacaagagccgcacccggtgaaccgggggaaggggagatcggtgcgctctgcattctggacgattaccgggaacgtggattgggacgccgcctgatacgtgctgcggcatcgcacttaagaatgcttggatgccgctccgcttatacatgggtgttaagggacagtccggcccgctggtttcatgcccgtctggggggcgttgctgtggcccagggccatatttctctggctggtgtaacgctggaacaggacgctttcctctgggaaccaattgaaatgctgctacgcccaggagcattacgaaaagaagaccgggatgacacctgatctccggcatgcagagtggaatgtcgccctgtcatgtcagttttccactgttttaccgttgcgatccgacgcggcttccggcattgcccccactggccatgtagggcctgcatttgcccccattttcacggggtgcgttgaaggagagagagcctgatgagcgacattctcgaacagatcgttgatcgggttctgattctggatttcggcagtcaggtcactcagcttattgcccgcagagtccgcgaatcaggggtttattgcgaaatctggccatttaccgcggatgccgagcgtatccgcacctatgcaccgcaaggcattatcctttcagggggcccatccagcgtggcgctggcaggatctccgcgcgcaccggatgtcgtgttctcgatggatatccctgtgctgggtatctgctacggccagcagacgatgtgcgtgcagcttggaggctcggtcgagggcaatgaccatcaggaattcggccgcgcccatgttgatgtcgtggagaattgtcggatcaccgacggtctgtgggaaaaaggcgcgcgtgagcaggtctggatgagtcatggcgaccgggtcactgctttaccccccggtttccgtgcggtagccgtcagcgagggcgcgcctttcgcgatgattgccgatgatgatcgccgtttttacggtgtgcagtttcatccggaggtgatccacaccccgcatggcacgcagttgctgcgtaacttcacacatgcggtttgcggctgctccggcggctggagcatggcggcattccgccctgctgaaatcaagcgtatccgggagattgtcggtgaagggcgcgttatttgcggcctgtccggcggcgttgattcaaccgtggcggcggtgctgatccatgaggcgattggcgaccagctcacctgtattttcgtggatcatggcctgctgcgccagagtgaggcggaacaggtgctcgctatgttccgtgaccgttttaacatcaaactggtgcatcgtgacgcttccgatctgttcctcggggcgctggaaggggtcagcgaccctgaggtaaagcgcaagacaatcggcaagctgttcattgatgtattcgaggaagaagccgccaagatcggcggcgctgatttcctggcgcaaggtacactttatccggatgtgatcgagagcatcagctttaccggtggtccttcggtcacgatcaaatcccaccacaatgtcggtggcctgccagagcggatgcgaatgaaactggtcgaaccgcttcgcgaattgttcaaggacgaggtgcgcgcactgggtcttgaactgggcctgccgaaagaaatggtcggccgccacccctttcccggcccgggccttgccatccgtattcccggagcgatcagcaaggaccgtcttgaaatcctgcgtcgtgctgatgccatttatctggaggaaatccgcaatgccggtctctatgacgagatctggcaggctttcgcggttctgctgccagtccgcactgtaggcgtgatgggcgatggccgcacctatgacttcgcctgcgccctgcgtgccgtcaccagcacggatggcatgacggcggatgtctatccgtttgatatcaagttcattgcgagagtggctaaccgcatcgtcaatgaggtgcgggggatcaatcgtgtggcctacgatattacatcgaagccaccgggaacaattgagtgggaatgatttttgcctatccgggcatacccaaaaccacgctaatgtacgatctaacccactgataaaaataaatattcatgtcgacatctatcgatgcctatcggtgggcagagatcgcggccgtcggccccgctgacgggcctcggccatattgatcgcgacgaaatttgaaagtaccgtcaagggagatgaggctcctgacggtacttttttgacgctaagctgctgacaatacgcagacttttccggcgagagccccccaaaaccgcgcgacggtacttttttggaggtggcatagcatgttgacggatgcagcgatcaaagcgctgaaacccaaagagaaaatgtacaaggtgacggaccgcgacggcatgtatgtgcgcgtcgcgccatctggcgcgctctcgttcaggctggactatcgggctcaatggacgacgcgagacggtctacctgggcaaatacgggcgagatggaatctcgctggcgcgagcccgggagctctgcctggatgccaaacgagcgatcagcgagggccgatcgccagccattgagaagcagcgcgaaaagcgtcgtatcaaggaggccaagagcttcggtgagttcggcgaaaaatggctggtgaacgcgcccatggccgacagtacccgagcgatgcgtcgttccatctttgaacgggagctaatgccggtttggcgcaaccgcctgctgaccgaaatcacaccagatgaccttcgcgcccaatgtgggaagatcgtggatcgcggcgcaccggcgacggcaatccatgtccgggacatcctgaagcagatctacggcttcgccatccttcatggcgagaaggtcgccaatccggctgatgacgtcggaccggcatcgatcgcaactttcacgccaaaggatagagctctgtcgccagccgaaattcgggtaatgctgaaagagcttgaaaaggttgccacgctgccgacgatccgtctcgggatgcggcttttcttgctgacgatggtgcgcaagagcgagctgcaggacgcggtatgggatgaagtggacttcgagaacgccgtttggtcaatacccaaggagcggatgaagcgatcgaaggcgcataacgtctatctgtgccgccaaaccctcgacatcatgatcgcgctcaagacctgcgctggcaactcccgctatttactgccttcgcggtacgacgccgatgctccgatgtcccgggcgacgttcaaccgtgtcacctattcggtagtggagcaggccaaacaggatgggctgccgctcgaaccattcacggttcacgatctgcggcggactggatcgaccctgctgaatgagttgggcttcaatcgtgattggatcgagaaatgcttagcgcatgaagacggccgatcgtcgcgcggcgtctacaacaaagcggaatacgaagttcagcgtcgtcatatgatgcaggagtgggcggacatgatcgacgcgtggattgatggccggaagcatgtccccactctcttgccgccggctatgtcgctggtcgcgcttgatcccgctctttgatcggacgcgacttccgttttgatacgtcgggatgttttgcgcggcggattggagcggcccgccgcgccatcagccaggcttccacctccgccaagtcccagactatgcagcgcggagatagggcaaaccgtcgcgggaattcgccacgttgctccatctcatagatggtgctgtcggcaagcggaaccatttcgcgcagttgttggcgtcggattgtccggcgaattttcaggtattcgattcgagtcatctatttctcctttctcgctgacgcgattgagggcgatagatgtcgatactggaagtccccttgaagcgccgtgcggtcctttcgggctatggcgtatacatcggcgggtttccttgtggcatatcccctcgtcaggccattcccactccatgcttgatctggagactgaatgagcgcccgcgccacgggcgatcggcggaaagtgcatatttctacccgggtgtaattgacaataagttttatccgggtattaatcgggcggtccataagtgagcaccccatgtccgatcctactctcaagacctgcacggcatttgtcgggcatcgattgctcctctcaggtccccttcctgacgtggccctggccgttcggcaatcgaccggcgtggcggacatggttctcgttttcgacgacgcaacgggtcgcatcgtcgatctcgacctgcgtggcagcaatgccgatattcttgaacggatttcccagccccccacgacctatgcggggcgctatcgccccaatatcgatgcggtgccgacctcccagggattggacgaagcccagagccagaaaacccggggccgaccaaagttgggagtcgtcgcgcgcgaggtgaccttgctgccccggcagtgggactggctgacgaaccagcccggcggggcgtcggcgacactgaggcgtctcgtcgacgaagcgcgcaaaacagcgagcccccgccagcagaggcgggcggcgcaagaggctgcgtatcaattcatgcaggcgatcgcgggagacctgcccggttacgaagacgcgacccgggcgctcttcgccgacgatcggacatcattggaacaacggatcgctgcgtggcctgaagacatccgcacccatgcgctgcgtctcgccttcggcgcgggcgagaaccaaagcgcttaacccgccattcaacggaacaccgatgaccagagccgaccccatttcctacctcgaaccgacacaggacgctggccgcaggttcgtacagcgcaaccttgccggtcccgtcgtgatgctcaacctgctgcgcttcagggctgtcgccgattattcgggccaccctgagctggcacctgccaggccgatcagcggtgctgaggccttcaagctctatgttgagcacacactgcccttcttacgagaaaccggcggcgatctcctctttctcggccatggcggtcccttcctgatcggaccgaccgatgaacattgggatctggcgatgatgatcaggcaggccagcaccgcgtccttcctctccttcgccagccacaagggctatctcgctggacttggtcaccgcacggctgcggtgatggattccaggcttctgccattgtccgaaatggcgctacccgttgcaggagcgaggccatgaatattgcaaaggccaatggtatcgagctcgcgtgggacagtttcggtcatgccgatgcggaaacggtcctgctgatttcggggcttggaacgcagatgatccgctggtccgagactttctgtacggggctggcctcacgagactatcgcgtgatccgtttcgacaaccgcgatgcgggccactcgacgcatttcagcgcttcgcccgcgccggatttcgacgcactcgcaactgccctgatggccgggcgcagacctgatgtgccgtatacgcttgacgacatggcaacggatgcgatcggcctgcttgatgcgctcgggattgccaaggcgcatgtcgtcgggcgctcaatggggggaatgatcgcgcaggttctcgcgagcgaacatgcggatcgggtcctttcgctgacgtcgatcatgtcgagcaccggcaatccggtcctgccgcaggcggcacccgatgtcatggcgatgatgatgcgccctgcgcctgatcctatgatcgatccggaaggctttctcgcggtgcgcctcgcgttcgcgcgcagaatcgccgggacgggctatccgttcgatgaagaggcccatcgtgccattctccttgatgaagtaaggcgtagctacgatccgggaggcactgcgcggcagatcgctgccatggcggtggctggagaccggcgagcacgactcgcaaacatcacggtcccgacactcgtcatccacggcgtcgatgacccattgatcccgcccgcctgcggtcaggacacggcgcgctccataccgaacgcggtctacctgcccatcgagggcatgggtcatgatttgccacgagacgttgaagaacggaccgtcgacgcgatccgcaaggtgatggcagatcaatcgtcggctgaaggcacctgaccatgtcgcagggcgaaaggatgacgccgggcgtcacccttccattccctttgacagtagactctacgaggtcacaaccgggccaacaatggcctggccaaatgtttcgcagacggactggacgtcgttgaggtcatgcggaaccggcagagcatccatggcctggaaaaagcggtcatggcgtgcgggtgtcgatatcaacatcacgcgcgccacgcctcccatcgcggaaaagccatgggtgacgcctttggcaacgaagagtcgatctcccgcctttacctcaatcttctgcacgccgatcaggaacagcaaccgcccttcgctgatgcagaagaccttatcctcctcaaacgaaatgtgcgccggtgcgccctgatccggttggaccgtcatcgccatgacggtcatgggagcagctttaccaccgagcaggatttcggcatcgatacccgagaagcgggcggttgcgtgagaggagagtacgccgcttgcaggcgcagcgggatgaggggtgatgtccatgatgtggtctccttatgatccggacccacggtacctcatcagagcaagaacgattatctggcaagttctgccatcatcatctattattctggacaatgatgaagcttgatccgatccagacctttgtcgaagtggttcgtgctggcgggtttaccgcagcggcccggcgcacgggcacgccgcgttcgacggtgagccttcaggtcagggcgctcgaagaaacgttaggggttcggttgctcaagcgctcgacccgttcttttgccctaacggacgagggacagcgcctctatgacaaggcgtcgggtccggtagatgttctcgcccgggcgcttgatgacctgcaagcgggagatggcgtactgggcggtctgatcaggctgaccgtcccagcggatttccccaccgcgttgctggcgagcgcaatcaccagcttcacgcaggcccacacggcagtccgcttccagatcatgtggacaaataccgtgatggaccttgtcgaggacaacatcgacattgcggtcagagtcggcgcgaaccctgcccagactgcaatcgaacgacgcttactcgacatcgaatgggctttctatgcgagcgcatcgtggctgaagcgaaaggggcggccggaaaatatcagcgaggtggaggatttcatctccccgcaaccaatcttacgcgcctacttggagaagcatgtgcttggtggtgtttccctgcctaccggtgcgatcgaggttgatagccatgccatggcccgggatctgatgttgaacggctttggcgttgctctgttgccgcagggcttgtgccaggatgccgttatgaccggcaacgccgaaccgctcctcccgcacgcagggctccgcccgacgcggctcaatctaacgtttccaaatcgagcggacatggtgccaagggtgcgagccttcgctgatcacatatgcgcccactttcgttgaacagatgtgtaccgcggccggcgttcattgcaattcaggagcgcattattggggcaacacaccgactttcccgccctgatgcccaactccgaaccattgaggcaagggaacagaaggtccggagaatagtgagacaacagcggcatagccgggatatgagcgacctggcctcctgcctcgtctcagtcgtaaaagtccggcgcgagcctaaactgcgaccacatctccgggtcatggcctgggacaagagtggctccgacctgctcggccagcattcgcaattttcccaccgagcgcacggtatccacggcagaggcgaggaagccgggcagtgccctctcgtgccagtggtccatcgtatacaccgcgtcggcggccagcaggatggagccattgttgggaagggtcacgaggatggattggtgaccaagcgtatgtcccggggtgaaaaccgtctgaaggacaccgtcgccgaataggtcataatggtcgctcgcttcaccttccaggaattgccagctcagaccggggcggtcgaagtccttgcgcgcatacgcaccggcagcgaaccaatcgggcgtgaaggcatactcatattcccgtcgctgaacgatgtgcttttgcgcggggaaagcgtccaattgcgccggtgtgatccgaatgaagatgagaaagcacgacaaagctgacgtcctcaggcattaacccgagcgtcgccaattgcgcgacgcaaccctggctttcggccatgacgggtttgtaggaatcgacggaggcgccccagtagccgcgcggatcggccagtccctcggccgccaggccgccgtctatgacgacgttgcccttgggatgaacgaggagaaaccaggggaccggtatttcgtaatcggcaccgttgccccggttcatcttgatatcgtgcaccttgcattgctgagtgcccgactgaaacatgtaaagcttgatgttgctcatgagcctgccatcccgtgatcggttgaagttgcagagcgcaatttgcatgatggatggcccgatcggtaggtagctcaatctgctttcatttatcggataacccgataaaatatcgatcatggattatctggcggcaatgcgggtttatgtgcgggtagtagagcgcggcagcatgtctgcagccgctcgcgatctcggtatcggccagccggccgtgagcgagcggatcgagcgactcgaggtcgatttgggcacacgcctgttacggcggaacacgcgcgcgatttccgtgacggatgttggggcggtgttctacgaacggtgcaagatcgccattgaagctgcggatgatgcgctcgccagcgtgcaggaagatatgccgttacgcggtacattgaggatcgcggcccccgccggattgggagaggtcgtgttgccttccattctgctcgatctccgcaatcatcatcccgaactcaaggtggatctggtactcaatgaccggatcgtcgatccgaccaccgagggggtggatatttcgctccggctgggcgatcccggcgagggcaacttcgtggcacgtaagctgggccatgtttcccgcgttctggttgcttcacccggatatcttgagcgctatggcgcgccgatgacgccggcagagcttttccgccaccccttcgcgcgcgtgtctggcctgttcaacaatggccgtcttcccttgcaaacggctgatgggcgactgacgtcggcgccggtcgacatcgtcatgaccatgagcaactggcggccgttgcacgccatactgctcgacggcggggcaattggtgtcttgcaggagcccgtttgctccgatgacctcgccgccgggcgcctcaggcgcatcctgccggacttcgggttgcccggctttgaccttcatcttctttattcggcgacccgaccgatcccatctcgaatccggacgcttgcgaccttgttcgagcgtgaactgccaagcctgatcgagtctagccgtcttgcaccgcatacgcattcggaaaggaagtaagaatggcattcccacaagcagcactgaccttgatcggcgacacgtcaaagccacatcgcctgacactgcgcccacgccgtccgtccgacgctgacgccttatttttaacgatggccgatccagacatgatgcggtggtggtctcgcgcaccctttgagtatgtcgaggacctgcgggagtatttcgccaacgacgatcaatcgaactggcgctcatgggcggttgtacggacaggtgaagagcttgccgttggcttcgtggcggcaggccagaaacgcgaaggtgtgtccgagatcggctatctgcttgcgcgcgaagcgcaggggcatgggtatgcgcgcgaagctgtcgccatactgatcgaccaattattagccgagggacaacggcgcattttcgccgataccgatccggacaaccagtcatcgatcgcgctgttgacgaggctcggcttcacgctggaggggcgcctgcgggccgaatggcagacgcatatcggcgttcgggattctctgatttacgggcttctggcggaggaatggtcatcccggacagcgggatagtccgcgccctgactttggccggaacggactgaagaggactctgcacgttcggatccccgtgagagccgccaggtcattaacgcgtcggcgccgcgccctggccgcacgccgagatgatccctctcgactgactcgcccgtttcccgattgacggtaatcaatttgacgccttggcccgttcgcctgtcgatgaagtcgaggggcggtccttcgaggttggacaggttccactggtcgccgatctgcaccattgcctgcatgaggaggccgagatcgcgaccttttccggtcggctgatattcgaaccgatcgggccgtgtctgatactgtcgtcgctcgacgagcccgttttcctccagcagtttcagccggtccgacagggtggcgttggtgacaccactcgattggcgcaggtcgtcataacggcgaatgccgagcagcaggtcccgcatgatgagcataccccagcgatccccgatcgcgcccatcacggcggcgatcgagcaagccattccctcgaaccctttcgaccgcatcgttttcgctcgcctctacttgtttcggatgcgtcagcgatagcatgttgcaactctgatgataagagcttgactaactcttattatgagagttagttacgaccgttatctaggaggtagttgatggtcgagactggaaagtcacaaaaaggaactgcaatcgtcactggcgcgtcctccggcatcggtgccgtctatgccaaccgtctcgccaatcggggtttcgatttgattctggtggctcgccggctcgatcgcctggaggctgttgccgatcggatacgcggcatgagtgggcggcgcgtcgacattgtcgccgctgatcttgcgaacgaagacggtgttcgtcgcgtcgaggagatcgtgcgcgacgcccccgatctcagcttgatcgccaatgtcgcgggcgcgggtgcgttggggccggcgtcccttgtcgatccagcagcggtcgaagccatgctcaaggtcaatgttgtggcgttgactcggctgtcgctggcggccgcccgccgcttcaccagcatcaaaagcgggacgatcatcaacatcggatcaatcgtcgcgctgatggccgcaccgggtgctggcgcttactgcggatccaaatcgtatgttctctatttttcgagggcccttcaggccgaagtggggagccatggggtgaccgttcaggtcgtcatgccgggccccgtgcattcggaatttttcggggagaggccgccgcctttcccgcctgaattattcatgtcggcggaaatgctcgtcgacaccgcgctggctggcctggaccgcggtgaggccgtgattttcccgagcttgcaagatgcggaagcgtggaacaggttcgagggttcccgcaccgaactgatgcaggcgctgctgcaaaccgggctaccggcgcaacgctacgccgctgaagccgcccgcaagaattgacgttcgtcatccgaggagaataactatgccgatgtggcaaatctatcatccggaatctgtcttttccgaatccgacaagcaggaactggctgggaaaatcacggcgatctacgagagtttcttgccgcgcttttatgtgaacgtcttttttcattcgatcccgaaagacggccttttcattggcggcgaggtggcgaacgattttgtccgcgtcacgatcgatcatatcgcgcgctcgatcgacgatccggaaatgcagcatcaattcctagtcggctgttcgggggtgctcgagccctatgtcgccgggcgtggctatcgctgggaattgcacgtcgatgacacacccttcgatttgtggatgatcaacggcctgaaaccgcctcatccaggcacgccagccgaattaaaatggcgttcggagaacaggccgtcaacctattgagtcgaggaagctcgaaatgttgacagtgagcaagctcgttgatcagtatcggaccgttcttggtctatggccggtccctgccgatcacctcttggtcgatacacgagagggcgccacttttgtcgtcgcctgtggccccaaggatgcgcccccgctcgtcctcctgcatggagcgctgaccaattcggcgatctggatgttcgatgctgaactctggtcgcagtcatttcgtgtctatgccgtcgatgtgatcggggagccgggactgagttcggcccaacatccttccgtggggggtggtgggtatgcggcgtggctcgacgacgtgcttgccgggctggagctgacaagcgccgcctttgccggcgtttcgttcggagggtggcttgcactggattacgcggtccgccgtccacatcgtgtcgatcgtcttgcgctgctttgtcctgcaggaatcggccgccagaagtcgttcttcctaaaagccttgccgcttctgctgctcgggtcctggggaaaggctaaggttcgcgctatggtcatggggccgcagccgcaagcgttcgccgacagggcgcgacctttgatggatctcgtctccagcatccattcgaaagtccgcccacggtcgattaggattccgcttgtctcagatgcagatctcagcagcctgaagatgccggtcctcatcattattgggggacgggatgctctcatcaattccaacgaaaccaggcgccgggtggagagcactatgccgaacgcccaactccattatctggaacacgcctttcatcaccttcccaatcagcgggaaaccatcttaaattttcttcgggacaagcaaatcggacgcattccatgagcgacgtcattacaatcctgggcaatatacgtgtactctcctttgacttgaatggtccgcaaatttctacagaggctgacatcaacggcctcatcggaaccgcttttggcgaaagagccgatctggtcgcattgccagcagcgcgactgacgcagaatttcttcgagctgcgaacgggatttgcggggctgctcgtgcagaaattcgtcaattaccaactgcgcctggcagtcctcggcgacatttcaagtgcatgtgcgcgaagcagagcgctgaaggaattcgtgtatgaatcaaatcagggatcttcgtgctggtttctgggcgatctggaggacttaggtaggaagttggtctcacgttcctaaatacccaacgagcgtgaacaccttcggtcacgcatgtggagaatgccgtgctcgttcctcataggcgacgtggtaatttccccccgttcgctcgatgcgcgcgaaaccgagctcaccaagatgcatcccggcgatcagaagccgttccgaactgaccatatccagcaatctcgatcgcgtcgctgcggcgagatgtgtatcctgatcgaacgcgatcgacacatccggccggcggatctggatctgagggaaatggactatgtcgccccagaccaacaggttctggccaccggactcaaggcggtagccggtatgtcctgccgtatggccagggagcggaactgccgtcatgccgggaagcacgtctccggtctcgaacatgcgcaacctgctacgataagcggcaaacgcctgacgggcgaagatgaagttgccatgggctcgctcgggcgcgtggctcagattaccgtcatcctgccagaacgcggcttcctgttgagacacgatgagctcggcgttcgggaatgcggcttcgcctgtggggtcgagcagtccaccgacatggtctggatgggcgtgcgtcaacaggatggcgtcaatagcagcaggctggatgcccgcctgggcgaggttgtccttcagccggccgccccattgtttgaaaccgcccgcgccggcatcgatcaggaccgtgcgaccgcctccgcgcaccagatagcagttgatgtggatagcggtgtgatcctgtatccccgcattttcctgcatttgagaggcatcgtcagcatcgatattcgagagtaggccgaaactggcgtgtagatagccgtcactgatggctgtgagcgtcaggtcgccaaccgtctggctgggaaaatcggtcatcgtcatggttcttctctggcgtgagttcagttgcgtgcttggatgctcgacgcttcgtagccgaagcagcgaatgcgcgcggtcagatcggtgctgcactgaatgacgtcgtccagttccttcatgaaccggtccatcacggccgctgtccggaacggttcgaggcggtattggatctcgacaaaggccggatgcccccggccatgccgaacggcgacaaaaatgatatgcacattctccaaggccgcccgaaggatgccggtgcagagcgctgtgcatcgctccgtgagcaccacgagcatctcctccggcggcatcctgtcttgcgagatgtagagggtgacattcggcatcggcgttcaccgcgcgcttgcggaggcgacgtcatcgccgttcgtcaattgcggcgtcatcggcgcatagacgtgaacatcgtctggcagatgtccaatatctccgatcatgtcgcgacccgctttcgcgagccaacgatgttccgggaacttgtccatggcgaccgcgcgcatcgcaaaaggcgtcaggcccaattcgctcagcggctgaggacctgttgtgctcagcacaagatattcggtttcgtcgacggccggggcgcgttcgatgccctcgtataggttccggtgccaatcggtgatgtgttgttgccagcgggcgaagttgccgccgcccttctggctatattcttcgccggtcagaatatcgaggccatcgatcgaatggagagcgagatagacgggacagccgccgatcaacgctttgaaacgctgtgaggtgtgaaagccactgaccgaaatcagggcaggcaacttgtccaggctgtaaaacgcgttccattccgcttcgctgtgcggatcagcaaagctgcattcaaccgtatagatcatcatatcgcctccggccggccgcgcagcgcttccggcttcgtttataattgacactttgtcatggtaaaaggcgaccgatccaatggatatcgatattgcatcacccttcaatgatctaatatcaagctggggtcgatcaagtgccgatcaaacctgcggagacctccgatgcgccgtaaaattcccagcaattcagcgctcatggcattcgaggcatcggcgcgtcacggcagttttgcacgcgcagccgacgagctggcattgaccgaaggagcaatcagccgccagatcggtcggctggaggctttcctcggcgtgacgctgttcgaacgcgtcggaaaccgcgtcaggcttctgccgagcggggaacggtatgccgcccaggttcgcgagtctctcgaccggctggagcgtgacagccagtatctgatggggcagcccaaggatggcgccagcatcgatatcgccacgatcccgactttcgccacgcgatggctcattccccgccttggaggatttcaggagcgccatcccaacatcattgtgcatcttgccgaacgaatggaaccattcgtgctcgccggaagcggcttcgatgccgcgatccatttcgagcatcccgcgtggactggtatgagaatgcaccggttgctgcacgagacgctggtgcccgtctgtcatccggcccttctcgacaaagccgcagacgcggcgtcgctcgaccgcctgccacgtctgcaccgtcgccagaacccggatgcctggcagcgttatgctcaggaaagcggaatcacgctgaccaatcccacgatcggcccatgctacgatctccacatcatgctgattggggccgcacttgcgggacttggcgtcgcgctggtgccgcgcctctatgtcgagacggaattggcggaaggtcgtctgatcgcgccgtggcccgaaggtcagtcgatctccaagaccttcagcctgatcctcccagagccggtccggttgagtgacggtccgatacaggcttttgcggattggctgctttcggaagtgcacgctctgccccgcgccggctgagatggtggctttccgttccgccatagagtcacgtaccttgccgagaaaggccgcgacgacgatctgagggcgactgggccgcgtggacgaattcgttgccctcgcaggatggcagaaaaccgagcctttcgtccaataacgcccttccggaaccgcgaacgaagcagactatccggacccgatcgggaaatattattcctgttaccagtaagcggccatcagttcggaaacccattccggctgtcgaacctcgccgcgaggtagaaactcgcgcattaccggcttgatgtcgatgacaggcgttccatcgatcgcgtctagcccctcgacgcgcaactgggattcttcgacgctcagcacgcgacagacggtcacaccgagccgattgggacggttctttcctcgttgcgcgaggatacctgtcagcggccagtcgtcacggcctcttggatgacgtgcgcctcgctcgatcttctcttcgggcacacggtcgaacagaaagataatctcagcgtggctaaatgcatccagccccgccagcgcatcggctccgacctgtgttgcgtccaactcaattgtggtgcggctgcttccccaatcgtcgtcaatcggatcggaccgcccgcctcgtacatacgctatgggttctatagtgaacgtcataagtgccttccatcgatcatatctactgccatgttcggtcggctcaaatgccgatccgaaattatcttaagtgatatcagcaccttagcttgacggctggggcggtcgctgattctggagttttgcgaagaacttccaaggaacagcaatgtggaccgatatcactcgcgcgcagcatgcgcgaagcgagctggctttgccaacggatttgacggatgcggagtggcgggtcctggagccgttcttcccaccccctcgctggtgggccgcccgcgtaaatggccgatgcgccggatcgtcgaggcgatcctttatctgcttcgtggcgggctgccgtggcgggctgccgtggcggatgctgccgccgtgcttcccaccggtgtccaccgttcgacgctggttctatctgtggcgcgacagcggcttgttgctgacgatcaaccacatgctgctcatgatcgtgcgggaactccaggggcgcgaggcttcgcccagcgccggcgtcatcgatagtcagagcgtgaaaaccacggaatccggcggcccacgcggctacgatgcgggtaagaagatcaaggggcgcaagcgccacattctcactgatacccagggttacctcgtccatgccgtcgtccacggggccgatattcaggaccgcgacggtgctccgctggtgctctctgccatcgtccagcacttcccctggctccggcacgtatttgccgatggcggctacgcaggcgacaaactcaaggatgcactgcgcgccgtgagcaaatggaccatcgagatcgtcaagcgatccgacatcgccaagcgcttcgaggttctaccacgccggtgggtcgtcgaacgaacactcgcatggctcaaccacaatcgccgtctcgccaaagactttgaaagcaccatcgcttccgccaccgcttggctgttcattgcctccgtctagctgctcgcccggcgcatcgcaaaactatgatattgcaccgaataatttcgaatccgactctcaggggagtgcgtatcagttttttgatggggaacttttaatgggacggcctcacggtgccagtcagcccccccaatttcctgacttttcgctcgttctcagcgaccctcgaaagcggacgctcgtacaggtcggaatatgtccacgcggcctagatgggaagagtgagccgatatcgttggtcgctgtaaaagcgcttagatcggcaggggttgacttcaaaacgccgaggtgagaagcaagctgcgtatcagcgccgccggaaaggcggccgagatctttttggcgcaacgccaaaggagatctacatgaaagacgatacaagctctacgatcatcggccgcaaaacagttggcaatggtcaacagaaggtcatcatgctgcatgactggcatggagaccacaccttatatacccccatcttgccgtacctcgacggcaatacgtttcattacgccttcgctgatcttccaggctacggattgtctcgcggtcacgccggtccagccagcattcaacagactgcatcggctattatcgccttggccgatgaactcgattggccgcgattccatatcgtagggcattccctgtccgcgatgattgcgcaataccttgcggtattggtaccaaaccgcatcgacagcctgactgctgtctgtccaatcccagccagcggttcactggccagtgacgacgctctagcgtttttcgcttctactgcccgggacgacgacgcatttcgcaggttgattggttatttgtcgggccagttatcgaaggggtggacggaagcgaaacggattcggagccgccttgcctcctcgcccgaggtgaagatgcagtatttcgggttgttccgaacggacttctcccaacggcttctgggttcgactacaaaagtcaaccttatcctaggggaccatgatccaggtttggatgaggcgaccgtcgcgcctctatttcgacaatggtttgacgatctgaccgtggaaaccattgttaattgtggccactacccaatggaggaggcacctccgtacttcgcaactacgcttgaacgccttctgaaggggacgatcgggtctctatgagcgccggcgcgccccttggatctcgtgcggcgcacgccgaggggcgccgtagcggatgccggttggtctctgggaaggatatctgcctcttgcaagcggtagccttgttcctcatgcgcaacatgcatgtagaattggcgttgcgcttctatgtcgagatggaagcagtgaaaggtcgtctggtggcatcctggctcgaagctcattcgatttccacgaccttcagcctgcctcccagagcaggcccagttgagtgacggcctgatacaggctggctgctttcggaagtggagactccgccccgcaccggctgaggtgacggcttgctcgatcgacagtggacgtttcgctgccgctggcaagtcgttcgattatacgtttctcgtaacgatgcgtgctacgtcgaccaaaacggcttcctgctccgccactgagccacgtgcctcgcccagataggccgcgacgacgatcggaggacgattgggcgggaagagcacgccgatatcgttggtcgatattccttcccaggtcccgggtttgttcgcgatccgccacccagccggtaaaccagcccgcaggcgttgtgcggccgcatccctggacgccatcatccactcggtcaggtgcgcccgcgacgtcggcgacagagcggagccgagcacgatgcgttgcagtgtgcccaccatcgcgcgcggcgaagtcgtgtcgtgcgtctctccggacttgacgatattgagagccagttcggtcttgtcgatacgggtcgtttgatcacctattgagcgcagataggcggtcaatgcagaaggtccgccgaagctggccatcagtagatttgccgcggtgctgtcgctgacaattgctgccgcttcgcagagttgctcaactgtcatgccgtcagcaaggtgcggtttagtcgccttgaaaggcataaccagatcctttttgccgaagaagactcttcgatccagcttctcttctccgcgatcaacgcgtgcgagcgtgaacgcgatagccagagccttgaacgtgctgcacagagcgaagcgttcatcgagacggttcccaattacctgaccggtcgcggtgtccaggaccgccacgccaagatgaccaccactacggatttcgagttcccggagccggtcttcgacgatgcttcggccgttatctgcgcgcgcgccatgccctaacaaccaaggcaatgcaatgagtggggtcaaaaatgtagtccgtcgcgtgaacatccgagtcattttgcctttgcttccgccatatcctcaagttgctatctgtcgcgaccccgtgcgtcaggttaatcatcgggaccgatactgcttttttagaccgttttttgacaagattgtgggcgtttacgtgcattattcagtatgtccacgtggattgcagtccaccacttggttcgcgccgcgcgttagtggcccgccaggacgtgacttcaaagaacttcaggttatgaaataaaaaaatgtcagtcattcaccgtacttcaggtggatgagcggataagtttttccttgcccgtcgagcggagaacgaccgatgtgcttgaagcccattttttcatagaagccgaccgcctgactgttctgctcattgacgtcggttgtcagcttaggatgaagtgtaagggcgtggcgtaccagtgcggcaccaattccagttcctcgatatgcgggatcgacgaacagcgcctccatgtggcccttgtcgattagcatgaaagccagcggatagtcggcagcgtccacggcaaaccaaagcggcgcttggggcagaaagccacccaccatctcttcgatggaaaggcgatcctcacccgagagaaagttatgggtggcgtcgaccgcaccgcgccagatttccactgcgcgatcgccctcgtcaggacgggagcgtctaattgtagtcattgtgccttcctcattcatttgccggaaacaaagggagccacgcagagcccattgctccgtcaggcattccagtcagcccgctggatcacaaccctatagccatcgggatcttcaaaggtgcggcctgagcgatcccaataggggttgaacgcaggtacggctctgaacccggctccttccattctttcgacagcaatgtacatggctggacggctaacggatgccaccggcgtagcaatcgatcagaaagccttcatccaattggccattggcaacaacgcggcgcacgataaggtccaattcttcggccaaaatcgcgaaggcccggacaagatgtggccggcagctgacgatcgaactttcatggataccggtcaggggcttgccaaaatgctcccgatggatctcgtcgtagcactggcggaagcgatgttgaatgagcgccgcgtcgaacgtgagcgaatcctggagatcgccgcgcctttcttcaagtagccgaaatctcggctccaaaccggaaaacttagctttttcaatcagtaagtccatcgtgagctgtcgctcttgaaaaatgtcagaaaactgtgcatatttctgacaggagaatggccatggaacgcttgaccgaacagattctttcgtatgcgaaggggctgcccgaaggcgccccagtcgccgctaaaagcctgctccatctcggtaatcgcgccgcggtggaccagtctctgtcgcggatggccgagagggggcaattgatccgggcaggtcgaggcgtttatctcctcccggtcacaagcaggtttggcacgcgggctccctctgtggagcaggccgtcgaggcactcgccagccagcggggagagaccatcgtttcgagcggcgccgctgccgccaatacgcttggactgacaactcaggtgccggtccggtcagtttatttgacctcgggccgaacccggaagatgacattcggtaagcaagtggtcgagcttcgccacgcgccgcgctggcagctcgccatggcgcataagccagctggcgaggcggtgcgggcgctggcttggcttgggccggagaacgcagaatctgctctgcaaacgttgaagcggaaacttccgccgagcgtttttagcgagctggtcgcgatcgcgccgcagtttccaacctggctggcgcgcagcgtgggcaaggccgcctatggctgatcctttcctccacctcctggtcgacgatcgccgtgaggcgttggctgttgcggccgatagatccgggcggccagcccacctcctggaaaaggatgtctgggtagtctgggcgctctccacgctttacggctcggcactcggggagcatctggtcttcaaaggcggcacgtcgttgtccaaggcctatcaggtcatccgaaggttttccgaggacgtcgatctgacctacgacatccgggcgatagcgcccggcctggtcggaagcgatggcgaggcattgccgaagacccgcagtgaggaaaaacgctggtcgagcgaggttcgcaagcgcttgcctgagtgggtggccggaaccgtgcagccgatcatcgcagatgcgctggctgcggaagcgctgacggccgcaattcgcgtcgaaaatgagaagctgttcatcgactatgaagcaaccgccaccgggtcgggatatgtcgcgccgagtgtgatgctggagtttggcgctcgctcggccggcgagcctgccagccatcgcgatgtgatctgcgacgcggctggtctcgtggacggtgttggtttcccgattgcgcggccgcgagtcatgcatgccgagcggacgttctgggagaaggccacggcgatccacgtcttttgccttcaggagcggttacgcggtgatcgtttcgcccgtcactggcacgatgtggcgcgtctggacgaagcgggttttgcagccgctgcttttgaaaatcgagagctggccgatgccgtggcccgccacaaggcaatgtttttcgccgagaaggcggccgaccgatctcagattgactacgctgcggccgtgagcggcgggttgcaactcgtcccatccggggacagcgcaaaagctctcgcagaagattacgcaagaatgatcgatgacgggctccttcttgaggaaaccgaatcgttcgatgcactcatggcgcattgcgccgaaatcaccgcgagagccaacggagcgggaaagacagaaaggggaggctgatgcgaatcaaaggggtcgaaatcgaaaatttccgccttctgcgagacgtagcggtgggcttggaagagcgcaccacgctgatcgtgggccgaaacaatagcggcaagacctcgattgcagagctgtttcgccggctccttggcgagaaagcaccctcattcagaatggaggatttttctctcggttgccatgagtgcttctggacggcgttcgaagccttccggactgaggcttcagagccagatgtcgtcgcgctcctcccatccatcaaggtcacgattgacatcacgtatgatgtcaacgctcccgaccttggcccgctgagcgactgcatcgtcgatctcgatccgaactgtagcgacacaaggctcatcctcacttacggccctcggccagccgcacccaccacacttttcgcagacctcacggtgggcgaggatgtggcggtcaaccgtgcaacccttttccgggcgctgggcagccgcatatcaggtgcctacacggcgtccctggaagcagtcgatcccaatgacgcgaccaatcgaaaagccctggagccgaaaaccctcacagcgctggttcggggcggtttcatcaacgcgcagcgcggtcttgatgatgacacgcaccgcgaacgggatgttctgggtaaggtcgtggaggtgctctttcagtcggcgctcaccgatcccgtcgatcccgcgaagcgtacaacggccgagcagctcaaggcggcggttgagcaaattcagggcgaccttcacgccggcttcaatgcgaaactcacttcgctcctgccgacgttcgatctgttcggttatcccggcctctccgatcctggcctcgtcaccgagaccagcttcgatgttgacaagctgctgaacgaccacacgaaagttcgctacgtcggtgtaaacggcatgaccttgcctgaaacctataatgggctcggcgtgcgcaatctggtctacatgctgcttcagttgctgcgattcttccgcgaatatcaggcggagccgactgcggccggcgtgcatttgattttcatcgaagaaccggaagcccacctgcatccccagatgcaggaggttttcatccggcagctggatcagatcaccagcgcctttgttgctcagcttaacgaaaacaagccctggccagtccagttcgtcgtaactacccactccccgcatatggcgaacgaagcgcggttcgaggccatgcgttatttcctctcgattccagatggcgaaggcatgcgccgttcagtcgtgaaggatttgcgcaggggtatggggggcgcacccgagcccgatcgcgaattcctgcatcagtatttgaccctgacgcgatgcgatctgttcttcgctgacaaggccgtcctgatcgagggtacggcggagcgcatcctgctcccggcgatgatccgcaagactgacagcgccgctgccggccagccgaagctcggcagccagtatcttagcgtgatggaggtcggcggcgcttatgcgcatcgcttcttcgatctcctgtcgtttctcgaattgcgcaccctcatcatcaccgacatcgacgcggtgaagccgaacgatggcgggaagcgcgtcgccgtgcctgtggcagagggtttgttcacgagcaatggatgcttgaaagccgcgttcggcaacgacgtctcaccgcagaccctgcttgggaaaaccgctgccgagaagatcaccggtattcggcgcattgcttttcagataccggaagcgccgggcggtccgtgtggccggagcttcgaggactcctttatcctggccaaccctgcacgtttccccctcgacgacgatgacaaggcgcttgcggcctacgagttggccagtgatcagaagaagtcggccttcgcgctaggtcacgcgatcgagcacacggattggaatgtgcccaagtatatcgccgaggggctgcgctggctggcggaaggcaatccggcccctgcggagccaaatccccccatcgcggtcgaaatcgttgcgggcgccgcgggcgtcgcggtgaacgtgaccggggttagcgcagatggctgaggaagtagaaaatccagccgacgccgccgggcgagttgcgcttgagcgaatgtttgcgtgtctcgacaatgggcacagcttccgtctggaggctggcgccggggctggcaaaacctactcgcttgacaaggctcttcgccgcctaatcgatcgccgaggtgccgagctgcttcgtcgcggccagcaagtcggctgcatcacttacaccaacgttgccaaggacgagatcatctctcgcatccaggcccatccggcggtgcggaccgagacgatccacggcttttgttggtctgtcctgcaggacttccaatcgacactgcgtgcgcttgtccccgcacttgaaagctgggcagagcgtctcgaacctgttggcggcattggtacccgccgtgtccactacgagctgggataccctagcgtcggcgaccatcaggtgacgcttcggcatgaagacgttctcgcgctgatgattcaagcgcttgcttatccgaaatttcgagcggttctgaccgcgcgctatcccatccttctcatcgacgaataccaggacaccgatgccgacttcgtcaatgcgatcaaggcccggttcttggacgcgggccaaggcccgcagctaggcttgttcggcgatcactggcagaagatctatggtgagggctgtggtctggtcgagcacgcgagtctggacgtgatcgacaagaatgcaaatttccgatccaccgacccgattgtccaagttctcaatcggatgcggccagctttgccgcaaatggtgcgagatcccaccttgccgggtgaggcgcgcgtgtttcacaccaacctttggccgggcgtcaggaggaccggacaaggtggtggccactggacgggcgatacaagccccgaggcggcgaaggcatattttgcgcatatcaagcataggctcgcggccgagggctgggacctcgcggtcggaaaaaccaagattctcatgctcagccatagcgttctcgcacgcgagcagggctattcgagcatcccgccgatctatggccagttcaacgatccttggctgaaaaaggacgatccacacatcaagtttctggccgaccagttggagcccgcttgcgccgccttcacggcgaagcgttacggcgaaatgttcgaatgcttcggtactgggacgcctaaaatccgtaagcatgcggacaaggttgcttggacggatgccatgaccacgttgatcgcgctacgcacgtcggggacgatcggcgaggttgtcgatttcattgcagcgcagccgcacatgcgtcttcctgggcaagtggaagatgcggagaagcgactggccgatgttggccccgacgcggtggaaggagagtcccgacgcgtgacccagcttcgaaagctgcgtgcggtcccatatgtcgaactgatcgcccttgaccgcttcatcgacgggtatacccccttcgccaccaagcatggcgtcaagggcgcggaatttgagaacgtcctggtgatcgttggccgcggatggaacaaatataatttcggccagatgctcgaatggatcgagcctgggccacccgctgacaaaaccgatttctttgagaacaaccgtaatctcttctacgttgcatgctctcggcctaaggtccgtctggccctcctgtttacgcaagtgctcagtgcaaatgcgatggcgcgactcacggcttggtttggagctgacaacattgtggccctgccagcagatcctggtggcgtgccggcatgagcgctttggatctgctcgactttgacggcgtcagtgcggctgactcccagcaggtgcgtgtcgcgatccagagtggcgacaacttctatggctacattccttcggaagcgctcggtttcatcgtacgcaattatcgtgggctggcccagctacaagcgttggaggcggcgtggctcgattgctacgttcactcgtccaacttcagcgtttatgggatcgagacaatcaaggcgatcttcgacgcttgcgatcgggagcggttgcgcaggctcaaaccgctgacacagattgctggagaccgcgcaacgctttttcgagggtgtgcagggcctgagcacacattgggaatgtcgtggaccacctctctcgacaaggcgatctggtatgccgcccatcatgcggcttattacgatctcaccaatcgggcagtttacgtcacctctatcccggtcagcgaaatctactgctgtctcgaccactatgaccatgactgtatcgctcatcctcagtcggcatggcatgtggatgttccggaggaggagttccgcctagatagacctcgttgaagcggccggctttgcaggagcgtctagctcgcgcctgagagaagactctgctataggcatggcggtactttctgcgggtattgagcagagccccgtgtggcttgcagctcccccgaaaggctcgatcggcaccgatagatgccgaaaccacgcaaaaaaatttcagggtaatttccgtttaaaatcaagagcgtaactttttgacggcctacggctcggctttcggcggcgagcgaaataaaaaatcaatatatatcaatgatataaactggtttagaacaatcgagtgggaatgatttgacgtctgcctgacgctggttgccatcctgtaaaacgacaccagggataggcctttgtaaaaaggggcttatccatattggatctgatgaatctgcggcaggctggacgcgttatcagcattgccaatgcatacaaacatgttcggatcacaaggactggcaaagcattgcacctcgctatgagctgcatcgcagccataatcacatactgtatccgcagcgagtcctgagcctgttcgtctagtaaacctgcaggcgctcagcagtcatcatgggggtagagatcacggtagtgatcatctaaccagctttttcagctattaacctcccgaactggctgctttccctccggaccaataaaaaaccctgcatttcagggcttgcgctgtgtgcggagagggggtaggaaccgcgccgcggcggaatgctgcgtgctggcgctgttgtagctcaggggtagagcactcccttggtaagggagaggtccagggttcaaatccctgcaacagcaccattcgcccggctttaaacgccgagagacaaagcacgggataccgcaatggccgcaatcgcagatatcatcgcccgcgaaattctcgacagccgggggaatcccacggttgaggtcgatgtcacccttgaaagcggcgctcagggccgtgccgctgtaccgtccggcgcttccaccggtgcgcatgaagcagtcgaacttcgcgacggggataaaagccgctatggcggcaagggcgtgctgcatgctgtcagctttgtggaaggcgagatctttgaggccattggtggcatggatgcctccgaacagcttcgtattgatgaaaccctgattgccgttgacggcacccctaacaaatcccgtctgggcgctaatgcgatgctggctgtttcgctggccactgccaaggctgctgcgaatcatcagggcgttccgctgtatcgctatcttggcggtgtgtatgcacgcaccctgccggtgccgatgatgaacatcgtgaatggcggcaagcatgccgataaccccatcgatattcaggaattcatgatccagccggttgccgcaccgacgattgcggatgcggtgcgggtgggggctgaaatctttgccgccctcaagaaggaactgagcgcagccggtcacaacaccaatgtcggggatgaaggcggttttgcacccggccttaaatcggcggaagaagctctttccttcatcaccaaggcctgtgaaaaggctggctatcgtccgggtgaggacgtcacctttgcgctggactgcgctgcgaccgagttcttcaaggacggggtctatgatctggaaggcgaaggcaaaaaattcgatgcggccggaatggtccgctatctggaagatctggccgcgaagttcccgatcgtctctattgaggatggtttggccgaagatgactgggaaggctggaagctgctgaccgatacgcttggccgcaaggtccagctggtgggcgatgatctgttcgtcaccaacccggatcgtctgcgtcatggcatcgcattgggaactgccaacgcgattctggtgaaggtcaaccagatcggtaccctctctgagacgctggaagccgtggaaaccgcgcatcgcgccggttatgcggcggtcatgagccaccgttcaggtgaaaccgaggattcgaccattgctgacctcgctgttgccaccaattgcggtcagatcaagaccggcagcctgtcccgtagtgatcgcaccgcgaaatataatcagctgatccgtattgagcaggatcttgacacatccggccgttatgcgggtcgcactatcttgcggggctgaaacaaatcgggataaagccgccgcgtttttgcaacatggtttggttttctgtttagaaaacgatttaacgggcagtcagatgatgggctgcccgttatctttatgtcagcctggtagttgatcggggcaggggagcagccaatggcattcatgcggacagtcagacggaagctgaaaagcgcggtggcccctaccgtgtttctggcattgctcggatatttcagttggaacgtcacccgcggtaatctgggtctgcaatcctaccacgagcatcaggcggatatgatgcaggcagcaaaagatcttgaggctgccaaggccgatcttgcctcttgggagcggcggatcaagggcctcggttcatctcgtctcgataccgattcattggatgagaggtcccgggccatgctcaatctggctgatcccaccgatatcgtagtgatgtatcccaagggtgataaactgttctgacctgtttcccccacaactcgacgaaagcttgatgcgtcagcaccgcttttaaagcaccttctgaaccgtaaaatgcatcgttgcgcaatctcgggtctttcttaactaaacaactgacttataagccttttagggggcttcctcgcttgtcgcgcaattttcttgcggctacgtcttggagacggagtgccggaggaaatgaccgagatggcgcgtatgacgcaggccacaaaaggcaacaggacacccgataacaggggtcaaaaaatatctgatcagcgaccgctcgatcagaaagcactactgactgcttttcaggatatgatgctgatccgccgcttcgaggaaaaggcgggacaattatacggcatggggctgatcggtggtttctgccacctgtatatcggtcaggaagccgtcgttgtgggcattcaggccgcactggaggacggtgatcaggtcgtcacatcctaccgcgatcatgggcatatgctcgcaacgggcatggacccgaaaggtgtgatggctgagctgactggacgccgggacggttattcccggggaaaaggcggttccatgcacatgttcagccgggagaagaatttctacggcggtcatggcattgtcggcgcacaggtgccgattgcggctggtatcgcctatgccaatcagtatcgcggcaatggcaaggtcagtgtcgtttattatggtgatggcgcttccagccaggggcaggtgtatgagacttataatcttgccgccttgctgaagctgccggttctgttcgtgatcgagaacaacaaatacggcatgggtaccagcgtcgatcgcgccacggcgtctcatgatttgtcgcaaaacggcacaccctggaacattccgggccgtcaggtggacgggatggacgtacaggccgtctatgaggcggcccgggaggccgtcgcgcattgccgctccggcaaggggccgtatctgctggaaatgcagacctaccgctatcgcggtcattccatgtctgatcccggcaaataccggacgcgggaggaaatccagaaaatgcgggccgagcgtgactgcattgatcatgcccgtcaggaactgatcgccctcggtacggatgagactgttctgaaagaaatcgaggacgcgatcaaaaagcgcgtggccgaggcagccactttcgctcaggaaagcccggagccggatgaatcggagctgtggaccgatattctggccgaaaatggggtggaagcataaagatggcgacgcagattttaatgccggcgctcagcccgaccatgacggaggggcggctggcacgttggctggtcaaggcgggggatacgatcagtgccggtgacgttgtggctgaaatcgaaaccgacaaagccactatggaagttgaagctgtcgatgaggggcgcatcagccgtctgctggtcgaggaaggcgcagaaggggtcgcggtaaataccccgattgccgagctggcggaagaaggtgaaagcgaggctccggccacatcatcggcgccaccttcgcttcagcaggataaagaagctccgaaggaaccgctaaaagctccccccactgctccagccactgtcatatccgctgccgaagaaaaagattggggtccgacgaagccgatcacggtgcgcgaagccctgcgggatgcgatggcggcggagatgcgatcagatgatcgcgttttcctcctgggtgaggaagtggcgcaatatcagggtgcgtacaaggtcagtcagggattactcgacgaattcggtgagaagcgtgtgatggatacgccgattaccgaacatggatttgccggttttgccgtgggcgcagccatggccgggttgcggccgatctgcgagttcatgaccttcaacttcgccatgcaggccatcgaccagatcatcaattccgccgcgaagacacggtatatgtcgggcggtcagatgagttgtcccatcgtgttccggggaccgaacggcgcggccagccgggtcgcggcccagcatagccagtgttatgccagctggtacgcccatgtgcccggtttgaaagtggtggcgccatggtcctcggcggatgccaaggggctgttgcgcgctgccattcgtgatcccaacccggtgatcgtgctggagaatgaaattctctacggccagagttttgattgcccggtggatgaggatttcgtcctgcccattggccgtgcgaaaatagagcgtgtcgggacggatgtgacaatcgtcgctttcagcatcgcggtcgggacggcgctgaaagccgcggagcagctggcggatcaaggcatctcggcggaagtgatcaatctgcgcagcttgcgaccgctggataccgataccatcgtgcgcagcgtgaagaagaccagccgcctggtcacggtggaagaaggctggccgtttgctggtattggtgcggaaatcgccatgcagatcatggagcattgtttcgactggctggatgctccgccgatccgggtgcacgggctggatgtgccacttccctatgccgccaatctggaaaagctggccttgccgcagcctgaatgggttgtggatgcggtcaatcgctccatgcagggggcacgctgagtcatggcaaccactattctgatgcccgcgctcagcccgaccatgacggaaggcaccctggcgcgctggctcaagaaagaaggcgataccatcaccgctggcgacgtgatcgccgaaatcgagaccgacaaggccaccatggaggttgaagccgtcgatgagggcgtgctcggtcgtattctggtgccggacggaaccgagggtgtggccgtcaacgcccctatcgccattctggtcgaggaaggggaggctatacccgatcagggggatattccggctcctgccaaggcttctgccattcctgccgctgaaagctccgttcctgcgaaactggaaccgaaggctattgcctcttcagggccggacagaacagaaaatcgtatcttcgcttctccgctcgcacggcgtatcgcaaaggaggccggaattgatctgacatcattgactggcagtgggccctcaggccgtattctccgagcggatgtcgaaaaagcgaagggaacgggtggaaaaccggcttcggcatctactgctgctccggcggcaacgggtgcaactcataagctggtgccgcattccggcatgcgccgcaccattgcccgtcgtctgaccgaggccaagcaaaccatcccgcatttctatgtgacgatggatgtcgcactggatgcgctgctgaagctgcgtgccgatttgaatgcccgctctccggcggaggggcaggaaggtgcgttcaagctctccgtgaatgatctgatcatcaaggcggcgggactggccctgcgccgtgtgccgggcgtcaatgctgcgtggagcgaggacggaatcctgttgttcgaggatgtggatatcagcgtcgccgtgtccattcccgacgggctgataaccccgattatccgtcaggccgaccgcaagggcgtggtctccatcagcacggaaatgaaggaactggcggcgagagcacgcaagggcggattgcaaccctcggattatcaggggggtggcttctccatttccaatctcggcatgtatggcgtacgggactttgcagcgatcatcaatccaccgcaggccgccattctggcagtgggggctggtgagcagcgccctgtggtcagggatggagccttggccgttgccacggtaatgagttgcaccctgtcggtggatcatcgcgtggtggatggcgcgcttggggcgcaatggttgggtgcgttccggcagatcgttgaagatccattgagtctgctgctgtgagtcgggtgatcctgacaaatggacgtttcctgattcgcgaagcgaaccggggtgacgttccgcatcttgtgcgcttcatccgcgatctggcgacattcgagcagttatcccatgaagcgatcgcaaacgaagaggatttcgaacaggcattttttggcccgtttccccgcgtgttcgcgctgcttgcctgtgtggagggaaagccggtcggggttgccgtctggtactacacgttcagcactttcaccggacggcacgggatttatctggaggatctttatgtcgatccgccgttccgccggcgtggcatcgcacaggggtttttcacgtctctggcccggattgcggtgcaggaggggttacgacggttcgaatgggccgtgctggactggaatgaggatgccatcactttctatcgccgcatgggtgctgtcggcatggaagaatggacagtccagcgcgtgacgggggaggcgcttgagcgtctcgcggaggattaggatatggcggacacggtattcgatctgattgtcgtcggtggtggtccgggcggctatgtcgcggccatccgcgcggcccagttggggatgaaaaccgctctggtggagcgggcgcatctggggggtatctgtctcaactggggctgtattcccaccaaggcattgctacgggcagcagaaatcaaccatctgctgcaccatctgtccgattttggttttgcggccgacaatatccgttacgatcttgatgccgtggtgaaacgctcccgcaccgtggccgggcagctttcgtccggggtcaagcacctgctgaaaaagaacaaggttacggtgttcgacgggcatgccagactgtccgggcggcatcggctggatgtgtcgaaagacgggcagcctgtcgccacgctggaagcgccgcatatcgtgctggcgaccggtgcacgggcaaggcaattgccggggctggaagcggatggcacgctgatctggagctatcgtgaggcgatggtgccgaaagccctgccgaaacgcctcctggtggtagggtcaggcgcaatcggcatcgaattcgccagtttttatcgctcgcttggctccgaggtgacagtgctggaagcggtagaacgcatcctgccggctgaggacgaagaaatagccgccttcgcccgcaaatccttcgaggctcagggcatgaccattcataccggcgtgaaaatcgggaaggtggaaaagggccgcgatgaggtcacgatctccttcgaggcagccggcaaaaaacactctcttaccgtggatcggatcattgccgcggtcgggattgtcggcaatgtcgaaaatctgggtctggaaggcacggccgttaccatcgaaaaaacccatatcgtcacagacgggcttggccgcaccggagaagacggggtttatgccatcggcgatctgaccggcccgccatggctggcgcacaaggccagtcacgaggccgtgttgtgtgtcgaggcgattgcagggctggatgtgcatccgctcgatatcaccaacattcccggctgcacctattgccgcccgcagattgcctcggtcggcctgacggaggcaaaggcgcgggaacgcggatatgaggtcagggtgggccgcttcccctttatcggcaatggcaaggcaattgcgatgggggaggcggagggactgaccaaaaccattttcgatgccaaaaccggggaattgctcggcgcgcatatggtcgggccggaggtgacggaaatgattcagggcttcaccatcgcccgcactctggaaaccacggaagccgagctgatgcacacggtgttcccgcatcccactgtcagcgagaccatgcatgaggccgtgctggatgcgtatggtcgtgcccttcatttctgattacgctgccaagcgggttgacgggacaccacgtgcgtcccatctcccgttttgcgtttacggagccgtgccatggtcacgcgcgttctgattgatcaccggcagggtggccggcatgaggctggcgtccggcacccggagaaacagcaccgcccggataatccgtcgcagccgaaaccgtcatggatcagggtcaaggctccgaaccatcccgtctatcaccagacgcaggcgctgatgcgggaaaaccgcctcaccacggtgtgtgaggaagcagcctgccccaatatcggtgaatgctggagccagcgtcacgctaccatgatgattatgggcgatacctgcacgcgggcatgcagcttctgcaacgtcaaaaccggcctgccacatgctctggatggcgatgaaccggcccgggtagcggatgcagtggcgcgactggggctgcgccatgtcgtgattacctccgtggatcgggacgatctgaatgatggtggtgctgcgcatatcgcggcggtcataaaagctgtcagattggcggcacccgagaccacgattgaggtgctgaccccggatttcctgcgcaaaccgggcgctgccgagactgtggcggaggctcgtccggacgttttcaaccataatctggaaaccgttccccggctttaccctgccatccggcctggggcgcggtattttcagtctttgcgcctgctggatcaggtcaagcgactggatccgtccattttcaccaaatcgggattgatggtcgggttgggggaagatcgggctgaaattgctcaggtcatggatgatctgcgcattgcagaggtcgatttcatcacgctgggacagtatttgcagccgacccccaagcatgcggccgtggataggttcgtgacaccggatgagttttcggattatgcctccatggctcgatcgaaaggcttcctgatggtttcatcctcgccgttgacccgcagctcctatcacgccgatgccgattttgcggccctgcgcgcggcccggatggaacagcagcagcggattgcctgatgcccaaacacgctgaacgcaaatccgtcccctatcaggccgcgcagatgttcgatctggtggcggatgtcgggcgttatcccgaatttttgccatggtgcgttggtgcgcgggtcagaagccggactgaaaccctgatgatcgccgatctgacgatcggtttcggcccgttccgcgaaacctttaccagccgcgtcgggctgcatcggccggagcggattgatgtgcggtatgaaaacggcccgttccgctatctgaacaatcgctggacattcatcccgcatgccaatggctgcacgattgattttttcgtggattttgaattccgcaaccggctgcttcaggcagctatcggcactgtgtttaccgaaacagtgcggcgtatggtcaatgctttcctgaaacgggcggaaaatctgtacggcgtgatgcctgatcagggcagggtagtcacagaaacaggaagtaccgcgcccgtcagaagctaatgcgtcctggagactgattttttctcaatcgtgccataaagccgcctcgctatcgacatgatgtgagaataaatcaattcttggttgatgaggtcgatctggccgaaccgaacaaggattgaaaaccatgcgatttgtatcgctgctgccttcatctctggcgctgagcctgctactggctggcctgacggtttcccaaccgtccatggcggctgatcagaccggaaatgcgcctgttaccactgctgcaccggttgcttctgctccttccccggccgccgtagaaaagccgaaagatcatcgccatcgtacgctggcgcagcgtttcgaggatgccaacaccacccatgatggcaaattgacacccgaacaggcgcaaaaaggcatgccgtttgtcgctcgggattttgcgaaaatcgacaaaaccgccaaaggctatgtgacgcttgacgacattcatgcttatcagaaggaacgccgtgccgagcgtaaggcgaagaaagctgctgaagccgctgccaaggctgctccaaccgcaacaactaccccttctgctcccgcagcacactgaattgtaatcgcatgacgataacggtctgaccgtggcaaggtgttctgatcgctggccagctttgaaaacaaggagcgattatgattcagcgtctaaacggtcaggccgtcgagactccccagatcctgatgacggatccggcacattacaccgtctcctacgccatcaatccatggatggacccggatagctgggcggcagacgcggagaccaatgccgctgctgcaaaaaaatccgctgacaggctggtggaacatttacgggcctgcggtgccagtcttgaaatcattcccggtgcgcccggcctgccggatatggtgtttcccgccaatgccggaacggtgctggatggacgcatgctcctggcccgctttcttcatccacagcgtcagggggaggagccatattttctggccgcgttcgaaagcctgaaagaacgtggcattttgcaggatatcgcttttcttcctgaaggggccgtgcaggaaggggccggagatgcaatctgggatcggcgccgcggatttttctggaccggttttggtcagcgcagcaaccgggaaggggtggaagccgttgcccgttatttcagccaggatgttgtcacgctggaactggcgacgccacaattctatcatctggacacatgtttctgcccactgagcggcggagatgtattgtattatcctcccgcctttacccctgcctctctgtccgcgatcgaggcacatgtcgcgcctgagcatcgcctggtggctgatcaggaagatgccgaccgtttttgtgtgaacgcggttaacatcggccagactgttatcatggcacaggcggcggcgcgactgcggggaaggctgtcggagcgtggctatgtggtccgggagacagatctaacaccttatatcatgtccggtggcggggcttactgcatgacattgcggctggaccgttcaagccgttaggtctcaatctctggcagcttcccgcagcatatgcagggcatgcacgaccgtggcagccctgacctcggtgcggttgccggagaaaacccgcgattccgtgattgagccatgcaggcgacgggacaagccgaaccagaccagcccgaccggcttaccttcactctctccggtagggccggcaatccctgtgacagacaacgcaaactcggcatgggaggcattcagtgccccttgggccatcgccagagccacttcttcacttacggcgcccacttcctcgatcagggagagcggcacgccgagcatctcgcttttcgacgcattggagtaggtcacaaagccgcgatcaaacattgcgctggccccggagatggctgtcagggtcgcggcgatcaggccgcctgtgcagctttccgccgtagccacaaccttaccacgtcgggcaaaatcctcgaccagagtgattgcctcgcggatgatagaatcctcgatcatcgtattttactcccttgataataaaaaatattatccaagcagatggggtgcagccagccgtatgaaaacaaggatcatcgcccctgcaattccggccagaatatcatcgcccatcacgcccattgcatctttcttcctatccgcccagccgattggtccaagcttcgtaatgtccagcaccctgaaaatcagaaacgccagagcaagggctgtggttgtgggatgaaggggcagggccaacattgtaatccacataccggcaaattcgtcgatgacgacccagccgggatcattgagcgctccgcaggcccgtacagcccaccagccccccagacaggctgccagagcggcaatgcccagcaacaggggtgacacccaccagaggaaggctccggcaatcagcgcgaaggccgtgccaacggttccggcaccttgcatgacgatcagcccggaaccgaagccgctggcaatgaaacggggaatgttcatggaaaccttcaatgcgccaaagcaggagcggataacaagggcggctccgtcaatgaatcattgcgtttcgcacgataaaccattgtattttcaatcactctctgaacatagttgcgcgtttcgttgaacggaattaactcgatccagtcgatcgcgttctggaagctggcgtaatctatgcgccatgcatcgacccgatgcggaccggcattatatccggcgacggccagtggcacggcttgcccaaagcgatccagcagcccttgcagataggtgctgcccagccggacattcagcgctggatcactgagaagctgagcggatgagacggtgatgcccaaggttcgggcgacctgactggcggtggcaggcatcaactgcatcaagccacgtgctccggcagggctttccgcctgcgggtcgaagctgctttcctgacgaataatccccagtgtcagtggcaccggggttgcactttgttcgacaggtgcatccggcggccagccggtaacgggcagcatcgccccatcacggcccatccggcgggccacaaagaccgcgacatccggcaaaccagcctgtaccgccagatgtgccgtcagcgcatggactgttccggcaggcagttgacgaccagcctcggcctcatccgcctgcaacaggaaagcacgtgcccggcggctctcttcccatgaaatcagcagcagggcggctctgaccaactcctgcccggaataggattccagttgcgcactgctccagcccggatcgtttagagagcggatatgccgccccaggctggatggagattctccagcctgcaaggctccaagctgcccatagaacgtgacaggccatgctgccgcctgaagccactcagcctttgccgttgcctcatcaccacgggcctgtgcaacctccccgagccagtaatgtgccctggacaaggtcagcacggcgttgcctgaggaaagcaatgaacgaaaacgattttccgcagcagcaggatcacgcagaaaacggagcgcgataaaaccagctaaaaactcgctttctgccttttgtacaggggttgaggcactcccccccgtgatgacctcgaaagccagccgggcattgtcttggccgccatctttcagcaaggcgcgggcgaggattgtgcgttcctgccggaaggcggcgttatgagcagcggattccgcctgttctgcggtgtcaccatcctgtttccagactgaggccgcatcctgatcatgatcggtcaggcgcagatagcgcgcgctggccagcaccatcacgggtgaggatttcgcctctcccgacagggcgttaaacaacgatagagcggttggttccttgcgccacagcgcagcgagggccgtggcactggcacgatcagaggcgggcaaatatggaatctggcggaaagccgcctccatattggtcagcagaagggcctgatagcgggctttccgggtctctgccgttaaggcctgactccatttttgccgtatcaaagtctcctgcgtctgattgcctttgccctcggcccacagtgttctgatctggtccagagcagtgctggttgctccggttgcgctccatgcctcggcacagcgaatctgcgcatcgaccagagcaggatgcagcgagtcgcagagagaagccgctttggcattatcctgttctgccacaatggcctgatcgcggcggcgcgccagagtcgattgcatcggccagcccggattggctgccatgaaggcggcaatatccggggcggacatcgctccgggcgccaatgcccgataaaatgtgaccagcttgaccgcgaccggatcagggagtgccgatgcctcagccatggcctggtcccattgatcggcacggatcagggcaccgatcgtgtttgtcgatgctggtggtgaggatttttttataacactatcagtgacttgcgaagaaatgctgccatcatgtggccgtgtggagcatcccgtctgggcaatgactgccagaagagttgcccaaagggttaccccctggcggatacgcaacagggaagggatcatcgtgttcacaatcatgcggctggagatgagggtggaaagcattgcaggggagtgtagcaagcggcgatcttgcagcgcatcccccgcgcgcttagcttccgcgttttcgcaacataccgcgtgacccgggccggcaggcctggcccggttcgtctcagggagctttccatgttcaaggggtcgcttgtcgcgctgatcacgcccatgcgtgaggacggatcggtggatgaggaagcgctggcccgcttcgtcgactggcagatcaccgaaggaacgcacggtctggttccggtgggaacgaccggagaatcagcgaccctgacgcatcatgaacacaagcgcgtcgtcgaaatcacggtagaagtcgccaaaggccgcgtccctgtgatggcgggagccggatcgaacagcacaacggaagccattgatctggttcgccatgcgaaacaggccggtgccgatgccgcgctggtggtcacgccgtattacaacaagccgactcaggaaggcctgtacttacattacatggctattgccgatgccgtggaactaccgatctacatctataatattcccggtcgtagcgtggttgagatgtcaatcgaaacgatggcacgtctggcccgccatccgaacattgttggcgtcaaggatgcgacagccaatctggtgaagccgcttcagacacgtcgtctgtgcggtgatgatttcatccagctctccggtgaggacccgacagcggtggcgtatctggccgctggtggcgcgggttgtatcagtgtgacgggcaacatcgctccgaaactgtgcagccagatgcagacggcatgggccgagggccgtatcaaggatgctcaggccattcagcaacgtctgtatccgctgcatgaagccatgtttgtggaaagcaatcccgtgccggtcaaatacggagcctccttgctcggtctgacagcggctcgctgccgtctgccaatggcgccgatcagccaggcggcggctgaacgggttcgcgaggcaatgactgaagtcggcctgctgtcccaatcagccggataatcaatcatatggcggagacaaaaagcggcaaatccgggctgatcagccatggcgtcgctgcccagaaccgtaaggcgcgtttcgattacaccatcaaggaaacggtcgaggccggacttgtgctcaaggggccggaggtcaaatccctccggcatggccgcgcgacgttaagcgaagcctgggcgggagaacgggatggcgagatgttcctgttcaacgcctatatcccggaatatcagggtggtgtgttgtcccggttcgagccgcgttccccacgcaagctgctgctcaagcgcaagcagatcaaccatctgctcggggctgttcagaaacagggtcagacagtcgtgccgctccagatccatttcaatgagcgcggcatggccaaggtgctgctgggcgttgccgaaggacgtaacaaggccgacaaacgcgccgccattgcctcccgggactggcaacgggacaaggcccggctgatgcgggaaaaaggctgatctttcacagctcagggacaaggcccgtggagggtctgcttgtctgagtatttagtttccataatatatcttatacgacttataaatgcctgattgtgcttcttctaaaattattacaatcacttacaagagcataatttatgtcacgtcccattcaccgccctatcgcattcatactgacatcgaccgatcacggaacaatgatccttaatcgaaatgaccatcatatcattagtcctgaaactatttacggcgtcggtcacgatatattgcgagattcgagctttaatagttatgaagtggaattgcttttgaatcttctgacattgcgcagacattattttggagacggagtttttgccattgatggtggtgcgaatataggtgtccacactgtggaatgggccagatacatgactggttggggccgtgtcctgagctttgaggctcaggaagttgtttattatgctctggctggcaatatcgtcatcaataactgcctgaatgcccgtgcaaagctggcagctattggtgaaaacgtgggtgaattaaccattccccaacctgattatttttccgctggcagtttcggtagttttgaaatcaaacaacggccagatggggaatttatcggccagcctatttcttatgcaccttcggatggggtaagtatacccatgctgagcattgattctcttgagcttgaccgtgtcgactttatcaaacttgatatcgaggggatggagattgaagctctgcgaggagcccaagaaaccattgaaaaatcgcgtccaattctgttccttgaaatggcaaaatccgattctgctgaaatttacaaatttcttaatgataacaattataattattttgaagacaagataaatctttttgctcttcataaagatgatcccgtctggcctcacataagccataatgctaataaagtgcctgagcattaagcaatattgaagttctgacataacttcttttatccgaaggatattttatattggctcctttccgtcctgtggcattcatcctcgcgtcaacagatcacgggatgatgatcgttaatcgaaacgatcatcacactgatgataccgggaaaacttttggcgtaggatacgaactgctgcaattttcaagctttacttcgcaggaagtcaattctctcctgcaaatgtttactttacggcgacagcagttcggcgatggtgtggtcgcgattgatggtggtgcgaatataggtgtgcacactgtagaatgggccagacatatgactggatggggacatgttttaagctttgaggctcaggaagttgtttattatgctttggcaggcaatatcgttatcaataattgcttgaatgctcatgctaaacttgctgcactgggtgaagaggtaggtgaattaataattcctcgacctgattattttaagccttcgactttcggaagcctggaaatcaagcctcaacacttgcatgaatatattgggcaaccgatttcatacgacccatccataggcgtcgctgtgcctctggtaagtattgattccctgaatcttcagcgtgtcgactttatcaagctggatatcgaaggaatggaagttgaagctctgaaaggcgcgaagaagaccattcaggctcatcgtccaatcctgtttattgaagttattaaatcagatattgaacagattgtcagtttttttaatcaaatcgattatctatgcttaaaagatcagatgaatatttttgccatccataaggatgacccgatatggccgcatatcgcctataacggcgattcttctacgaacagttgaagccataagcattcaaaatcatgcccatcccttttcttcccagtgaggcagtcgatagtactgcccatatggtccagatcgcgctgacacctatttttctgctgaatggtgtcggcacgcttctgaatgttttcaatacccgtctggcccgtgtctcagaccataatcaacgcttgtcggagatgaggcgtgatccatcctgtacgattgataaggcaattctcgacatacaccgccatcgccttcgctggcggctgcgtgcactggatgcggcgattgccctgacggcatgtgccggggcggcgacctgcggcaccgcttttattctgtttctgggcagcctgcatgacagtgccattgcatcatggctcgaactgtctttcggggcagcgctgatctgtgtgattttggcattgatgtcgttttttgccgatacgatgctggcatggcacggtttacgacgcgaaggaccactgcctgatacggcttccaaataggcagcctgtcctgcttttatctgtctgcaacagcaggaccgcgcagcaatatgtagccacataacccggacagcatggaacctgacaggatgccgagcttgatctggttcacggccgcagtgccgggaaacgctagaatggcgatgaacaggctcatagtgaagccaatgccacagagaaaagcgatcccgattctatgccgccatgtgatgtaaggcgggaaaccggaagcaccggataattggagaatactgacagcccccagcactcccaatggtttccccagcatcagggctgcccctacccctaatgtcagcggcgataacatctgtccgactgttacgccatggagactgatccccgcattggcaaaaccgaacagaggtaaaatcacgaaccgaacaggccatgacagcatatgttccagacgcatgagcggagatgcctcgtcatgtccggccgggatcagcagcgccagtcctacacccgcaacagtgggatgaatgccgcttttcagggtcagccaccagagcgggacccctgccaacagatagggaaacagcgttctgaccccttgccggttcagcatcagcagcagcccaagaatggccgcgacccctgcccccggcagcacggatagagtccccgtataaaacagggcaatcacgatcacggcccccagatcatcgacaatcgccagggctgtcagaaagactttcagaatccctggaacgcgcgatcccgccagtgccagcacaccaagggcaaaagcaatatcggtggctgtcggaatggcccatccgcgcagggcctctccagaatgattgaaagcaacgtagatgatcgctggaaccaccatgccgccgatggctgcaacgcccggcaggagacgttgtgaccaatgtgaaagatgaccgtaaagaatttcccgttttatctccagcccggcaagcaggaaaaacagcgccatcagcgcatcattgatccagccccgcatagtaagcggaccagtttcgatattcagccaatattcataggaggcctgccagatactgttggcgaacaccatgccaatggctgaggctgccatcagcataacaccggcagccgcttcgtggctcaaaagagctgatgaaggaagaaggcgagcatgatgacgattttgcacgtgttcccgttagcatggcgcttgtcttctcagcaagcggccctgttgtccaaaccgtcatatactgcacaaaatacgatttttattgctatttatgcatatatataatcataaaaagcatgattattttacccaatatctcgaatggtgtttgcccggcataaacagcccttccccctcttgcgtccatgcggagtttccccaatcaaattccgctcagggagaaaaacgccggggagataatcggcattgggcgcgttaatagaaatcgagcggctgacgaagcggttcggaaccttcacagccgtcgatgacgtctcgtttgcggtcaaaaaaggcgaagttctgggttttctggggccaaacggggccggaaaatccacgaccatgaagatggtatcggggttcatgaccccggatggcggtaccgccagaatcggtggtcacgatgttcgtcatgatacgatcgctgcacagaaactgctgggctttctgccggaaggcgcccccagctatccggaaatgacggtgcaggcttttctgcgcttcattgccacaatacgcgggctgagcggtgcggaggcgcgtaaccgcattgccgaagccatggaacgcacgcagcttcagggggtaaggctgcaaccgatcgaaaccctgtcgaaagggtttcgtcgacgcgtcggtctggcgcagaccttgctgaatgatccccctgcccttgtgctcgatgagccgacggacgggctggatcccaatcagaagcatgaaattcgttctttgattgcggaaatggcgcctcgcaaggccatcatcatcagcactcatattctggaagaggttgaggcgatctgcaccagggcgattgtcatcgcccatggacgcatcatcgcggatgaaacgcctgcggctctggcagaacgccatccatcacgcaaactcgacgatgtcttccggaccctgacccaaactcccgacagggagcgcatgatatgagaaccatcctgaccatcgcccggcgggaactggccggttatttcgccacaccggttgctgtggtgttcatcgtcattttcctgctgttgcaaggcattttgaccttcaatctgggtgatttcttcaaccgtaatcaggctgatctggtcgttttcttccagttcatcccgtgggtgtttctgttgctggttccggcgatcaccatgcgtctctgggcggaagaaaggcggctgggcactatcgagctgctgctgaccctgccgatccggcagtcagaagccgttatcggcaaatttctggccgcctgggctttttgcgggatcgcgctggcgctgacttttcccttcgtcatcaccgtgaattatctgggggagccggataatggcgtgattgcctccggctatctgggcgctatgctggtggcgggcgcattcctgtcgatcggggctgccgtctcagccgtgaccaaaaatcaggtcatcgctttcgtgctgggggttgcggtgtgcttgctgtttgcgctcgcttcctattccgccgtcaatgacttcctcagtcagacggtgccctccatcgtgccgctgatccgccgtttcagtgtcgtggacaggtttctggatttctcacgcggcgtcatctccgtgcgcgatctggtttttttcgcctcgttcatcggatttttcctgttcctgaatacggtcatccttgagcacaagaaggcggcatgagatgagcgatctgaagacagccgccgggatgccgggcggcacccaaagtcatgcccctcagggtagcccccctcagggcagacagcgtatctggccctccgtgctgggggtggtatcggttgccggcctgctgatcggcgccaatatgctggtcgatgccaggctgccgcaggtgcagtgggatgtgaccagtaaccgcatctatacgctgtcggacagcactgtttccgtgctttcccatctgcaatcaccgattacgctgaagtttttctattcgccgcctctcggcgcacggattccgaaatatggctcctatgccgaccgcgtgcgggaaatgctggagcagtacaagcggctttcgcacgggatgctctccatcgagttctataatccggagccattcagcgaaaccgaggatcgcgccatcggcaatggcttgcagggcgtgccgctcgatcagagcggagagcaggtctatttcggtctggtcggtttgaaccggctggatggtcgtaagatcattccgttcttccagccggaccgggagcggtttctggaatatgatctgactcgtctgatctatgacctgaccgatccgcaaaagcctgtcgtcggacttctgaccgatttgccgatcatgggcagcggtcagtctctggtttcgacccggcgcatgggaccgatgaagccatgggccatcgtcaatacgctgaaagaagtcgctgatctgcggcctgttcccatttcggcccagtggattgatcctgggattcagacgctgatcgtggtgcatccgcagcatctgtccgaagtgatgcagtatgcaatcgatcagttcatcatgcgtggcggcaaattgctgctggcggttgatcccgacagcgaaacacaggctctgctgccgcctgatcctgcccagaaacgccagcaggatgggcctccgagctatgcgagcaacctgcccaaactgctctccggttggggcgtgttgtatgacccggatacagtggtgctggacccgaacggcgcatggcgggtccgtacggaggatatgaaaacaggctccaccaattatctggcctggttcaacgaccgtgacgggctgaaccgccatgacccgattaccgcggatctgacacaggtaacggtggctgcggccggagcgcttcgcaaagcaccggatgcaaaaatcagcttcgagccgctgctgtcctccagcccggaaagcggatcgatcccgtccattcgtacctctcatgatcctgatccgcagcgtattgcggcagagttccatccctccggtggcccccgcgtcctggctgcccggatccggggccacctgaaatcagctttctccggtaaacccgattccgtggcatccctgaaggacctgcctgactatctgccagagacgaaaggggatgccgatattgtcatcctgtccgatagcgacatctttgccgatcgtttctgggtgcatggctcggatttctttggcaaggaaacgcttcagccgttcagcgataacgggattttcctgtcccgaatcgtcagcgccctgaccgggaacaaggcgctgggcggtatcggaggcagcagcattaccgtgcggcctttcacggtggtggaaaccatgaaccgcaacgctcagggacggttccggcaggcttctctggccctgcaaacccgcttgcaggcggctcaggacaagctgatagccctgcgtcagggccagtcgggcgatggcgctgccatggatgacgacgctatctccgctgcacaggaaaaggaaatccagtcggcccagcaggaaatccaggagagcagaaagaagctgcgtctggttgagcatgatctgagcaaggatatcagcacgctggagacacgcctgcgtctgctggatatcggtgccgtgccgctggcgctgattgccattgcgctggggattgccaccatccgccgcatcaggcgtcagagggcacgcagatgaggacaaactcttccatgtccctgccctgccttctcctgaaacgaccgtttattcggaggaacgcgccatgacgccgcgctcatccctttttctggccggggctgctgtgctggctctggctggcggctggtatttcggtccgcatgccgtcagtctgacagctgttgcggtgcatcagggggaagccgcctttccggccctaatggataaaaaccgtctggacagcatccagaccatcactatctcccagtttggtcagagcatgacactggtcaagacaccggatcacggctggaccgtgcctcaattgggcggctatgtcgcccggcctgcgaaaatcaggggattgttgaatacgctggttagtctgcggctgactgagccgaggaccaaccatcctgcggaatatccgcttttgggtgtggcgacgcccgatccggcaaaaccggccaaatccgacgcgacagtcattcgtttgcaggatggaaaaggcgatctggtcggagagctgatcatcggccatcgccagagcgccggagatattgagggcgtggtccagcagacggacagcacgaatgcacctgctaccacccgtggtacctatatccgccgtcatggggatgactatgtatggctgaccaaagatgcgctggagttcagcaacgatccgcaggattgggtcgatccggtgattatcagcatcaatgccgcgaggctggatcgggtgcatatcacgcgaccggactctgcgcatgaaccggtgctgacgctcagtcggaaaggtgacatgttcaggctgacagagccggcagatgcgccgcgtaccgacagccatgcagtggccgatacgcttcaggcactgagtgatctggaattcacccatatcaaaccggctgctgcaatcagcggagtaaccgaggcccaatccgtgttcgagacgcaggatgggctgaccgtcatcgtcaatcagatcaaggttggtgatgagacatggctgacattctcggccaaggcagcgccgggcagcgaggctattgccaacaccatgaacaaggcggtcggtccatgggcttttcaggtgcaggattataaggaacgggccctgttccccacgctgcaactgctgaaatccgtggaacatgttccctccggcgctgcgggcgagtcagagataccgaccaccatgccgctgccgaatatcggcccccgtgcagtcccccctgtttctggcggaccatgacggaggactgtccccgcctttatccggcgcgaccgctggttggcgtcggtgtcgctcttttacgtccggatggagctgtgctgctgatcaggcggggcaagccgcctgctgagggctgctggaccctgcccgggggtgcacagcgtctgggcgaacgcgccgaggatgctgcccggcgggagttacaggaagaaaccggtcttgtggcgggagcattgtctctggtcgcgcatgtggacagcatcacgcgggatgaggccggccggatcgcttatcattacacgatccttgattttgcgggtctccatccgggcggaaatgtctttccggctggagacgtggttgcggcagactgggtgatgccggaagtatttgatcgtcttggtgtctgtgccgaaactcgacatgtcatcggcctggcgcgccagacgctgtccttgacctgaaactcgaccgcaaggctgccacccacctgccacggtagcaggataagagctgaacgctcacattacgcgctgtcagaaaaaggttgaacacgccccgtcatggtctgcggggcatggagtatggcccgtgagtggacagataacagcgcagccggcaacgctgcccggcggcaacacgactgaaacccgcaacgaaggcaccgtcttcgccattctgatcgcgatcagcatcagccacatgctgaacgacatgctgcaatcgctgctgcctgctgtctatccgatcctcaaaaccgaattcagtctgcaattccgcgatattggcttgttgaccctgacctatcagatgacaggctccattcttcagcccctgatcgggctttatacggatcgcaagccgaagccgttttcgctggctttcggaatgggatgcacgctgatcgggctttattgtctgtccattgccagcgggtttaacggattgctggcgggagcggcaattgtcggccttggctcgtcaatttttcatcctgaaagctctcgtgtggcacggctggcttccggtggacgccatggttttgcgcagtccctgtttcaggtgggcgggaatgcgggggcggcgatcggtcccctgctggctgcctttattgtgctgccgcacggccgttacgccatcggctggttctgtgccgcagcgctgcttggcgttatcattctgacggctgtcgggcgctggtacggagcaatacaccgtcagaaaaagcgtgtcgtcaggcacactgtgcaggctcttccccgggcaaaaatcgctttggcgatgacggtactctgtgcgctggtcttctcgaaatatttctacatggccagcttcaccagctactacaccttttacctgatccatcatttcggggtttcggtgcagtcggctcagctttatctgttcctgtttctgggcgccgtcgccgcggggacattcgcgggtggaccaattggcgacaggatcgggcggaaatatgtgatctggttctcgatcctcggcgtgttgccgttcacgctcattctacctcatgccagcctggcctggaccgctatcctgagtgttgcgatcggcctgatcctgtcctcggccttcgccgccatcgtggtctatggtcaggaattattgccggggaatgtcggtgcggtggccgggctgtttttcggtctggctttcggcatgggcgggattggagccgctctgctggggtggcttgcggacaaaacgagcatcgagactgtctatggtctctgcgcctggctgcctgctttcggcatccttgcagtgtttctgcctgatctggagcggcggaggtattaagcctccgcctgcaacagctttacggcagcatacgctgaagttcggcttccttgtcgatgagatgatgcttgaggaccccaccgaaatgcagcgccagcaggccatacagcacataccctgcccatagatgcaccgagccgaacacagcccgcagggatatccgcaggctggtctccagcgtatcaatcggaggaatcaacggcagatgcaccgtattgaaccagtaaaaaggatgcggtgcatcccctttccatgccgattcatggagccatcctgacaaaggcaatgtcagcatgacgaggtaaagcaagccatgcaccgtgtgggcagcgtatttctcccaagccgggtattgggctggaaaggccggcggcttatgacccagacgccagaaaatacgcagcagaaccagccccaacacggtgataccgattgatttatggacgccgaatacctgccttagcgaggattccggccaataatctgcactgagcgccagaccgatatttgtcaggatcagggctgccaccacccagtgaaaaaaaatggccgttcttgaatatctttgaaccgtttccatcagtcattcctcttcgtctttatcgttcccagcccgggatgcaggatggttgctgctccagcaaagagcgaaactgacggaaagaaaagctaaactatcgtcatgattgtaggagaggtttatttcacccggcctgattattgtccgcggactgcggccagcagcaccgtcatgttgtggcggaacatatccggataggtggcggcaggcccgcccggaggcgagagggattccacgaacagagttccaccctgcttcgcaccggtggctgcagcaatctgttttgccagccgggaatcaacagagttttcaaggaaatactgcgtgacatgctcaaggcggatttgctgaatcatggccgctacggttttggcggatggctcattatccgtcgtcagcccaagcggtgagaggaaagtcaggccatatgcatggccgaaatagcccagcgcatcatgagtggtcagaactttccgttgtcccggcggaaccgactgaaagtcacggcgggcttcctcatccagacgggtcagaacggcgatcagagccgctgcacgctggtgaaaatccgcagcctgaccggggtcgatctttatcagcgccgtctcgatattacgagcatacagaatgccgtttgcagcactgttccaggcgtgtggatcaaccaccgaatgaccattttcctgcatggtcagcggtatcaggcccgcactggcggtcacgatctgaccacgcgggccggaggcggcaaccagacgctccatccatccttcaaggccgaggccattgatcagaacaagatccgcctcgtgcagacggcgtgcgtcatccggtgtcggttcataagtatgaggatcaccgcccggaggcacaaggctggtaacctccacatcattgccgccgatctgctttgccatgtcggccagtatcgagaaactcgctaccacgtgcagcctgcctgcctctgcatgggatgcaccgactgtggtcagcacaaccagcaatgtagccagtatgcgggcaatcatgcgttgcgtcctcttaacagcagaccatggcggctgaaaaacaacgaaaacaggtagaaaacggcggcactcaggacgatggacggtccggatgcaacgccgagatggaaagaaacaatcagtccggtcagcccggacagacaggcaatggcgctggccagcgccatcattggcggcagagcttctgtccacagccgcgcggttgcagaaggaagcatcatcaatcccaccgccatcagcgtcccgagcgtctgaaacccggcaaccagattgataaccaccagaaacagaaaaatgaagtgaatcaccggtcctcgcccactgaccatgaacagaaaaccgggatcgaaacactccatcaccagcgggcggtaaatgatcgccagagtgatcagtgtgacggaggcaatagtgccgatcaggaacagggaggaagaatcaattgccagaatcgtgccgaacagcacatgcagcagatcaatgcccgatcccctcaaggagacgatcatgacccccgctgccagtgaggtcaggtagaaactggcaaaggcggcatcctctttcagcactgtgacccgactgaccgagccggataacagcgagacggccagccccgcaatcaacccgcccacccccatggcaggcagggaaagcccgaatgccagaaagcccagtgccgcgccgggtagcacggcatggctcatcgcatcgccgaccagactcatgcgccgcaatagcaggaggacaccaaccggtcctgctcccagactgagcgcaatgctggccagcaaggcgcgtcgcataaatccgaacgtgacgaatggctcgatgatggcctgatagacagtcatggcatggccctaaaggagctcggccgaatcaagggagggctggccattcaccagcacccgtgcatgccggatattagcgtcggacaggacatcctgcgttttcccccacgcgatgggttggcgggccagcagcaaggtttgcggaaaataccggcgtatctgttccacatcatgcagaacggcgacgacagtgcgtccttcctgatgccatacattgattaactgaagcagatccgccgttgttcccgcatcgacggcattgaatggctcatccagcaggagaaggctggcattctgcatcagcagccgcgcaaacagcaccctttgcaattgtcctgaagacagggagccgatcgtggtgtccatacgtccctgcattccgaccgaagcgagggcagatctcatttcagaatggagagtctcgcaggcaccccggaccggtccaagacgacgccacgcccccatcagcacggcatctgagacagtcatgggaaaagagcgatcgatatctgcaacctgcggcaggtacccgatggtagagcgctccgcaccgccaagatcaaccttgcctcctgacacaggtacaatcccggcaatgctccgtagcaaggtggattttccggctccgtttggtccagctatcgccgtcaggctgcctgggtgaaatagcccggtcacgccatcgactgcgatatggcgaccgaatgtcacccgcacattatgcaaggaaacagagcatctgccaccgctcccatcagaacgtgccccttgagaatgttcgtttttgagcatgctcatggaagtgagacggcccagagaattcccagccacagacacgccagaacaatgacggcccccagcatacgtacagggaccgcgcatgccagcagggaagtcacacgagattggcgaaacgacagaaaacggaacataggagggacattgtgttatgttataacatataatctcaacgccgctttttacgcaatgtgccgccggataaattcagacctgttaccccaaaaaagccgtaatatgcggggacagagtggctgcatgttcttcatgcatggccaaagctcctttgctccatagcaccatcctggacggcgtcggttcgatcgcctgcatgtcggagcgtgaacgtggcggcgtggcatctccacatacaataagcgccctgccgccaaaccggtcgagcatggtctggaatgcagcccgtgttcctgcgggatccagcccgccagtcacgaaggaggccgatgcatagcgtgcaccgggttgccgggcgacagactgcttcgccgatacccgggcatcagtgatcggctcatcatacacgtgcctgcgcatcatggcgccgatcacacgatgatgtgtgttcagatgatacaggatctgaccgataccaggtgcgcggatcaggctgcggattgccgtccggaaggctggccgcatgcccatcaccttcagtgggccttgccatgttggcgccagcagcaccagccgcttcacccatgggcgatcggcagcacaggccagagcatatcctgcagcatgtcctgccgctagaatggagcattccccgtcgacagggagcagccgatcggccagaaaagccagacaggcatgatagaaggccggagaataatgtagtctggcccggctggaggccccaaacccaggccagtcaatcaatgtgcaggcatggccatccgccgccaatctgcgcgccagtggccgcatttcatccatcgtcgagatcgtgctgaatgcgggaagcatcagaacaggacgcccctccccgatcgtttcagtagcaataccgatcacatggcgctgccaccgccacgggatgatatggcgcgtcataatggaatcggggggtgctgctgccgtatcagcgtgccaggaaggggcctgcatgaagcggcttttcctgttgcgcgcaggtgatgagccttttgtcacgcgggctggcatgacgcacaatcgaaatgaccatccgcattctcatcgtgctcgccatgtccttgcccatcgacacagtcgctgcactgccccgtcagttccacagtcggctgatccagcacgaatccctgcgctcgccccagatcggcagtggcttttgcgatggttcggtcatgtgcttccacgaccttgccgcaggatcggcaaatcagaaactgcacggcatgcggatggtcaggatgggcacaggccacataggatcgggtcgtttccagacgatgcaccagcccttctgccagcagaaaatccagcgcccggtaaatagtaaccggcttgaccatgggatcaaccggtcgcagccggtccagaaggtcataggccgataaaggcatacctgcctccagcagaaccgccagaactgcccgtctttgccgggtgaagcggctgccggcacgcagacagatggcatcggcggctgccagcgcttccgccactgctttttcgctcatcggcacgctgcattctcccgtagacaatccctttgtaacagggagcctcgatcaggacagccccgtcagaaagtgatggtcgttcttagccccattatcaactcattcccgatacgggtggatggattggtgggcagagccagacctgcgctgggattgaaaacatactgcaaatccggctgaagcagccaccaatgcgttatacttgcctgatacgtaagttcgaaaactgtttcagaccctttttgaacgacgccattttgcggctgtataaatccgtttcccttgccgtcagagacatgggaataggcaaccgaaatgccgattgtgtcgagatctctttttggaatcagtcctttgtaggttaatcccgcattgacgttgaatgagacgagattacggtccgagggagccgaaataatttcaatgaaggtgcccaacccctgatcttcagtatctttttcacgataaagcatctgatcggcgctgaaatacacggcccagtcgttacgataggtcaggatcgcatggcgatttgaaactggcgtaagaccaactgtggaagcggcattattgaaagaagccgagttataatagctgccgagatgataaaaaccgggcagtccgtcctttccaccatgatgcagatcgtattgaaactcgacgatcgcaaacaggccgtcattgatgggaaaagccgtgccggaggggtttgtgacgtaactaccgggattaccgttataagctccgatcagcagggtatattccggacggggctggaagcgaaatcggagacctggcgtcggcaggggaaaggcgttgccgccattaggcagatcgaccgagggcagtgtcggccagccgaaaccgccattgatgaacagcatggaataatagctgatcatgaattcattatcgacagattgctgaccaagacgcagagagaacagcccatcccaaagcgactgatccagccataattcattgagtctgaagccgcgatccgcttccagtccactcgcagtattcagatctgacagattatccagcgtaatgctgcgtccatggaagtgaaacgcgctgacgttgaattgaagacctggaataccggccagtttctcgagatttgtagtcaaagcgatggaagtcagaccatcatagacagcccccgtgtgcaaaccgccggtcagattgccgagaacctcgctctgctccatcatcgaaatgttgacacctttctcattgagataggtgcgcatatggaacggatcaccgatcaggtaatcacgatcccatagcggtccatcataggattcgttttccccaagcggtggcgcaactgccaatggcatctgctggttggcttcaggcgcggcaaaagtcgggggggggatcagactgaaactgtcagaaagatccccgaaaccaagaatagactgggcatgggacggcgtagaaaagccacaccagatcgtggcagataacaccgctgaccgccagtttagaaaatgtgccacatacggtctcatcatgagcagcccgaaaacgtttcgcctgctagacgttttgtaacgccttgccaatgagaataattattaaaaattactgacattttaccatcacctgacgggctaccctccatcctcatcatccgctagggtccgcctgcttcagggttgatggatacggtgatgaccttcgggatcgatttgggaaccacgcgggacgggacgactgcccggcttgatcttgaagaacttctggcaacccgtttgctggtgcagggaaattccggttccggcaaatcgcatttgctgcgccgtatgctggaacaaagcgcaaactgggtgcaacaggcgattatcgatcccgaaggagagttcgttaccctcgctgagtcctataaccatctgattattcaggcggaaggccgcagcgaagcatggctgcaaagaacggcagaacgggtgaggcaacaccgcgcttctgtcgtcctgagtctggaagggctggatgccgatatacagatgcgggctgccgcggcctttctgggaggtctgttcgatgccgaccgggatcactggtttcccatgctggtggtggtcgatgaggcccagctttttgctccagcggcggcaggcgaagtatccgacgaagcccgccgcgcctcactcggggccatgaccaatctgatggcccgggggcggaaacgcggtctggccggggtcatcgccacgcagcgactggccaagctggccaaaaacgttgcagcggaagcctccaattttctgatgggccgcacttttctggatatcgacatggcccgtgctgccgatctgctgggtctggaacgtcgtcaggcggaaatgttccgtgaccttcagcgtggacagttcatttctctggggccagccctgtcacgccgtccggtgcaaatccagattggcagtgtgcagacgggtgcccgcgctgccccgcccgctctcactccgctgccccccgttgcggcggaagatgtacgggatctggttttgtcagggccggagccggaagcaaggcccctgccgccccgtcgaccgacatcccctccaccgctggatgttgccgagcagttggcccgcttccagccagcccagaatactctgccgctccctctgacggagcaggagaagggggagcgtgatcgtaaggtacgcgacatcctgcgtgatattctggacgatccggaggcagggttcaggccgctcagcgtgctgtatcaggattttctggtgcgttgccgtattcatgcgatcaccggggatgctccagcgctaccccagttccgcgccatgctggcaactgcccgtgccgggatagatgcggaaaccgaggcgggtggcccatggcaatcagccgtggaacgcagcctcatgctgccagacgacatgcgcggtgttttcctgatgctggcgcgagccgctctggaaacactgccctgcccctccgatgaggaaattgcccgtgcctacggaacacgctcgctcggacgggccagacggttgctgggctatatggaggaaaagaaccttctggtcatgcgtcatgatcggtccggcctgcgtattctcacaatggtcgaactcggctgggaaaccgcccctgccgccgcatgaaaggggctacatgaaaagtttctcacggctccgccccgtataaagcgaggcgacctgttccgcgtaaccattatatagcagtgtcggtacacgctcatcgctaccgatcaatcgttctgaagcctggctccagcgaggatgcgacacatcgggattaacgttggcccagaacccatattcgcgcgggccggtctgctcccagaaagttttgggacgttgatcggtaaagctgatgcttgccagtgatttggcagatttgaagccgtatttccacggtactaccaggcgcaatggagcaccattctgtggcgatagaggctttccgtacagccctgttgcaatgaaagcgagcggatgggtggcctcatccattgccagtccttcagtatagggccacgggtaccatatctgggccagaccgggcatctggtccggctccattctggttttgaacacgacatagcgtgctccggaaagcggttctgccagtgcgatgagatcggcaagcggaaaccccatccatggcacggtcatgctccatgcctcgacacagcgatggcggtagatacgttcctccaccttcattttgcccaacagatcttcaaaggcgatggtgcgaggttttcctaccatgccatcaatggtcaaagaccatggatgcagttgcatggcctgggccgcactcacaatgtctttggtagaaccgaattcataaaaattgttatagctgaggacatccttctcggccgaaagtggacggcccgctgatggaatatcggttttcgaggcgggagaagatccggcagcataagaaggaccaccatacagggtggtcgacagcgcaggtaccgccaaacccgcccgtaagagagaacggcggctaagacgatttttctctggcgatacagatgcttcggatatagcccaatctggtcgaacggtgatgaacatgggatcccttatcctgtcctgaacatgctgtgttgctgatatggtgccgttaagcttctgaacaatctttgcagtcatattgactgggtggaattcaatggactcatacgatatggctatccgtcggtgggccggtcgcattgttgtgatcgttatggcattgatgacctgcatcaacctgtatcgggcctggcaggctcactaaacaggtcgatcaattcgctcttattgcaagaaacaatgcatttattgcatactccctgacgcagtagcctttcaggcctgatttgcctgacggcttccttgtcccggagttatagtgtgatggcaggtggtcataggtcactcgcaaccgacctcgccctgatcgtcaggctggaagcttctaccggagaagaccgagtcacgatcgggagattgcaactgttgcgtctgctggccctggcaggtctggacagaacagaggcgttctcggctctcacctccgcccgcacccgcaccgtgcatatctcgaaagaacggctacatcccgtactgctaatggcacgccgaagaatcgaggcatgccaaaatgaacaagccagcacagatcagacagaataaaatagatatatggtgagcccggtgggactcgaacccacgacctacagattaaaagtccgttgctctaccagctgagctacgggctcccataaaagcaatgcgtggcgcttggatgccccgccattgcgtgcccggctaattggccgagacgcggctccgggtcaagaccctgaagccgatttatcttgcaaaacaaggggcatccgcaccagtccgggcgaataccccttttttgcagcactatgactctgaagaaaaaagttactgcggatcgctggccagacgcatctttacgatacggtcgggattctggaccatgccactgccaccggagccgcgcttgatcttgtcgacgaattccatgccctgaatgaccttgccccagatggtatactgaccatccaggctgggggccggagcgaacatgataaagaactggctgttcgcgctgttagggttctgggtccgggccgcaccgaccgtgccacgcaggaaatgcgcgtcatcagtaaattcggcaggcagatcaggcagcttgctgccacccgaaccggttccggtcgggtcgccgccctgcgccatgaagccttcgattacacgatggaaaggggtgttgtcgtagaaatgctcgcgacacagttccttgacgcgttcgacatgcttcggagccaggtctgggcgtagctcgatgacgacgcgaccatagggcaggtcgaggtaaaccagattattagggtcagccgcttgggcttcggtctcgctcatcgcgatccctccgatcattgctgttgtggctgcggcgagcagagtgcgtcggcgcatggtagtatcctctctgtcaggtaaaggggccttgttcagacgggcctttccgggtcagggaccgatgacgtcctgacacgcgcaagcgtacgctgcaatgtcaggggaggcacaaaggtggaaatatcaccccccagccgcgcgatttccttcacgaagcgggaggagatgaattgatgacgttcactcgccatcagaaacactgtctcgatatccggtgccaggcgataattagtgcccgccatttgtacctcataatcgaaatccgacaccgcacgcagaccgcggacaatgatactggcaccatgctggcgggcgaagtcaatcaggagcgaggaaaacggcaccacctcaatgatggttccggtttttccccccagcgtaaccgtttcggcacgaaccagatccaccctttcctccagcggaaaaaccggatttttgccgatattggcagccaccccgatcaccagacggtcaaacatccgggcagcacgggtaatgacgtccagatggccgttcgtcaccggatcgaacgtaccgggatagacgccggtgcgcagcatcttgccctgtgtcgactcagtcatctgaatccgtcacctgtccatcaggtgctgccggagcaactgaatcggcatcatccccattatcatcgacagactctgtctccagcaccgggaaaacactggtgacgacctcatccttatcgacccgaaacagggtaacgcccatggtagagcgtccggtaatccgcacctgatcggcgggaacacgaatcaaacgacccgcgtcagtgaccagcattacatcatcacccggcctgaccgggaaagttgccgcgacggcccgaccattgcggggagcgagattgatattggcaatcccctgcccaccacggccagacacacgataatcataggcggaagatcgcttgccgaaaccagcaatggtgacggtgagcaggaattcttcggcttcttccagcccggcgatccgctccggcgaaagggctgtatcatcgaccgtgacctcggaatcatccgcctccatgacctcggcatcgatctgatcctcttctccagcagcactgcgacggcgggcggaggcatagcgcagataggctgctcgctcttccggcgttgcctccacatgccgcagcacggacaggctgatgacctcgtctccctgcgccagtttcatgccgcggacaccggagctttcgcgcccggcaaaaacgcgcagcgtgtcctcattcgcctggaaacggatgcagcggccgaggcgggaggccagcataatgtcatccccctcccgacaggtagcgacgccgatcaggcggtcaccttcatccagcttcatcgcaatcaggccggaagcccgcacatttttgaagtcggagaggcgattgcgccggataccgccggaagcagtggcgaacaccagatgcagcccttcccacagcgactcatcctgcggcagcggaagcacggcggtaatcccgtcactgcccagttccggcagcagattgaccagcgccctgcccttggctgtcgggccggcttcgggcaggcgccagactttctggcgatacgccttgccgccggaggagaagaacagcacccattgatgagtgtgtgcgttaaagctgcgggtcacgatatcatcgccacgcatgctggcagccgcacggccccgtccaccgcgatgctgctgacggaacacatccagcggcgtacgcttgatgaaaccgtctcgggtgatggtcaccaccatctgacccggttcgatcagactttcatcatcctgatcggcaaggctgtcgttgatttcgctgcggcgtggagagttcagctcggcccggatcaccgccagttcttcccgcatgacttccatgcggcggatatggctgccgatgatttccagaagctcgccaatacgggcggcgacttcctgcatctcattgtggatcttgtcgcgctcaagcccggtcaggcgttgcagacgcagttccagaatgccgcgggcctgcacttccgtcagtcgcactgtctgcgcttcggtcagcacattgccgccatcatcgatcagcgtgagcagcggtgccacatcggcggccggccaatcgcgttccatcaaggcgatacgggcgctggtgctgtccggactctgacgaatcaggcggatcacctcgtcgatattggccacagcaatcgccagaccgaccagcagatgcgcgcgatcacgtgccttgttcagctcaaacctcgcccggcgaaggatgacatcctcgcggaaacgaatgaatgtagacagcacatcccgcagccccatcaggcgcggttgcccgccatccagggccaacatattgatgccatagctgatctgcagctgggtaaagcggaacagatggttcagcaccacatccggcgtggcatcgcgcttcaattcgatcaccacacgcacgccggagcgatcgctttcgtcacggatatcgctgatgccctcaatctgcttggcacgcaccagctcggccatgcgctcctgcagggtggccttgttcacctgatagggaatttcggagatcacgatggcctgacggccgccgcgcacttcctcgaaatcagtgcgggcgcggacggtgatactgcctttcccggtctcaaaagccgagcggatgccggaacgcccgagaatcaggccgcctgtcggaaaatccggaccgggaatcacggtcatcaattcatcaagagtgatgtccggattgtcgatcattgccagagtggcgtcgatgacttcagtcgggttgtgagtagggatcttggtcgccatgccgaccgcgatgccatccgccccgttgaccagaagattgggataggaagcgggcagaacgcggggttccatctcgctatcatcatagttcggctggaaatcgactgtatcgcggtcaatatc

SEQ ID NO: 1 - DNA, 2708355 bp, Artificial Sequence (residues 1,354,179-2,708,355 of 2,708,355)
  Description of Artificial Sequences; note = synthetic construct
gttcagcaggaagctggcggagcgggccagacgcgcctcggtataacgcggcgcagcagccggatcgccgtccatggaaccgaaattgccctgaccatcaatcaggggcacccgcagggagaaaggctgagccaatcgcaccagcgcatcataaatcgcggcatcaccgtgcggatggtatttacccatcacgtcaccattgatgcgggcggatttgcgatagggtttatccgccgtatagccgctttcctgcatcccgtagaggatgcgccgatggaccggcttcagaccatcccgcgcatcgggcagcgcacggctgacaatgacggacattgcgtaatcgaggtaggagcggctcatctcctcctcaagcgtgaccggcatcagcagggagccgccgttcggatcgtcatccggcggtgcagacgggggattggtatgatcgctcaatgcactctcacgagatcagtagtaaacggcgacacgggtcaggaacgatgacccgtccttccgatccataccatgcctccgtcatccaacatagacggttgcatcggcagacctgaatgatgaaggggcgcagcaagggcccctgcgtggtgatataatctgatcagaacggaatttcgtcgtccagatcgccaccatgagaaggttcccatccactgccaccggatgcagggcggctgctgccaccaccaaatccgctgccaccgccggatggcgcacgctgggcgggagcggaccgatagccaccgccttcaccagccccttccccgcccgaacggctgtccagcatggtgatttcaccacggaagcggctgatcacgacctcagtggtgtatttttcctgtccggcctggtcggtccattttctggtctgaagcgccccttcgacatagaccttggtgcccttgcgcagatagcgttcggcgatatccgccaaccggtcattaaagaccaccacacgatgccattcggtgcgttctttccgctcaccggaagcacgatcattccacgtttcgctggtcgcgagcgtaaaattcaccaccttgccgccatcctgggtattgcgaacttcggggtcgcgcccgagattaccgatcagaatgaccttattgacactgccagccatatatttgtccgcttttttgctcaggccggacaggcaaaagggcgtccggcaagtggataacctctatagcatgagtgatttactgttgctatccatgcggaacttttccagaacattttccttgtcgttgctgtttctgccccctcctctcgtgtcggattgatcgtatggccggttccattcgtgtgcgcggtgcccgcgagcacaacctgaaaaacgtcgatattgatattccacgggatagcctgacggttatcaccggactgtccggctccggcaaatcatcactggccttcgatacgatctatgccgaagggcagcggcgttacgtcgaaagcctgtccgcctatgcaagacagtttctggaactggcgggcaagccggatgtggacagtatcgagggcctttcccccgctatctcgatcgagcagaagaccaccagccgcaatccccgctctacggtcggtacggtaacggaaatccacgattatatgcgtcttctctgggcgcgcgcaggcgttccctactctcccgcgaccgggctgccgatcgaggcccagaccatcagccagatggtggaccgggtgctggacatgccatcgggcacgaggttgttgctgctggcgccggtggtgcgcgaccgcaagggagaataccgcaaggaactcgccgagttgcagcggcgtggctttacccgcgtcaaggtggacggggaattatacgatattggcgatgtccctgccctgaaccgaaagctcaagcatacgctggaagcagtggtggatcgcgtagtggtcaaggcgggactgcagcagcggctggccgacagtttcgaaaccgcgttggggctgtctgacggaatcgtctacgccgaagatgcgaccagcggagaacgcacggtcttttcctcccgctttgcctgcccggtcagtggctttaccattgaggagatcgagccacgcctgttcagcttcaactccccacacggtgcctgcccggcctgtgacgggctgggggtcgagaatttcttcgatcccgatctggtcgtgccgaatgaacgactcagcctcaaggagggtgccattgcggcatggtccggtgcggccagcccttactacgatcaaacgctgatggctctggctgcgcattatcgcgtcgatccacgtaccgcgtgggaggaactgccagatatatgtcgcaacggcattctattcggcaccgaagaggatgtttccatcacctataaggacggggtgcgcagctatacggtcaaacggccattcgaaggcgtcatccgcaatctggaacgccgtctgcgcgagaccgacagcgtatgggtgcgggaggaactgtcgcgttatcaggccgaaaaaccttgccatgtctgtgatggtgcccggctcaagccggaagctctggccgtcaagatcaatagcaaggacattgcagcggcctcggatttgtcgatccgcgatgcgctgccctggttccaatccgtgctggccagtctgaccccgcaacgagccgagatcgcccgccgcattctgcgtgaaatcgaggatcggcttcagtttctgctggatgtcggcctagattatctgacccttgcacgatcctccgccaccctgtccgggggggagagccaacgcatccggctggcaagccagatcggctctggcctgacaggggtgctctatgtgctcgacgaaccgtccatcgggttgcaccagcgtgataatgaccggctgctcggcacgctccggcgactgaaatcactcggcaacactgtgctggtggtcgagcatgacgaagatgcgatacgcgctgccgaccatctgattgatatggggccgggcgcgggcgtcaatggggggcatgtgatcgcctgcggcaccccgcaggaggtcgcgaaacatcccgatagtctgacaggcgcctatctgtcaggccgtgccgcgatcgccgttccccagcagcgccgtccaattcagaagaaacgaacactgaccctggtgggagcaaagggcaataacctcaaaaatgtcacggcgcattttccattgggaacttttacctgcgtcaccggcgtatccggtggcgggaaatcgacgttggtggttgatacgctctacaagctgaccgcaaggcggttgatgggggcggctcaggtgcctgcaccgtatgagcggattgaaggactggaactgctcgacaagatcatcgacattgaccagtccccgatcggacgcacgccgcgttccaacccggccacctatactgatctgtttgccccgatccgggaatggttcgccgaactgccggaaagccgggcacgaggctacaaggcgggccgattcagcttcaatgtcaaaggcggtcgctgtgaagcctgtcagggcgacggggtgctgaaaatcgagatgcacttcctgccggatatgttcgtcacctgcgatacctgtaaaggcaaacggtacaaccgcgaaacgctggaagtgaaattccgcgataaatccattgccgacgtgctggatatgtcggtcgatgaggccgtgccctatttcagtgccgcaaaccgtatccatgaccggttgaaaatcctgcaacaggtcgggttgggatatgtaaagctgggtcagcaggccaccacgctttctggcggcgaggcacagcgtgtgaaattgtccaaggaactcgcccgccgtgcgaccgggcggacgctgtatatcctcgacgaacccaccaccggcctgcatttcgaggatgtccgcaagctgctggatgtgctgcacacgctggttgatcagggcaataccgtcatcgtgatcgaacacaatctggaagtcatcaagacagcggactggattctggatctcggtccggaaggcggggatggcggcggacgaattgtggcggaaggcacgcctgaacagattgcggcttctcccgaaagccataccgggcgttttctggctccgcttcttgctaaaccaaccgcgtccccacgccggatcaaccgcaagcgggccgctgaataatactttaaatttttgtattaagtaaaatttatcaaagaacgttttttatttgttgattaatgagtcggatcgtggtttattcacgatgccgctcgggaagatcgtcagccgggctgccggagatgatgatgcatgttttgctggcccttcccgggtattcgttccttcctcaaactgcctgcggtcccggccgcaggccattttcttcctgtgcgtttcgaatgtgctgttgtgaccgctgagcagccggttcctgcaaaagccaatctttgagacattatggaagaaaaacgggtttcccccccgtgaggagaaaacgatgctgcaatctcatgtgattgaggtcgatggtgcttttctgggcgcggcggtccgcaatgaaagcggtttccgtttcgttgccatcgatctgcgcgttgagcaactggatggcagcgtatggccgactttggccgatgcgaagcgtctggcaagccagctttaccgtcatggacgcctgctgaacgctcctgccgtcagacaataaccaaggcttttaccattgacgtcggtattaaccggctacggaaaattccgtagccggttttgctatgcccggtcctggctttcagccggggatgcgatcatcgctgttgacgccaagctgtttcagcttgcgatggagtgcgctgcgctccatgccgacaaatccggccgtgcggctgatattgccgccgaaccgcagaagctgggcctgtagatactgggtttcgaacagatcacgggcctctctcagcggcagggccatgacatccgcgccgctatcaacatgcagcaacgcaggtgcatttgagctgatctcaggtggcagcatatccgcccttatcggatcgctggctgacccgggtgccatgatgaccagccagtccatgacattgcgcagctggcggacattgcccggccagtcataagcctgcaacgcagtgagtgtgtcggtggacagatcgcgcagcggcatgccggacgaggatgcggaacgcgccagaaaatgccgggccagagcaggaatatcctcccgccgctcctttagcgggggaacccgcaaaggtacgaccgcaagccgataatagaaatcctcccggaaccgccccagtgcaatctcggcctgcaaatcgcgattagtggtggcgatcacgcgcacatccaccttcacccgggcggagccgcccagacgctcgaatgtctgatcctgaagtgcgcggacaatcttgccctgcgtttccaggggcatgtcgctgacttcatccagcagcagcgtcccgccatgagcacgttccagcacaccggcgcgtctcggtgtctctgcgttcgcttcaaccccaaacagttcctcctcaaaacgagcgggattcagggtggcgcaattcagtgcgacaaatggcccctccgaacgtcgggaacggctgtgcaacaggcgggcaacgatttccttaccgctgccagcgggaccggtgatcaatacgcgagagccggtcggagcgactttttcaacgctgttgcgaatgccattgatgacgttgctgtcaccgatcagatcgctttcaggcccggcacggagccgtagctccgcattttcccgtgccagacgggccgcattcagtgcatggcgcacgaccagcagcaaacggtctgaattgaagggcttttctataaaatcgtacgctccggcatggatcgcattgacagcggtttcgatattaccgtgccccgagatcatgacgactggtacatgcggttcttccgcatgcagcacctgaagaatgcccagcccgtccaaacgtgatccttgcagccagacatccagcagcaccatggatggacgacgggcacggaaagccgcgatagcggagtcggaatcggctgcctgacgggtttcatatccttcatcacgcagaatgccgtcgatcagcagacggatatccggttcgtcatcaacgatcaggatttcgtgcaccatgctaacctttcattctctccgtcttcagagccttgcggactccagctttatacagccgtgattccatcaggatttgaagcattgttctgcaatggaaggaacagtgacgccactgttccatgtccatcctcattgtctgccagcacaacccggccaccatggtcttccatgatttttttgacgatagcgagaccaagtccggtccctttgggtttatgcgtgacgtatggctctgtcagacgtgccctgtcgacatcaggcagtccgacaccgttatcaatgacggagagccgtatttcttcgccctcgattgccacacgaagcacaatacagccatcctgctggtggggcgtttccagagcattggccccaacgctgccgccattgccgaaacgggcgacaaccgcatcagcagcgttctgaagcagattcgtcagtgcctgccccagcagccggcggtcacacagggctgaaggcccccgttccgggatatcagtcgtccatccgagttcaggacgggcgctgcgttgcaaaatcaacgcatcacgggcaacgcggccgacatcctccagcttgatcaccggctgcggcatacgggcaaaagcggaaaattcgtccaccatgcggcctatgtcacctacatgacggacaatcgtatcaacacattgtgtgaacgtctcgggatcagagctgatctctctggcaaagcgacgtttcaaccgttccgccgccagctgaatgggcgtcaggggatttttgatctcatgcgcaatccggcgtgctacatctgcccatgcggctttccgttgggcggattgaagctcggtgatgtcatcgaaggtaacaacaaagccaggtgcatccacgggagacgcttctccgctcctattatctgaaatgtgccgctctgcaccgatccgcgccaacagagttctgcgtccgctggaacgggtcagatgaatttccgccacctgagcacggtccggctgctgacgggctgcctcgatcaaaggagaaaattcctgtgcaatctcggcaagctctgagccgactgcggacataagatcctgaccaagcaattctccggccgcccggttgggcagttctatcagacctgacgcattcaatcccaccacgccggcggaaacacctgacaacacggcctcggtaaatcggcgtctctcgtcgatctgggcgtaggcgttgaacagctccgcccgctgggaggaaagctggccggtcatccggttaaaggcccggctcaatccggcaatttcatcgcccgtagcggcttcggggacacgtactgacagatcaccggccctgacccgctctgccgcaagaatcaggcgtccaatcgggcgggcaatctggttggcgagaaccagaccgatcagcacagccgcagacaggaccagcagcgcaaccagtgcaaaaatcagcacgaaggtaatctgtaggccggatcgattctgatccagcctttcatattcggccactgcttcttccacatgatgcatgtgatcgagaatggcgggatccaccggacgaccgatcacaagcatcagaggcggtgttgaattgagctgcacgaccgcccgcacggctgttccgttttccgcgctcaacacggccacatccccggtacgggccatgtcaatggcccagctggggggaatctccgtcgccagaccggcgaccagaccggcagaggcaatgacctgctttgtcaccggttcgaacacgacggcttcagtcaggccgcggagcacagtctgctgatccaacgtacggaaaaacgcattgggatcggtcaccgagattttgccggcctgagaaagatcattggccatgccggaggcatcaccacggatattattgcggtgttcgtcaagataaccccttgccgtctccagactttcttccagcgcggtgcggacacgatcgttgaaccaggactgaatgccgaaattgaaaaacgaagtggcaaatccggccaccagaatactgggcaccacggcgacaacgctgaagagcagtaccaatcttacatgcaaccgcgatccggccgatccacgccgccgttccgtccagacacgggtcagacgcccggccagcaccgcaccaagcagcagcagcacgatcacattggccagcaccagaccgaagacgagattggggcgcccgctcaatggaatgccgcctgccagaactgcaaacgtaccaatgccaagggccagtgcgctgatagccagcacaagcgtcaccaaacggcccagcatcacattggagaggcggcgcagcatgttgccaaggcggcgtgtcgagcgggcgggcggatttgttgcgcgaccggaacttgaagatgtatggatcatggccgcgctccgtgatggagagccttgctggtgatatgccgggccggtttcaggcgatccccctgaccacgggaatatccagatcgcggattttcttccgcagtgtattgcgattcaaccccagcatcgccgcagccttgatctggtttccacgtgttgccgccagcgtcatctgaatcagtggacgctccacctctgccagaacacgatcataaatatctgacggggcaagcccatcatgatgggctgcgaggaaagtcctgatatgacgctcgacagcctgtgacaacggctcgtgggaggcattgccgccggagcggtcctctcctgccgaaccggcttcaacgccgtgccaaccactgtcattctgtgtgatatcgtgcaattccgcatcaaccacgctggccgagatcacttcctgcggacacagagccgccagacggcgcatcaggttttccagttcacgcacattgcctggccagcgatgggcgcgcagggcctcgatcgcaccctgatcgaggctttttgcgggaaggccggattcgcgtgcacgatccagaaaatgacgggccagcagggcaatatcctcgactctctcccgcagcgcaggcaaacggatgggcacgacgttcagacgataaaacagatcctcgcggaacaggccctgacggatcgcctgccgtaaatctctgtgcgtggctgcgacaatccgtacattggcccggataggttgccgaccaccgacagctgtgaactcgccttcctgcaacacgcgcagcaaacgtgtctgcgcttccggtggcatgtcaccgatttcatcaagaaacaacgtgccgccattcgcctgctcgaaccgaccctgaccacgcccgaccgcaccggtaaaggcgccacgttcatgaccaaataattcactttcgatcagctcacgcggaatggccgccatgttgatggccacgaaaggaccattacggcgcttgccataatcatgcagcgcacgtgccaccagctccttgccagtgccgctttcaccattgatcatcacggtgagatcagccgtcgtcaggcgtgcaatggtgcggtatatttcctgcattgccggagagcgtccgatcagcggcagtcgctcatcctgatcggccggctctctgacgggtacttccggttgtggaggcgttgcttccagcgcacgtcctaccactgacagcaattctttcagatcaaacggtttcggcagatattcaaacgccccttgctgggtggccttcaccgctgtgctgagtgtggattgtgcgctcatcaccacgacacgaagatcaggacggatccgtttaatccgcgggatcagatcaagcccgttctcatccggcattaccacatcggtgatgaccagatcaccctccccatcttccacccagcgccacagcgtagatgcggtggaagtgctgcgcacctgatagccggagcgccccagcgcctgagtcagcaccgtgcggatcgagcgatcatcatctgcaatcaggattgtgggagtagacatcaggatgctttccacgcacgggtcaaagcgaaagacagttcagcaacagcagagccgtaaagccagtcagtcgccatggtatgattcctcgaccagcatcggcatatgcaggctgaattcggtacgacctggcctgctatcgacttcgatcaaaccgccgtgatcgccgatcacctttgcaacaagggccagtccgaggccactccctgtcaccttggatgtcacaaaaggatcgaacagatgatgggtcatatcttccgtgatccccggtccattatcgcggacagaaataatcagtggcagatgggtttttctggtcgatcccggcacggccatacggactccatggcgataggaggtggagagaacgatttctccgctggacatgccgctatcgttgatggcctcggacgcgttcttcaccagattgagcaaaacctgaatcagctgatcccgattgccgaaaaccggtggcagcgatggatcatagtgctccacgaaacgaatgccggaggcgaagccggtctgtgccagacggcgcacatgctccagtacgcgatggatgttcacggctccgcgctggatgggtttttcgccaaatgcctccatccggtcgaccagagcgcggatacgatccgcttcttccctgatcagtacagtcagttccttgtcggcttccgtcacggatgattccagaagctgtgcggccccacgaataccggataacgggtttttgacctcatgcgccagaatggcggccatgccggtcacactgcgggccgcattgcggaaggcaagctggcggtccagatgacgggctgccgaggaatcctgcatggtcagcatgatgcagccgggatattcagccaacggtgttccctgcaccgcaatgccttcccgctgaaagcgcggaccttccagagacatatcgtgatcggcaaacgtggcccccacacgccgcacctgatcaatcaggacaaaaaccgggctgtcttgtgccaccacatctgcaagggtcaggttcagcaattgatgcacggacaggcccagaaactgctccgctgcatgattggcgtagataatccgatttgtatttgtcagaatcagcaacggcatcggcagaatgcccggcagcgaggccggatcaatcatcggaacagggtcctgacccgtttcagaggcaacccttgccgtcaggcgattatcaacggctttatcatttctctgctcaatgcctgccatcattactcagccgcttcacgatgagcaggtgatacggcttctgcctcgatcagtggatcgaaaaacgtgtcgatcagggccagaacctgtgatggatcagccaggcgattgaccgtagcacgaaaagccgccgatccatgcaggccggtcgtgtaccatgacacatgcttgcgtgccagccgcataccggcatctgtaccgaagcaacgcaacatcgcatcataatgattcagcagaatctgcttgcgctcgctcaacgggggttcaggtatatgaactccatcccgcagataggccgccacctgacggggaaaccagggtcggccatagcagccacgcccgaccatcactccgtcggcgcccgatatggcccgtgcctcggctgcctgctcaaccgtctggatatctccgttaacgatcaccggaagagaggtcgcctgcttcacccgcgccacaaaggcccagtcagccttaccctcataaaactgctggcgggtgcgcccatgcacggtgatcatccggatccccgatgcctcggcaattttcgccagtgcaggcgcattcaggctctggtgatcccagcccatccgcattttcagcgtgaccggaacagagacagccttcacggtcgcttcaaggattttcgcagccgtgacctcatcacgcatcaacgcggaaccagcggattgtccgaccgccactttcttgaccgggcagccgaaattgatatcgatcagctccgcccctttatcgatggcgatccttgcggcttctgccatcgcctccggatcgcatccggccagctgcaaggcgttcgggctgcccggcgaaggcggaccagcaggctccgccatacgcaacgtggttttgttctcccgcaccatggcccaggaggcgatcatttcggacaccaccatcccggttcccatctcccgcgccagcatgcggaaaggcagatcggttacgcctgacatcggtgccagaatgacgggggtttcgatcgtcacgcccccaccgagcgcaatagcagggagtgccccgccatgcccgctcatatggctttcgctgccgttcccggtctccggaagcgaggagttaacgtctatattgcccatgatttgggcaaaataaccttcatgccaccgtattgcaatccgtcttgccgcaatagaaagcctgacacgcttccctttttacaatctgggcaggaatagatcaggagaccacccgcatccgaccgggattgaacagagcatgaggatcgaacgcttcccgcacccctgcaccgagacgtgccagagcagccgattccggcgggataacgtcaaccgcctgccgcatggcatccggagcgcgcatcaaggtccagctccctttaaccgaggccacagctcgcgtcagggcatgatgtgtttccgtattggccggagccgatacccagaccagacctccaccccaatccatctgcaccgctcccccgctctgctgtgccgtgctgacgatagccggcccgacggaaggggccacgctgacccgccagatggcatccgtgggagcatgggtcagaaagcggacatcccgcacatcgcgccacaaagtcacactctccttatggccgagcagatggccacccagcatcgcctgtaacttttccagccgataatgggcgctgggggcgaaagcctcgatccgcaacagggctgccgggccgcaggcagcatccagatgcgctacccaggccgccccggtgacaccgaaaggtgagcctagcccggccgacaacagacgcaccgcctgttcgggtgaaggacagggcagaaccagtgtccccaccgtttcgtcagccggtagaaccttcagggtaatctcggtcagtatcgccaacgtgccgaaactgccggtcaacagtttgctgaaatcaagcccggtgacatttttcagcacgcgcccaccggagtggatcagctccccgcgcccgttcacggcccgcacccccagaacatgatcccggaaggagccatattgaatgcgtctcggccctgccagattggtggcaaccagaccacccaaagtctgagggagggtctgcgcctccccgctacacagcatatgtcgcagatcaggcggttcggcgatcagaatctgacgatgttctgccagcgccgcttccaatacatcaatcggtgtaccgggccgtgcggaaatgatcatctcattcggggaatacagcgtgatccctgccagatgacgggtggacaggacacgatcagcccggaccggacgcagcatggcggctttggtcgcattgccttcgatacagagcgtttcccgtctggcaacagcagcctgaacggtatcgacaacgccttgctcactgtcaggagcatcctgcgtatgaaaaccgctcatgctgcttccacagccttggcacccggcttcatggcaggcagcaaaggaaacaccttggccggattcagcaaccaatccggatcgaacactgatttgaccatacgctgctgggtcagttcgatctcgttgaactgcaccggcatcagatcacgcttttcgaccccgaccccgtgttctccggtcaggcagccaccgacctcgacacagagacagagaatatccgcccccagcgcctccgcttttctgacgctttccggatcgttcgcatcatacaggatcagaggatgcagattgccgtctccggcatggaaaatattggcgacccccagaccataggattcgctcatctcacggatacgttgcagggtgtagggaagctgactggtcggaattgttccatccatgcacaaataatccgggctgatgcgtccgatggctccgaacgcgcctttccgccccttccagatcgccacgctttcttccatcgaggccgaaacgcgcaggctgaccggatcaaagcgctgacagatctgttcgatcatgcccagcaggtgatcctgttcctgcagcgcgccctcgacctcgatgatcagcaaggcctctgcattcaaagggtagccggctttcgcgaaagcttccgcggcatggatcgctggccggtccatgaattcaagggccaccggaataatgcccgagctgatgatggcatcgacgcattgccctgcaacctcattggaggcaaacgccgccaacatggcccgcgcgccttccgggctatggagaatccgcaccgtgacttcggtaacgatcaccagttggccctcactgccggtcagaagccccagccagtcatagccagccgcatccgggtaattaccgccaatctctataatgtccccattgatggtcacagcgcggagcccgagcaggttattggctgtcaccccgtatttcaggcaatgtgctccgcctgagttcatattcacattgccgccgatcatgcaggccaactggctcgacggatcgggagcgtagaaaaaacctgccccctgcacggcctgcgtgatggcgatattggtgacacccgcctgtaccaccgcataccgatcctcatagttgatctcgacaatacggttcatccgcatcatcccgatcacaaccgagtcactgaggggcaacgcacctcccgccagacttgtcccggcgccacgagggatcacccgaacgccatgctggtggcagaaagccaggacagatgctacttcctcagtcgttccgggcaggaccacaaccatcggagcctgacggtatgcggtcagggcatcggtctcatacggcttcagacgcaacggatcagcgatcaccgcatcatcaggcagcaagtgtctcagaccggccacgatgatatcgcgcttcgccagaacatccgctttcggttcgggtaattcgatcatcgtacccccttatcctgccgccgcttgcttcaacgggagacagttactggaaccgtccgccccgctccagaacctcgatcagatacccgtcagggtctttgataaaaaagaacttcccgaccagacgatcatgaagacgaagctccttgacctgcaaaggctcaagacctgccttgctcatccgctcgtactcggcctgcacatcaggaacggaaacagccagatgtccatagccattgccgagatcataggcttcttcacgcccatgattaacggtgagctcaagttcaaagccgctttccggattgctcagatagatcagggtaaagctgtcgaaacccagcctgtcgacgacttccagtccgaaagcggtgcgatagaatgccagcgagcgctcttcattcagaacccggatcatggaatggatcattttggccatgagtgcctccgcgcttgatagatcatagtggaaaagccggagataaggtgatttctcaccctatgctccggctttccagatagtcgatattcacgtcgacgccatcagaagcgccgcccgtaatcagccctgacgggccttcatacgggggttcttcttgttgatgacgtaaacccgaccgtggcggcgcacgacgcggcaattcttgtcgcgcaccttggccgacttcaggctgttacgaatcttcatgatccaagctttcgggtcatctaacaatatggaggccgctgggtaaggccccgacatggttctgtcaagaacaaagcaggattcgccgagatattttggcggttgacgcaatcacgccctgccctgatacgcctttatatcatggcacatcgtatcgacagcacccaatccgcctttttgatcgcctgcttcgccgtcaccggcctgaccggactgatggccacttatgcccttcctgtcccttttgaggcggcggtggagaaggaaacagtgctggagcatgccgcagccgggctgacctctgacaatcaggcgctgacagagcagatcctgcacgattccactcttcgctccatactgggtaaaaaggcggatagcatcatgagcgcgcctccccagcacgccgcaaaggccctgctgcaggaacgggatgcgatacgcagccacgcgctgggtgaaacgcaggcagtcgcacggcggatgcggctgctggttattgtcgccacagccgccgccgccttattcgggattatcctcagtggcctgaggagccgacaggactgacgattcttgcggcatccggtgctttttcggaatcgctgcgggtaagggcttcccgccgcattccaagcgcatggcacagcccgatggtaccacctttgacaatgggcagcagcgccagcgtcataatgaccatcaccggcagccagattgcaaactgtacccacatagcgggctcataacggtagtcagaccagatgaatgccggaatgacgatatggccgacgataaacagggttatataggggggcaggtcatcggcgggataggctccattctcggtgccgcaaacgctgcaacgcggctcaatggccagatagcctttgcgtaaatgtgtttcgccgcagccgggacatttattgcgcatcccccgccacaccgcctgcagcatatacgagctgctcatgaagccctctcctcgattctgttctcacagcactagggcggcctgagcgatcattcaagcataacacaagggttggaacagaattgcctgtatgatgccagcctcaagggacatgaaaagatcatttttcaccctcaggaccagttgcacaattgacgccccctctcccacgctctagaagcaccccagcaaacgccgtgtgccggagaaaatccagcagacgcccggcggaggggtggccgagaggctgaaggcggcggtttgctaaaccgttataggatgtcaagtcctatcgtgggttcgaatcccatcccctccgccattcttccttccatacccatttgatccagttcagggtccatgtcgcatgcgcaggctctccaagcgcattccggctattctcatgtgccatcctgatgcagaagctccggcaacatctgcgccacgagcgcactgtaaagctgggtttgctgattggcctgaatgtactggggatctattttttccacataggatttggtccgcactgatgcataccaatgaacaacgatggtttgcggcatcagtgccttcctgaaggcatccggcgcatggcggcagagccgaaaccagtgttcggagatttccggggcaagaggataaaaatattccggatcatggacgacaagatccggaataagcccttggccgatcagctcctgcaataaatcaggccccaacgcattgggctttacctgtttgtcagcagacattgcgaccatatgccgcaaataaatctcaaacaaaggcgctttcggcgcgccacccatgatggcaccgttgatgcctcggaaataggccttctcaacataacggtaaaatcgccaaccttcaggtagcactctcatggctttgcgcattacgtccaaagccagcgcccacccccatacaaatggggatcgggacgatttgacccaataaggccagacgatcctttcaacgccaatgaactgctgtaattgaaacagtgatgaaaatggcgcgattgttacggtatcgacatctaaatagatgccaccatcacgatataaaatcgccgcccgtaatatgtccgacaaaatagcaggactggaaacacggctatatataacccacaatttatcatccaggcccaactccgcaccgactgactgcaataaagcctgcgggtcgatccgggatacgcggatggatgacacggcccgcaatgcgtcaagcacctgactgctttccagctcatcagtgtggtgcaggatgacttcatccgcctcaccgtgagcggcagcggacagcagagcaatgccataagcccatggcaaccttgatcctatccagcagaaatggagcgatttgggcgtagacatggcagagccggaaacatccattccctgcattcctgaatggttcacgtgtttttatgcaggctgatggccggttcctggctgaacttcatccagaaacaaccgcataccgggaacggcgatttcaattccgtgctcttccagtacgttcttgacgatctcattataggctcggccaatgatccactgctcgccgggcagcgtcttgatgcgggcgcggatgctgatgatcgccggagaaaggtcgatcacaccctgcatatcgagtgttccaatgatggaaccggcatgttcagtctgcatcaaccggtcaaatgcctcgaacatggccgccttggtatccgggatgctggcgcggtgaccaacgcgcaccacggccgcatgcatggagaagatacgattgtgatttgaaacacgatcaaccgatgaaaacggaatcagatggtaaataccgtccacgctgcgaatagcgaccgatcggatcgtcaatttttcaaccgtaccctggatacccgcggcttctaccacatcgccctcgttcatggcattttcgaactggatgaacatgccgttgatgatgtcctgcaccagcttctgggagccaaaaccgatagccaggccgaatacccccgcaccagccagcaagggtgcagtattgacgcccagctgtgacaggatcgccagcacgacgataaccgccatggtgatggaaaacgcgttcctgaacagagagagcagggttcgctcgcgggaggaaatgccgtgctcctccccctgcaacagccgtttctcgatccaggagatcacaagcagataaatcgctgcgctgcatcccagaacgatcagcaccgatatcccggccgacagcgtaaattttccggcgtcggtctgcaaccagccgacgacatcgaccaccgcccagacctgcaatagccccagcacggtcaccacgaacaccgtgagtcgcaaaatgcgacgcagcggattgatcagtcttcgcagccagatattcaataacgggatcgcgcgtttcagccggtctgcaacagggacgtcgttgtgtaacagggccagcctgctcaaggcgaagccgcccaccagcagaatgacaacggaatatatcgaggcccgcagcacgaaaggcagcagccacggcatgctcagccagcatatgaacagcgccgtcaaccacagcgtcacaaccgcatgccagattgccgcaataacggcaccgagcttggcaaagatatcagatgcactctccagagagccatgattggtcagtctggtcagggcaatacggccctcccggcgctgtattatgcagaaccagatggctacgatcagcgcggacagaaccgtcagcgtttccagcgcccgaccgccatcaatggagaccgtttccatcaggggaatgaccatcaggaaactgtaaccaaacaccgacgccgaccatgccagccagctgtaccagagtctggccctgtgattggcttcagaaagcgtgcccattttcaggaagcgtaaatgcggcagccgcggtgtaaaaattgcccgtaaagccaccctgaaggattcaaccagcagaaaggagcgcaggaacatctcctgtccggcagtgacgttagccccgtcttcaatcagcagcgccagttcctctccggccagccacgcgatgaccacagttccgacatcaagcagcacaatcgtcagcagtcgcagtactttgcctgcaaaactgcccggccgatgcagccagacaggcgttgagagacgtgcggctatccatcggactgcatagaacgccgcgaatgtcccggctgcaacccctgccatgttgcggaagatcatcagcacatgccagctgaacaaccgggatgtaccgtgcaacacctccagcagctctctgaacgccatctgccataccgacagaaatgagcgcaggtgctgaaacagcagagcggaaaaattagccagatgaaccgctaccggctccggaggtgagacatccgctttttcatctgctgtcgccgtttttttcaaacgttcaatcaggcgtgcccgtgctttgtcatcctcaagaattttcaccaacccatcaatatcagggtccgcgttcccggatgtgtcagaagaggatgcagagggaaaattcagccccggaatgatgcccgggcgggacgaaggggcggctgccagaccgggttgaacacaatgcagcccaacacctgccagaagcatcaacagtcccagccgcttcatcaccttcacccccctgcccggcttcataatgccggagaatggcatgatcagggcgttttcgggcactcaccagtccggcgaccgtcaatcgtgatatgagccagcggtttgccatcctgtgtattgtcgatcacaccggtcaaatgcgtggcgctgtcaaacatgaactttccgctgctggcgattttcttgtcgttcttgcattccaccgtccaggacagggtggtgccgtcccagtgatgcgtattgtcacattgcggcatggatttgctgaagttgaaaccggcttcagggtttttcgcctcttccggggtgatgcactgggtcttctgacgcttgaccgttttttcatccttctgggcggtgatatcaatcgtccacagccccgactgaatctcggttgcccgcgccagacctggcaggccaatgcagacagaaagaatgaaagcagcagttccgttgagcagggccttgttcatgagcagtattcctcgaaaattatattggttttgagcgaaagcggccttggttccagaattaggcggcgtggtccagttactcgacagtgacacttttagcgaggttacgaggctggtcgacatcggtacccttcatgaccgcgacgtgataggccagaagctgaacaggaatggcgtaaagcagcggggccacaaacgggtcaatgtcgggaaggatgaccgtctcagctgcgatccccttcaatcgctctgccccgcgttcatcgctgaacaccatgatctggccgcctctcgctgcggcttcctgaagattggaggccgttttatcaaaaagcggcccgctgggggtaatggcgatgatcggcacgctatggtcgatcagggcgatgggaccatgcttcatctcgcctgccgcataggcttcggcatggatatagctgatttccttcagctttaacgcgccctcatgggcgatgggataacagtttccccggcccagatacagcacatcgcgcgcttctgcgacccggaccgccacgcgcttgatggcatcatgccgttccagaacctcggcagctgcaccgggcacttccagcagagcggcggtcaggcgcgcttcctcggcatgatccagcaggccgcgatgacgcccggcggcaatggccaggcaggccagcacggataattgggctgtgaaagccttggtgctggcaacgccgatctccggcccggcaatggtttgcaggacagagtcactttcgcgggcaatggtgctctcggcgacgttgacgatggacagaagggtctgcccacctgctttcagacaacgcaaggccgccagagtatcggccgtttcgccggactggctgaccagcaggcccagtccacattccggcaaaggcggctcgcgataccggaactcgctggcaacatcggtatcgacgggcagacgggccaatgcctcgaaccagcgcgcacccacaagaccggcataataggctgagccacaggccgtcatggtaatgcgtgatatatccgaccagtcgaaaggcaattccggcagcgccacctgacgggtcgccggattgaccatctgatgcagggtatcaccgatcaccgccgggtgttcatggagttccttctccatgaaatgcctgtattcccccttgccgatcgcggcaccactataggcggtgagcttgacctcccgcacggcttctgtgccatcctccgtaaagaaacgggcaccttcccgtgtcaccagcacgtaatcgccatccttcagataggcgatccgccgggtcagcggtgccagagccagagcatcagagccaagaaacatttcctgatcgccatagccaaccgccagaggtgcgccctgctgtgctccgatgatcagatcggggtgcccggcgaacagcatggccagcgcataagcgccctccagacgactcagggctgcctgcgccgcagcaaccggccccatgccctgccgcagatgcagatcaaccagttgggcaacggtttccgtatcggtttctgtttggaaaacctgcccctccgcctccagctcggtcctcaattcggcatgattttcaatgatcccgttatggacgatggccacacgggaggtgccatgcggatgggcattgctctcggtcggtgcgccatgcgtggcccagcgcgtatggccaatgccggtcagtcccggcagagggcaacgatccaacaaggccgcaaggttggcgagttttccttctgcacgacgacggtcgatgatcccatccaccaacgtggcgaccccggcactgtcgtagccgcgatattccagccggcgaagaccgtccaacagcaaaggggcggcatcccgcgccccgatgacacccacaatgccgcacatcagacgctgcccttcagttgacggcgaatctccgccgcacgctctggcttgtttacctgccgcccgcgggcaagtgccaaggcatccgctggtacgtcatcgacaataacgcttccagcccccgtaatcgccccgcgtccaatcctcaccggggcaaccagcgccgtatcggagcctataaacgcatcgtccccgatctccgtgcgatgcttgtgcacgccgtcgtaattacaggtaatggtgccagcaccgatattggcacgcgcaccgacctcgacatcccctagataggtcaggtgatttgctttcgcaccctcacccagcgtcgcctgtttcagttcaacgaaattcccgacatgagcacctgcccccagaacgctgcccggtcgcagacgtgcataagggccaatcagcgtatgccggccgacatgacatccttccagatggctgaaagcacggatttccgccccttcctccaccgtgacgccggggccgaacaccacatgcgggccaaccagcacatcaggcgcgagcaacgtatcagccgaaagaaaaaccgtctccggggccgtcatggtaacgccgttttccagagccttgcggcgcaatacgatctggaccgttgcttcagcctcggcgagttccactttgctgttgattccacgcaactcttcataaggggcttccacagccgcaacatgccccccgcccgcaatggcgagcggaatgatatctcccagataatactcgcccttgctgttggcgttctctacaccgcccagccaggccgccattgacgcggcatcggcacagaacacacccgcattacagagcgttacagccctttcctgttcattggcctccgcatattcgacgatacgcgaaacatagtctccggtctggtacttctccgttatcacccggccatagcgtcccggctcgggcgggcgcatggcgagcatggccagcaccgcatcgccctgccggcggcgctgcacgagggtatgcagggttgcggtcgagatcagggggttatccccatacaggattgcaacctctccctgctgcaccagggccatggcctgcagggcggcatgcgcggtgccgagcctttcctgttgcaccacggtgggatggggggcagcttcccgggccacactgtccatatccgggccgatgaccaccacgatatggctgaacaccggctggcaggctgcaatcagatgccgcagcatggagcgccctgcaatcgggtgcagaaccttgggccgggtggatttcattctcgtgccgagcccggccgcaagaatcacggcggtgccggatggcggggagtaagacggggtctgatccatgcggaatccgctagcgctgccagccggttcctgtcaaagcctgaaagatcacttcagattacggaatgcgacatgcgcacggtattgctggatcttgatggaacactggtcgattcgctacctgacatcaccaatgtcctgaatgggacgctgcaacgggccgggctgccgtcctatacgcaggcggaggtcgggccgatggtgggcgatggtgcccgtgccctgctgacgcgggcggccaatggacggggagcaaccctgagcgaagccatgatgcaggatttcatggcggcctatgccgaccatgcgaccagccattcccgtttgtatccagatgtgccgcctacgttggccgagctgaaaaaacggggctggaccttgctggtttgcaccaacaagcctgccgttccggcgcagatcattctggaaaattttgaaatagcgtctttttttgcaggcgtaggcgcgggagacagttttccggttcgcaagcctgatcctggccatctgctttccacccttgcactggcggggatgacaccggaaggggcaatcatggtgggggatcatagcaatgatattgatgctgcgggttcgattcccatcccctccgtctgggcgcgatggggctacggcactgatgcaatggggtcagccgccacggcgattgccgaacggttttccgacctgccagacctgcttgaaagccttatgccggtaacctaatccggcagtgtgctgatgctgtccaggtagaaggtgatgctccccatccagcgcgacttcacatcatcaaagcgcatgcggataggaaagaccggggctggtcctgccggtcccagccatgccgttgcatgccatggtctggatgcgggaatacccgccccctctacggcctgtttctgccccacgatatcgcagcgcatggcctgaaccgattttgcttcatcgctgacaggggagagaagctgatctttcccgctcagcgtggaatgaattgttgccatacgccggccatcgaaagtagtggcggttccagcgcagccaccggacaaagccgcatgatgcgtcagggcgaccatcgcgctgagactgtccagcgcgatatttttgaacggaaaagtggaaatcttgtggactgcatcctcaggccccagcctgatcccgctcggctgtcccttacgatagagaacctctgtcacgctctgccgtccgttaacggaaccggtgctgagaaacagggatggtacaggggagccatcctgccagcctcccgcagcctccgtgatcgaccaggtggagcgtatccattgcaggattcccgccgtcctggattccagcaatacgtgataatgcgtgtcgttccagaccacccgcacaatcacatcagcaacatgcagccctctggcataggcgtggtaggtggcaataatggctgtgttggccgatggttcgtcggcctcgatatggtcgggcaagcgaaccggcatatgagccaactggaccccagagggagatatcgagggagatatcgagggagatatcgagggagatatcgagggagatatatcgggtgacagactatgggatacttcctgcggttctgcctgaccggctttcgtctgggccatcccatgacctgccagaacgcagtatcccgcaatgatcacagtggcgaggcataccccgtttacggcagcccctgatttatgaaccggttccatgattctgccccattctccgtgatctatgaaaatacggctgccacaatttcagcgaccctgaactgaaagataccgctcggaaaaaaacctctgtccgtcaaatctcctgaaaggagggcttgccaccatccgtattccgtcatagaacgcgcccatcggatgggcgcgtagctcagcgggagagcatcgccttcacacggcgggggtcacaggttcaatccctgtcgcgcccaccatcctttaccagtcagcctaatagcaaaatccttaaaacacaagaatgaacggcaccttgtgacaatcgtgcgaaatcattcaatcggttgatcacggctcgcagaatgaccgaatctgtcattcagcctgaaccatgcgatccgattaatctgatccagagcctcctgcctttcctccctcttggtcctgctcaggcgcgctttcatcgctgcgataatgctgtcaggaccatgccccctcactgcaatgataaagggataaccgaagcgctcacgataggcgcggttgagtgttatcagactatgccggcgcgcatcgtcgcactcatcaagtccggccgcgtgctgctcggaacgtgatgcaggagtcaactgcattgccctgtccggcgccagttccggatgggcgtggatcagggaaagctgtaatggctgctcagcgccgttcactgcctgtttcaacgctgcatgcaggctctggatatcttcaaaaggctctgtccgccacgcatgttcggcaacccatggcgaattttcgtaaattccttccagcagcgccataaattcttcccgtggcatattcctgctgaacggccagcagggctgacggtttccatccatgaggcatcattccctctcttggcagagcatccgccagcctgcgatgctggcggcccatctgccctccatctggcagcccatgacaagacatcattaaagccgtccatcaccagcaggcaaaggcatctgaatgggacaacttaccacgcatgttctcgatacggcccgaggcaggccggccgcagggattccggtgcggctttatcgccagggagagcctgaacccctgatcacgacaatcaccaacagcgatggtcgctgtgacgcgccgctgttacagggagcagccctgattgccggacgctatgaacttgctttcgatgtaggagcctatttcgccgcccgggattcatccctgccggatccaccatttctggagaccgtgcgtctggcggtcgggctttctgacccgtccgcgcattatcatgtgccgcttctggtctccccatggggttacaccacctatcggggcagttgagcgatgaatctgctttttccttatttcgccagctggctggagctgcttttgcgctggttccatgtagtggccggcatcgcgtggatcggtgagtcgttctatttcgtgatgctggatcgtggtctgcggtcccctcctgctgatgcggcatcccgtggcgtggcgggagaacagtgggccgtgcatggtggcggcttctaccatatgcaacgctatcgcattgcaccgcctgatctgccgcatgagctgcactggtcgaaatggaaagcttacgccacctggctgagcggtttcacgctgctcagcacgctctatctggcccaaccgggattatatctggttgatcccgacgtcatggtgctgccgccttatggtgcatcggcgctggcggtcggatttctgatcgtgggatggatcatctatgacggtttgtgccgcttgctcggtgcacgtgagcttgctctttccatggcagtgggggtgttcgtcatcggtgcctcctgggtaggaacccatcttttctcgggccgcgccgctttcctgatcatcggagcaatgctcgccacgatgatgacggccaatgtgctgatggtgattatccccggccagaaaaccatggttgccgccatgatacgcggagaaacacccgatcccgaaccgggacgcagagggcggcagagatcggttcacaatacctatttcaccttgccggtcgtctttacgatgatcagcaatcactacgccttcaccttcgcggatcatggccggtggatcatgctctgtgccatcatgctggccggagcactgacaagacagtttttcgtcgcctggcacgaaggccggcgcgtctgggcgttgcctgtttccgccgcggttatcatggcagcgttgatggtatggagagcaccgtatcacctccatactaccgcagaaaacagggctgcagccccctcgttttcccggatcatgaccattgtgcagaaccgctgcacgccatgccactccgctcatcccaccttgatggaaagtgctccggctggtctggcgcttgatacggccgatgccatcatggccaacgcgttgcgcattcagcagcaagcctctgtgctgaaaaccatgccgctgggtaatgccacccatatgaccgaggaagagcgatccgccatgacacgctgggtcgaaaatatggctcacccttgacgaacaaaaagctcagatactctcccgccctgctgaaccgtgatgcacccggtcagccgtgaccgcccgactgccatgaccatgtcccgatgcacagaaaggaaagaaatctttcggcagcacaatacaggccgtctgcctcaacccgaccagactgctggcggggctgaccccggtggccgatccagccccccagagcgcaagtgccacgatcagcggctcgaatgccgacccggtgcgacagagcggcaaggcccaggtgcctttcagcggccaacccagccgcaatccggcaggcgtcagaagatcagccgccagatgcgacagataaccggttaccaagggatcaatgatggtccggggcagccgggaatgctgcatcgcccagccgcaggcgatgattgccagcagggaatgggtcacgccacgatggccgaaagccttgctcaacgcgatcgacagaccacccagacgctggccgacccatgatttcgggtgatccacatccggcaacaacgcgccagccacagccagcaccaacccggcggcatcggccggcggaaggcccagcttcggcgcaacgatcagccacgctgccgcgccaagcgccacgtgggagccagccatcatcgcaaaacgcccgtgtctacaaacggacaccatcactaaagtgagagaatcggctccacaaggttgattctgaataattttttaaaccttgtgccagtcggttcccctgccgggagaaaactggaaagaatacactcaggatcacacgacactttataaaaaaggcgggatattcttcgtatggtgagcctcgatcgttcagacaccctttcgaccgaccagatttacgatctgatcgtcattggcagcggccccgccgggcgcagagcggccattcaggctgccaagctcggccataccgtgctggtggtagagcgaggccaaaaagtaggtggggtttcggtccataccggcacgatcccctccaaaaccctgagggaaactgttctcaatctgtccggctggagggaacggggattttacggtcgtgcctatcgggtcaaaaaggatatcgaggccgatgacctgatgaaccgtctgcacatcaccctgtcgcatgaggtggatgtgctggagcaccaattctctcgcaaccgcgtccgtaccatccatggcgtggcacgctttctggaccgggagcatgtcgagataacaaccgccccggacataagctttgtagcccgggcggcccgcattcttattgcagtcggcaccgtaccacatcggcctgacaatattccattcgatggaaagacggttctcgatagcgacgaaatcatctctatccccaccctgccccgcagtctgacagttatcggagccggcgtcatcggcgttgaatacgcaacgattttccatgcgctggatatcaaggtcacgctggttgagcctcgtaagacaatcctggatttcatcgacagcgaattggtggatgactttctgcatcaactccgtgattccggcatgacgatccgcctcggctcggcagtcgaaggcatcgttttcgaaaacgaccatccggtcacccttctcgaaggtggcaggcgtcttccctccgacatggtgctctatgccgccggtcgaagtggcgccgtcgaagggctggggctggaaaccatcggactggtcccggacaagcggggacgcctgagcgtcaatccccagaccatggaaacatccgttcccggtatttatgcggccggtgacattattggtttccccagcctcgcctccacctccatggagcaggggcgcattgccgcctgtcatgctttcgatgcgccctcaccgcctgcaccggattattttccctatggcatctattccgttccggaaatgtcaacggtcggattgaccgaggaacaggtcaaggaacggcatattccttatgaatgcggtattgcccgcttcagggagacctcccgcgggcatataatgggcctttccaacggcctcatgaagatgatcttctccctcaaaacccgccgcctgctgggtgtacatattgtcggggaaggagcgacggaactgatccatatcgggcaggccgtgctgaacctgcatggcacgctggattacttcatcgataacacgttcaattatccgacccttgcagaagcctacaagatcgccgcgctggatgcctggaaccgcatggcctatgaagcgcccttgcctgcagccccgcttccggctgatccagtgccgggagtgcccagcaccacggcctgaaaacagaaaagacggtcacatccagcctggcggacgtgaccgtcttatttgatctgatactggtagcgacgggattatccgtctgtcatcaatcagccagccttggaagcaggcttcgtgtcattggccgcctgtggattgacgacgctggcgatggtatcgcgcagcacgatcactttgacattcggcgcaatctcgacctcgacttcaggagtaccgtcggtggccttgaccacacgcccgacaataccgcccgatgttacaacctgatcgccgcgcttgaggccggcgagagtggctttcaacttcttggcctgctgctgctgaggacgaatcagcagaaaatagaacacgccaaacaccagcagtagtggcagatactgcatcatctcggtggtaccgacgcctccggcagactgggcgaaggccggggtgatcaagtttggaaacatcgtatgtaccttgatgatgtggcagaggcaggtaaagaaacggcctgaaccgcaaccggccggtgccgcaccataaattctgctcccgctcgcttcaaggccgctttctcacagcaccgctatgtctgaccactgcggcgggcttcaccgtacacccgaaatacggtgatataccgcccgtgtcttcagagggattgatgatgacatctttcagcccacaggattccgccaacctgcaccgcattgccgaagctctggagcgtatggctcctcccccgccccggctcccttccttgcgggatgcagatgctttcgtgtgggagccggcgcacaatcatctcctgccggttccagccgtcgcatatgtgtcaatcggcctgctgcaaggcgtggaacgacagcagcaaattctgctggataacacgctgcgcttctccagagggctgccagccaataacgccatgctgtggggggcacgcgggatgggcaaatcctccctcgtcaaagcggctcatgcagaagccaatcaccagcaccccggtagcctcgcgctcatcgaaatcgcccgggaggatattgcgaccctaccgacccttctgcgtctgctgcgtcatcccgctatcggcaacccgagacagtgcctgattttctgtgacgatctttcttttgaaaaagaagatgccgactacaaggcgctgaaatcggttctggatggcggcatcgaaggaagaccggccaacgtcctgttctatgccaccagcaatcgccgtcatctcatgccacgagacatgatcgaaaatgagcggtcgaccgccattcatgcctcagaggcaacggaagagaaagtatcactctccgatcgtttcggattatggttgggctttcataatgccgatcaggataccttcctgcgcatggtggatcagtatgccgccaggctgagcctgccgatcgcgatgcagacactgcatgaagatgcgctggaatggtctgtcacacggggtgcacgttcaggtcgtgtcgcctggcagttcattcaggatctggccgggcggctgggcgtggtcatcacccaggatgcgctgcggtaaacgctgccggattactcatcttcatcattgtctgttgtggacgtcttttcatcgcagacccgccgcaccgcctgccagtccttgtcactcatggcagacgcacctgaggaactgcccggattggcatgacgtcgtacaatcgtcgccggatggtcggagaggaattcaacggaaagagagtgctcctcccgtttctccaaagtttcaaagaaatgagcgagaccatcggagcgcaacccggctttatcgagaaaccatattgccgctttatcggcccgctcctcctgcctgcgattgtaatgaagccccagcatttgcgtagccaaatcggcggacagtgaccagcttccgcctgttataactgtctccaatacacttaaaccaagaagccgcaccaaaagctgcatggaatcatgataaaatacatgaccggtttcatgcgccataacaccggccacttcatcggaagtacggcttgcttcaatcagaccacgcaataatacgatgcgtcgccccggcatcgtgaaggcattgacttggggatcatcaataacatccagatgaatagaaccattgatcccggctgcatgggcaattttctgctccagcacacgcagtgtatgcagcccggtcttccccgtgcagacacgttttttaactatgatgctttccgcaacctgctgaccaagccattgctcggtatggtccgggatcaagggtacaatccattcgggcgaacggtcgatcagaataaatgagccgagaacacacgcaacgatacctgtggttatatagcaccacacatgcttcgtgcttttgaagcgtattcccaaatgccccagactgtcaggatcattgagaatcagccggtcagcatatccccgccggaacaggatgacatcgttttccggcgttggctcgctatatctgatcgtccgtaatttccatactactgccggatgatgagaccgctctacaatcaatcctgatccctgcacatgaacggagacgtgatgcgtctccgccgtgctgccgtcatggtatcgcgcaggataagaacgtggcgcgataccattgtctggctgggaagtaatcagaatccgctgcctccgtcgaagacattcaacaggccctcgccagtagcgggcagcgactgtgtattctggtgcagccactcggctggaagcggattgcctattaccaaagtatggcgctccagaaaccgcatgttccgctgaataacaaatggcaatcccagaccaagcgtaaacaaggtgatcagaaaatttccggtcaattgtcccagcagtttcagcccggtaacagtgctgaaaaagcgaaacgatgcataggtggtattaccaatgacatggcgaataaaaagagcaatataccagcaggaaataagcgttgccagaataagataaataaacagcgccccaactccgacaagcgcaataatggtttgcacattctttgcaatctcgggctcgaaatgtggcagcgccttgaacagcgtcacgagtgaacgcccgttatcgctaaatacccaaggatcagcgccgaacgtaaccgccagcacataccatgtcagcagagcgatactgaaaaacagaacaaccatgatcaggaatgtggccagaaaggccagataaagccgtcctgcgcgcccataaaatgatagtttttcactgccgaactggctgttattgatccggtattccgtcagtcgaacagccgcccatggtgccaactgatagagagtcaaaattgtgagcacaccataaagcagtgcgtaaaatgcgtaggtgaaaagagacccggtcattccgccacgaatgccattccattctgttcggctcaaacgatatcgctgtgccgcataaggcgcaccgacagccagcagcacgacgaaaatataggcagcgacgattggaacaggaacaagagaagggctgagcttagcaaggccataagccgcagcccctgtcgccgcaatcagcaggatcagcagacccagcactttcaaaaaacctaaaaataactcgcctcccgttccggtgtaagtaaaacgagtctcttgaaaacgacaacgcgaccataggtagcgcctcattctggaaatagcccaaaatcggtaaataccgagcgttacgatactcaaaagaagattgatcagaaaaattttataaagctcgcctgtttttccgtcatactggaaaaaaggtctgggtttttctgatatgggggctgaatagtcggtagagctttcgttcaccacacactctctccttgccatatctgaccggctcaggagtgtggaataaaaaaattacttaggcaatattattgcaatttcatcgctatgatgatgcaagaaaaatataaactctgaatgatgagagtcaaaaaggccattttgcatggccatggaatgatggttcttttgcttacacaaaaacgctatcgtgatagagtgtaacaatgctccatcgccgggaagcgccgtgtgcgtacatcctccgcataacaggcagcagcctccgcgactgtcagcgccaactccgcatagcgtttcacgaaacgaggctggaaagaaccgtataatcccagcatatcatccgttaccagaacctgaccgtcgcaatgtggcgaggccccgatcccgatgatgggaaccgcgaccgagcgggtcattccggcggcaaccggttccagcgtgccttccagaacgatcatgaatgcccctgcttccgccacagccatggcatcagccagaacacgggccgcactgtcctctgtgcgaccggtcgcacgataaccaccttccatcagggtatcctgtggcatcaatccgacatgaccgcacaccggaatgcctcttgctgtaagaaaagcgatggtctcagccatctcctgccccccttccagcttgacggcccctgcccccgtttcggccagaagccgtgcggcattacggtaagcctgctccggactttcgcgatatgtcccccatggcagatcaacgaccacgcaggcccggctggacccgcgcaccaccgccgcagcatgggcaatcatcatctccagcgtcaccggcagggtcgtctcaaacccgtaaatcaccatgccgagactgtcacccaccagcagcacatcgacatgcggatcaagatgcccggccatcggcgcagtataggcggtcagggccacgatcggcgtgccgcccttacgggcgcgcagtgccggaacgctgatacgtcctgaccgcactacactgctcatgacggtatcctcacgcggaaatacgctccagcccacccatataaggacgcagaacggcaggcacatcaatgctgccatcctcgcgctgataggtctccatcacagcgatcagggcacgcccgacggccacaccggagccattaagcgtatgcggaacccccgccaccttcccatccgcaccacgataacgggcgctcatgcggcgcgcctgaaaatcgcggcagttggagcaggagctgatttcacgccatgcttgctgccccggcagccagacctccagatcataagtccgtgctgccgagaagccggtatcgcccgagcataaaaaaacacgccgatatgcaagaccgagattttccagcaccgtctcggcacagcgcgtcatacgctcatgctcggcatcgctgtcctccggcctggtgatgcagaccatctccaccttatggaactggtgctgacgcagcataccacgcgtatcccgtcctgcgctgcctgcctcgctgcggaagcagtcagtcagtgcggtcatgcgcattggcaggctggcttcatcaaccacactgtccgccaccagattggtcaaaggtacctcggcagtcgggatcagccagcgcccatcggtggtgcggaacagatcctcggtgaatttcggaagctggccggtgccgtatgccgttgcgtcattcaccaaagccggcacctgcatctcggtaaagccatgctccgtactgtgcaaatcgagcatatactggcccagagcccgttccagccgtgccagagcaccgcgcagcacgacaaaacgtgcgcctgaaagtcttgctgcggcatcgaacagcatcatgcccagcgcctcacccagttcgaaatgctggcgtgcggagaaggggagggaaatcggctcgcccacctgtttcagaatgacgttggcactctcatcggggccggtgggaacttcggcatccagagtattgggaagacgctccaacaggcttttctgctccgcatccagcgatgcgctccgtgcctccagcgcctccatctcatcacgcagggcgacagcggtcgcctccagcatggaagtatcaatcccctgacgcttgccctgccctatctctttggccaatgcgttgcggcgcgcctgatagtcctgcaaccgggtctgggccatgcggcgatcggcatccagcgccagcaggctggaggcagaggcaggcaggccacggcggcccagcgccgcatcgaaagcggcgggatcggcgcgtaaagcgcgaatatcgtgcatcttgcctccaaatggtcgtgccgctccggatggctttctcgcctgctgccgggtgcggttatcactgagtaaaatccgggtatcggtgcttatagcggagagcctgtcccgccgctaatccccgtcctcatcggtttctctgttctccgatacatccggtttcggggccacaatccgtgcggcgatgatcgagacctcatacagcgccaccagcggtaaagcgaggccgatcatcgtaatggcatcgggcggtgccagtactgccgcaattgcaaacatggcaacgattgcataacgccgcttggcagccagggactgtgcactgaccagtccgaccctggccagcagggacagcccgaccggcaactggaacgcaacgccaaaggcgaggatcagcttcatcaccagtgccagatactcaccgattttcggctgcaactcgatcggaatgccgcccccgccatcaggcgtagaaaaatgcagaaagaaccgccatgcagccgggaaaatggcgaaataggccaaggatgcgcccatcacgaacagcacgggtgtcgcaatcagaaagggaagaaaagcccgtttctcgctgcgatacaggccgggtgcaacgaacatccagacctgtgaggcgatgatcggaaaggaaagaaaggcggcaccgaaaataccgaccttcatgtaagtgaaaaacccctcggtcagggccgtatagataaagcgcggattggccaccccccgatccttgagcgcatccgccagcggcttggccaaccagaaatagatcgtgtcggaaaaccagtagcacagcgcgaaacacagcccgaatgccgccacagaccagagcagcctgcgacgcagttccagcagatgctccaataacggcatcggcttgtcatcaatcatgtcgtcttgtgtgtgcgctgccaccagacttcaactttcactacagaatatcatcacactcacggacataaccggagccggtctgcggagccatatgttgttcaacccttacccctgatcggcaggcgggatgaaggcgggagcacggcgggcggagcggaatgcctcccccggcggaataaaagccggcgccgtcgctgcacgacgggcggtttccgaagaaacggttttctccctcgtccattccgatgccatatgactctcatccatgaccgacagggaatggaatggccgttcctcgaccatatgggcctcatcaccccccatgatcatcggagcaggcgatggtgccatcggattgttatcaaaggtggagcgcatcgacccatccgggtccagcgtgcggctcaactgctgacggagattaacgccgcgcagatcgttgaaggtctcccgcacatcgccgagatcggcctccttcatcatctgatccatctgcccctgaaactcggcagccatggaacgcgccttgcgcaccatgcgtgcgacaccgcgcacggcgcccggaatatccttcgggccaatgaccaccagcgcgacgacaccgatcacggcgatctcggaccatgcaaaatcaaacatcgcccgatgatccttccacccggatttctacaggcgtactctctacagaatttttttcatcctcaggcatcatctcggactctgcatcagagaaaatacctggatggggcgatagtctttcctgtccggtaccatcggtcagcaattcctcccgcttcggcagatcggtcagggatgccaggccgaactgctccaaaaagcgtggcgtagtgccccacaggctgggccgtcccggcacttccttgcgcccgcgcggagtgatcagcccggcttccagcaatgtatccagcgtggactgactgagggtggcaccacggatttcctcgacctcgccccgtgtaacaggctgatgataagcaatgacggccagcgtttccatcgcaacacgtggcaaccgccttggcacctccactacccgacgcagagcattggcaagatccggtgccgtgcggaactgccatcccccggcaatgtcgtgcagctcaatccctcgcccggtataacgctgacgcagcaatggcagaatcatctccgcatccgctccgaccggcaaggcatgggccagcgcggtgactgaaaccgggccggcactggcgaagatcacggcttccgcaagcctgagataatgctccaactcatcgttcatgactggttgctttccgcctcttccggagtgtcttcagccatttgcccatcaccacgcaagaggatcggcccgaatggcgcctcctgccgcaggcgtaccgtgccatgccgcgccatttccagcccggcaatcaaggtgctggccagagcggcctttcgttccagcggactcagcagctcctgcggtataaattgctccagactggtccagtccggcaggcttcccaccagcttttccaaacggcccagcgcatccttgacactccagaaggacactggtttaggccggtaaatgcgccgcctgccgccacggcgccttgccgagagataggcacccaccaacccggccacatccagtttcagccgggagcgatcatagtctgtaaaattctccggcgtgccacggatgaacacctcttgtccgacctgtggacgggcggcaagccatgccgccagacgctgcatggtttgcagatgggccaaacgctctgccagagcctcccccgccagttcgccttcctccgcctcggcaggagacgctggaagaagaaggcgggatttcagccaggtcagccaggccgccatgaccagccaatcggctgccagttccagccggaccacacgtacgccttcgaccactgccagaaactgctcgaccagagacaggatcgagatcgttgccagatccactttttgcccgcgtgccagttccagcagcagatcgagcggcccctcgaacccctccagccgcagcagcagcgcgccatcctgcggttccggcatctcagccaccatcatggcccgccagacgcaggacgagaccaaccgcaggccgcagcatccggtccatcagccaccggaccggatcaaggtccattcccagttgatgcccgagccatggcaacagcatcacgatcatgaggaccggcagaacgccgtagcgatcaagtctgacccagtgcatcgccacccgtgccggcaacacggcggcaacgatccggctaccatccagcggagggatcgggatcagattgaacaggccaagcgcaagattaaacaggatgaaatcgaacagcccatccatcatccactgactggcctgcgcaggcataaatggcagcaggtgcagccccagcgcgcccagccatgccagcaggaaattcatccccggccctgccgccgcaaccacccccatcccctgcaaagggtggcggaaccgcatcacattgaccggcaccggcttcgcccagccgaaaatgaaccccggatgaccggtggcaatcaactgcccgagcaccataagaccaggaacgatgatgctgcccattggatcgatatgccgcaacgggttgagcgataaccggccttgctcccgcgccgtggggtcacccagcgcaaaggctgcaaacccatgcgcggcctcatgcaatgtgatggcaaaaaccgccgggatcagcgaaagcagaagatgcgatagcattgggtgtaatccgtccggctgaaatcaggccgggtgatggccttcagtcgggtctttggcgcggataccatcttccagcaagcccaggcgctctctttcctgcgccagagactccccatccccgatactaatggaagcaacaggacgggcagccagcagggtatgagcctgatccgtcagtaacggacagccttccagaaccgcctgtgtctccgcctgcacaccggtgcaatgcagcaccacgtcgcatccggctgccagcgtctgacgggtgagagaaacaggatcaccactcagtgccttcatggcgatatcgtcggaaaccagcagaccattaaaaccgatgcgttgccggatgatctgcccgatcaccacgggagataaggtggccgggcggagccggtcccacgcttcgtagagaatatgcgctgtcatcgcccagacgggaaggcccgcaaaacgcgcggcattacgggtgaaaggctccagctcggcaggaagttcatcagggacgaccggcaattccagatgactatccgcatgcgcccggccatgacccggcacgtgcttcatcacagggcgcacgccagccgccagcagcccttccatcaccgcgccgcccaacagcgtgaccgtgccgggatcggtgccgtatgcgcgatcccccacaatgtcatgggcgcccggtaccagcagatcgagcaccggggcacaaaccacatcaaaccctgcccccatgcagtccagcccgatcagcgccccggtcaaccaggcggcccgcagcccggccttcttatctgcttcatacagacggccaatgacagcagcaggcggatgggatcgccagtgaggaggccgcagccgcgccacacgcccaccttcctgatccaccagcaaggccgcctccgaaggcagaatggaacgcagccttgccgtcagggccttcagctgggcaggatcgctgatattgcgacgaaacaggatgacacccgcgggacgctgcgtgtgcagcatggcctcctcggccgacgtaagggtcgggccggacaggccgatgatcgcagctttcatatccctgcctcagaatgtggcgaccgagcagccgccacctttggccctgacttcggcacagaatgattttgctgccgcaacgtcggcaaagcctccggtacggagacgccagtaggttttaccatcacgctcggtcttactgatgctcggctggcgatgtcccagcaggtccggcatccggcgggacagacggttccattcactatgcgccgcatcctcgctgttcagcgcggcaagctgtaccgtcacatgaccgtttgaagcaggcgcgacggacggagcaggttttgccgcggcctgaggagccgtttttgatggagcggcagatggcggggcagacggcgtttcatcatccgcatcttcggtggtaaccggcggtttgggggaggacggtagtttttgttccgtggccttgcccgttacagcaggcgagtctaccgctgctttggcaccgggtgatgtagaaccctgtatgacgggctcctcagtcgtttcggaaccactggggggcaaaggctgcggtgcagaaggcggagccagacggcccggcatgggggcttccggcttgggggccagagattccggcgcatcatcactcgcaccggagagaatggcatcatcggcaccggatatctgcataccgccgggattggctggctttacgcgcaatggacgattatcggcctcgatcaccggaacagggcctcctgtcccttgcaccagtgaccacaggccgatgaaaccgaccagcgccacaccgatagcacctgccgccatcgccagcttgcgcgtggcgggatcaagcgctccgccaccggtcacacggcggctggaacggtaggcggtttcttcctccacccccggcagcagatcgtcggtcgggcgggtgcgtagatcctcccgctgaaggtcgatccggggcatacggaaaccctccggaccgcccatggcctcaccatcatcgctatagacgtggtttggatcaaaacgcggcgcttgccgaactctcggtcgatcagatgccagaccgcgaggatctggattttcgttgggagtatgatccggcatcgtcgcctgttccgttcattcgccgcacgctgcggaggaagctcccctcagcgcatttcattcaccggtgccacacccatgacggccagccccgaccggatgacaatggcggcagcttcgaccaaagcaagccgtgccgttgtctctgtcgtacggtcctgctggataaagcgcaaggttgcatcgtcacggcccttgttccagagcatatgaaaatcgcctgccaactcatagagaaaaaacgcaattctatgaggctctctggcctgtgcagcggcctcgacaatccgtggccacccggccagacggcggatcagggtcagttcggcatcggaggtcaggctgtccagcgcggcatgacgtaatgcctccggttgcgtggtcagcccctgctccgccgccatgcgcagaaccgagcagcagcgagcatgcgcgtattgcacatagaaaaccgggttttcccgtgtctgggccagagcctgatccagatcgaactccatctgcgcatcgcttttgcgggtcagcatggtgaagcgtacggcatcacggcccacttcctccagcagatcgcgcagcgtgacataggttccggcgcgtttgctcatccgcacgggctgcccgtcccgaaccacatggacaatctggcacaacacggcctcatagatcgcctgcggggcaatggcgcgcatggctgccttcacacgtggcacatagcccccatgatcggcccccagcacgtccacaacgatatccgcacgggtggccttgtcggcgtgataggcgatatcattggcaaaatacgtgttggtgccatctgattttcttagcggacgatccacgtcatcgccgaaggaggtcgagcggaacaaggtctgttcacgcggctcccagtcatccggagtcttgcctttcggcggctccagcacaccctcatagatcagcccgtcctgctgcaaccgctcaatcgcggcatccgcagcgccagactgcaacaaagcaagctccgaggagaacacatccgggtgaacgccgagcagatccagatcctcgcggatcgacgccatcatttgcgccacggtgaattcccgcacggtattcagccacaatgcagagtcagccacggtggtgccgggaccggccagcgtatcgccatgaagcctggcgagttcttccccgaccggaaccagataatcaccgcgatattgcagcccacacggaacctgtgccgcatactcatcctcggtcagggtcgtgccgagcgcctgcaggtaacgccagtaagctgcccatgccaatgcgatcacctgggcgcccgcatcgttgatgtaatattccttcgtcaccgtgtagcccgccttgcccatcagattggcaagtgcatcccccaccacggccccacggcaatgaccgatatgcatcggcccagtcgggttagcggatacatattcgatgttgacccgctttccgtatccggcactgccgtcaccataacggataccggcctccagaatggccggaatccgcatccgccacgcttcggcccgcagatgcatgttcacgaagcccggacccgccggttcggcacgctcgatttccgtaaccccggccaatgcagccgacagggcctgcgccaaatcacggggcggttttccagccggttttgccgcgatcatcgctgcattggtggccatgtcgccatgcagaggatcacgagtgggcgtgacctccacccgtgccgtcagctccgcgggaagatcaggtacaacgcgggccagcgcttccagaacatgggtacggatcagggcgtagatgtcatcggccatggaattgggtatctcgatcagtgtacgtttgggcaggcaatattggtatggggagctgtctcagccgggaacggacagatccgtcaagcgccgatgttcttcagcagcgaaacgatccgtcataccggcaatgtaatcacagaccgtgcgggcagcccgttcagaaccggtggagccgcctccccgcacccgccactcgccgggtaacagggtcgggtcgtcatgcaggatgcggaacagatcagccgtaaccctgcgcgccttcacggtcatgcgattgactcgccagtggcgatacatacgggcgaacaggaattccttgatgaccctgttggcttccgccatgcgggggctgaaggcaaccacagcctcattggcgcggcggatatcactggcactggctggattgagctgagcaatccggccacgtgtctccgtgatcatatcccgcacaagcgtatcaatcacgcgccgaatcgtctcatgccgcagacggggtggcggcacatccaggctggtcttcctggcagcctccaatgcctcccccaccaccggcagatgggcgatgtcatcgaacccgaacaactgggcacgaataccatcatccagatcgtgggagtggtaggctatatcatccgacatggcggcaatctgcgcctcgaccgaggcatagctatccagttcgagatcatacagcgcattgtattccgcgacataaggtgggggccgatgcagcggaccattatgctttgccagaccttccagggtttcccatgtcaggttcagcccatcaaagggagcgtaacggttttccagcctcgtcacgacccgcagggactgggcattgtgatcgaagccgccgaacggcttcattcctacctgtagagcgtcctccccggcatggccgaaagggggatggccgaggtcatgggcaagagccagcgtctccgccaaatcttcatcgacatccagagcacgcgccatggaccgcgcaatctgtgccacctccagactgtgggttagccgggtgcggaagaaatcgccctcgtgattgacgaaaacctgcgtcttatattgcagcttgcgaaaggcggcgctgtggatgatccggtcccgatcacgttgccacggactgcgcatctggctttccggctcggggtagagcctgccccgcgcggtttccagccttacggcccatggcgccagaccgctacgctggaaagcgcgactttccggcggatagagccagtccgctgcccggggttgaatggcggataacagatgatccggtccagtttcgttcataactcaacggattagcactgctaccagccaccgcaccagcacccgatcaatgcagcaccgatggaaagcgtcttgcagtccgggtttcttcgcttattttcatgggatggacgcactcgaaacctctcctgacatttcttcctccggctcggcagtggggttcggcgtatcggcctcagccgccgcacgcattgccgaaattgcacaagggcaagccctgcgcgtttccgtgctggcagggggatgcagcggtttccaatatcagtttgctctggatgggcagcgggccgatgatgatgtcgttatcgagcgcgacggagcagtcgttctggtcgatccggcgagtctggaatttttggccggtgcagaactcgattacaaggatgcgctgatgggcagtcatttcactatccgaaacccgaatgcgaccgcctcctgcggctgcggcaccagcttctcggttgaatgatcatctgatagccagatcgacaccgtctttcaaaaaagtagcattgcccgtgaaaatcgccacctggaatgtgaactccatcaggcagcgagagggtcatgtactgtcctggctggagcggaatcagccggacatcctgttgttgcaggaaatcaaatgcgaaaccgctgcctttccggcacaggcttttgccaaactgggatatcaggccgaggcagtcgggcaaaaagcctataatggggtggctgtgctgtcccgcgtgccgtttgaggtcacacagcgcaccctcccgggccttccccccgacgatgcacaggcgcgctatatcgagatcagagcgctgaacaccatcatcggcaatctctacctgccaaacggcaatagtgggggggaagccggatacgcctacaagcttggctggatggagcatcttgcacagcatgccgccagcttgctggctgccggcgaggacctcattcttgcgggagattacaatgtctgcccgaccgaggaggattacgcccccggcgccctgcctccggaggatgccttgctgcggccagaaacaagggcgcgattccggtcattactctggctgggcctgaccgatgccgtgcgggcaatgcggccatcgggacagatttatacattctgggattatcaggcgggtgcgtggccgcgtgaccgggggctgcgtatcgaccacgccctgttatcaagccgcatggcagagcgactgatcgaagcccttcctgaccggatggagcgtgatcagccgcagccttcggaccatgttccggtcataatatcgttcgagccttgagcttttatccgcaagccgccacaacgctatgactgaacaatgacctgatcagcggccgggccaatcgggatgcctctcaacaggctgtcaggcagagaggggaagcggatatgaatttcacattcatggtgatcgtggcagctctcggcggccttttgttcggctatgacacaggtgtcatttccggcgcgctacctttccttcgtgaagacttcaaccttgattcctggaacgaaagtctggtcgctgccatcactcttgcaggtgccactttgggggctatggcggggggaaatctggccgaccggtttggtcggcgcctgatgatcttgcttacatccatactgtttattgtcggtgccgttctctcggccttcgccgggagcattctggttctgacggctggccgcctgatcgtcgggctggccattggcgtgtcatcactcatcaccccgctctatctgtcggaaattgcccctgcctcacggagaggcggaatggtgtcgatgaaccagtttttcatcacactcggtattctggtggcgtttctggtggattacgccttttccttttcccgtgcatggtcgtggatgctgggccttggcgctgtaccaggcataatcctgtttctgggaatgcttgctttgccggaaagcccacgctggctgctgaaaaacggccatgttgatcaggctgcggatgcattgcggcagttgatggggaaggagcaggcagaaggagagttcaaaagtctgaatcatttcatgcagacagagttagcgtccgagagaactgccaatggagtttccattttcaatgatcgacgttaccgcctgcctctggtgatcggggttggtctggccgtgctgcaacaggtcaccggcatcaacacagtcatctatttcggcccacagattttcagtgcggcgggtattggcgatcattccgcctccattcttgccaatgtgctgatcggcgtcgtcaacgtcggtatgacaattattgccatgcgcctgatggaccgggccggacgacgctccctgctcatcaatggtctgctcggcatgacgattggcctgctactacttgctttcggtttctggatcggcacatccggcccaggaggagcttccgcctggatcgccattgccgccttgtcgatctacattgccgctttcgccattggaatggggccggttttctggctgatcatcagcgagatatttcccctccatgcgcgagggcgcggcatggcggtggcgacagtcgccaactggggttccaacgccattgtcgcctatactttcctgccaatgctcaacagtgtggggatcatctctacctttctgatttttgccctcatgtcggtggtatccattttcttcacgatccgcttcgtgccggaaacgaccgggcaaaccctggaggacattgagcggagtatgagtgcttcctgatccttccgtattgtgcagcgcacaaatttgcgctgcactgatatcaggatgggtaaggggatctgatcgacgtgcgtttttctttgctggctcttgctgttgcctccttcggtatcggaacaaccgagttcgtcatcatgggcctgctgccggatgtggcaaaaagcctggatgtcagcatccccaaggccgggctgctggtgacgggatatgcccttgccgtcaccttcggttcgccattgttggcaattgccaccgctcgtctgccaaggcgctcaacgctgatgggcctgatggggatattcatcctcggcaatattttgtgcggccttgccggcaattacaccctgctgatgctggcacggattttcacggcgttggcccatggggcatttttcggcatcggctctgtcgttgcttcccagatcgtgccgcgtcatcagcgggcacaagctgtcgccatgatgttttccggcctgacactggccaatgtactgggcgtaccacttggtaccctgcttggacaatgggccggatggcgcgctactttctgggtcgtctcagccattggcgtcatagcctttacagctctggctatatgggttcccgctgttccggcagagcggggcgtcaacatgctggcagagttcaaaaccctccggcgaccacaggtgctgctgaccatgctgatcagcgtgatctgctccgtcagcctgttcacggtctatacctacattacccctctgcttgagcaggtcaccggtttttcagaccgtaccgtcaccatcgccctgctcctgttcggcgtcgggttgacaggggggaattatattggcggtcggctggcggactggaagctgatgccttccgtcgtcggattactgatcgccctgatcctggtgttgcttctgttcaccgggacagtcctcaaccctgccctggccattgcaaccatgatcgtatggggcgccatcgcgttcgctttggtctctcccctgcaattaagagtggttgatcaggccgtggacgcccgtaatctggcatctaccctcaatcagggagccttcaatctgggcaatgcaaccggggcgtggctgggaggggtgatgctgtcatggggattcgggtaccggaccctgcctcctctggccgccgctattgcgttactggctctgggcttgacgctgtatgcgatcagggtggagcacgccaatacggcccacacccggccctgcggccagcgctgagacgcattgcgacagaaaacgttgcacaaacggagaaataccgttaaccgcgtccattcaagtcaatttactatttttctcgagtaaaatgtaaattccacaaaaatggatgtcagaaaaatgcattacctgaagcccatcaaacgcagaagccttcttcaggctgccggtatggcgcttcctgtcgggttgctggtccgaactggctgggccgctactgagcaggcgatacctgacgctggagcacaccagcacgccagcaccggctctccagcattcgcattgccagagccgaaaaaattgcgtgtgacctggaatgcgaattcagtatgcacagtcagcgttccggcagcagcggagcgcggtattttcaaaaagtataatcttgatgtggagctgattaatttcggtggctcgacagatcagttgctggaagcgattgctaccgggaaagccgatgccggtgtcggcatgaccctgcgctggctgaagccgctggagcagggattcgatgtgcgcattaccagtggtattcatggcggctgcatgcgtctgctggcaccgaaggattcaaccatccgcagcgtcgccgatctgcgcgggcagacaatcggcaccagtgatctggctgcccccgacaaaaactttttcactattctggcatatcagcagggtgttccagcagattccatcgactggcgtgcttatcccgccgatctgctcagcgtggcgctcaagaaaggtgaagtgaaggcaatttcccttaacgatccgctggcctggctgatcaaggagcgggagggtctggtggagatcgctaccaacctgacctctccctatcaacacagcgtctgctgcattcttggtatccgtggcagcatggtgcgtgatgacagggcagcagcaagagcactgacagccgccctgcgggaaagtcaggaatgggctgccgctcatccagccgaggctgccgcgatttatgcagcccattccggcaaggtgaaagcagaacaggtcgaaagcatgttgcgctctcacacccagcatcatatgccgagcggacaggcactggagcaggaaatcatcacctatgccgccgcactgcgtgatatcggtgtcattcgcagccgtaccgatccagagcgttttgcaaaacaaattacagcagatgttctgtcatgacaggttccgcttccgccttttccagccagcccggcattcttttgggtcgcagccgtgctgcattctgggtcattggcctgattgctgccttgctgtgggggatcgatggtgccctgatccagctctggccagatgcgaatgatcttggccggagcgactggctggctgccggtgccacgggggtagcagcgtttctgctgcttctgtccctgagcaaccgggttccagccagactgcgctatatcggcccatggcttgtggtgttggcactgctgctgggagcatgggaactcatcacggcaaaactcaacctgctgccacgcccgttttttgctgctccccagtctattctggaagtctacactgatgattggccgcggctgggtaacagcatcggacattccctgatcctgctcggtcttggctacggtcttggcgctgcaaccggtttcgtaaccggggtcgccatcggctggtcacgggccgtaggatactgggcgcatccggtgctgcgccttctcggcccattgcctgctacagcatggctgccactggcatttttcttttttccatccagcttcagcgccagcatttttctgattgcccttgcctcaggcttcccggtggccgtgctcacctggtcaggcgtttccagcgtcgccgccgcctattacgatatcgcccgcacactgggcgcaaaaccgcgttttctggtgctgaaagtagccataccggcagcaatgccctccgtattcgtcggcttgtttatggggcttggcgcatctttttcggtactggtcgttgctgaaatgatgggagtaaaggcgggcctgggctggtatctgacctgggcacagggctgggcggcctatgccaacatgtatgcggcgttgctgctgatggcgctgatgtgctccgggttgatcgccctgctgttccggctgcgtgacagggtgctcagctggcagaaaggattggtgaaatggtaaatcctgccctgaaatctgcttcggcaggtctggatttacggattgaagccgtctcccatgctttccccggtaaggccggtccgctgccggttctgcaggatgttcagctgaatctggaaccgggcagtttcgtcgccctgctcggtccgagcggatgcggaaaatctaccttgctgcgtctcgtcgccgggctggaaccaccggtacagggtcgtatcctggctgatggcaccccgataaccggacctgatcccagccgggtagtcgtgtttcaggatcccaccctctatccatggcgcactgttgaagccaatgtcgggctggggccggaggcgcgtggaaccctgcatcaggatcgacaccgtatccgcgatgcgctgcaacgtgtggggctggcggaatttgcggattcgtatccgcatcagctttccggcgggatggcacagcgcgcagcgctggcaagggcgctggtcaacgatccgcgtttgctgatcctggatgaaccgcttggcaaactggacagtctcacgcgcctgaccatgcagggggaaatccagcgcctgtggcagaatgcagggttcacggtcctgctcgtcacccatgacattgaagaagctctgctgctttccgagcgcgtgatcgtgttcagtgatcggccagcaacagtgttggcggatcttatagtagatcggccctatccccgccatcgggatgatgcacagctggtctcgctcagaaaagaaattctcggattgctggggatggaacggtcctggtaaccgtcccttctccccttaccgggaagatggagcaggctcaggtagcttctgatgggccacaacgggcgtcaccatagccgcagacagaccgggcaatacacccatagcttgattgagacgcgcgcgagcacggccaagctcgacctccgcccgtgcatcggcctccaatgcgtcggacagaagccgcctgacctgataaagattatagagcgtggtctcacctgcctcgaatgaaagacgcgcactggcgagctgctttctggcgacatccagacgctcccgcgcaatccctgcggagattttagcccgttccaacacgttctccgccctgcgaatggccaggccgagaacgcggcggtgctgggtccattccaccgttgcccgggtcaaccccgcctgggccgccgcccggcgtggtatgttgcgggcttcggtggccaacggaaccctcagccggaacccgaatgaggttccttcctccgacatgacaccgccctgctgtgatgaatacaggctcacctcgggattttcacgcaaggtcgtattcacatagcgtatctgggcacgtgccgcctcgatacccgccagagcaagctggatcagcgggtgatcatccagctttctgtcggttgcaaccggctctgaagcaaccagtggttcatcaccgccggtgatggtgctgtaaacagaacggagcctttccgcttccatccgcgcgcgggacaggtccaggtcggccgcaagggtctcattttcaccgaacaatgtatcctgtgacgaaagatcaccgaaatgggcgcggcgttcgacatctttctggatagcctgcgcagtttccagacgctgttccgcaacatggacattcagcatggccaggacagcatcccaccacgtctcacgtagctcccctgccagttgcagggcgcgctccgtcgcgcggcgttcggcctgcaacagatcggcgtctacctgttgaccaaacgcctgacgctgcccgggcaaccagagcggagcgcccaactccacatccgtctgccacaccttgcggggacctcgcgtatccatacggccgccaatgccgacagatggagatcccgcaataggtatgctggtggttgcatgtctggcatcaactgccagcacctcggcctgtaaggagatatattcaggatcgagcgacagcgcacgcagcagatgacgcgcaaatacggtttcggaaatgatggcaggctgactgtccgacactgatttcggaaccggtttttgaagagtgctccgatgatgagagctttccgagccggattttccagtctgatcttctgccgcctgcgccgtttcagaaatgccccccagatcgactcccagagcacccatcaatgtggcagccgagataagggcaacagtcagagggctgaccgagaagtggtacttcctgaatatcattcgggattctccgaagcacctttctttgcacctgcccccgcccccgctgccgccgcccgtgcagctttgggcaaggcaaaacggtcgtaaagaatgggcagcagcaccagcgtcaatgtcgtagccgtcaccagaccaccgatgaccacaacggcaagaggacgctgaatttccgatccaggcccttccgcatagaggaaaggcaccagaccaaatgcagcaatggtcgccgtcagggaaaccggggtcatgcggcgtttcgttccctcaagcacggcagtgcgcagaggcaacctcaactcatattgcagccggttaatatagctgatcagaacgacaccattcagaaccgcgataccgatcaaagcaataaacccgaccgatgcaggaaccgagagaaactcccccgaaatccagagtccgatgataccgccaatcgcggcaaaaggcacattgcagaagaccagtgttgcctgccgcacggaaccgaatgtcagatagagcaacaggaaaatcagcccaagggcaatcggcaccaccatagccagtcttgctgatgcacgttgctgattttcaaactggccaccccattcaagtcggtaggctggaggaatggatactttctttccgacagcctcctgcgcttcggccacgaatccgaccagatcccgcccatgcacattggcgagcacggtctgaaaacgttgcgcctgttcacgaacaacctgcacagggccttctgtttccttgatctgcgccacctgtgaaagctgcacggtactgccagcccggcccggcagagcgatctgaacccgtccgaaatcggccaccgactgcctcagactttgctcaccccgcacgacaagcggaatcctgacttctcccggctccagaacctcaccgacatcggtgccatccacccatactctcagggcacgctgaacgtctttcagatcaagcccgaagcggcccgctgccaacctgtccacagtcaccgacagatatttcataccttcattacgcagcgcgtacacatccgatgcaccgggaatattgctgatgacggcggcaatatccttaccgatccggttgagctcattcagatcggagccgaaaatcttgaccaccacgtcaccacgagcgccaatcaccatttcctgcacacgcatctcgatcggctgtgcaatctgataggaaataccggggatttgctccatcacccctcgtatctgctcaatcaaccagtcaggatccggcttgcgccatttatcccgcggggccagcgtcagaaacatatcggtatcgttcaaccccaccgggtcaatgcccagctcatcagcgccggtgcgggcatgaataccaaccacctccggcacctgcgccatcaagatcttttcaatccggttatccagttctgccgcctccagaacagaaatggatggatgcgtgcgcacactcagaaccggatttccttcatccatgctcggcacaaaagtggaaccgatcccgccaaatgccagaaaagccccaacgacaccgcagccaaccacgcccacgacataaagcgggcggtcaatgatccattccagaaacggatcgtaaaatcgatgcagccatcgcaccagcaagggatccacgggatgaccatgcgcatcctttttgcctccaccccgtaaaaccatggcagaaagtaccggaaccactgtcagagacagcagcaatgcggcacacaacgcaaacgtgatggtgagtgccaccggagagaacatcttgccttccagcccctgcaaagccagcagtggcatgaagacggttacaatgatgatgacacctgataccagcggcacgaccacttcacgcgtggattccgccaccagtcgcagacgctgcggaaaagtcggcggcctgacagcttccgtgaaacggtgcgatgcgttttccaccaccacgacggcacaatccaccagcagaccaatggcgattgccaggccacccagcgacatgatgtttgcggacagaccccaaagccgcatgaccccaaaagttaccagcacggccagcggcagaataatcgacacgaccaaagccgggcgcagaccgccgagaaacagcaaaagcagcacgacaaccagcgttacggcttccagcagcacgcgctgcaccgtccagacagccttgccgatcagttcgctacggtcataataaatctcgatatgcgcgcctttgggcagcagaggcttgatttcctccagcttggctttcacaccatcaacgaccgtacgggcattggcacctgcaagaccaagcacggttgcccataccgcttctcccttcgcattggccaccacgacgccattgcgaggcagggagccatatcgaacctctgctacatcctcgacacggataatgccattggggcgcgaagccagaacaatggagcgcagatcattcaatgtctcgatccgaccggaaacactgaccagcaaggcttcctcgccatcctcgatccgtccggcaccatcatttccgttattggcctcgatcgtatcgagcaattgcttgacagtaatgccatgtgccgccaatgccgccgtgttcggcacaacctcataggtgcgtgacaggccacccatggagttcagatcggccacacccggtaaaccacggatacgcggacggatgacccagtcaatcagatgacgctgctgctgaagatcaagaccaccgccggtgatcgtaaacatcagcatttcgcccagcggcgtaacaatcggcgccagtccacccgacacgcctggcggcaattgcgctttaatgtccgatagtctctctgctacctgctgccgcgcccaataaacatccaccccatcggcaaactcaaaggtcaataatgcgaccgagtaacgtgtggtcgaacgcatcatcaccagataaggaatccccttgattccaagctcgatcggaacggtgacgcgctgctccagctcctccggcgtcaaaccggaggctttcatcgacacgatcacctgtgtcggtgagacatccggaaacgcatcaatgggcaggttttgataggcattggcaccccatacggccagagccaccgccagaagcagaacaatcaggcgctgtttcagcgcaacttcaaccagtctggcgagcatcggatcagctaccgtccgctttggtcagctccgccaacaaaggcaacatgccctcgacagcgacgttatcctgcactgacagatgaccgcggatcgatgtgtaagtggatgtttcgcctataactgtaaccggctgggcacgaaacccaccctccgtctgcacaaatacccagttgtgattgtgatgcctgatgacggcccctactggcacgcgccattgcggcatgcctgattgctcaagctggacggacaccgtgacagcctgaccaggccgcagcccttcggtaccctgcgttatttccgccgtcgccgatgtagcctgcgtggttggatcgacactgcgtccgacgcgaataacctgaccctgcccgccaaaagtcgatacggacactttgttccccggcgccagagaagcagcccgggccagcgggacctgcagatgcacccacaaaggattaaggtgagcaatggtgaaaagaggtgccgcctgtgccactctttcaccagccatactctgccgctgcaaaacggtaccggaaaccggtgcgataatcgtcaaggtcggagaaattgtgcggttttttttcaggactgcaatattcgccgcatccatccccagcaaagacaacatctgcaatcgctcatcaagacgggaacgagcaaaagatgcttcagcgcgggtcgtcaacaagcggcgctcgggaataatatgctccctgaacatggcctcatcgcgcgtcaaccgttcctcagccaatgtggcaccagcctcggcttcaagataaaggcgttgtgcctccaccagctccgtactgcggagaatagcgatcggctgaccctgctgtaccatttcatccggatcgatcagaactgtttctatcagacctccggcaggtgctgcgaccactcttacctgacgaggaggagcctgtacaacgccctgaagagttgcctcggtcatcccggtctcgggagtgacctttgcgacttctataccggccgcctgaatctcccccttcccaagtttgagaagaatgggtttccgatcactctcggcagcgtaaagagtggtgaccaaaataagtaatggcagcagagtgacaagaaataaaggttttctagaccagccagacataaagcaagacacacagtgggataaacaggaccggaatgtcacgcagtattgctcctgcatattttaatatggccatagaaatttccggccagtccagtatgtatgatcgcagagcttttagagaggcaatgagcgttgctctgaatagtctgaatcagtttttctgccgttcagtatatattgtgtgcaacgcaacatcaacatgaagggatcagcaggagaggaataatacacactgccagtaagctgttctccctgtctatcgacataacctgaaacagtccgctgcgaacagggcaataaaaaaccccgcctggaagcggggtttttctggataatcagtgcattgttcaatgcactgcaggctgcgttaccagagaaggcgtggccggtccatgatccatccggcttgtcagattgtacatgatccagatcgagcctgaaacgaggatcagcagcacgaccacggaaaacacaaatgccgtcacgttccagcgctgttcggaggaagcattcatgtgcaggaaaaacaccagatgcaccagaatctgaataacagccaaagcggcaacacccggaaggatcagatgctctggcaccagtttgtaagcgacgatcagaaatgccgccgccgtcaggatcaccgaaagaatgaagccgatgatatacgagccgacgctgccatggcttgaaccatggtcagacgcaccatgcgcatgtgcggtggccatttacagaactcccgccagatagacgaagctgaagacgcagatccagacaatgtccagaaagtgccagaacaggctgaggcaggtcagacggctcatataagccggcgtcagcccttttttcagcacaccaagctgaaacaccagcaccgccatccataacaggccgcaagttacgtgcagcccatgcgttccaaccaaggtgaagaaggcggacaggaatgcactgcgatccggaccggccccttcggcgatcagatgagaaaactccttgacttccatcagaaggaagccaaggccgaacaggaaagttactcccagccactgcagcgttccgcccagccgatgcttgtgcgcctgcagcatcgcgaaaccataagtgatgctgctgaacagcagcagggcggtttcgattgcgacgtccttgagatcgaaaatctcctggcctgtcgggccgcccgcaaactgcgagcgggcgacggcaaaggctgcgaacaggccggagaacagaatgcagtccgtcatcaggtagagccagaaaccgaaaacggtcttcccatgctcgtcgtgatgcgcgtgctcaggactggccggaggatcctgaatggccagcggttcagtcagcatgctgaaggtctccctgcaccgatttgcggagattggcgtcctcaatccgggcgacatctgcagccggcacgtaatagtcgatatcgtcgttacaggttctgataatcagggtcagcataccgccaataacacccagaatagccatccaccagatctgccacaccatgccaaagccaaagaggaaggcaaatacgccgatgatgaagcccgcaggtgtattccgcggcatatgaatgtcttcataatgcggccgcgccagacgacgctgagcctggaaggtttcgctccacagcggctctgcatcatccacttccggaacaatggcaaagttgtagaacgggggcggagaagcagtcgcccattccagggtcggaccattccacggatcaccggtcagatcggcgttacgcttgcgatcacgcaggctgacgacgaactgcatcagctgacatccgatgccggcaaaaataaccacagcaccgatgaaggcgatgatcatccagggcgtccaggcaggattgtcgtagtggttcatacggcgggtagcgcccatgaagcccagcacgtaaagcggcataaaggccagatagaagccgaccaaccagcaccagaaagcacgcttgccccaggtttcgtccagcttgaagccgaacattttcgggaaccagtaattatatccggccacatagccaaacaacacgccaccaatgatcacgttgtggaaatgcgcgatcaggaacaggctgttatggagcaggaagtccgcaccgggcactgccatcaacacgcctgtcataccaccgatgacgaaggtgcagataaagccgatcgtccacagcatcggagccgtaaaacgcacccgcccgccatacatggtgaacacccagttgaacactttcaccccggtcgggatggaaatgatcatggtggtgatgccgaagaaagcattcacgtcagggcctgcacccatggtgaagaagtgatgcagccagacaataaaggaaagaatggtaatcgccacggtggcgtaaaccatcgaggtatagccgaacagcttcttgctggagaacgttgcggtgatttcagagaaaatgccgaacgccggcagaacaagaatgtacacctcgggatgaccccaggcccagatgagattgacgtacatcatctggttaccaccaccatcggtggtgaagaaatgcatgcccagataacgatcgagactgagcagagccagcgtcaccgtcaggatcgggaaggctgccatgatcagcacgttggcacaaaggctggtccagctgaaaatcggcattttcatgaacgtcatgcccggcccacgcatacgcaggatggtgacgaagaagtttacgccgctcagcaatgtgccgatgccggaaatctgaagcgcccagatatagtaatcgacgccgacatccgggctgtactgaagttcagagagcggcggataggccagccatccagcccgggaaaattcgccgatcgcgagagacacattgatcaacacggcagacacggcggtcagccagaagctcaatgagttcaggaacggaaatgccacgtcccgtgcgccaatctgcagcggcacaaccacgttcatcagcccgatcacaaaaggcatcgccatgaagaaaatcatgatggtgccgtgggcggagaaaacctggtcgtaatgttccggcggcagatagccgggtttgtcgccggatgccagagcaagctgggagcgcatcatgatcgcatcggcaaaaccgcgcagcagcatgatatgggccagcacgaggtacatcacgccgatacgcttgtgatcgacagatgtcagccattcagtccagaggtatttccacttcccgaaataggtaatggcccccagcaccgcgagagcagccagaatcatgccactcacagcgcccatgacgatcggcacatcgaacgggatggccgataacgttaatttgccaagcattgtttgtcctcgttagcccgtcacataccctcgtgggacatgctcatgtgggactgatagccatggatgatatggctgaagagaccgtgctccaccttggagtagtaagcgacaggatttttctcgctcggcttggcaagctcggaataggtcttcagatcgagtgtgctggctgactgccgcgccttctgcacccagtcgtcgaagcccttctgatccgtagcgatcaccttgaagcgcatgtccgagaaaccatcgccgttaaaattcgcagccagcccgtcatagatgcctgcacgatcggcaatcaggtgaagcttggtttccattccggtcatggcatagatttggctgcccagctgcggaatgaagaagtcattcatgacggaatcagatgtgatggagaactcaaccggtgtgttcagcggcattgccatctgattgaccgttgcaatcccctgttcgggatagatgaacatccacttccagtcgagggcgacgacctcaatcttcaaaggcttgccggcgacatcaagcggcttgtagggatcaagctcatgcgttgtgcgccaggtgatcgctgccaacacgatgatgattgcacagggaaccgaccagacgatgatttcaagcaccgtcgaatggtgccagttcggacggtagatcgcgtttctgttggaggcgcgatatttccaggcaaacaggaatgtcataaaaatgacaggaaccacgaccagcagcatcagtgcggtagaaaccaggatcagattcttttccgcccgtccgatagcaccggcaggatccatcagatccagcttgcatcccatcaacagaagggcgggaagcaagccgatacaggctgagatacgcgaagaccttcttcggctcattggcactctcttaactcttctgcatgcgcaaccgcgccggcgcagcgacagctgaagccactctatcataaaggcacgacattattcaggccatgggcgtcaactttccggaactgacgcgccacagcccatcatcttatcactaaaagggcagacaggtggacataagcgtcgtccatcggcatttctccctcgttcgtcaacccggacaatttgtcacagggcatgcaaacacaatccttttgactgggacatagaagtcagagcagccattatccggctgaacggtcatcactgccaagcctatcgtgtcagagtattgccgtcagcggccctcatttaaaccatctcccgatggctcgcccattatattctcattcttccagcggcttcagagtttcctccgccccctgtatcgggcaaatcacatagaaaagcccgccccattttttgggacgggccatgatagataccaagaaaggctgaaaaatcagcttctcagggttggatagtcaggttttcggtcatcaagccagcccggccgcagcggcgacttcggcggcgaaatcgctttcaggccccttctcgacaccttcgccgagctggaagcgggcaaagccggtcagtttggcgccggcattcttcacgatggcttttacgcggctttcaccatcatgcacccagacctgctccagcagcacgacttcctcgtaatacttacggatacggccttcgaccatcttctcgataatggcttccggcttgccggaggcacgggcctgctcggtcaacacggccttctcgcgctccagagcggccggatcgacgttatcggtgtccagagaatgtgggttggcggctgcaacctgcataccgacctggcggcccagcgtttccagagcggaaatctctgaagcgctttccactgccaccagcacgccgatcttaccaagccccggcttcacggggctgtggatgtaggaggcgacaacaccctgcggcaccgacagaacgcgggcgcgacgaatgttcatattttcgccaatcgtcgccaccagatgtgtcagctgctcggcaacggtgcgctcagtaccgggatagggcgcggccttgatggcttccacgtcttcaccaaccgtcagcgcaaccctggcggtttcggtcacgaacgcctgaaacagctcgttacgagccacaaaatcggtctcggcattgacttcgaccatagcggcagtctggggagcactcgcaacaccgaccagaccttcagccgcaacgcgaccggactttttggcggcggcggacaggcccttcttgcgcagccagtcaatggctgcttccagatcaccattggtttctgacagcgccttcttgcagtccatcatgccagcgccggtcgtctcgcgcagctctttgacgagggcggcggtaatctcggccatgggaaactcctcaagcagaaatgaatcaggggggcgatgccccctttaaagcccgttcgtcccatcattcctgcatgatattatcgtgtcaccgatgcagggagccacgctgatcattcattcagcaggcaaggaatggaacgccggacaaagatgaccccgcccggaaacgaccttttacagggtgttgccggacggagattgccttgaagtcaggtttcaggcggtggcctgttccgcttccggctcaggcaggatttccggagccaactcctcggcggcaccgaggtcacggccggaagcgatcatctcggcgctgataccatccagcacagcactggcaaccagatcgcaatacatggtgatggcgcggatggcatcatcattgcccggaatcggataggttacgccggacggatcggagttgctgtccagaaccgccacaaccggaatgcccagcttgttggcttcttcgaccgccagcttttccttgttggtgtcgatgatgaaaaggatgtccggcaggccgcccatatccttgatgccgcccagcgcgcgttccagcttttcgcggtcacgcgtaatgtccagcacttcttttttggtcaggccggtcgtgtcacccgccagcatctcgtcgatctgacgcagacgcttgatgctgcctgtgatcgttttccagttggtgagcatgccgcccagccaacggtggttaacgtaatactgaccgcaacgctgtgcagattcagcgacgtattcagccgcggcgcgcttggtgccgacgaacagaacgcgtccaccgcccgcaaccacgtcgcggatggcgcgcagggagcggtcaagcaggggaacggtctgctgcaggtcgagaatatgaacctgattgcgcacaccgaaaataaacggcgccatgcgggggttccaccgacgggtgtggtggccgaaatggacgccggcttccagcagctggcgcagggtgaattcgggcatcgccataagcgtgctcctttcgtcttctggttacacctccgcggggctcaaggcttttggcaccagaagcgccccgcgtgcgaatttgcccatgcaggggacagaatcacctgcggaccgggcggatatggcggaagatgccgtcccttgcaagcacctcgttgcagggctgcgatgttcagacctcctctacccgctccacgcccgggatgagtttcagggcctgccccagacgaggggtgacattgaaaccacccggaagctcgatttccatctcctgatcctcattgagacgtggaatcaggacgacatgccccttccccttcgtatccggacgggacagcaccgcacggatctgcccgatatcggcattgtctttcagccagacgcgcatcatcccggctgtgccccccgccgcatcatcgagaggcataatgtcctgagccgtaatgcggatcgaatcctccccttcggccttgatatcagcagtcaccagcacacaggcaccgatccgcagcgcgtcgcgggaacgggaaagaacctcactgaacaccgtaatttcatagctgccgccagcatcggacagacgcacccaggccatgcggctgccggtgcgggtggtacgctctttcgcattcaccacgcagccggccagacgaacacgctgatcgccatggcgcgccgcatgttcctcgatccggttgctcggaagcaccctcagcttctgcaacgtcaccgtatagacgtccagcggatgggcggtgagatgaaagccgatggcctcggcctcgaagctcagccgctccatatccggccagtcggggcaggatggcagacgcaatggctccggcgtaccggcccccgcaaacagcccgatctggccggagtttttttcctccgatgcagcctgcgcccggcgcaggatcatgtccgccgcgccatgcaccgcagcccggttgggtaccaaggagtcgaaggcacctgcccgcgccagattttcgatctgcatgcgattgagctggcgtgggtcaaccctggctgcgaaatccgccagatcggtgaaggcttgttcgccacgcgcagcgaccactgcctccatcgcggacagaccgaccctcttgatcgcggccagagcatagcggatggcaagcctgccatcctccctctgctcgaccctgaaatctgctgccgagcagttgatatccgggggcaacaccgaaatacccagcctggtcgcttcctgccgcaaggctgcgagcttgtccgtattattgatcgccagactcatgcaggcagccagaaacggctccggataattggccttcatataggccgtctggtaggcaaccagcgcgtaggcggcagcgtgagatttattgaagccgtaatcggcgaacttgaccatcaggtcgaaaatctcgcctgatttggcatccgggatgccgcgtttggaggctccctcggcaaagatggaacgatgggtttccatctccgcacggattttcttgcccatggcacggcgcaggctgtccgccgcccccagcgagtagcccgccagtttctgggcgatctgcatgacctgttcctgatagaccatgatgccgtaggtctcgccgagaatatcgcgaatatcttcgtgcggcggctcccaggcttcgccatgtttgcgctggcagtaggcggggatattcgccatcgggccagggcgatacagcgcgaccgcggcaatcagatcctcgaaacggtctgggcgcatctgccgcagcacatcccgcatgccctgactttcaaactggaatacaccacccgcatcgccacgctggagcatctgataggtacgttcgtcatccagtggcacatgcgccagatcgacactcacccccagaccggccagaaattttacggcccgttgcaggatggtcagagtcgtcaggccgaggaagtcgaatttcaccagcccggcattctcgacatgcttcatcgagaactgcgtgacgagaaaatcggatttcggatcgcggtaaagcggcaccagctccaccagcggccggtctccgatcactacaccggcggcatgggtactggcatggcggtacagcccctcgatctgcaaagcgatttcaagcaggcgtttgaccgcttcgtcgctctcccgcatctgttgcagacgaggctctccgtcgatggcttcctgcaaggtcggcggcttggcgggattgttcgggatcagctccgcgaccttgttgacctgaccgaagggcatccccagcacacgaccgacatcgcgcacggcggcttttgcctgcagcttaccgaaggtgatgatctgcgccacgcggtcaccaccatactcaccacgtacatagctgatgacttcgtcacgccggtcctggcagaaatcgatatcgaaatccggcatggagatacgatccggattcaggaaccgctcgaacaggagattgaaccgcagcgggtccagatcggtgatcgtcagcgcccatgccaccactgaaccggcacctgatccgcgccccggccccaccggaatatcgttcgccttggcccactggatgaagtcggcgacgatcaggaaataaccggggaaccccatgcgggcgatgacatccagctcgtaatccagcctttcgcgatagcgggcacgatcctccggccctgccccgacatcttccattcgccgctcaaggccttcaacggccatagcgcggacggtctcatcctccgtctgcccttcatgtactttcgggcagaccggcagcagtggtttacgagtctccgccatcaccacacagctacgggcaatcgcgattgtgttgtcgcaagcctccggcagatcggaaaacagggcgcgcatcatttccggtggtttgaaccaatggtccggtgtgacgcggcggcgatccgtctccgacagcacccgtccttcggcgatacagagcagcgcatcatgcgcctcatacatgtccggctgagcgaaatagcagtcattggtggccaccaagggcaagccagccgcatccgccagagcaatcaggcccggctcgatcgctttctcgagtctcagaccatgccgatgcagctcgatcaccgtgcgatcaggaaaagcctccttcagtacggccagtaaccgttcggcctcccccttctgcccctccgccaatagacgggccagcggtcctgaggtgcccccagtcagcagcatcaccccctccgcatgcgccagaatcgtctccaacggcagttgcggcttcgcccccggctcgccctgaagaaaacccagcgatgataaacgctggatattcgccagacccgcctcatcccgcgccagcaaaaccagttgatcaggcggcagacgttgttgttgctcaggccgggccagaccgatctgacagccaatgatcggctgcactccctttccggcacaggcctgactgaactccagaatgccgaacagattgccgctatccgtcatcgcgacagcaggcatggccatttgccgcgccaaagccgggattttatcggtcttgatcgcaccttcgctcaaagaataagcggaatgaacccgcagatggacgaaattcgcgtgcgccatgtgccccgatcaaacctcttgaaccatcgcaacaagccggaattacccgaaaaggtcggaaaataaccagaaaatcgacggttttgataaaatcatccgtttcaccgtcttggagtgaaacagacagtcgtttacagtcccgccgctgacgattcatcgccagtgcggcgcgatgcgtcgcgtgacagacctgccatgcggagcccgctgatggacactacccttgatcgtaaccgcgttctagccgctcatggacatcatgaggggctgttgttcgcgctcaacgccattgaagcaaccccttcctatggtggccattaccttcagcttggcaatctgctggcgtccctcggcgaccattcctcagcttcttcagctctgggccgcgctgaaagcctgctcggggccgatgtaagcggtgtgcatgaaggtcttctgtttgcccggaacgctatcaaggcatctccggattatgctggcggctatgtccgtctgggcaatctgctgcatgcgctcggtcagaaggcggaagccaccgaagccttcaggaccgcgctccggattgatccgaaaggtctcgatgcgcagcgtttcctcaatctggcagaaggtaaggtctcttcggccgcgaagccaattgctcagggcactgcctcccatgctgccccgtcccgtccggcaccgcatcgtcctgcaacaccggcaccgaaggaaggattcttccgtcgtttgctgcgtggcctgttcggcggctgaagcaggtttatagacagatcagcagaaaaaccggctcatgagccggtttttttatatcgttttgaaaacacctctgttcaggcaggaacgatttgcccctcacggatggtgacctgacgatccatccggcctgcaagatcaggattatgtgtggcaatcagggccgccacgttctgattccggacggcactcagtaaagccgaaaacacggtctcggcggtatgaatatcgagatttccggtcggctcatcggccagcagcacggcagggccgttcgccagcgcccgtgcgatggcaacacgctgttgctccccccccgacagcatacccggcagatgcgaggcgcgatgctgcaagccaaatgcactcagaagagtcagagcatgctgctccgcctgcctgcgtgttctgcccgcaatcatttgcggcagaacgacgttttccagtgcggaaaactccccaagcaaatgatggaattgatacacgaagcccagatgatcgcgccgcagcgcggttctggccgtatcggacagaccgccggcatcatggctgccaatccagaccctgccctcatccggtttttcaagcaaaccggccagatgcagcaaagtcgacttgcccgtacccgagggcgctaccagcgccacgatttcacccggtcgcagctccagatcggcatgatcgaggaccaccagttcctggtcaccactgcgataacgacgtgcgacctgctccagccgcagggcacaggaagggtaatcactcatgacgcaaagcctcgacaggatcggtgcgggccgcgcgccaactgggatagagtgtcgccagcaccgaaaggatcagggcgagcagcacggttttgatcacctccgcccaatccaccgtatccggcaaagcagtcagcatgaaaaccgatgaatcaaacacctgcccgccactgatattttcaatccagtgctgaatggcaacgatgttccggcagatcgcaatgccgatgactgtgccgattaccgtaccgctgatgccgataaaggcgccacacatcagaaaaatgcgcatgacggccccgcttgatgcccccatggtgcgcagaatggcaatgtcgcggcgcttgtccttgaccagcatgatcagggaggaaatcacgttgaacgccgccaccagaatgatcagtcccagcacgatgaacatcgtgtcctgctgcaccctcagcacaccaagcagcagatcattgctgtgccgccagtcccgtgcaaacgctttctggccgttcagggcctgacgcaggtcaggcacgatcgcatccacctgatcaggctgatgcacacggatttcgatcccggtcgcaccatccggcttctggaagaaaatctgtgccgcatgcaaaggcaaaaatacgacgccgctgtcgtactggctcagcccggccgagaacaccgctaccacccgataggtcgcaacccgtggaatgaccccgatggccgtcgccgccccttctttcgcgagcagagtcaccggatcaccgggacggagccggaatctctgcgccagccccgcccctatcgcaatggcgtcatcgcctttcagatcatccagcgatcccatgacgatatggccgccaatcgcgggcatggcggcaatgtctttcggctccatcccccgcaccagcacaccggttgaaccaccagcatccgtgctcagcagaacctgtccctgaatcatgggcatggctgaggccacctgcggcagcgccttcaaccgcgagacaatcgcctgataatcatgcagttgctcgcccgcataagcctcgatctccgcatgcccgttcacgccaagcatgcggttcacgatatcctgacgaaaaccactcatcacgctggacacgacgatcagcgtcgccacccccaaggcaatgccgatcagtgagaacaacgcaatcaccgatacgaagcgctctcccttgcgggcacgcaaataccgtgcggcaacagcccgttcaaaggcgttgaacaagatcagacagactcccgaatacgcgccagagcatcctcgaccgtcaattccacccgctcaccggtgcggcgacgcttcagttcgacacgcccggcagccgctccacgcgggccgatcaccacctgccacggatgccccatcagatcggcatcggcgaatttcacccccgcacgttcgtcacggtcatcatacagggcatggcgcacaccgatccgtcgatacacatcttcggccatggcatcgcaggccgcatcaccgtttttcaggttcagcaccgcagccctgaacggcgcgatgctgtccggccagatgatgcctgcctcatcatggctcgcctcgatcactgccgcgaccatgcgactgacaccaatcccgtagctgcccatttcaggatgcagcttctgcccgtcacgacctgcaaccgtcatattcaaggctttggagtatttagtgccgaaatagaaaatatgcccgacctcaatcccccgcccggtacgacgacgcgcttccggcaaggcctcataggctgctgtatcgtgcttctcgtcagtagcagcgtaatggcctgtgatcgtctggaaaaaacgctccagatccgcatcggaatcgacattgaaagacgcaccggaccagtcgatttcctcgaacgctgcgtcgtaaaagacctcgctctccccggtgggagcaagaataatgaattcatgactcagatcgccaccgatcgggcctgtatcggccagcatcggaatcgccttgacgcccagacgctggaatgtgcgcatataagacagcatgatacgacgatagctgcgcaccgctcccgcataatcgagatcaaagctgtagccgtccttcatcaggaactcacggccacgcatcacaccgaagcgggggcgaatttcgtcgcggaacttccactgaatctggtaggccatctgcggcagttcacgatagctcttgaccgaatggcggtagatatcggtgatcacttcctcattggtcggcccgtagagcagatcacgctcatgccggtccttcagccgcagcatttcggggccgtacgcatcgtaacgaccgctttcccgccaaagatcagccgactggatggtcggcatcagcacttcctgagcgccgatcccggcctgctcatcgcgcacgatattggcaatggcgttcagcacgcgcagcccggccggcagccaggcataaataccggcggcttcctgctggatcagaccagcacgtaacatcaaccggtgcgaggcaatctgggcctcggcgggtgtttccttgagggtgggaatcagggcacgggaaaggcgcatgggttcatccgtcacaaaaagcctgcggaccctacaattccctcgttcctgccgccagtctccgcagaggccgcacataaaaaaaaggcccgcgcgcatcagcgcagcgggccaaagtttagggaggaaacgccagtcacacggcagaaagaggaacaccctctctctggggcccattatcggtgcaccgcgcagggatggccagcaattttctctcttttttgactgaaaaataagcgtttaaaacagaaaaagcctattttttaactatctgaatatgaatagaagtcatttgattaatctttgggcagcgcaagccatccacttcggaaactgaggtagtcgctgttaatgacagtcatgaaaatgccccacaccacgatggagatcagggtcgtcagcaaagcttttttcagaatttgcggattttcgggtgtaccgcgccacccgctgacatcatcagcctcctgtctggtgcgggtacccagcggcagaatggcaaaaagcagggtccaccagatcaacgcatacagcacgatcgccgtgaaccagccgatatgacgaaacatctgatgcccctgcccttttttcagatacgcagcagatgtacgtctaccagcggacgcttttgcaatttgcgtcccagagcgcgacgcaaggcactacgggcggcctccgtcagcaatgcatcgtcatgccgcagggaagccggcagactatccatagaggccgcaaactcgttgatcaccctggccgcttccgcttcctgcgaatcgaacagccccggtgcgctgagcttgggacggcccatcagatggccatcctcatcgaccgcaatactcgccagcaccacgccattataaagcatccgccgccgtgccgagagcacgccaccattgagtggcaaaagcctgccgccatccagcaccagacgacctaccggagcactgtccacgatttcaggacgcccggagccgaagctgagaatatcgccatcttccagcatcaccggttcggcctgcatttccgctgccagatcagcctgcgccgccagatgacgccattcgccatgcaccgggacagagtaacgcgggcgtaccaactgatagagacgccgcaattcctcccgcgccggatggccggagacatgcacggttgcttcggaatcagtgatcagatgcacgccacggcgcaccagattatcctgaacggtattcactgcccgctcattaccgggaatgacacggctggaaaacaccaccgtatccccttccccaagggcaatattgggatgcgtatccgcggcaatccgggccagtgcagaacgaggttcaccctggctacctgtaacgatcatcagcagattatcatcgggcaccgacagcgcatcatcctcggacaggaactgctgcacatcccgcagataaccgcagtcacgggccgccgtattcagattgcgcagagaacggcccaccagcgccacgctgcgtccggcttcctctgccgccatggcgatgctttccacccgcgcgacattgctggcaaaacaggtcaccgccacacggccgctcaaaccggcaatcgcatctcgcaagccacggcgcacatcggattcggagccgctatgtccctccaccattgcattggtggaatcgcagacgatcgccagcacgccttcatcccccagcgcgcgcaacccttcctcatcggtcggcggaccgaccagaggatcgggatcgagtttccagtcaccggtatgcaggatcgcgccatgcggcgtgtcgatggcaatcgccagagattccggtgtggaatgcgccatgcggaatgtacgcagggagaacggcccgatgctcagcgctccgccgaggggcagaggaagaattctcacttcattctgtaattgcgcttcggacagcttgcgcctcagcaccatcgcggcaaacggggatgcatagacagggcagcgtagttgaggccacaaccatgccaccgcaccgatatggtcctcatgcgcatgcgtgatcaccagcccggtcagccgatcccgccgctccgcaatgaaagagggatcggccatcatcacatcgacttccggcagctccgtgccgccaaagccgatgccgcagtcaatcgccagccaatgctcacccgccgggctgcgcgaccggtaaagattcaggttcatgccgatctcgcccgtcccccccaggggcaggaaagcaatctccgtatgtgtgtcggtcatctcatcctttcagtatcgcggatggatgaccaggcgggaaacaatgcccccgttcagtcaccatccaccattctcgctctgtctcggtttaaaaaaggtgtggggttgcgaagagccagaagtcgcagcccctccaatgtcaaatcgggatcaatccggctgataacctgagtgccttccgagaacagcggcgccagcccgcctgtcgcgaccactttcagcttcgcgccaaattcggactctatgcgggctgtcatgccctcgatcatgccaatatagccccagtatatgcccgactgcatggcggcaaccgtacccttgccgatcaccgattgcggtcgcccgatcccaatacgcggcagacgtgctgccgcctgatgcaacgcttcaagcgacagattgatccccggtgcgatcacaccgccgcaatatgcgccccttttatccacgacatcaaaagtcgttgccgtgccgaagtcgatcaccaccagcgggccgccataagtctgatgcgctgccattgcattgagcagacgatccgcgccgacttcttccgggtgatcgacctgaatgtcgaacccccagtccagtgaagccctggccaccagcggctccacctcgaaccagtcccggcacagtcgacgcagatgatacagggcggcaggcacaacagtgccgatgacggccgcatgcacatcggcaggagtcaaccgcgcatgggtcaacaacgtcagcaaccagacggcatattcatcgctggtccgctgatgattggttgcaatgcgccatgtcccgcgccaacctttttcatcatggaccgcaaaaacgatattcgtgttacccgcgtctattaccagaagcatgcaccatcccttagcaggaagcgatgcgaagcacgacctcctgtttcacagtccggtcatctttatccggtctggtcataagcggcagagagcagaatctcaccggtgtgcaccacccggcattctccgccgcaatcaagcagaagtgcaccatcttcaccaatgccggtgaaaagaccgtccagcacctcaccctgacaacgaacagtcagcctcgttccgggtggatgcgcggcccgccgccaggcatccctgatttcaagcggggccgcatgccgccaggctgaaagtcgtgtcacaattttctgggccagaacctgcggcatgggaaccctgtcgctgatatcggcaaggcaagccgtcatccgtccgggaactacaggagcagaggcgacattcaccccgattccgatcacgagccattccggctctgcggcagctatcgccgcatcaatcaggataccacccagcttgcggtcgccgaccatgatgtcattgggccatttcaggaacactgcctgaggatcatccacgtaaggccatatcgcatcgaacacagccaggccggccacgaacgcccagtgtccggcttcccgtgcactgagaaaagccggcccctgtccgggcctgatcagcagggaaagcgcaagattcccttcaggctctgtccaggcacgtcctctcgtcgcgcggggcaaagtttgacgaagagccagcacagccagaccatccggctccccctgcgatgcccttgccaccagataatcggacgtggaaggcagtgaggcatgaacctccagacgccaggggtggggaagagtatctccttccccatctgtcagactcaccggagcaaagccttggccgccagatcagccgccgcaaggatcggggccgggaacaggaagaacagggccgtgaatatcgcactgccaaccgcgactacagaaaccgaggtcggccaggcttcgaacgggccttccgacgcatcatcaaaatacatcaccttgacgacgcgcagataataataggctccgatcacgctggtcagcacaccgatcaccgccagcccccacagcaggggctcccccgcctgaacggccgccagaaacacgtagagcttgccgaagaaaccggacattggcggaatcccggccatgctgaacatgaaaatggccagcaacagggccaaagccggatcggttcttcccgcgcctgccagatcgctgactttctccagctgccgtccacgccgacgcatggcgagaatacaggcaaacgtaccggtattcataaacacgtaggtaaccagatagatcaacaaaccgcggataccagcctgcgatccggctgccagccccaccagtgcatatcccatatggccgattgaggaataagccatcagccgcttgatgctcgtctggccgatagcagccagcgccccccacaccatggaaaccacggagataagcgctacaacatgctgccattgcaccaacacgccatggaaaggtgtgaccagagtccgcagcatcatcgcaatcgcggcgaccttgggcgcagtgcccatgaaagccgtcaccggggttggcgacccctcatatacgtccggcgtccacatatggaacggggccgctgaaatcttgaacgcaagccccgcgatcacgaacaccaccccgaccgtcagcccaggcgacgtgcccgccggatgtgccaatgcttcacgcagggcggagaaatccatggtccccgcaaatccatagatcagcgaaattccgtacagcagcaggccggatgccagcgaaccaagcacgaaatatttcaaccccgcttcagcagagcgaagttcatcccgcgcaaacgccgccagcacgtagatggccagggacatcaactccagccccatatacagggtcatgaagttggaagccgacaccatcaccatcatgccaacggtggaaaacagcgtcagaaccgggaactcgaacctctccatcccatgatggcggttataatccagcgacagcacgacagcgatcgatgcaccggacaggatcagcagcttgaccatgaccgcaaacggatcggccacgaactgtccctgaaacccgaggccaagcgcgccggaaacagtcagcagccccgtgaccagaaatgcaccgagcgtcagcatcgcgcaaaggaacgtatcctcgcgccggttccgtgccacaccgaccagcagaatgaccagtccgcacagggccagaacgatctccggagaagcgagagtccagttcatgagtatagggccattccgttgggcaaagttttatccccgcgtcagggagtgactgacgccagctgatgcatctggctgatcgccgcctgatgctgttgcaccagatcattcaccgtcgcatcaaagaaatgcgtgaagctggatggatagacgcccatccacagagtcagcagcaccagcggcacgaacacgacgatttcccgcgtgttgagatcgaacatggagcgtagctcgccaagggtcatccggccgaggattacacggcgatacagccacagtgaatagaccgcgccgagtatcatgccggtgctgcccagcagggcaatccagatgctgaccttgaaagcaccgatcaaaaccagaatttcaccgacaaacccgccggttcccggcaagccaatggttgccatggtgaacacaaggaagaccgccgcataggccggcatccgctcgaccagcccgccataacggttgatctccagcgtgtgcagccggtcgtatacgacacccacgcacagaaacaacgcggcggaaaccacaccatgggacagcatctggaacagcgcgccacttaatccctgctggttcacggtaaagatgccgatggtcacaacgcccatatgcgcaatggatgaataagcgatcagctttttcatattctcctgcgcgaaggcgacgatggaggtgtaaatcaccgccatgaccgacagggcaaacatcagcggggcgaaatactccactgcatcaggcagcatgggtaccgagaaacgcaggaagccgtatcctcccattttcagcaataccccggccagaataacggacccggcggtcggtgcctccacatgcgcatcaggcagccaggtgtgaaccggccacatcggtactttcacggcaaaagatgccagaaaagccaggaacagccagaactgcatatgcaccgggaagcgggtatgcagcagggttggaatatccgttgtcccggcatagtgccacatggtcagcagcgccagcagcatcaacaccgaaccggccagcgtgtagaggaagaatttcagcgccgcataaacccggcgcgcatgcccccagatgccgatgatcagatacatcggaatcagcacggcttcgaagaaaatatagaacagcaggaagtcggtggccgagaacattcccaccatcatggtttccagcaccaggaaggcgatcatgaactcccgcacacgggtatggatcgcatcccagcttgccagaatacaaataggcgtcaggaaggtggaaagcagcacgaacagaacgctgattccatcgacaccgacgctgtagcgcacaccgaattcgggcagccactgcacggattcaacaaactgcatacccggctgggccgggtcgaaccggacccacagaaccaggctgaaggcaaacaccaccagcgaggtccatagcgccgtccagcgcgcattgtttgccacaacttcctcatccccgcggatcgtcatcagaatgacgaccccgagtagcggcaggaaggtcagcagagacagtacgggaaagcccgcctgattcatgacatcacctgaagatgaggaaaatggaaaccagagccacaaggccgatcagcatggcaaaggcataaaccgcgatggaccccgtctgaagcttcacaaccctggaggagccatcgacagtcaggctggcaagaccgttcggaatgccatcaatgatggtggcatcaccaaccgtccagagcagccgggcaaagcactgataaggacgcacgatcaggacagcgtagatctcatcgaaataccatttattggcgaacaaacggtaaatcgccgggaacattgccgccagacgtgcaggtgcgccgggattgaacatatacatccaataggccagcgcgataccgagcacaccgagaatggtcggcaggatcgaggcaaggaacggaatatgatgcatctcatgcatcacatgattatccggcccattgaacacagccccacgccagaaggcgctcatgccctcgccgatgaaccagtgctccagcagcatgccaccggcaatagcgccgatggacagcagcgcgagcggcgccagcattaccagcgggctttcatgcacatgttccatggtgtggtggtcggcacgcggcttgccatggaacgtcatgatcgtcagacgccaggagtagaacgcggtcaggaaggccgcgagcgtaccgcaaacatagccgtaaaatcctacaccaccctgtgcccaggcggcttccagaatggcgtctttggaatagaacccggcgaaaggcggaatacccgccagcgccagattaccaatccacatcgccgcataggtgaacgggatcattttccagataccgcccattttgcgcatgtcctgctcgtcggacatggcatggatcacgctgcctgctccaaggaacagaagcgccttgaagaaagcatgggtgatcagatggaacaccgatacttcataggcacccaccccagccgccacgaacatgtagccgagctgcgaacaggtggaataggcgatgactttcttgatgtcgttctgggcgcaaccgatggtggcagcaaacagggcggtggtgccgccgatcagcacgataaaagtctttgcatccggcgcgaattccagcagtggcgacatacgcgccatcaggaatactccggccgtcaccatcgttgcggcatggatcagcgcagaaaccggggtcgggccttccatcgcatccggcaaccacacatgcagaccgatctgcgcgcttttgcccatcgcgccgataaacagcaggaagccgatcacctcgaaggtgcgcagttcggttccgaacaggtgataatggtcattcacatgctgggaaacggttccgaaaatcgccgagaactcgatggagccaaaggtccagaacaccagcgcgatgccgacggcgaaaaacaggtcgcccacgcgattgacgatgaaggccttcatggccgcagcattcgcgctgtccttgtagtaccagtatccaatcagcagatagctggccagaccaacgccttcccacccgaaaaacagctggagcagattatccgctgtcaccagcatcaacatcgcgaaggtgaacagggagagataggagaagaaccgataattcggcaggctgtcatgcgccatatagccagtgctgtagacatggatcagcgtggcgacaaacgtcaccatcgcgaccatgacagcggatagcgtgtcatagcgaagcgcccagttgacatgcagatccccggcctgaatccagtcggacaccctcatcacatccggcaggcttcccggcggtgaggaaagcagcgtgtagagagacagcgaaccacagatcgctgcggcaatcatcagcgcgattgtcaccacctgcgcggcacgatcccccatcacccgtccgaacagaccggcgatcacggaccccagcaggggggcaaagactgcgacggcgtagatcatcgctcagcccttcatcagattcacgtcttcgacctggatcgaaccgcgattacggaaataaatgaccagaatggcaagaccgatagccgcctctgcggcagccacggtcaggatgaacatcgcaaagacctgcccggcaagatcgcccagcgaagcagagaacgctaccatgttcaggttaacagcaagcaggatcagctcgatcgacatcagcatgacgatgacgtttttacggttcagaaagatgccgaaaatgcccagcacgagcagaaccgcggccacggccagataatggcccagccccacagtcataaaggaattcatacacgatcctccgctgcgtggtgagcattctgcggcaaatgagtgctggcaccgtgatcatcctgaccgatctggccatggttcggtgcgggctttgataaggcaggcggcaggggacgcagaaaatcttccggatggatgccctgcccgaccggagcattcaccagttgcagcgtgtcctcaatccggcgattgacctgctcggcaatgttctgatgccgtgatgtcttgcgatcacgcaaggtcagcacgatggcaccgatcatggcgaccagcaggatcagccctgccatctgaaacaacatcacgtaatgcgtataaacgatctgacccagcgccacagtattttgtacgtgatcaggacgcggggaaaaacgcagagcgctcgctcccggtgcgacctgccatccccccagaaccatcgccagttccacgagcagcacaccaccaatcgccgcaccaaccggcgcgtaacgctgccacccatcccgcacttccgcgaaattgatgttcagcatcatcaccacgaacaggaacagcaccgcgactgcgcccacatagacaatgaccagaatcatcgccagaaactcggcccccgtcagcagaaacaggcccgccgcgttaaaaaacgccaaaatcaggaacagcaccgcatgcaccggattgcgggcgctgacgaccatcgcccctgatacgatcaggatggcagagaaaacatagaatgctatcgcggcgatcatgatcgtctcaccggtacggcgcgtcgagttcaaggcgacgggcgatttccggttcccaccggtcgccgttcgccagaagacgatccttgttgtacatcagctcctcgcgcgtttcggtggcgaattccagattcggcccttccacgatcgcgtccaccgggcaggcttcttcacacagaccgcaatagatgcacttggtcatgtcgatgtcatagcgtgtggtgcggcgtgagccatcggcacgaggctcggcctcgatcgtgatcgccagagccgggcagacagcctcacacagcttgcaggcgatgcagcgctcctccccgttcgcataacgccgcagcgcatgctcgcccttgaagcgcgggctgatcgggtttttttcgtacggataattgatggtcgccttcggcttgaagaaatacttcaatgtcagggccatgcccgaaacgatttccgtcagcagaaaactgcgcgcggtgcggtccagcaacgccatgtcagcccctttccctcaacacgcaatcactcatacacacggtcatcgtcaattcaccgtcggcagccagcctgccagctccagcacgcaggcggtcagcagcagccacaccagagaaaatggcaaaaacactttccagcccagacgcatcagctggtcatagcgatagcggggcacagtgccgcggacccagaaaaacacgaacatcagcgcacagactttcagcacgaaccagatcggccctggcacccagttcagcggcacgatgtcgaaaggcggcagccacccgcccaggaacagcagggtagtcatcgcacagatcatgaacatgttggcgtattcgccgagaaaaaacagcgcataagccatggcgctgtattccaccatatgtccggcgacgatttcgctttcgccttcgacgatatcgaatggagagcgattggtttctgccagcccggagatgaagaaaatcaccgccatcggcagcatcggcagcacgaaccagacatgtttctgtgccagaacgacatcgttcagattgagtgatccaacacaaagcaggatcgcaaccatgacgaagccaattgaaacttcgtagctgaccatctgtgcggcagcacgcagcgcacccagaaaggcgtatttggaattcgaggcccagcccgcgataatcacgccataaacaccgagcgaactgatcgcaaacagatacagcacaccgacattgatattggccacggcccagccatcattcaccgggacgacagcccaggcgatcatcgccagaataaaggtcagcagcggggcgagaataaacagaaccttgttggcgccatccggaataatcgtctccttcaggagcatttttccagcatcggcgaaggcctgcaacatcccccatggaccaactacattggggcctttacgcaggccgatcgcggccagaaccttacgctcgaatacggtggcgtaggccaccatcagcatcaacgggaccagaatggccaatgcctgcaaggccgtgatgatcaacaggccgagattggtattgaacagaaaatcgtgcattccgctcactccgccgcactcggcaaggctgcctgagcagtctcatagacccgtacacactccgccatggtcgggctggcacggctgacagggtcagtctgccagtagctgctgatggcatagctaacaggggccgtgctgattgttccctgagcggaaggtccggaaggatcggtgcagccacgcactggcagatcatcgatcacggcaaaagccggattgacctcgatcagccgcgcccgaacggcctcaatcgtatcgtagggcagcggacggtcgatcacggcactgaaagccctcaggatgcgccagtcatccttggcatccttcaacggatgcacggcacggttggcctgctgcacccggccctctgtgttcacataagtaccgtctttttcagtataggccgcgccgggcaggatcacatcagcccgtgccgcgcttttatcgccatgcgacccctgatagaccacgaatgtatttgccccgatccgggccgtgtcgaactcgtccgcacccagcagccagagcagatcgacgccaccatccaacagacgcggcaatccgttttctccgcccggcggcactgcgccaagcatcaacgcaccagcacgtgatgcggcagtgtgcagcacgttgaagccatgccagccagcattcaacgcccctacctgatcggccaatgcccagcttgccgccagaatggcagccccatcaggacgtgccagcgccccctgcccgacaatgatcatcggcttttttgccgcgcgcagggtttcgacgaatgcgaaatcccccgctgatagcgccgacagatcggtccccagccaatcgacctgataagtcaggtcaagcgatgcgccgaaggaagcaatgggaagctgggtcgccagccagtgtttgcgaatgcgtgcattcagaaccggcgcctcatgacgaggatcggtgccaatcaacaggatggcatcagcttcttcaatgccggcaatggtcgaattgaacaggaagaaatcaccacgggacgcatccagcgccgcaccatcctgccgacattcgatcagggatgatcctgcaccggccatcagatctttcaatgccacgatgctttccgcatcggccagatcaccgatcagcgcgccgatccgtgctccatccagaccctgcatacggctggcaatagcctgaaaagcctcctgccagttggcctgccgaagagtgccgttctcccgcacccatggcgtatccagacgacgacgacgcaggccatccaccgcaaaacgggatttatcggccagccattcctcgttcacatcctcattgatacgcggcaacacccgcatcacttccggaccacgggcgcacagcacgatattggccccgaccgcatccatgacatcgatgctgtcagtcctgttcagctcccaaggacgagccgtaaaggcgtacggtttcgaggtcagggcaccaaccgggcagatatcgatcaggttaccggacagctcactggtcagcgctttttcaacataggtgccgatctcgacattctccccgcgggaggtagcccccagttccggaactccggcaatttcctgcgcaaaacggacacagcgtgtgcactggatgcagcgcgtcatcacggttttcaccagcggtccaaggtacttgtccttcaccgcccgcttgttttcctcaaagcgggagtgatcccgcccgtaagcaacggattgatcctgaagatcgcactctccgccctggtcacagatcgggcaatcgagcggatggttgataagcagaaactccatcacaccgcgacggccacgacggaccatctcgctgtcggtttttaccaccatcccatcagcaaccggcatcgcacaggacgccaccggcttcggcggccccttttcgatctcgaccagacacatccggcagttaccggccacagacagccggtcatggtaacagaagcgcgggatttccttgccggccatctcgcaggcctgcaaaacgttgaacccggatggaacctcaagctcggtgccgtcgattgtgactttcaccatgctgattactccgccgccgcgggaaggttgggaaccggcgcccgaccgggaacacgctgtttataggcgcggatacgatcctcgatgaccgggcggaaatgacggatcagcccctgaaccggccatgcggccgcatcgcccagcgcacagatcgtatgaccctcgacctgtcgcgtcacctgctccagcatgtcgatctcctcgagatcagcgcggccttcgaccatgcggttcatgatcctcatcatccaacccgtgccttcacggcagggagtgcactgaccacaactttcatgcttgtagaaatggctgagccgagcgatcgccttgatcacgtcggtggatttgtccatcacaatgaccgcagccgtgcccagcccgctgcgctgttcccgcaggctgtcgaaatccatcagcacatcgtcgcagatgctcttcggcagcagcggaaccgatgatccaccgggaataaccgccagcagattatcccagccgccacgcacgccccccgcataacgctccaacagctcccgcaggggaatgccgagttcttcctcaacattgcacggcttgttcacatggccggagatggaaaagagttttgtaccgctattcttgggccgccccagagaggcaaaccaggctccgccacgccgaaggatcgtcgggcaaacagcaatgctttcgacgttattcaccgtcgtcgggcatccataaagaccgacaccagccgggaaaggcggcttcaggcgtggcatacccttcttgccttcgatgctttcgatcagcgcggtttcctcaccgcagatataagcaccagccccgcgatggacgtacaggtcgaaatcccagccgctgccgcaggcgtttttgccgatcaggccagcctcataagcctgatcaatagcagcctgcaagtgacaggattcattgtaaaattcaccgcgcacataaatataagccgtatgcgcccccatcgcaaaggcggcgatcaagcagccttcaaccagtttatgaggatcatgccgcaggatatcgcgatccttgcaggttcccggctcgctctcatcggcattaacgacgaggtaatgcggacggccatcggattccttgggcatgaagctccacttcataccggtggggaaacccgcgccaccacgaccacgcagaccgctgatcttgatgtcctcgataatggcgtcgcggcctcgcgccagaatggctgccgtgccatcccagtccccgcgcgccagagcgcccttcagcccccaatcatgctcgccgtacaaattcgtgaagatgcggtcgcgatcgttcagcatcgcctgccctcagccgatagaagccggcggtgtggaaccggccccattttacatacgacatacaatccagtttccggctggagagaatgtcggtcctcactcgccgcgaagcggcagatcagtgttccattccgtgcggtcactcccctgctgcgggcggtgtatgattgccctgcatcagggctgaaggcacgtcacgcaacgttgtcgggccaccctccggcgcggagttctgacgacccgacatagagccaggtgtcgggcgctccccgcggcgcaaggcctccagcagaacgagggtccggggaccatccatatcctcgtaataatcgtcatccacctgcaggatcggtgcattgacgcaggcgccaagacattcgacctccgtcatggtgaacatgccatcctcactggtttcgccccagccctggatacccgtcgccgaacggcaggccgctacgacctcatccgagccacgcagccagcacggtgtggtcgtgcagagctgaagatgatgacgccccaccggccgggtattgtacatgaagtagaaagtcgctacctcataaacccggatcggcgccatcccaagacggcgcgcgatctcatccatcgccgcacggggaatccatgcactgccggtctcacgccccatctgccgctgtgccagatccagcagtggcattaccgcgctcgccctgcgggctggcgggtacttggccaggatgatctctatgcgttgctcgctctgcacatcgaacgagaattccgcaggctgccagggctcgcgcccgacatcactgcctccgttgacgtccgccatcagcggtccacctcaccgaacacaagatcaagcgagccaatgatcaccaccgcatccgccagcatatggcgatgggccatgacatcgatcgcctgcaaatgagcaaaaccggtcgggcggattttgcagcgataagggcggttgctgccatccgagaccagatacacaccgaactcccctttcgggctctccaccgccgtataagtggctccctctggaacgtgatagccttccgtataaagcttgaagtgatggatcagagcttccatcgaccgcttcatctcggcgcgagggggtggcgtgatcttgtgatcctgcaccttgatcgggccggggcggattttccccaggcactgctttacgatgcgcacgctttgccgcatctcctcgacccgcaccagatagcggtcatagcagtcgccattacgaccgaccggaacctcgaaatcaacgtcggcatatttgtcgtagggctgggacttgcgcagatcccacggaatgccgctggcacggatacagggaccgctgaaaccccaggccagtgcctgttccggcgtcatacgaccgatatcaaccacccgctgcttccagatgcggttatcgctcagcagaccggccatatcatcgataaaggccgggaatttttcggtccagtcggcaatgcggtcggtcagacctgccggcagatcctttgccaccccaccgggacggaaataattggcatggaatcgggcgcctgataccgcctcgtggaattccagcagcttttcacgctcttcgtgtccccacagcactggcgtcatcgcaccgccatcgagcgcataagtggtgaggttgagcaaatggttcaggatgcgcgtgatttccgcaaacatcgtgcggatccactgtgcacgctctggtgcggtgattcccagcagcttctctgttgctaaagcgaaggcatgctcctcgcacattggcgagacgtaatcgagccggtcgaaataaggcagggcctgaagataggatttgtattcgatcagcttctcggtaccacgatgcagcaggccgatatgcggatcggcacgctccaccacctcgccatccaattccagcaccagacgcagcacgccatgggcggcaggatgttgcgggccaaaattgatagcgtggctatcgatttcaacaacacggccctgcttctggacggtctcgctcatcgcttcgcctcctccgtcacgaccggttgcggcggagtgatgccgatggatgctttttcatcaccgggcagagtcgtcattccttcccacggagacaggaagtcgaaattacgaaaatcctgagtcagcttcaccggctcatacacgacctgccgtcgttcttcatcccagcggagttcgacataaccggtcagcgggaagtctttccgcagcggatgcccctcaaacccataatccgtcaggatacgccggtggtcgggctggccggagaacaggatgccgaacagatcccaggtctcacgctcgaaccaggtcgccacgggccagattgtgtggaccgaaggcaccggcacgccatcatccgttcccacgatcatgcggattcgatgattcagggatattgaaagcagattatagacaacatcaaagcgcggagagcgtgaaggccagtcgaccccgcatacatccatcagctgctggcacaagaaacgcggatcatcccgtaaggtcagtgccactgcctcaagctgatcgcgtgtaacctcgacgaccacctcatttttttccagctgcgcacgtgtcacgccatgaatggcagagagagaatccagcaattgagattgatcagccacggagaatggttcccgtccggcgaattttcttctgaagctgcatgatgccatacaccagagcctccgcagtcggcggacagcccggcacatagacatcgacaggcacgatccggtcgcagccccgcaccactgagtaggaatagtggtaatagccgccaccattggcacaggaacccatgctgatcacccagcgcggttcgggcatctgatcatagaccctacgcagggcgggggccattttatttgtcagggttcctgccacaatcatcacgtcgctctggcggggggaagcgcgaggaataaccccgaagcgatccagatcataacgcggcatgtaggcgtggatcatttccactgcacagcaagccagaccgaaggtcatcggccagagactgcctgtgcgcgcccaattcaccagcttgtcgagattggcgaccacaaagcccttatccgccatctctcccgtgataccacgcagcacggcctcctgccccggcccgggcggcaaagcctccctgttccagagcatcgcctcatctgctgtcggagcatgggcggaaggatactggctctgcatgatgctttactcccactccagcgcgcctttgcgccattcatagatgaagccgacagtcagaacgcccagaaagcccatcatggagaaaaagccgaacatgccaatccgggaaaggctgactgcccatgggaacagaaatgccacttccagatcgaaaatgatgaacagaatcgccacaagataataccgcacatcgaagcgactgcgagcatcatcaaaggcatcgaagccgcactcataaggcgcaagcttttcagcatagggtttctgccgtgccgccagataggaaccaccgaccatggcgcaggcaatgaccgtagcaatcccgataaaaaccagaatcggaaaatattctgtcagcacaggctgcataggacatcatcccttccgaaggccgtggaagcgtggccatcgagatttctcagtgttggaggcaatacggaaacaccactgcctcgatagaaaaggtttatcgcaccgcgccacacatcgcaacggagcaaacctaactaacaccatccccgtccagataagagggggatcaaaagattaagttattttttaattttgctgaaagctcgccatcaaacgaaaatggcgcgagtgacggggctcgaacccgcgacctccggcgtgacaggccggcgctctaaccaactgagctacacccgcgcaacagcgaggggcgcttcctacgctttgatggccccatcgtcaagcgcatggacacagaaaatatgtatgccacgatggcgtcctcctcttcaccccatgaataagagttatgactgcgcgtaacccctgaactcaccccttgcggttgatggaacgcagcgcacgccgacagattctggccgtagcaagacccgcactttcagcgctccattgcgcacacagggaccgaacccagtcaggctggtccttgctggcatcattgagccaatttccaacagaatcctgcacataaggtgccggatcggcacgcaatggctgaagaacaggcaatgcctttccgggacattgccgcaaagcacggagatgggagcaccacaccccacgcggccgggtggcttcactggcaaagcgtcgcaggcgttcggaagagtccgtcgtccacccggccaataatgcaagagcatgatcaaggtctgcggcgatatgaggccggaccgccatccatgcccattcccgaacaccgaaatgatgatcatcggcaaagggtcgaatcatcgctaaacgctccgcaagagtttgtcctgctgccacgcccaccatgaaacacgcccaaccgcgcacagtgtccgaggaatggttccgcagaatatccagcccagccatgccgttatgctcaaagatcagactggccgccaatgccatgcggcgcaaaattccttcttcttcctcacgctgcattttcagaatggcatcaggcccaatagcaggaaacacttgggacagcagggaggcaaaattaacactcaaacactcggagagcgtcgtggcttcaatggtacctgcattcagcaaagcgaggcgggcaggctcaatcactgcaacacgcggcacggcgctcacccttcaatagccaaaggcacatcaaaaaagcccgcaaagatggcatgaccatcctgacgggcaccagatcctatcaagaaaaaatgagaaactggcgcgagtgacggggctcgaacccgcgacctccggcgtgacaggccggcgctctaaccaactgagctacacccgcgcaacagcgaggccggttcctacaggctgccgatgctgccgtcaaacccttccggatcaaagttctggggataactccagataatccggatgcagacagcaccataaacctatggtgggcggtgacgggatcgaaccgccgaccctctcggtgtaaacgagacgctctacctctgagctaaccgccctgacctcagtgagcgccctataaaccgatgcacgcgcacggtctactgcttcgacagcaggaaacggaaatcggccaggtaaaatccttattcccctgaagaatcctgctcgttcaaagcatctttcagtgtttttccagccttgaaacgtaccgacaaggcaggcggaatcgctatttcttctccggtgcgtggattccgcccgacagatgccttgcgggaggctacggaaaacgagccaaaccccaccagccggacttcctcatgacgcttcaaagcagactcgatgctgcccagaaccgcatcaaccgcctgtgcggcccggctacgcggaagctcaagctcatcggcaactgccgtgatcaattccattttgttcaacgtcagtcccctgccccgcgtgacgataaaagccggtcggcaattaaaggatccgcttttatgccgtcaacgtaacagagagtcgccaaagtgcaaaaagtgaaaattcatccctctgcctgatcctcagatataaaaaaggggagcggtgctccactccccttttccgaaaccaacaagccgtcaatcaatgcggcagagaggtttcactgacctgaccggattttttggtcacggattcctccatgctctcatcccaggttatcgcctccggcttcctcaccagagcctgcccgatcacctcatcgacatgggaaaccggaacgatccgaaggtttttcttcacgttatccgggatttcagccagatccttctcattgtccttcggaataaagacagtggacaatccggcccgcagcgccgccagaagcttctccttcaacccgccgatcggcaaaacacggccacgcagggtgatctcgccggtcatggcgatgtcacggcgcaccgggatgccagtcagcacgctgacgagactggtcgccattgcaatccccgccgaggggccatccttgggcgtcgccccttcaggcacatggacgtggatatcacgtttctcaaacacagtcggcttgatgccgaagctggcggaacggcttcggacatagctgagcgctgcggatacgctctcctgcatcacatcacccagtttaccggtatgcttgatggcgcctttaccgggcagcaaaacactctcaatggtgagaatttcgccaccaacctcggtccaggccagaccggcaaccacaccgatcatgtcctcagcctcaatctcgccatagcggaatttctgaacgccagcgtatttctcaagattcttccggttaatcgccaccttcttggcttttttggtaacgatttccttcaccgccttacgggccagaccggcaatttcgcgctcaagattacgaacgccggcttcccgcgtgtagtagcggatcaggtcgcggatcgcgtcctcagtaactgaccattcctccggcttcaggctatgagcctcggtctgcttctgaagcagatggcgcttggcgatctctactttctcatcctcggtatagccggggatacggatgatctccatgcggtccagcaaaggctgcggcatacgcaggctgttggccgttgtgacgaacatcacgtcggacaggtcgtaatcgacctccagataatgatcggcaaaagttccattctgctccgggtccagcacctccagcagcgccgaggacggatcaccacgccagtcggatccaagcttgtcgatctcatccagcaggaagagcgggttcgaggtcttggcctttttcatgccctgaatgaccttgccgggcatggaaccgatataggtccgccgatgaccgcgcacctcggcctcgtctctcacgccacccagtgacatgcggacaaaattacgccccgtcgccttggcaatcgacttgccaagagaggttttgccaacaccgggcggccccaccagacagaggatcggaccacgcagcttgtcagaacgggactgcaccgcaagatattcaaggatacgctccttgaccttttccagcccgtaatggtcggcatcaagcaccttttcggcttcctcgacgtcgttacggaccttgctgcgcttcttccacggaatacccagcatccagtccagataattccggaccacggtcgcttcggcgctcatcgggctcatgctgcggagctttttcagctcgctcagacatttctcggtggcttccttggtcagacgggtctttttgatgcgctcttccagctcggcgatttcgtccttgccgtcttcgccttcacccagttccttctgaatggccttcatctgctcattcaggtaatattcgcgctgggtcttttccatctggcgcttcacgcgattgcggatgcgcttctcaacctgaagaacgccgatctcgctttccatatgcgcaaagacacgttccaggcgctcagagatgggaacgatctccagcaattcctgcttctcggcgattttcaggctcagatgactggccaccgtatcggcaagcttgctgggttcctcgatctgattgactgagaccagaacctccggtgcaatttttttgttgagcttgatatactgctcaaactgcccgaccacggtgcggcccagtgcctccagttccttgtccgtctccccggtatcagccagaatctcggttttagcctcaaaataggcctccgtctcgccgaaacccgtaatacgggcgcgtcggctgccctccaccaacaccttaacggtaccatcaggcagcttcagcaactgcagaatcgtggaaacagtaccgatccggtaaatatcatcaataccgggatcatcctgcgaggcgtttttctgggcgaccagcagaatctgcttgtcgtccttcatgacagcttccaacgcgcgaacagatttttcccgcccgacgaaaaggggcacaatcatatggggaaaaacgacaatatcacgcaggggcaggacgggcagcatctcgccctcagtgccggaaccctgtgtttcgttctgtggtgtggcgtccgtcataggggacttcctttcaacgacagcctgccgcctctatgccccgttacaaggcacatagcagcgacggcaccgtccagaaaaaccgtcatcatcagacttctctggcggttcatggggcttcccccggaatgggcagaagcagactcgagtcagcagcgcttgcttcggaaagaggaattggcagcatcatgagggctgattccaattccgaaacataaatgaggattgcgcaatcaggcgctctcctccgcgcgttcttctggtccgtatgtcatcagcggtgcggcacgaccctcggccacttcaccgttgatgaccacttcttcgacgttttccatccccggcagatcatacatggtgccgagcaggatgccttccaggatggaccgcaggccgcgcgcaccggttttacgggcgatagcgcgattagccacggatttcagggcatcatcggtgaaggaaaggctcactccctccatctcgaacagacgaccatattgcttcaccagagcatttttcggcttggtgaggatttcaatcagggcggcctcatcaaggtcttccagcgtcgccaccaccgggagacgaccgatgaattccggaatcagaccgaaacgcaacagatcctccggctcgacctccctcaggatttcaccggtgcggcgttcatccgggtcgcggacctcggcaccatagccaataccgcccccctttccgcggctaccgatgatcttttccagcccggcgaaggcgcccccgcagatgaaaaggatattggtggtatcgacctgcagaaactcctgctgaggatgcttgcgccccccctgtggcggaaccgaagcaaccgtgccttccataatcttcagcagggcctgctgaaccccttcaccgctgacatcacgcgtgatggaagggttgtccgatttacggctgatcttgtcgacctcgtcgatatagacgatgccgcgctgcgcacgttcaacgttgtaatcggccgcctgcaaaagcttcaggatgatgttttcgacatcttcacctacatagccggcctcggtcagtgtcgtggcatcggccatggtgaacggcacgtccagaatgcgggccagagtctgggccagcaatgtcttaccggacccggtgggaccgatcagcatgatgttggacttgccgatttctatatcgttgttcttctggccatgcgccaaccgcttgtagtggttgtgcacggcaacggagagaaccttcttggcatgagcctgaccgatgacgtagtcatcgagaaccttgcagatttctttcggggtcggcacaccgtcccgggacttgaccagatgggtcttattttcctcgcggatgatgtccatgcagagttcaacgcattcatcgcagatgaacacggtcggaccggctatcagttttctcacttcatgctgcgacttgccgcagaaggagcaatagagagtatttttcgaatcgccggacttagtcatgagcactcctgtcccaacatgggacttaaccctgttagcctagccgcgcatttcagcgggaacaagcgctgcagggaacattctgacgggtctgaccttctatatggtacgcccgcactcatcagtggcattaaaagaaatttacgtatgcttgcggcacagctggtcgtatccggtattgccgcattctgtcgctagatggaaaccggatggccaagtgcaagaccaagccatcacggttctttgacaaagtttggcaacagccggctttattcagcttttgctgctatcaggggtagaagagacaggacgacgctcgaccacctgatcgaccagaccgaaatcacgcgcttcctcggctgacatataggtatcacgctccagcttgcgctcgattgcctcgatcgactggccggtatggcggttgtagatctcgttcaaccgcttgcgcagcgtcaggatctcccgggcctgaatttcaatatccgttgcctgaccctgcgcaccgccagaaggctggtgcaccatcacgcgcgcattcgggagggcaaaacgcttgtctttctcaccggcgcagagcagcagcgatcccattgatgccgcctgaccgatgcagacggtgctgaccgggctgcggatgtactgcatggtgtcgtaaatcgccaacccggcactcacaacgccacctggactgttgatgtaaaaggaaatttccttttgcgggttctcgctctccagaaacagaagctgggcgcagatcagagcactgacctgatcatagacggcaccggtcagaaaaataatccgttccttcagcaaacgggaatagatatcaaaggaccgctccccccgtgcagtctgctcgaccaccatcggcaccagagtgttgctgtagacctcaacgggatcgcgatccctcatgttccgtatccttgcatagacagagcctgcatccaccggggatgtgttccggttcaaacgcatgactccatggctgagcgacaccgctgcttcagtcaagttgaaccgattctgatgctgccgccaagacaggggcgcatcattcagatcaaaataaaatattttcttttaaaatcatattgatgcgacgctttttcaagagcggtgtccagataggataatggccatctccgaaacagtatcccggcatccacaaaaaagccgccacgccatttttttattcttcgatccccctctgccatcgggcaacgagggaatgacgggattaatcaggcgatcccggcaacatcctcatctgcattcagctcttcgatactgacaaacttgtcatcgaccttggccgtttccagaacaaaatcaacgaccttttcctcgaagatcgggccgcgcaggctgtcgatcgcctgcgggttctggcggaaaaagtccagaacggcctgttcctggccgggataacggctggcttcggcacgcatagcgcggatcagctcgtcattgccgacctgaacaccgttcacgcgaccaatctcggccagcagcaggcccagacgcacacggcgttctgcgatcttgcggtaatcggcccgcagcgtgtcctcatccttgcccttgtcgtcctcgtccagccgatcagccttgcggtcggcatcgacgcgctgccagatctggttgaattcgttttccaccagagtcggcggcacttcaaaagcagcctgatccgccagagcatccagcagggcacgcttcacgcgcagacggctgacctgatcatattcgttctggatctgctgggtgacgatctcacgcagcttttccagactgtcgaggcccagcttcgtggcgaaggcatcatcaatcaccggagcaacagcctttttcagggccttggcggtgatttcgaactgggcgggcttaccagccagctccggcacgccatattcttccgggaaggtcacgtcgatcacgcgggtttcacccacggacaggccttccatctgctcggaaaaaccgggaataaagccggttcctgcgatctcgacatccatatcggtgccggtgccgccctggaacgccacaccatcggtcttgccgacgaaatccacggtcaggaagtcgcctttctgcgccggacgcacttcctcgaccggctccagattacgctggcgctgagcgatctcctccagagccttgtcgaccgcttcagcgctgggttcagccttgaggcgggtcagggacacggaacccagatcaggcaacgtaatatcaggcagcaattccagctcgaccttgaattcgacatcctgatcgagatcgacgcgcaccagctccaccttcggctgaagggcggggcgcaggccgcgctcgctgaccatggtctgggtcgcttcattgacggtttcttccagcacttccgtctcgacagaacggccatagcgctgacggaccagcgtcatcggaaccttgccagggcggaagccgggaagcttcagagtcttggccagctcggccagacggcgcgtccggcgctcctcgatatcagtggccggcacctgaacggtgaatccgcgcttcaagccctcggaaagggtttcggtaacctgcatcgaccgggagtcctaccctaaaaaattgacgccagcccggtatgcaccgttacgtagcggtgatcggctggtgcgggcggagggacttgaacccccacgacttgcgtcaccagaacctaaatctggcgtgtctgccaatttcaccacgcccgcgccgtacccgtacaccgggtggcccgtacacaaagcagcatgcgggccaagaagcggcggctttagcgcaggccgtgcaaacccgcaatgccatgagtggccgaaagcgtgctgaaagggttttcaccctttgattttcgtcgaaaacgacgcaacggatgctctattccgtttctggcatcggcttcagcggtagccaggcacgggatcagatcctccgcacacatgcccgggcctgccagagcggcagcccggccatgcagaaaaacggcggcacaggcagcctcccatcgctccatgccctgcgccagcagagccgccacgataccggacaacacatccccggcgcccgccgtacccagccagggcggggcagacgcattaatggcggtcctcccatccggggccgcaatgactgtatccgagcctttcaggatgatcaccgcattggtctgcacagccgcctcacgcgctgccttcagcttatcgccgccgatcgcaccgaagacgcgggtgaactcgccttcatgcggggtcagcactgccgtgcccttcagatgcaacggatgattggccgcccaggaaaacactccggcatctgctacgacctggcggcctgcatccaccagctggcgcaaggctgctccggcagcttccggctccagccccggcccgcagacccagacatgacggcggcgatcctgaagcagagtggcaattgcttcatccgtcacgatcaggcccggctcaccgaagcggtagccccatgcggcttcacgtcccgtagcgatggaaaccaggccggctcccgccctgcgcgcggcggcactcgcaagacgggccgcacccggcatggtcgtcccacccagaacggtgacatgcccacgtgaatatttgtgcgattccgctgtcacaaccggcaggtgccataaagcgggactattcagccaggcatcggcagaaatgccgttcaacacagccgctggcataccgatatcggccagaatgacctctccgcacagcaacttccccggcatcagataatgccccggtttgcagcggacgaaggttatggtcgcctgagcctgagtgactttgcccatcgattggccggttgccccatccagaccactgggcacatcaacggcaatgacccgcccgtctgccttcgccgctgcattacccagcatctccgacacgaacgaatcgagcggtttcgacaatccggcgccgaacacggcatcaatgacgagatcatatttccggattgcttctatgcccgtcgtgataaccggaccattccaccgcgaagccgcccgagccgcatcactgccgggtcgtggaggcaaaagagccgcgaccgtaaccggccacccagcctgttgaagctttcgggcggcaacatatccatcgccgccattattgcccggcccggccatgaccagtacgcggcaaggagaggacaatcttctcaccagccgtgccaccgcggcaccggcatgctccatcagcccggaacccggcacatccatccgcgtcgcatccagaagggccgcctgccgatcagccagcgccatcgaatgaggcgtcagcagcgcatggtcaggcagggcagagaaaccgttgacatctttcacatctcgatttcctgaacaacagtacctttacagacaccggctacagataccgacagggcagaattctgctgccatcatcctgtcaaaaagaccggctattttttctgaagaaatcatcgccgggaagagtgcaatcggctacgtctcggctccatggtttttgatccgctgtgccggcttacatcaaacggggttgcgacatgttgagttctgttctgctggccgtccatcttctggggaccgtgctgtgggtgggcggcatgattttcgccctgttcgtgctgcggcccaacctcattctcattcagcctgccgaacgggtcgcctttcatatggccgtgctgggacggtttttcgccattctgcgactggtcattccggccattctgctcagcgggttcatcatgagcttcagcctttacggctctttcgcccgtgccccctggcaggtgcatgtcatgacactgaccggcctgatcatggcttgtgtctacggtgccatcctgagcggaccatggcggagccttcagaatggcgccatccctcctgtcagcgcttttgaccggatcaggcaactggtgcatgtgaatttcggcctgggtttcatcacgatcatcattgcatgcacaatccggacctatattggttgaaagggatcatggcgggatagacatattcccgttacaatttctctgttcccttacaccccgtctctattggccactctctggaaacgcgtgccaagtattacgccttcgccctcagccgaacggtattaccctgtgcttcggcatcagggattcctgttccttgtccatcagccggaagcacgatcacgtatggcggtaagaacatgggcactgggcccgtttctggcggctattttgggggcctgttcgctcgggcccagctggaaatctccggatttggatatccccgccgctttccgtgccactcctgccagtgcacaagcggcctggccgtctgccgagtggtggcgtgacttcaatcagccggaactgacggagctgatggaagaagccaaagcccgcaatttcgacatcgccgccgccattgcccgtgtccgtcaagccgatgcacaggcacgcgtctccggcgcgccattgttacccgcctcatccctgtcgggaggccattcatggaatcagacagcacggaccaaaaacggggcatccggtgtctccgtcggggcgggcaacaccattctgacacctggcaatcataccaatgaagtccggcaatataacatttctgatacaatcagctatgagctggatttctggggcaaaaatcgtgcgactttcgaggccgcaaaggaaagtgcccagtatagccgtttcgatcaggccaccgtagcactgacgacgacagccgctgtcgccaccacctatttcaatattctgggctttcaggcacgcgtcgccattgccgaggacaatctgcggcaaagtgaggaaacactgaaggtcatccgtgcccgtttcgaggcaggaactgcctctttgctggatgtctcacagcaggaagcgctgatggagggattacgcgccaacgtcccggcactccgttcccagctggaacagcaggtgatcagcctcggtctcctggtcggtcggccgccggaaatggtctccgtcaaaggaggatccctggaacaggcgaccatcccacaaccagcccccggtctgcccgttgatctggtggcacggcggccggatattgccgccgccgaagctcagcttgcctccgccaacgccaatatcaaggttgcacgggcgaagttctttccctcctttaccctgacggcaagcgggggatttcaggctttgacgatggcttacctgtttacgcctcaggggcagattgccagcctcagcagcagcgtggcccagacggttttcgataacggcgttctgttcggtaatctcgatattgccaaaggccgctatgaggagttgctcgcgacctatcgcaaggccgtggtgcaggctttcaccgatgtggaaaatgccatcacctcctatcggtacgctactgaacaggaagcaatgcagcgcaaggctgtggaggtctcacgacgcgcggccgatgtcgcgcgcgcccagcttctggccggggtgattgatgttactgccctgttgcaggcacaacagaccttgttcagtaatcaggccactctggctcaggtcaggttgtcgcgatttgaagcggtcatcaatctctacaaggcccttggcggtggctggacccgcttgcccgctcccggacacaagatatgaaattccgtacttttgcgatctggctgcttctggttgccactgcgggaagcggggtttactggctcgtcaaccataccaaacaatcccggccgcatcacgctggtggaaggcccacgcaggcggggggcagtcatgccgtggttgtaagaaccgcggacgttataacgcaggacattccggtttttctggacgggctggggactgtacaaggtttttacaccgttacggtgcagccgatggtcagcggcccattgctggaagtccgctttaccgaaggtcaggacgtccaccgtggcgatattctggcacagatcaatccccgtgcttacaaagcgaccctcgaccagtatatcgccaagaaagcgcaggatgaggccaatctcgccaatgcgaagctcgatctgaaacgctatgagcaattggggcggaacaactacacctcggcccagacactggccacccagcgggccacggtggcgcagaacgaagccctggtgaagcaggatcaggccctgattgacggcgcccgcaccaatctggactggaccaccatccgcgccccgattgatggccgcaccggattgagacaggtggatgtcggcaatctgatcagcagcagttccaccaacggtctggtggtgatcacacaaatcgagccgattgccgttatcttcacattgcctcagcaggttctgcccaggctgatacgcgccattcagcacgaaaatggtacgcctctttcagtgattgccctgccgcaggggaatgcaacgggtggcgagcgcccggatgatccggacgttctggataaaggcgcactgaccgtgctcaacaatcaggtggacagcaccaccggcacagtcaagctgaaagccgtgttcccgaataaaaatcaccttctctggcctggcggtttcgtgaatgctcgtctgctggtggaaactttgcatggtgccgtcacagtaccgccgctggcgattcagcacggaccggacagcgcttttgtctggatcgtcaacaaagataaaaccgtttcaaggcgtactgtcacaaccggccaggaaaaccagagtgcgatcgtcatcaaggacggtctgcatccaggcgaaacggtcgtgctggatggtgcatcccgcctgactgacggcgcgaccgtcagtatcgccacggatcagccacccggacagacacctcctcaacagaagccccatccgcacgggaacaggccgcacggatgagtatatccgcgccctttattgcgcgtccgatcgcaacctccctgctggcgattgcgatgatgctcggtggattgctgggctatctatggctgcctgtttcctctctgccggaggtcgattttccgaccatacaggtgatgacccgtctgcctggcctcagccctaccggctccgccctgctgctgacagcgccgctggagcgccagttcgggcagattcccggcttgacaagcatgatctccaccagtgccgatggcatcagccagattacgctgcaattcgatctgtcccgtaacatggacagcgcggcacaggatgttcaggctgccatcaatgctgccaacggaacgctgccggcaaatctgccttatccgccgacatattcaaaaatcaatccggcggatgcaccgatcctgtctctggccctgacatcggggactgtaccactggatgcgattgcagatattaccgatactgttctgcaaccaaaactatcgcagcttccgggtgtcgggcgggccaccattcaggggagcctgcgcaaggccgtgcggatcaggctgttgccggatcggctggcagcgtatggtctgtctctggaagatgtccgcaatgctgtttccaatgcgaatgtaaacggagcgaaaggcggcttcgacggtgctgaacgctccatccagctaggcgccaatgatcagcttgtgtcgccggatgcctatcgttctctggtcatcgcatggcgcaataacgcacccgtccggctgtcgaatattgccagcattgtgaacggactcgaaaacaatcatgtcggggcatgggttcttcgcagcggaacacagcaatcagccgtcgtactggatatccagcgccagcccggagccaatatcgtcgcaaccgtcggcgcaatcagggaagccctgccggaattacagaacgctcttccggcgggagtacaactttcgatcattgccgaccgcaccgataccatccgtgcctctgtcgccgaggtcgagataacactcgttctgtcgatcctgctggtcgtcgcggtgatctacctgtttctgggttccttacgggcgacgatcatcccgggcattgcgctgccactctccctgatcgggacgtttgcggtgatgtatgaggctggatacagtctcgacaatctttccctgatggctttgaccatcgcgaccggtttcgtagtcgatgacgccatcgtcatgatcgaaaacgtagtgcggtatatcgagcgcggggtgcctccacttcaggccgcttatgaaggggcacggcagatcggcttcaccatcatatcgctgacagtctcgctggtggccgtgttcataccgctgctgttcatgtccggtgtggtagggcggctgttcaaggaatttgccattacgctcaccgtggcggtggttgtctccgcagtgatctccctgacattgaccccgatgatgtgtggcagattgctgcgccccctgcatgaggaaaggcccggtcttctgccacgtctgttcgagcgtggattttccgcctgtctggaggtctaccgccgcacgctgcatatcgctctggcacaccagggcgtggtactgctggttgccttctcatcccttgccatcaccatcctcctttatgtgatgactccgaaaggatttctgcccgcacaggataccgggatcatcacgatcgtcacggaggccgaccagagcgtttccatcaaacgcatggggaccctgcaaaacaatgccgcccgccttttggccaaggatccagccgtggcaacgatcacgtctctggtcggggtcggcacgaccaatgccacgcccaatacaggccgcttgaccgtcgtcctgaaaccgcccgccctgcgtgatccggtgctggaagtaatggagcggtttcgcatcatcttcgcacatcaacccggcctgacggcgtatatgcaggcgcaacaggatatccagatcggaacccgtattacgcgtacccagtatcagtacaccattattgatacggatgtgagggaacttcagcaatgggcacctcgtctgctgcatacgctgaaagcattgcccatgttgcaggatgttgcttctgaccagcaggatcagggcagcgcgatcatgattactgtcgaccgcgccgccgccatgcgtcttggcattaccgtacaggcaattgaggatacgctgtatgatgctttcgggcagcgacagatctccaccatctatgcgcagtccaaccagtatcgcgtggtgctggaatccgacccggcgtggcagtcactcccggatgtgctcaaccgtctgcgtgtgccggggcagaacgacacgcaggttccgctggcggcggtggcaacgctcgctccggtcagcgcaccgctcgccatcacccatcaggaacagtttccctcggtcacgttcagcttcaatctggcaccggggatatccttggaacaggccatgagcagcatctctgccgccagtctccagatcggggtgccggaaacgattgccggttcctatgcgggtgatgccgccgaattccagcgtagtctggccagcgagccatggcttatccttgccgccatcattgtgatctacatcgtgctgggcgtgctgtatgagagcaccatccatccggttacaatcctctccacgctgccttccgcaggcatcggcgcgcttctggccctgatggcgaccggaaccaatctttctctggttgcgctgatcggcatcgtgctgctgatgggcatcgtcaagaaaaatgcgatcatgatgatcgacttcgctatcgaggcggagcgggatcgtgggctttcccccgcggcagcgattgaagaagcctgcctgctgcgcttccgtcccatcatcatgacgacagcggccgccttgctgggggcactgccgctggcgctccagcatggagccggatcggaattacgctatccgctgggcatcaccatcattgggggcctgctgctgagccagttgctgaccctttataccacaccggtcatctatctgatgatggagcgtgtgcgcatgcgcctcaaccatggccgcaagcccggtccgctggatctgccggcagactgagcgatgaatgtctccatgcccttcatcctgcgtccggtggcaacgatcctgctttccatcggtattctgctgaccgggatcatcgcgtatcgctttctgccggtttccgccttgcccagtgttgatcttcccgcgatcgtggtgttcgtcaatcagcccggcgccgatccggaaaccatggcaagctccatcgccgcaccgctggagcgcaggctgggagagatttccggtgtcatggagttgatctccaccaactccgtgggtgccagcaatatcgtcgtgattttcgatctcgacagaagcgtcgattccgctgcacaggatgtgcaggcagccatcaatgccgcccgcgccgatcttccatccgatcttccggtcagccccttcatccgcaaattcaatcctgctgaggcgccggtcatgatgatcgcgctgacctccgacagccataccattcgcgagctgtacgatctggcagacagtatgctcggacagagactggctcaggtgaacggtgtcagtcaggtacagatcaatggcgcggaaaaacccgctgtccgtatcagcaccgatcctatgcgtctggcagcggccagcctgtccggacaggatctgtataatgttgttcgcaacacgaatgtcacccagccaaccggtgtcatcgaaaatggggatgtacgccgcgccattctgatcaacggccagatcgatgatgcagaatcctatcggaaggtcgtgctcaaggcatcgaatggcggctttttacgtctgggagatatcaccgatatcgtagatggcgtggcgaatacgcggctttccgccaccagcaatggaaagcctgcgatcctgctgcagatttccaaacaatccggcgccaatgtcatcgagaccgttgatgggataaaaaaaatcctgccccagcttcgctcctggcttcccggtgatatcaacatggcgatcgtggttgatcgcaccggcacgatccgcgcaagcgtcgatgatgtacagttcacattactggtcagtatagcgctggtgctgatggtcgtgttcgtgttcatgcggcgcctgatgccgaccatcgccgctgccgtgactgtacccctctccatttccgggacgctgggggccatgtggcttctgggctactcgctcgataatttctctctgatggccattaccatcggggtcgggttcgtggtcgatgatgccatcgtcatgatcgaaaacatcgtccgtcacatggaaatgggcaaaagccgtcttcgcgccgccatcgacggggcctcccagatcggtttcaccgtcatttccatcaccctgtccctgttggcagtgttcatcccgatcatcttcatgccgggcatacaggggaggctgttccacgaattcgtcatgacgctgagtgtcagcattgtcatttccgccgtggtatccctcaccctgacccccatgctcatgggggtgtttggacgacaggttcatgcgctggataatcccctgctacggcgatgggatgagcgggtggaacacctgctgaacgggatcgagcggttttaccttcgaacgcttggctgggcgctgaaacattccgctcttatgctgctcagcatggttctgacgattgccgtcaccgtcacgctgtaccgcgctatccccaaaagcttcctgcccattcaggataccggcctgttgcagggaagcacgattgccaggccggatatttcctatgccgccatgcgcgatttacagcacagggccgaggcgatcatccgcgccgatcctgccgtcttgaatgtggatgggcgtgtcggcgtctcgaacggcttcaatgcgctcaatcgaggcatgatgtatattcagctgaagccgctggagaaacgccatgtttcgtcagaacaggtgatcgccagactcaggccgaaactcggcaccattctcgggctggagacatttctgcactccgcacaggaccttcggatgggtggcagagaggattccggacagtttgaatatgtcctgcaagcagatgatatcagggaattgcgcagctgggcacagcgtttacagaaacgcttgcagagcgtgcctgagattgccgatgtctcctccgatcaggatcatgccggaccggaaattgatatcatgattgatcgtgataccgcttcccgtctcggtaccactgtcagcgggattgattccgcgctgaacaatgctttttcacagcgacagatttcacgcatctatactgatcgtaaccagtatcaggtggtgcttcaggccctgccatcgcttcagagcagccccgccgggctgaacacgttgtatgtccctgccaccaacgtcaacggcaccgcggcccccgccacagccagccgcgccacgcttcagaacgccacagggcaggttacgctgggcagtgcagtcggcggcacgcagatcggcggtaatcaggtgccgctgatggcactggcccttacccaatatacgaccgcccccctctccattgatcatgaggccggttttccctcagcatcgctcagcttcaacatcaagcccggcattccggtcagcaccgctcaggacgccgttctggaagctgtgcgttcactcgggatgcccgccagcatacgcggagagttcggcggtaatctcgccctgttcaaaaaagccgggcaggccatgccttttctgctgatcggcgcactggcagccatctatgtcgttctgggtgttctctatgaaagcctcatccagccgctgacgatcctctccacactgccttcggcggggctgggtgcgctgatcgcactgctacttgcaggggttgatctctccctgatcagtattatcggcatcgtgttactgatgggcatcgtcaagaaaaacggcattatgctggtggatttcgcgctggagcagcaacgggatgcaggtctggatgccgccagcgccattcgcgaagcctgtgccgaacggtttcgcccgatcctgatgacaacactcgcagcccttctcggcgcagtgccactggcattttccttcggcacaggcgcagagctgcggcagccgctgggtatttcaatcatcggcggcctgatcgccagtcagatactgaccctctatacgacgccgatcatttatcttgcgctggaaaagctggccagacgaggcaaagcgcgcccggccattaatccttcctgaacctcgttttgtcataaaggatttatgaacgctccttacgttgataggcagggccgccatcagcaatgttcaggatcgtcgcgatcagaccaacatgcgagaaagcctgcgggaaattaccaacctgccgtttgcgatgggggtcgtattcctcggcaaacaatccgagatcactctggatggccagcaggcgttccagcattctgacggcttcatcttgccgcccctgcaaaacgtaattatccgccaaccagaaagtgcagaccagaaaagcaccttcatcgcccggcaggccatccgtgccctcctccgtgcgatagcggtacacgaaaccatccttgagcagagtccgctctatcgccgccacggtccccaccatacggggatcagttgccggcagaaatccgatcagaggcagcaccagcaggctcgcatccagcgtatcgccgccgaaatactgcacgaagctgttcatctccttgttgaagccctcgcggcagacccgctcatgcacttcatcacgcagggcacgccagtgatcgactggcccctccagcccgaaatgctcggcattcagaaccatccgatcgaaagccagccagaccatcgccttggagaaggtgaaatgctgacgtccgccccggacctcccacagcccttcatccggctcctgccatatggtttcgagatatttgaccagcgctttttccagactccaggaggaagccggcacttgcagccctctctcccgtgcctggtacagcgtgtcgatgacttctccatagacatcaagctgcaactgcccggcagccccattgccgatgcgaaccggggaggaattttcatacccgggcagccatggcactgaccattcatccagacggcgttcaccggccagcccgtacatgatctggatctgttcggccttcccggcaatgctccgatgcaaccagtcacgccattcctgcgcttcctgcctgtggccgccatgcatcagggcgaacagggtcagcgtggaatcccgcaaccagcaataacggtaatcccagttacggctgccaccgatttcctccggcaaggacgtagttgcagcagcaacaatgccaccggttggggcataagtcagcgccttcaacgtgatcagcgagcgttgcatgacatcccgccatggcccctcataggtgcactggctgctccattcatgccaccatgcctcggtatgccgaagctcctcctcggcatccagccgaaccggaggaggcagatgagacgggccgtaggacagaacgaacggaattttccggccctctgtcaccgtaaaccgggcaatgctggacagattctctccctcaatctccaccggcgttcgcagcaccgtcatggcagggccggcaatggcagtaatcccttcctcgtcatcaagatgcatgacccatggaacggaaatcccgtaatcgaaccgcagcacaagatgcatctgcatctctaccgagccttttctgccctccacgatacggatcagggaagaaccatcgtcgtccgggtccggatgcaccggcatgaagtcgatcaacgcgacttcaccggtatcggtcgtgaaaaccgtctccagtaccagcgtatcaccccgataccgccttgtgatgctcaccttttccggggtcttgcccaatgcttccggcgcaatggcccaacgaccgtgacgtgcctgccccagaagtgcggcaaagcaggctgctccatcgaatctgggccagcagagccagtcaatggaaccgtgacggctgaccagtgccgccgtccggcaatcaccgatcagaccataatcctcgatagccatgggaagatcatcgagcgtcacagcgcaccacctgctgaaaacggcatgaagggggtatttatcagacgcatctctgtctccttcttctttcatgcagccctgaccaacggagctataacacccggtttgcgacaggaagcacctagcctgccttgatatttcctctgacggcaacgccccgcaccagaaaacgggatactgggcggtctatcgcaaccttgactttccgaggcattttccagatatgagcgcatcaatacgcattgtgcgtaatggcgttcccgatcaacgagaccaatcccggccaaggccggtttcggcggccgagagcgcgcgaagcagcattcagtgattgagatcgccacgttgaacgagcaaccagccgacaaggctgaaccggccgaccttcccgccgcagaacaggcggatcaggacgtcagcaaaaagcgcccctcccgccggaaagcggccgccgccaaggcctctatcccagccgataacgaggcggaaaagcctgtgcgcaggcgcgccccctccaaagccgtgatggctgatgatgtacagcccgaggcaccgaagtcacggggccgccgcaccacggccgtcaaaaaagccgatcccgttcctgtagtggaagctgttgcagaaaccgccatagaaacaacggtggaagaatccgcgccgcgcggcaagcgccgggtctcccgtggcaaggccgctcccttgacggctcaggaatcaactgccgttgaaccagttgaagacacacccgttccggttgcgcaacccgcccctgaaacggcagcggcagtaacggaggataccacttccgtccggcttcggcgcccgcgtcgtccagcccgccatagtgcccgttctgcaacggcgcatgcctctgtcagcaacgagacacagaccgattcttcattagtggaggaggccgcggaaaccatccagccagctccgactgaagatactgtccaggcagtcgcaccagaagaagtcgatgatcgcccgcttttcgccgatctcggcctgtcggagccagtacagcgcgccattaccgaaatgggctatctgcatccaaccccgattcaggcgcaggccattccggtggtgctgatgggccgtgacgtgcttggctgcgcccagacaggcaccggcaagaccgccagcttcaccctgccgatgatggacatcctgtccgaccgccgtgcccgtgcccggatgccgcgcagcctgattctggagccgacccgagaactggcgcttcaggtggccgagaatttcgtcaaatacggacaatatctgaagctgaaccatgctttgttgatcggcggcgaaagcatgaacgatcagcgtgatgtgttgagcaagggggtggacgtactgatcgccacgccgggccgcctgatcgaccttttcgaccgcggtggtctgctgctgaccgatacacgcatcctcgtcatcgacgaagccgaccgtatgctggatatgggctttatcccggatgtggagcgtattgtcagcctgctgccacataaccggcaaacactgttcttcagcgccacaatggcgccggaaatccgccgtctggccgatgcattccttcagaacccgaaggaaatcacggttgccaagcctgcctccgtcgccaccaccattacctccggcctggctctggtcggcgaaatggacaagcgaaaagcgcttcgccatctactacggcaggagaaagtgcagaatgcgctgatcttctgtaaccgaaagcgtgatgtcgatattctgacgaaatcgctggtcaaacacgggtttgcagccggcccgctgcatggcgatctggcacagagcctgcgtttctccacgcttgagaagttcaaggcaggctccttacagcttctggtctgctccgacgtcgccgcacgtggcattgatattggcgggttgagccatgtattcaatttcgacgtaccgattcatgcggaagattacgtgcatcgtatcggccgcaccggtcgtgccgggcgggaaggcgctgcctttacgctggcttcgccggatgacaaatttgccgtcgatgcgatcgagaagctgatcaacgcccctatcccccgtatcgagatcgagggattggagcgcgccgagtggtcggaagagccgaatcgtggccgtggtcgccgtcataaaaatgggaagggcggcaagggaaataaccgctacggcagccgggggcaggacaacgcaaggaaagatcgcgctttcaccgaagccgatgccaaatcacaggctgacatcacgcctgatcccgtagcggaagttgcgaccacacagcctgcaccagcaccagcccagccaacccagtcacaggatcgtcaccatcgctcccgcaatgacgagcatggccggcagaagcattcgggtggccataaccagccgcatgcaccgggatcagcatcatccaatgccgcggtggaggatcgtcgtccgcaatccggccgtgaccggcgccgagatgatgatctcggcccctccgtgcgcggcttcggcgatgatgttccggcattcatgctgctgccgcgccggattgccaaagacatccggactgaagacacagcggaccctgccgacggtctttcctgagaccgtccggctgccctgcatgaggcattcatgacaatcgcattgcgggtcgctcgtctcggcgcggaggctgatggagtttgcccggctgaaggggatcatccgactatctacgttccgtatgccctggacggagaactggtcgaggtttccgaagcgggcaagcgtggcgatgcgctgattggccagatcgagcgcattctggaacccagtccgcatcgtgtagagccggtctgtcagcatttcggcatttgcggcggatgcgccatgcagcataccgatgatggcggccttggctggaaagctggacaggttgcctctgctctcaaagcagtggcaccggatgtgctatctgatgctttcagcacatggcaaagcccacctgctgtgcggcgcaggattgatttcgggttgcgccgtagcggcaaaaccgttcgggtcgggctgcaccgcgcccgctctgccgagattgtcgacattcagcattgcccggtgattgatccctccctgatggagctgattgccgcactgcgtatcgtgctgcctactctcgctttgctgaaacgtgaaggcagcgctgtcgccaatatgacggaaaacgggattgatctgctgctgcgcacggatcgcctcccttctgtcgaggatcgcaccctgctggcggctttcgcccatcaacacgggctggcccgcatttcctgggccgagggggagcggggacgccccgaggtactgtgccagttgcgtgaccccgttattaccttcagcggacacagcatcacggcccctccgggcgcctttcttcaggccagccgcgccgcagaagatgccattatggcagccatcgaagccggactgccgaaaaagcgacgcaagatcgtcgaattattcgcgggtatcggtaccttcaccctgcgcctgaaacccggcatggcctatgaaggcgatgaagccgccgtcgctgctgtcaagcgggccggatttggccagatcactcgcagagacctgttccgccagccgctgcaagccgccgagctgcgcggggtggatgtcgtgattctcgatccaccccatgccggtgcggcggcacaatgcgccacgctggcacaagccaaagtgccccggatcatctatgtcagctgcaatccgcatgccctgcggcgggatgccacccttctggccggagctggctacaggctggtatcggcctcagtgatcgaccagtttctctggtccacgcagattgaaacggtggcggtgttcagcctctgatccgactgctcgcgtgcaggatcagacgtggaagctttccccgcagccacaacggcctttttcattcggattgataaaggtgaaaccagcctcaagctgcttcacctgataatccatcaccgtgccgatcaaaaacagggtcgccttgcggtcgatcaggacggtgacgcctttgtcgatcaccacctcatccccctcgcctttttcctcgacccagctcatgtcgtaagatttgccggagcatcccttggtggatacggcaatccgcaacagccgtccctgctggccggtcgtataaagctgctgcaaccgctcggcggctgcatcggtcagtgacatcaacggtggcaaagcacgacgcggtgccgttcccgttgtctgatttgtatcgacagtcattgcatcataccccatgtcagaccacccagtcaggccggcctaaaacatattcagttgcagtctggcatcttcgctcatccggcttggatcccatggcggatcccacaccgtttcgacatgcacggaggtcacgccgggaaccgccgcaacagcatgatgcacctgttcaggcagttcctgtgcgctcgggcaggcaggggcagtcaaggtcatttcgactttcaccttgccatcatcatggatgtcgatagcgtagatcaggccaagctcgtagatattcaccggtatttccggatcatgtacgctcgcgaccgcagcaatcaccgcatcctccgtcacggcggggcgcgtctcaccatccggcgtccaactgccatgggtcgctggaggggccaccgatacggcagcgtcatctgccggcgccatgtcgatcttcgaatcagtcatggtgcgtattctatccttcatccagctccagcgcagccgagagggcacgccagggcagcgtcgcgcatttgatccgggacgggtactcatgcaccccgcccaaaggttgcaggcggctcagcgccgcatggcaaaccgggcactccagatcgggcacctgcccgctccggaccagagcatgaaaccccttcatcacatcgtgcgcctgagcacgatttaaacccctcaccgtctctgccatcagatcagcggaagcgatgctgatcgcacagcctttggcttcaaaaccgactgcctcaacgacctcattcccatcatccggcattccggtggcgataaacaccgtcacctgatcaccgcagagcgggttatcggcctccctcgacagggagaaaacaggcagtctctggccatgcaggggctttttgccatgacgcaggatcaggtcatgatagagatccctgacgtcatcatcagccatgccagcctgcactgccgtcatgccagaaaatccctcactttcgtaagagtgtcggcaaagaagtcgatttcgtcctgggtattgtacaccccgaatgtcgcccgggctgtcccggagagagacaggcgacgcatcaatggctctgcacaatgatgaccggcccgcaccgctatcccctgacgatccagcagcgtcgccacatcatgcggatgaccatgatcgagcacgaagctgatcacaccaccacgatcagccgcctggccaataatacgtaagccctctatggcgttcagacgcgccaatgcatggcgggtcagagcctgttcatgcgcttccagcgcctcgtaaccgatcgcctccacataagcgatcgcggctttcaggccgattgcctcgatgatggcgggcgtaccggcctcgaatttatgcggtacctgcgcccaggtggagcgctcgaacgtgactgagccgatcatgtcgccaccgcccatgaaaggcggcatggcttccagtaattcacgtttcgcccaaagtacaccgatgccggtcgggccgtagagcttgtggccggtaaaaacgtagaaatccgcatccagcgccgtcacatccacccggcgatgcaccacagcctgcgatccatccagcagaactttcgcaccatgcttatgtgcgagggcaatgacctccgccgccggcacataggttcccagcacgttggacatatgcgtgatcgcgacaaggccgaccttgccatccgacagcaaatgcgcaaaagccgccatatcaagctcgccagcatcggttaccggagcaatacgcagctcgacacccgtctcatcccgcagcatttgccatggcacgatattggcgtgatgttccatttccgaaatcagcacggcacgacggtcacttttcgcaaggatgccccgcccgtagctgtgagcgacgaggttgatcgcttccgtgctgttccgggtaaaaacgatctcctcccgtgcagaagcccccagcaaacgggccaccgcatcccgtgtggattcatattcttccgtcgtccgctcgctcatccagtgcaggccgcgatgcacattggcgtattgcgtacgcatcgcctcgctcatcgcctcgatcacgctgaccggcttctgggccgaggcaccgctatccagaaacaccagctttttgccacggatcgtctgcgacaggatggggaaatcctgcctgatccgggccacatcgaaaccggccgtgctgtgctgcgtctcccgcagcgcgatctccctgtcgacggtcgtattcatgcggtttccgacgcttcttcatgcgtccaccatgcattgatcgcgccgtccagaatggcacgagccccttcatgcgacacggtatcgatggcttccgccagaaaagcccttacgagaatggcacgtgcctgcacttccggaacaccgcggctgcgcagatagaacatctggtccgcatccagttcgccaaccgttgcaccatggctgcatttcacgtcatccgcaaaaatttccagctccggcttggtatcgatctctgcctcgtcagacagcagtagcgcggcattcatctgatagccgtctgttttctgcgcctcccgcgtgacctcgatcttgccctgaaacacgccgcgtgagcgtcctgccagcacattgcgaacggcctgccgcgatgaacatcccggagcggtgtggcgcacgatgctggtgatgtctccgacctgctgatcccgcaataactgggcgccatgcacatgcaccgctccgccctccccatcgagtctggcatggaattcggcacgtgccacccgaccgcccatgttcagcacaaaggcctcatatcgtccccgtgccgcgacatcagcaaaaacggtagcaatatgaaacgcgtgctgatcctcgttctgccaacggatatgctccagcaccgcgtcctcggccacgctgatctgcgtcaccgcattgtgcagataggtaccgcgaccacgacagatttccaccagagtcaggctcgccccactgccgagacggatcgtatggcgcggatgaaaatctaccgcctcccccgacatatcagaagccagattgaccagcacgatcgtgccggcagcaatcccggaggaaatggtcaataccatgccatcttcggccaacatcgtattgagtgccaccagcggcacaccatcgctgccagtacgttcgccaaaagcggacgaatgtccgaaatgttcaaggtcaatcccgtcccggcttccctccagcagaccggcgtcagacagatcgggacgaaaacggccatccagaaaaaccaggcggggtgcacccagatcaggcacatcaccgagctgacggctcgcagacccatccgtctgtgtcaggggttcccggaaacgaatatcggccagcgggcgcagggatgtatacttccacgcctccacacgctgggtagggaggcccgtccgatcgaatacctgggcagcctcagcccggatagccccatctccaggcatacgatcgcgcaatccctgaaaccgggagagaaacgatacacccagcgtttgcaagggctgaagagcgacaacaggcggctgaacggcgttcatgcggcctccttgatcactgcggcatagccttcacgctccagttggcgcgccagttccggcccgccggagcggatgacccggcccccgaacagcacatgcacatgatcaggcacgatatgatcgagcagacgctgatgatgcgtgatgatcagcgcggagaaattcggcccccgcagcgcattcacgccgtcgccaacgattttcagggcgtcgatatccagcccgctatccgtctcgtcaagaatggcaaggcgcgggcgcagaatggacatctgcaaaacctcgttgcgctttttctcaccgccggagaagccgacattgacgttccgcttcagcatgtcatccggcatcgacagacgctttgcctcggcgcgggcgagtttcaggaaagcggaggcatccagttcctcctctccgcgcgcacgccgcaccgcattcagcgcggtacgcaggaagttcatgttgttgacgcccggcaactcgatcggcgactggaaagcaaggaacacaccagcggcggcccgttcctccggctccatttccagcagttcacgcccttcgaacagggcggaaccgcccgttacttcatagccttcatgcccggccagaacataggacaaggtgcttttcccggacccgttcggacccatgattgcatggacctcaccttgcggcacttgcaggtcgatgcccttgaggatcggtttatcctcgattttcgcgtgcagattttcgatcttgagcatcgttttaacccaccgaaccttccagactgatggccaggagtttctgtgcctccacagcaaactccatcggcaattcctttaaaacttccttgcagaagccattgacgatcagattgaccgcatcttcttccgacaggccccggctgcggcaatagaacagctgatcatccgcgattttcgatgtcgtggcttcatgctcgatcttggcggtcggattgcggctttcgatatacggcactgtatgcgcaccgcagagatcgccgatcagcaggctgtcgcactgggtgaaattacgcgcgttctgcgccttcggcatcatcttgaccaggccgcgataggtattgttcgaatgccctgcgctgatgcctttcgacacgattgtgctggtcgtgttagggccgatatggatcattttggtcccggtatcggcctgctggcgattggtcgtgacggccacggagtaaaattcgccaatgctgccctcacccagcagcaggcaggatggatatttccatgtaatggccgaaccggtttcaacctgtgtccagctgatcttgctgcgcgcaccacggcaggcaccacgcttggtcacaaagttgtagataccgccacggccttcggcatcacccggataccagttctgtacagtactatatttgatctgcgcgtcatcaagggccaccagctccaccaccgcggcatgaagctgattttcatcacgctggggtgccgtgcagccttccagatagctgacataggccccgtcctccgcaatgatcagcgtgcgctcgaactgaccggtgtttttcgcattgatgcggaaataggtggacagttccatcgggcagcgcacccctttcgggatgtagacaaaactgccatcagtaaagacagcgctgttcagagccgcatagaaattgtcggaggccggcaccacgctgcccagatactgcttcaccagttccggatgctcccgcaccgcttcgctgattgagcagaagatcacaccgaccttggccagactttcccggaaagtggtggcaaccgacacgctatcgaacaccgcatccaccgcaataccgggggacgctgaggccggcagtgcctccgccccctccacaccggccagaagcgcctgctccttcagcggaataccgagtttctcataggttcgcagcagctcgggatcgacctcatccaagcttttggggccggtttttttcttcggagcggcgtagtaatgcagatcctgaaaatcaatcggtgcatgtgcgatccgcgcccattccggcatctccatcgtcttccaggcggcaaacgccttgagacgccattccagaagccattccggctcttccttgcggctggaaatcaggcggatcgtatcctcggtcaggccctttggggccatgtccatttcgatctcggtttcccaaccccatttatagccggattccgtgacggatttgacggcatcaagggtttcagcaacggctggcatggcaggctcctgtcactccgcgacggacaacacggcatgctcatggcacgcccgggtcttataaccgcttgaagaggattgcgtaggctggggtggtaaaacgttaccgagaggggtaccacccatcggctgccttgccatatcggcaaggctgatggaggacaaagctgtcgcaatcgcgtggttgaccatatcccatcgtccccgcatcgggcaaaggcaggcagcctcacaatccggatgcgcaccctcaacacaggcggtcagggcaatcggtccttccagaacccggatcacatcggcaatggaaatctgatcaaggaaacgattcaggcgatagccgccatgggcgcctcgctgcgagaccactaatcttccaaccgataaagccttgagtaccttggctacggttggttccggaacaccggtagcagccgcaatacaaggcgccgtctggacccgccctgatgcctcaccggactctgcggccagacggatcagcaccactaccgcatagtctgtcaattttgacagcctgaacatttgccacaccttaactggaccaattaagtcctgttttgtagaaatggactacccttattaaaagatcaagagtgaaaattttaggattttaatcctatagcaaaaacattattaaaatatgcgttattataataatttattagaattattaataaattaatgaatttttctaaaatgatttgccaccaaaatatcttattttgagatatttagttgacattaaacaaaaagagctttttacgttaacaaaattgtgtttctcgctttcttgaaaatttttctataaggttctaaggaatgatcctaaaaattttcagctccaataaaaatagcagaatagcagccattattctggttggagcggttaattctctgatccctctcaagtcaatcagtgcggcaaccactacaacaacctttcaggtcactgcaactgtacaagcctcctgcatcatccaggctacaaatctttcatttggtaactacagtggctcgcaaaccgatgcgacatccacgatccaggtgacctgcacgaattcgacgccctataatgttggactcagtgctggtacgggttctggtgcaacagtatcaaaccgtaagatgagcctgaactcaacttcagcccttccttatgccttatattcagacgcgtcacgcagcacaaattggggcaacacccctaatcaggatacagtcagtggaacagggaatggttcagcacagagcctgaccgtctatggacgtattcaaacaggcaattaccctactcccggatcctatgcagatacaatcacagcaactgtcaatttctaaaaatattatttttagtttttgtaggagaaatcatcaaaatttgtggtgattttttgttttaacactgccaaaatccctgagatattgatgctgatatttaattttaaacaaacagctgctgtctttagaatatgtctgactttattttgtctattgacagtcagcagtaagatttatgcgcagggaatcagcattacgcctgtcagcatatcattagcttcagggcaaatgacctccatggtgacattaacgaattcaggagatgcggacctgtcatttcaagtccgtagctttaagtgggattcgtccccagaagccccctatcatcttacaccgacagatcaacttttggtcagcccaccacttggcaccattccaccgcataacagtcagataatacgtattgtgttacgccgggccgcaaccaccactgaaaacagctatcggattctgattgaccaaatccctgccccaggcacagccggtatagtcaatgtcgctatacgtctgtctatcccattgtttgcagccccaccatcacccgtcagcccacatctgcaatggtccattgaacgatccactgcaggaacttttctcattgcttttaatacaggaggaaaacatctgaaaatttatgatgtttccctgtccaatggcaaaaaaaatataaaaatcaaagtagaaatatccccttacattcttccgcacacagcacaaaaatggaaaatacctgataatattgaaaatactgggcaaataattattttaggaaaatcaaatgaaggagatttcaaagaaaaagtataattttatgtattgggtgaatattatgggtttatttattttatcatttttaatttttacgttttcatttaatacaattgcattttctgcagacatgcaactcctgttggatgttatcatcaatggcaacaaaatacaaaaaattggcgaattcgtagagaaaaataacacattatatgcttccggcaaggaattaacagaactggggatcaaaattggtccatcttcccaaaccggtaaactgttagcacttaaaaatctggatggaataaagttcacgcttaatcaatctacacagaccatccatatcatcgcggaagaaaatgcattgcttccggccttgctgacagcatctcctacagcacgatccgatatgtatcagggaagcaccggttttaacctgtcttatgatattcagggatccatgacgggcaatgttccttacgggaccggatcattcaccgcgcgtgcgttctcgcatcacagtctcttctcatcatctcagactgtttacgctggccttgggcctgcgggcgcaggatcggtttctgtcatccgccaggacaccacctatacttattcaaatccacagacgttaaagcgatatcgttttggtgatgttatcggtggcagtttactttggacacgcccaataaagctggggggcattcaaatcgccacggatttctccatgcgacctgaaaatctgccgtttcctgttccatcggtagcagggttggcaaatggcccatcaaggatcaacgtattgatgaatgggctaccaattttcaatcagcagatttccagtgggccttttgagatttctcgccttccggtcatgaccggtgcatcagaactaaccagcatcataaccggcttaaacggccagcggacgacgaccacgatacctttctatgcaagcccgttgctgctgaaaaaaaacctgtcttcgctatcagccgaagcagggtttctcaggcgttattggggaaccttgtattctgagtatgataattttgcgggatctgcgacctaccgctacggtatttcctcacgcctgacattggaagggcatgtggaagcatctcaaaaagtgatcgagacaggcattggcactgattggaactgttttaaccttggtatcgtcagcatgacaatagcaggcagcaatgctggcggtggatcaggcacacaggaatcaatcggatttcaaagaaatggacggcaccttagttttggattctcggagctgatcagcgatgcgaaattccgtgatctggcccgtctgacgggcagcccagtccccaaaaaacagttgaacgcctatatcggatactcatttcaaggattgggttcaattaatcttagttataatcaaaccagcctctacagcatgccgatttcattaagttattatgttccaccaggaactttcaataccagcaacatgcccgtacctggtaccacgataacaaccgctgatagtggattgataacgttacaaccagcacaaaagaccgagattttgtcgatcaactattctttacagctcggtaaggtctccctgtatgcaacagccttcaacgcaatatcgggcggagggggatatggagctttctttggcatcagcattcctctgggcaatcgatcatcagcttcggtaaacagtggagcaggccaaacacgaccttatcagcagatccaggttaaccagacggccaatgtaccaggagattttggctaccagttgaatatgtctcatggcaaccagagtatccagaacggcacagtaaattataaatccagaattgggacaatctacggtggtatagatcatattgggtccaccacaacttatcgcggggaaatacaaggtgccatttcttatataaatggcggatttttcctttcaaatcaaatatttgatagctttgctgtcgtggatacaagtggtcttcccaatatccatgtctacagtaataatcgaccgatgggacaaactgacagcaacggcctgttgctgctgcctgacttaaactcctttaccgataataaaatttctatcgatcccggcgacgtgcctctcgacgcagatctagcgagcatcaattatacggtaaggccgatggatcatactggtgtgttgataccattccacattaaaacaatcacgtcagcactcatccaccttgtgaccccggatggtatgcctttatcattgggaagctccgtacagtctacgcctccctcacctattgggtatgatggaagtgcctatttgaccggcctgaaacctgggaccaacaggataaaaatcctgctttccaatggccaaaaatgctacgcttcctttaattatgtttttgtacctgctacgattcctacgattggtcctatcccctgcacacaacagtgatatcatgataaagctacgatatcttaaggcagctccattgatcctctttgctgttcttgcactctttccaaaatcatcgatggcccaatgcatagtatcagtcagcaatttgaatttcggagtttatgatccattctcttcaaccccggccaatacatcatccaatattaatgtcacatcatgccctatattatttggatcctatagcgtcggcctcaatacaggtcagaatgcaggtggatcatataataataggtcaatgagatataactcacaaagacttcaatatcaaatatatacttcaaatgaccgttcaaatatatgggggaataatagccaaggaacagtcatgcaatatggatattgttatttttttgcttgcaataattcttttaccatgtatggcgttattccacgttaccaaaatgtatctccaggattctattccgataccgttgttgtgacgataacttattgattttttgaaaaattagacgttgtaggatatatattcttggcaattaggatccacttcatatctcaagtcactgttatcctggtagcgagcattttcggcttgggatacagcctgagcgcagctttaattgccctccagctggatgaggccggggcaagtagcctgagcattggtctgaatgctgctatgcatgccgtcggtgtgctgatcactgccatgcttcttcctcgcttcagtgcccggttcggtatgcgctgtatgctgctgctttctcttctggcgacgacgattattctaatcctgtttccgctgatgccatggagctggacttggttccccctccgtctgggactaggggttgcaaccgagattctgtttgtcctttccgaaacatggaccaaccagctttgcgacgatacctcccgcgggaaggtcatggctttttatatgaccgccatgtcgagcggatttgcagccggtcccctgctgttgtccgctaccggaacacaaggctttgcgccatggctggcaggaggggcattgtcactgctggccgcggtgctcctgatgcttggcacgacgacaccaccgcccgcgccacacaatggacatggtggttttctccattatctccgccttgcccccgttgcccttttcagcactgccctcaatgcaggggtggaggccgccgggatgtcgttccttcctctctatgccatgagtgccggatggggcgaaaatggcgcaacccagcttttatcgacactgatgctcggcgcgatcgcgctccagctgccgatcggatggcttgctgaccggatgccacgggagaaactgattcttcatcttgccctgatcgccggcatcggtgcccttgcctggccgtggttaatcagccttggtgtaatcgcctatatcgccctgtttgtatggggcggagttttcgtaggtatttacaccgtgaccctgaccctgattggcagccgattctccggcagcgacctggtggggctgtatgcggcagcggggctcgcctggggcgtgggagcactgctgggaccatcggcagtcggggccgccaacatcctgacagcccaaggccttccagtcgtcactgcggcctcctgcctgatttttgccgtattcatacgccgttatgtttaccgaccggcctcgtgaccaaatctcataaccagccatccctcattacaaaaccattattataacaagaaaagaatggcagttattgagcaaactgagtcaggttgctaaaaaaacggatgttcctgctttttcaagctggcaatcttgcctccagccttcatggccgggaccataattgacgatatctgattggctttatgaatttgcccagtcgcaagccagttggatgataaggaacgttcatgatcagattaatattgcttttgcttggtgccggtatcgtcaagcggcgctggcgttttctgctgacattgggaattttatgggccggttgcggcgtgtttctggcgtttgatgcgctggacgaacattacgtcattccggtgcgctatctcggttacgtcatgatcatcgaggggctggccacagcctcctctgcatccgcggccactggcacggcgcagcggttgaggtggttcaaggcactttctctgttcatgatcggggggcttgccgcgctgaatcaccaccatgctaatctggtccttgccattctactggggctgttcatcgctgttgatggcatcatgaaggtcagcagcgcacaaattgtgaggtttcccggatggcgcactgcacgcgccatcggaataggcgaaatctttttcgctatttttgttctcgaaccatatccaacctggtacaaggcaacagtcggcgtcaatatgggtgcattgatgctgctctccggccttggccttgtgcggttgggattgcggttaaagcagctgcctgatgatgcaccgctttcgcccattctccagcagggtctttccggatggacattcattcctgcctctgccaaccagacagagcaaaacactcaacctgcacagatcggtgaactgatcgtgcatgtatggacccctaccggcctgtcacccagccagatccggtccggcaggcttatcgggcgctatatcgctgctgtcgatcaaaacggggtcgtctcaaccgggcacgctgcactggaaatggcgccggatgtttacatcagccattatccgaaaaacgaaatcgaccggaaccctggggaatttggacgtattctccgggctactcacgataacgatgtggagggtcgctttctgcctacctatcaggaagaagcagcgggatggtgtgaagccacggcccatgtccgctttgagcagttcgacgcggcccgtctgcgggctttctggaatacctatcggcaagacaatacctacaatctgaccaatcgtaactgttccagtgtcgtcgcgcaggctctggatgccgccctggaaggtgccttgaccgcacgaactgcacgcctgcctctgtcacggctgatgcggatattcctcagccccgaactctgggttgccggattgctgcgtcagcgtgctgaatccatggcctggacgcctggtctggttctggattacgcccgcgccctgtctgccgtgattgatccgcctgctatttcttggctgtcacttgcggcccgtgcgtggcggcgtcaaaagcgcacgcaggcatcatgaacaagcatgcaccatcaaaaccaagacttggcccgctaaaacgcatccatcatcatttagaccgcttctaaaagaaatgttagactctttcatggaagcagcagactcttccgccaatatactcgctcaatggcccaatattgtcattatcgggatattttgcgcggttctggttattgctcaatatttggtacagttccttgctaaaaaaaccttctctgtcaccacccttgccgaacataacctatcggctctggatacgtttcgggttcttggccccttggcaggggtattcattagcttctcactggtgcaggggattgccgaatatcgtgcaaccgggcgtcagataagtcttgaggccacggatgcctatcagcttgaccgtgccctagccggcacagatctgggtgataaggcaaccccggcccggcttgccctgcgtgcgtacatccagtctgtggtaacggatgaatggagtggattacgggagggaaaaaccgaagcccccgtcacatcgcagacaatgcagaccctgcaggagaaggttgaatctttggtcaatcagctgccctcctccatgcgtgttgccaacgatattgataaaaatttggacgatctgcaggatgaccgcgccaagcggttggccgttgtgcgaggcgggcttccttccatcatgtggtgggtgctgggcatgttaatgctgctgctgctgatctgctcggcttttctggcacgtccgaacaggattcacattcacccgctcccgaccttgtttatggccgggctggggatcatgtccgggcttctgtttattatcgatcgcccctatcagggggagctttgcgtcagccccgccccgctggtaaaggttctcaagcagcttaatatgcgtctgcatattgatcatacaggctaggcccgatcaccactccgttctggtggcctaccaaaaaagacgcttttgtaaggctgtcaggtgctcgcatatctgaatggcgatcccacgtagtcacaccatcaagaaaaagccgcgatcccatctgatcgcggctttcctgttttatcgactgttttgagggacgctatttatccaaaagcgcccacctcatggctaatggccgtgccgatctcccgcaccagatcaaacatatcgctcatcggctggaaaatagtggcatgctcatgagcatagctgctgccctggcgttcagttgatggttcgaaataatcccgttccaccgccgggtctggcgcaggcgggaatacctgactcagaagattgagggcgagaggaatttccagccgcaaaatcagggcttccagagcctgacgggttactccatgacgaggcgagaaatcaggaatttccgtctccagaagccagatacgatgaatcaacgccagcctcagcgcatgcagcaggcgctcacgcatggtcatgcgcggtgcatcagaccagccagcacgcagttgcaggtgatccacctgaatgcgccggaacatcgcctgtgtcaccgccgccagccccagccgctccaccgccttggctaccagcatcagcgcctttgtcttccgctgatcggtttctcgctcatgcgctgcacgatccagccaggtggtggggtcgaatgtcgccaccacggcacgcaatacgtccagatcagaatggcgcaacgcatgctcggccagattcatggcccggcggaaacggaagctgttctgataaagatcgtcgaacgtttcaggatgacggatcaaggccgcgccaatgccgtgaatggaattggcacaccagcccaactgctgaaggatggcgttattggggatggcccgcaattcgcgcggatggctaatctgcggacgccccacggctccatcgctctggcgggcggccgggcgggagccggtcttgtcgatcagagccgggccgaacgcacccaacagagcggcatagcccggatcttccaccagctcttccatatgcgtacggatggtcgtgaagtaatccgaggcaaaatcctgctcatcataaacgggatctttcgggcctgacatacgtgggaaagcatgttccgcaatccgggcaatcgtggccgttgccagcgccggagtgccgaacaacagatagccatcaccgccttgaaaagcactttcctcacgcaccacaacgcctgcagcacgaagggccttgcggcttttggtgggcgaaagatatttcaggcgatcatagagcgagccgggatgcgcaccacgtccgatgctttcgccatgcgtatcgaacagaatgacctcgacacccttaacgtcataacgggccagcagctcggcaattttcatacgcaggcgttcgatcagatagctggcggccagctgtccgacataacgaccggaatccgaataaccgaactgaagtgcaagacgaccggtcttttgcagataggcgcggtaatgcgggctgcgcagcgcttcctgcaggattcgagcgccctgttccaacgcatcggcggtctcgaacagcggagaaatctcgatccggtcctcgatccccagaagccttgccagccacagcgcagtcaacagcgtgtaaccgctttcggtctcggcgatcaggaatctgactggtgctgcactgtcgatgtgtttgacaacctgcgccaccgtcatcatcaaccgggccgccgaagcctgctcggcaatcagcgtaccaaaatcgatattaacgggctgaacagtatcgagcgcctcgttgatcttgctcagcagaatacgacggcgggactgatcttccggcggatctgtaatgcccagacgctgccgggcaacattatgcagctgggtcgcattcagacgcacatgcgtatgagccagagacatggaatgcgacaccaggcctgcacggatcacgcacagtgccagtctcgtctcctcatctgccgtgctgatcaccgcatcgaattgcggcagcagggcagcaggatcagtgatcgcttcctgccgacgtgtgatgagcgcctgagcaaaagcctgcacgccatcgggatcctgtgtcgtcgggcaagattcgatctggttcgaaacggcctcaatcgcctgagtcactgtccgctgaagcgcatcggttcccgcgagcgaggccaattgtgccagaacgcgctccagttggaggcgcttcatacgcagccgcaggcgtaacgtgtcccaccagccaatatcggtacgaccatccgtatcgtagccaacccagctggtcagaataaccggccttggcgtcagatcgctccagcgatccggccagacatcacgggcggccaccagcaggttgcggttcaactgatcgatggcatcacggccattgataatggcagccactgcctgatcgaactcgtcttccagagttacagaagggggacgatgcgattcgaaagaagatacttcagcgccaccggctgcttctgccagcgcgtgaccaacctcagctggcattgagaacgtcggatgagccgtaaagacggcggcaaagcgggttcgctcaacctcaggctgaaaatcgcggaaagaaatcgggctgtcattgggatcaggcctgaccacacgccgggccacgtgagcgagcgcctcgtcagccccttcgatgccaccaacataattggcaagccttcgtgcgcggtcgagataggcggcatctctcagatgctttaccagcgccacgagagaggcgtgacttaatgatccgctttcgattcggcgcgcaatcgcaagcgccactgaaagcatcggattgccgaagggatcttcggtagagcgctcaacagagcgttctgtgaccgaaagcaattcggcggccaggtccgcaggtgcctgcgtgtcgtgcatgtctgccatcaccggaattttgtgcacaggctcaaagagaacgcaaacccctttcgcatggtcttcctttcaaactctcgttctgtcatcacataagacaaaagcaatcttatgataaaattaatctattatcagaattaatagtaaaatataacagcatctatagcaataaaattatagccctttttggtcgcaatccttacggaaggaaaccaggcaggatataaatctcaattattttaactttttgcctctggacaggctacggaaccctcgcgcaaccatattgttaccaccttgcctaaaacatgacacaggagagaaattcttatggcacgtcgcttcggctgggctctcggactgctggttccggtcgccgcttgctccaacccgcctccgccgcccccagccccgccggccccgaccgtcagtgatacggatcgtagcttcgtgacagctttgacccaggccaatctggcagaggtgcaggctggtgatctagcctccaaaacctcgaacaaagccagcatccgcaagctgggcagccaaatgtccaatgaacatagccagctgaacgaaaagctcggcacactggcaaaagcgaagggaattgatgtccctacccagcccaatgaacagcaacaggctgtctatcagaagctgcagggcgaacgcgccagccgattcaacaacgattatgtggattctgagctggacagtcacaaggcgcttgagccggtgttgaatctggaaatcaaccagggttcagatgctgatctgaagaaactggcgggtgataccctgccggtgatccagctgcatgtaaaagagctggaagccctgaaaaacggcaagaccccgcgccgcctgcgtcatggtgctgcagcggcaaccataccgccagtcgtgcagtccgctgcgcctgccgctctggctccggccccggcaactgcccccgctgcgcagtaatcagcgcggttcataaaaaggatgccgtttctgcggcatccttttttatgactaccaaggaggctgtttttccatactctgatcaggtgctcagaccattggaaccctcccctctttttccacctccgcgcatgatgctcccggcgcaggataagcctgcccgtgacaggctgcgccgggcgaaacgcctcgccctttgtctgcttctgtttatggcgggtctctcactgctggccctgttcattccctccgatctcggggggggatgggtcaaaggcatgatcggtgcagccgccaatgccggcctgatcggcggactggctgactggtttgcggtcaccgccctgttccgccatccgcttggactaccggttccgcacactgcaattatccccgcccagaagcaaagactaggccaggcactgggacgttttgttgctcagcatgtctttacgccagaggaaatatcccgcgccgtcaaaaccattgatatggcaggcatttttcaacggctactcaatgatccttctatctccctgcctacatcgcaggcgggttcgaaactggtaccgcgtctcttgtccagtatggagagcggccgggcgcgtaaactggtcatccgcctgctgccacgcctgatgggtggacaagctgccagcgcggtgatcgcacgtgctttgaatggtctcgtcgatggaggcaagcatcaggatatttttaccctgctgctcaacgcgctgcgggatacactgcatcagaaagaatcgcagctgcacgagctgattgcccagcgcgtctccgagcatggcggtcggcttgtcggctgggccgtcggtgcacagatcgccagcaaggttctaaccgcgatcaatgttgaactcgataaaatggggcctgatcaatcagtcctccgtcttgccttcgatgaatgggtgcgggttcagattggtaaattacagaacgatccagcccatgctgcagagattggaaaagccgtcaccagattgatggcagaacctgccgcgcaggcctggttgaaagatatatggcagcgcctgcgcagtaccatcatcgctgatgccaataaaagggatggccgaaccgtcctgattattcaaggttttctgggtgagcttggcgccatgctcggccaaagtccggatatgcgggacaaattgaacaatggggcagaggccatcattctgaacgcgcttccttcgttacaggactctttatctcaattcattgcttcggtcgtggcgggatgggatacgcagacgattaccgacaggcttgagctgcggatcggacatgacctgcaattcgtgcgcgtaaacggaactttagttggctttgtggccgggggtgcgctttatgcagtgctgcgggtcatctccagccagatcggctgaacaggtcgtttttatttcagaaaaaactgctgtgcagggcactgcgaacgcgcagcactcgtgcagcaatataagccactgccagagcaaccacagccaccggaatcataagcacagccagccagattgccagtgcggcagccgccagaccggttacgatcatggctgccaccatggcagagacagcaaagcgcgcactgaagggcgggcgaaccgggcggcggaattcaccatccagcgtcatatccagcacagggggagatgactttttctgcatattgtccatcttgatcgaggcctccttgcatacaaggctgacgagcggctcaagttcctgccaccatagggctaataacgccctacaggaatgccagggacattaaactttctcaaatttcatctgtgacaacaccgaattcaaccagatcgcttttcccgaaactggttgaaatcgctacatcggtcgcatcccgtccacgcgccatcaggatacggccgatacgcggtttgttatgacgagcatcaaatgtataccagataccatccagatagacatcaaaccaggcgctgaaatccatcggatcaggcacaggtggaatgcctatatcgccgagataaccggtgcagtaacgcgcgggaatattcatgcaacggcataaagtgacagcaagatgcgcaaagtcacggcataccccgacctgctcttcatgggcttcccaagcagttcttgtggcgcgtgccatctgataatcaaaacggatacgctggtgtacgtaatcaacaattgcctgcacgcggggccaaccttccggcgtctgaccgaagagctgccaggcaagcgtggaaagacgatccgtctcgcaatagcggctgcccatgagatagaccaacacatcatccggcagcatgggcaccggggtctgtcgggctgaccagttcacgacatccggctcaccactatcctgaatggtgaacatcgtcgaaatcgtgatcagaccgggaggcgcaatcaggcgtgtgcagcggttgccaaagccatccgtataaaccgtcatagccgtcggcggatccagcgtaacaagacccggatccaacagatcaccggcacgggatggatgtacatgcaccatcagcagcatcggagtataatcaatatgctgataagtcagcctgtatccggcacgaatatgcaatcctgtctcccttcggcatacagcagaaaccggaaccgccctcttcaatgcaggaaaagaaaggtctcctccctccacatcgacaggtctgcgctctgaataaccttgaaacgcctgtggaacagaagctgttccccgcaagcgatgaataacatcaagcaaaattctggccagaccatgaaaaaaagtcagaacaatctcctgtgaagcaaaaaacaaaaaacggcccgtgaaaacgggccgtttccagatagaacaaagcagaaatgctccccgcctaagcggggaaagctttctcaggcactcttggtcatgatttcgtccgcaacattacgcggcacgggatcatagtgatggaactgcatggtgaaggacgcacggcccttcgtcatgctgcgcaggtgagagatatagccgaacatttccttcagcggcacctgcgcacgcaccagaacggtggagccggagctttcctgattctggatcatgccacggcgacggttgaggtcaccgacgacgtcaccgacatgatcctgaggcgtggtgacttccacgtccatgatcggttccagaatctggggaccggctttcttcatgccttcgcggaagcacgccttgcccgcgatttcgaaggccagcgccgaggagtcgacgtcatggtacttgccgtcaatcaggctgaacttgaagtccacggtcgggaacccggccagcacacccgtttcggcctgcacgcggatacctttgtcaacggccgggatatattccttcggcacggagccaccgacgaccttgttttcaaagacaatgccttcattccgttccagcggctcgaagatgatcttcacttcggcgaactgaccggaaccaccggactgcttcttatgggtataaacttccgtgtgagatttgctgatggtctcacgataggccacctgcggcgcgccgatgttgcaatcgacgttatattcgcgacgcagacggtcgatgatgatgtccagatgcagctcgcccatgccggacagaatggtctgaccggtttcctgatcggtgcgcagacgcagggacggatcttcaccggccagcttctgcaggccgagcgtcatcttttcgaccgcttccttggtcttcggctcaacggagatgtcgatcacgggaaccgggaacgccatacgttccagcaccaccggatcgtcctggctggccagcgtatcaccggtgccggtgtccttcagaccaacgaaagccgcgatatcaccggcaaacacttccttgatttccgcgcgcttgtcagcgtgcatctggaagatacgaccgatacgttccttgtgacccttggtggtgttcaggacggaatcgcccgaacgcagcacgccggaatagacgcgcacgaaggtcagtgtcccgtacttgtcgttgatgatcttgaaagcgagaccggagaacggcgcatcggtcttggccgggatgcggcgacgatcagcggcttcgtcctccccttcctcggcggccaccttgatgccgggcagatcagtcggcgcgggcaggtaatcaatcacggaatccagcagtggctgaacgcccttgttcttgaaggcggtgccgcacagaaccggacggaacgtgccgtcaatggtgccgcgcttgatggcgcgcttcagggtggcgacatcaacatcgcccttctcgaaatactcttccatggcggcgtcatcgacggccaaggcggtatcgagcaggttctgacgatattcagcggccttttcggcgagttcggcgggaatcggctcgtcgtggaacttcgcgcccagctcgccgccttcccagatgatggccttcatctcgaccagatcgaccacgcccaggaattgatcctcggccccgatcggcagctgcagcggcagcgcgacgatgtcgagcttttccttcagcgtgtcgaaggcgcgatagaaatcggcgccggtgcggtccagcttattgatgaagatgacgcgcggcacgttatagcggtcggcaagacgccagttggtctcggactgcggctgcacaccggccacgccttcaatgatgaacaccgcaccgtccagaacgcgcagggagcggttcacttcaatattgaagtcgatatggccaggggtgtcgatgatgttgatgcggtggtctttccactcacaggtcacagcggcggaggtgatggtgatgccgcgctcacgctcctgttccatgtagtcggtggtcgtgttgccatcatgcacctcaccaattttgtgagacacaccggtgtaatacaggatacgctccgtcgtggtggtcttgcccgcgtcgatatgcgcggtgatcccgatattgcggatcttttcgagcgacggtgtggacaaggcagacctccaaaacccagtagggaaaaaccctgcggggaatggccccagtcagggagtatcagcgcaaccccggcatgctgtccggcagatcacaccaaaacaagtgatacaaacaacaaggcggataccggaacgacgggaggattgcccccggcattctttgcccgacccgattccgccgtgatatgcgacaccctgccgatttttgcaatcgagcaaccgcagggcagaggcggttttatctcatggacgccttttaggggccataagggatggtactttaatatatgtctgatcagaatttccatcctgttcccgtgattctggacaccgatcccggcacggatgatgctctggcgattctgttggcgcttgcctccccggagctggagataaaggggctgaccgtcgtcgggggcaatgtcgggttggagcatacactgcgtaatgcgctggcgctgacagcgctggcaggtgccaccacccccgtccatgccggagcaaaccagcccttgctggggcgtcattatacaggggccccggaaattcatggggctgatgggctggccggggtcgatataccggcgccatccggtttgccgtccacgcagctggccgccgacgtgatccgtgccatcctgcgcgacaacgaaaaaccggtcacactggtggggatcggtccggcgacaaatctggccctggctctggccaccgagcctaccctctgcaccaacatagatcagatcgtgctgatgagcggcagtgccgggcgagggaatgtgaccccttatgccgagttcaatgcctggagcgatcccgaagcactctctatcctgatcggcagcggtgtatcggtcgtgctggtgacactggatctgacacggcaggctcgcatcacgccggaacgtatcgcgcgcctgcggaaatatggaacaggacgcgccctcaacacagcctgcgacattctctcccgcgttccgctgaccgaacagggcggagaaccgctgcatgacccctgcgcaatcgcatggctggttgcaccgcatctgttcagcacgcgtctggttgatgtctccgtcatgcttggagccggagaaaggcgcggtcaaaccatgctcagccatgccggacaggcctcttcaggacggatcacaatgctggacacagtcgatgcagaaggttttttcactctgctcggcaatcggctggcacggttgccatgaagatggaacagctaataccagaccatgcagcgccagaccggataatgagggatatgacgacagtgctctcctgtccggcacagactgaagaagcatgcgcacatcttgcaagacaggataaggcgctctcagccctcattacccgggtcggcccaccccgcctgacaatctctctcgaacaaagcccctttgaagctctgatccgtgccattgcccatcagcagcttcatgcccgtgcggcagaagcaatcctcgcccgatttctggctctgtttccagtgaacacagacttcccttcaccgctggaaattatggctctggatacggagaccctgcgacaatgcgggttttccggcacaaaaataatcgccctgcgcggcgtgtgtgaagcagcccaaggaggcatcattcccgaccgctccggctgcaccgctctggatgatgaaacactgatccaacggctgacgaccctgcgcggcatagggcgctggaccgtggaaatgctgatgattttcacgctcggccgcaccgatatccttccggtggatgatttcggagtccgggaaggttggcggctcatcaagggtttggagagccagcccaggccgaaaatactggcggatatcgggcaatcatggtctccatggcgcagtctggcagcatggtatttatggcgggcagcagacgaggccaaaaagattccccgccccccgccctctgagccggctacctccagagaaaggcttttgcgtgccaaaccataacaaatccttatgcctttcttcatggcccgccgagatccgttccatgtgcgcgatcggttcaggcggacagctcggcctgaacgggaaactgccatggcagggtgaccagcgtccggccttccgcgaggatgtccgccgtttctgggaacgtacgctcggacatgtcctgctatgcggaccagcaacctatcgtagcattccagcgacggcctttaccgcaagggacatcctcgaactccgctcctccatgcagccagaggacgtgttgagtcgctatcccggccggatcgtatatatcggtggcggtttagccgtctggaatacttatgcccgcttcatccagcactgggacatcacccgactgccttatgacggacccgctgatcgctatttcgatccggcgtggcttgcaaccggcgccggggcaagagaaacttcacgtccttaaaacagggtgatccgcaggcctcgccccaaccgaccgcaatcggccatcatcacggagctgccgtcatgccgtctctccgacgcctcattcctgccgcccgtccgatacacatcactctgcccgcccttctggctacccttggttggatggtgatgttcgctcctgcgcgtgcccaacctgcccctaacagggcctcacaggccggtttcgccatcacttttgcggaattcaaaatcgcattcaacaatcaggcgcaggccgaccagcccggtcacgcttctgcctctccatccggttcactcaagcggtgcaagcatataacgggtggcatcagttgcctgatccggaatcgcgacggcgatgctccaccaccgcccatcgaaccgaccaaccgtatcaagctgccaccgggacgagttccgcagccactgcgtctggaagcaaggctcaaccctgatggccgcatcgtgacactgcgcattctgggtgatcgggccgagcaggtcgatcacgccaacttcgtcgccgcggtggaaaacgcggcacaggtctgggaccagcaggaagggctgcccccacaatccgcccgtttcgacgaagcgctcggccttaatcggacggatgaagcccccgatatcggccagccccgcatcctgacacgtccctacgcgaagattacctgcatcgcctcagcgctatccgccaatgcaggcgtgggctgcacattcgatcctccagaccggtcaccatgaacgaacgccccgactcatctgagcggaaaattctgggcgacatcattgccctggtcctggacgaaaatcagggacaatccgaagcagccctgatcgccctgaagcgccgtgcagccagaaacaatatcaccggcggtctgctcaaaaacctgctgcatgaattacgtggccagccatctgcctttttgaatgttgaagcgcccggtggagactccatccggcaagccacgctggaacagcaactgacccgcgccattatggaacgtgattctgcgcggctccagctttccattcagatacaggctgccaatgccagacgtgaaacacggtggcgggaaagaatagtgggaggcatcttcacggccctggccgtttcgagcgcactgacagcatacacgctgctttcccctgtcgctctggatgaggaggggcaggaaaagaaccgaaatacagctgtcattgcgcccctccctcccccatcaaaggagctccgtgactctccggcaacggtggaggaagcagaattccgtgccggtgcccaggatcatcgtagaatgctggcctggctccacgccgcaagtgcagaacaacaatccggagcccaatactggctgagccggcaaagctccagcgggagccagtcctgctacatggtaggcggctctctgtcagccggctggctgaacggatgtctgatcgcccagcgcagcatggagcaggcaaatcgcaatagtgccaccagcgttgcgtaccagcgcggctggcaaagcgatggcagaagcaggtagctgatactcatccctatacacaaaaaaggcagccattatttggcagcctttttcatctgagaggatactgtgccggcatcccctccctttccttgatcagcacccacaatttaggccgagtctttttccggctctgccataagctgggaaacaacctgttccatcagagtctgccggatattgtccagcagcatgccatcgacgacacggcgagcgcagtagcgtgcaacagccacaccgttccgcttccttccacgagctttcaccttcgctgcaccttttccagtataggtatgtgcattgtggaacatgctccggttgttgtcctccacatagctttcagacgcagcaccctcggcaaacaccacatcatgcgtatcaagctcgatatgcacgtagctcactgtctccacatgctgttcctgaacgatggaaacaccgttcaccagacgaccggccggaaccagaacaccgtcaatgaacatcgcatggagtggggagaccagcaggtcacgcttcggcaacacaccgtccaaagcaccctgacggatacgaaccggcagcacatcacgacggccctggataaagcgaccattgtagctccgacggcccagccagcggatcggacgaactgcctcacccgctgtgatcacgtgatcaccgatctgcagatcttcaaccggaacctcaccacgatccgtcaggatcaggaagacattccccccattactcaccacatccaccacgtcggaagcctgataggccaatccggtcagggtgatggattcaccgttgccaaaatcggaaacggttgcagccaatgccgtgcctggcgtgctgatgataatgttaccagacccgacacccgcagaactcgtgccacccaacgtaatcgtgttggaggaatccagcgcttgcgagaccgtcaacgtgccggtcgtctacatcaggatattcgtgttggtcagcgtatccgccaacacccatccattacccttcacgttgatcgtctggaacccggtatattgggtcccaaacccgctcagagtggtgccagcaccatcaagctccagaacgttgccggtgccggcagccgtaaccttaccaataatgacgctgccgccgctgatggccagacggctgttgccagcaccgaaagcaatagcgcttctgaatgtgctttgggtctggattgttccgctattcacaaccgtaccaccaccagcaagcatcattgcctgtcccaaggtacccgttgcactgatcgtcccggagttggtgataatggcgctgccgctgacactgatgccggtcgattgggtctgattagcactgatcagaccactgttgacaagcgtagcggcattggccagcgcaatcagcgctgttccagacgcactaccctgaataatgccggcattcgttatggcaatccctgtgccattgctaaaaatgactgaagacaggcttccattggaaagaaccgccgtagctgcattagacaatgcagcgttcgcagccattgtgacagccccaccgaaggaacctatattcgtcagtgttccctgattgataagcgtggagccagttgtaattgtattatttccagtggccacccattgcgcaccggtatcaatcacggcgttttggaagccgatataattgacaccaagtccgctgaccgttcctgctatcactccggataacagctccagcgtgttggccccggcagaattcgcaaccgccgtcccgataatggtcgaggtcacaccaagctgaagcagattggctcctgtgccagccatatagatggccgcaccggcaccattggtaacattggcagtcccagatgcagagatcgtgccgtagttgataatagtgccagccgcatcaacgcgaaccccggttgccagactattgctgacaccgatcaagccactgttaacaatcgttccgcccaagccaagacgagcaccaaccagataaccagacgcggcacccgttcccgtttccagaatagtgccagtgttattaacatagtcagatgcgttattgcccagataaacaccggaggcacccgccagagcgcccgcattatccgtaatcagacccgcattgatgacagtgcctgcagcagcgccactgtatacgctgacagcattgaagctgccagagatcgtcccgccagagcggttggtgacaataccgccagcagacccccaaacggcctggccaccggaacccatgacctgaatggttccttgcattatcaaccgtgagcaaaccggcagcattgataccaaccgtacccccgctgataacgccaccagcaaggttcgtaacaatcccggtgctggcgaaggaaacgccgtatactccggagataaagccagcattgttaatcatactagcgccagccaggctgacgcccatcgtagtgcctgtaatagcgccgctgtttgtaatcgaccatccggtgatcaggctgctttgaagtccgatgccagcagtatttgcaaccgttgtatcagccaggacaagaataggattggagaagatggttgtaagagtaatacccgaggtggtggacgtcagagtggtcattctcaaagctgtccagtgctaatcagaaactcgatttttaaaatttggaacatacgtaactaacatatagcaaaagcacaaaaatctgcgcaaaaaaataattgcagttctgtaactttatgtaacaaacatgatgtaaacagcacaagaatatatcaagccattatcaacccaagggataatcataagcagctctctatcagccggctggctgaacagatgtctgatcgcccaatgcagcatggagcaggtaaacctctaatcagggctacagtaccgctgttggttattcccacaggatcaaatacgcaaacagtggcagcatgaatttaggtacagttgcgtatcaatttccgacatcaggctgctactgccatttttgagataacgcctggacctttgaacatccggcatttttcctaaggagaaaaaccgccgccagcgataaatgtttcaatcgcggtcacaaactggtccggctgatccgcatgcacccagtgtccggccgcaggaagagtgaccaattgtgcctgcggacataaatccgttatcagcctgtgatcttcagcctttatataaggtgataaagcgcccgccataaaaagggcaggcccattgaaagaagctccgggagggctgtcccagccttctatgtccggcaatccccgggcaatattcgacagaccaatccgccagcccaaatgccgcccggatttatcctcaaccgcttccaacccctgcgtcaggaaagcgcggacgcgaggatcggcttcaacatcggataacgcatcggctgcctggctgcgtgaagttatagatgacagatccagtctcagcatggcctgagcaacggggcgaaaacgcggtaaatattgcctcggcgcaatatctacgatgatcagtcccgcaaccgtctccggatggtccaaagccagtctcattgcgaccttaccgcccatggaatgcccaagcaggatgcagggagaagctttcatgctggtcagggtctcgaatacatcctgtgccagcgtggcatactccatgccggcctgatgcgggctgcagccatgattgcgcagatccagcgccagcacgcgacgaccatgcgcaaggtgccgttgaaccagtccgaaattacgcgcctgccctaacagcccatgcagcagaaccagcggtggtccggatggattatcaggcgcacgttcaatggcgttcaggatcatgccgtcgcctcatccatccgtcgtaaggatgattttaccagtatgtgcaccgctctccatcaagcgatgcgcttcctctgccttatgaagcggaaaaaccgcatgaacatgcggcccgatccgacctgccgacaatagcggccagacatgctccttcaatgcctgggcgatggcagctttttcctccttgctgcgtgggcgcagggtcgagccggtcagggtcagacgtctggtcatgacgcgggccagatcagcctcccctttcgctcccccctgcaacgcgatcgtcaccagccgtccaccggcagccagagagcggatattggccgccagatacgatccgccgatcatatccagaatgacatccaccccctttttaccagtcaattccgccaccgcatcggcaaaattctttgtcttgtaatcaatgctctccacggctccccatgcccggcaggctgcgcatttctctgccccgccggccgtcgcatacacagtcgcccccatcgtggatgcaagctggatcgcgctactgccgatcccacccgagccgccatggaccagcaatttctctcctttctgcaaccgcccgagcatgaatacattggcccagacagtgaaaaatgtctccggcaacgcggccgcgcgaatgtcgtcgaagccttccgggtagggcaggcactgcgtagcaggaacggcacagtattctgcatatccaccgccatttgtcagggcggtgactttttcaccttgttgcagggtcgtaacacctgctccaagcgtggccacctctcccgccacctccaatcccagatgcgggctggcacccggcggcggcggatacagtccgctgcgctgcatcaggtcagggcggttgatacccgctgcccgtacacgaatcatgacctccccctctgccggcaccggcaagggggcgttttcataccttaatgtttccggtccgcccgcgccatcgacccgaatcatcgccattctgtcgggtagtgtcatcgattccatgttcccggcgttatatggttcatcgcatgccttcccctattcatcttccctatcagaaacgcgtctctattgccctgtcgaagcccatggtatcgcttgtccggcttcattgcctaaccgatcaggagatcatgcatgatatcgtcccgtaccggattgttggcccttctgctgctggccatggccgcatgcggcgttacgcccgagaatatcagcggccacgcaagcggacagattaccccgcctgccgatctgatgcacgcaccgaccgacaggtcatcccgttaagcgtaccctgaagggatggatactccatcatctcattcccatcgtcaccgccagctgagtgaaaagctgctccatgcaccttatgtgctgcgagcactggtgcgggccgatgaaatctggctgaccgttctggccgccttcgtcggttgtgtgacggggggatgcgtcagctttatctattggctgacgcaatggatgcatgaggtgatctacgccctgcccgcaggggggaaattatccgcagcgccctttctggaaccctcccgcgctgtgcttggcccaatcattgggggagtcgttgtcggtctggccttgctgatggcacggtatgtttcccgacaggctacagtagatccgattgaagccaatgcactgcatggcggccgcatgtcgatgaccaccagcctgcacgtcacgctccagacgattttatccaacggatttggtgcgtctgtcgggctggaagcgggctatacacagattggctccgccattgcttcccgccttgggcgttccttccggctccgtagaaacgatctgcgcattctcgtcggatgtggcgcggccggtgctatcggtgcggccttcaatgctccgctgaccggtgcattttatgcgttcgagcttgtgatcggtgtttactccctcgccacgctggcccccgtcgtgacggcatcgatcatggcggtgctgacagatcgccttctaacaggtggagcacctggatatcatctgcaaattccgctttctattccccccgcagactaccctcctcttctggcgctcagcctgctggcggccctggtaggcattgccctgatgcgcggggtgacgttgatggaagcgttatttacccgcagccatatcccatactggggacggcccaccttgggtggaatagcgctgggattgatggccctgataacaccgcaagttctgtcatcaggccattcagccctgcatatgggaattgatgcaccttacacgctgtccaaaatcctcatgctgctggttctgaaagccattgccagcgccatttccatcggctccggctttcgcggtggtttattctttgcctccctgtttctggggggaatgctcggcaaggcttttggcggtctgctactcgcggtttccataccatccacactcccatccactgtctttgcgttggtcggtatgggtgcactggccgtcgcggtggtgggtggaccactgacaatgagtttcctggtgctggaaaccacaggttccttgccgataacggtagcagtgctggcaggcacagttatttcctccctgacagtgcggcggctttttggatattccttcacgacgtggcgctttcatctgcgcggagaggcaatccgcagcgcagtggatataggctggatgcgcaatctgaccgttggccggatgatgcgcaaagacatacgcactgtctgcgccaccatcacactcgaaagattcagacgtgactaccctctcgggtcatcacacagcatgatcgtggttgatgagcggaaccgctatcttggcatgattttgctggctgaagcccatgccagtgaaacagacgccgcctgcatcggtgatctgctgcatttcaaacacactgttctaacaccggatatgacggtgaaaaaggcgatcgaaacctttgaacaggccgaagcggatagtctggcggtggtggagcaacaggcgacacccgactgtaaccataacagccccggcaccggaacagtgctggggctgctgacagaggcctacgccttgcggcggtatagtgaagagctcgatcaaagacggcgggaactgtctggcggcatcacgatgtaagatacttccgcccttcccaaagcaggcaaataagaaagtgtgaaatcagggattctgacggcgcgccagaagatcacggatttcaatcagcaatgcttccgtgggtgtcggcacaacttctgcagcaggttctgctgtctgcttcgccttgaagctggacagagctttgaccagccaaaaaatcgcgaaactgacgatcaggaaattgatgcagtaattcaggaagacgccgacattcaacgtcacggcgcccagcctctgcgcctccgccagagtggccgcatgctcccccttcagcgtgatgaagatgttgctgaagtcgataccgcccaccagcaacccgatcagaggcatcagcatgtctttcacaagactgttgacgatccctgtgaaagcggcaccgataatgataccgaccgcaagatcgacaacattcccgcgcataatgaaagcctggaactcctcaacccatgccggttttttggccagaccggagggaagattgagtggtgatgccatgcttggaaccccttcgtttctgtatttgcgtcaccaggaaaggtggagtgatcaaagccggtcaggcaagcgttcatgacacacgaaaagcaatcctcacgaaaacgctatcgctttgcgttccaatgctctgcccgtcttacaccgatccggcaacataggcgcgtaaactgtcgacttcatgttcctgctgattgatgcgagccgcgacaacgtcgccgatactgacaatgccgataaggcgaccttcttccacaaccggaaggtgacggaaccggcctgtcgtcattgtttccatggccgcctcaacggtcatctccgcggaagcggtacgaataccacgcgtcatcatctgctctgcggtcagttccagcgctttgacaccgtaattggccatcgctctcaccagatcgcgttcgctgacgatgccgcgtatctctccctccgcgcccaaaacggggacggcaccgatgcgcttgtcactcagcaggacggcgatggcggcaaattctgcctttgccccgaccgtttctacggcatgtcccttatttttcagaatagttccaataagcatgataacgttctcccttgcatgaatgttgtcttcattgccattttcgaacgatcagatcggaggggatacctctttcctaatcttgttaaaaaacaatggcagattatgaaacaataatgcaaatataaacgacaggaagaacgtttaatacgccattccccctcaggatgcagtggcgataaagctctcccggctggaaatatgcctccaccactccccgataggaccgctgctgagaaactcatcccggtgcggtgatttctcgatataggcgagaatcggggccagaaataagtcggccagactgacggattcacctgccaaatacgagttgctgcccttgatcccggccagaacggagagaaccatgtggctcttctcgatagcctgacgatgcgcctcatcattttttccgccgatcaattcggggaagaaataataacccgacacgcccaccagtgggttatagccatatgaatcgataatattgatcaccatgtccatacgggcacggtctttcagatcctccgggatcagggatggaccgggcagaatggcgttcagatagcgtgtgatggctgcggtctcgatcacccggaacccatcgatatcaacaactggcaccttgccgaacgggtgccgttccagatgctccggctgcctcggttcccatttcaggacgttgaccggcacctgttcataatcggagacatttttctcgacgaaaagcattttgaccgttcggacatacgtcgaaccgtcaaaaccccacagcactattttagccaccatatgcttcgttcctcgcctgccagaacccgtatccgagatatcagtctttacaaagtgtcagacgtataaaagatcatgcggcagaaagcttttttatccacacccattctatcagcatatctgcgcataaaagcatgttgatggcgtcagaaattcctgacgggcagccactgtcaggatttccatgctccctgcctctgccgtccgtttcagcaggccataaacggaagaagcggctttctccagagcctgccgggcatccccagtgtccagacgatggaacaggaacagggccgcgatcgcatctcctgccccattgatgctgactggcagcaatggggtgcgcaacaggtaaaaccggccattttcatagaccagcatatccagcgatcctgagggtgtttccgccacatgcaggctggtgaccaatatgatgcgcggcccctgccggatcatgctctcagccagcaccttcactgccgcacgtgcatcagccagcgtgcggcagtggtggccggtcagccattccagctcgaactggttgggagtaagaatattggccgtcggaacagccctgtcccgaaacagctccggcagaccggggcggacgaaaataccccgccccgtatcgccgatcacaggatcacagcagtaaagagcctccggattggccgcacggacagatgcaaccgcatccagaatggcacctccaatcgcatcggaccccatatagccggacagaacagcatcacaacgcggcaacacaccacgatcagcaatacccttcatcagggcggcaatatcgtcgccgccaaagacctgtcccgtccagtcgccatatccggtatggttggagaactggaccgtgtttaccgcccatacctccgcccccagcaattgcaacggaaaaaccgcactcgcattcccgacatggccgtaacaaacccaggactggatcgacaggatattcatgccatcggttgtaaacataaccttggatgaatgtcagcctgtgccgcttccggcgtaatgccggggtacagctccgtcaatcatggcgcattctgccctatccctgccctgttttggccacatccacctgattcgatcgccccgcgacagaatcagacctaaggattaggatgatggatcttctgatgactcggcgctcccgcgctgcctgggggtttctggggatgttgagcgcctctccggcccttgtaccacaggattccagagcagacagtgctgccccgcctcagctggccgggcagcgggtagctccacagcctcaatctgcagcaggacatgcctctacccgcgcagaacggcaactgcaaagtctctataagtctcttgccatcaccccagcccagcagcaaccgtgggataactttgcccgcgtcctgaaggacaatgccgcagcaatcgatcaagcctatgccgatgccgccaaaccagaggtcggcgcgaatgcgctgagccgctttcaggcttacagacaggttcaaacagtgcagacagataatctgcggcgactggaaccagtctttacggcgctgtatcaggcgctgtctcctgcccagcagaaaacggctgaccggctgtttgaacagaggaccaaagccgccatgcgctatgtctccacccatcactgattttgcctggaagctgcattccgtctgtagcatggcttgaagcccggtcacgtgcgtaacggtgattgcattcaggtgaatgggtttgctatacgcgcgccttcaatgcgcccggtcggcatcgggctgcctcgcaaggagataacccgatgaagagcggtatccacccggaataccatgagatcaacgtgatcatgaccgatggcacggagttcaagacccgttcctgctatggccagcccggcgaaacgctgcgtctggatattgatccgaaatcccacccggcctggaccggcgttcagcgtatgctcgataccgggggacaggttgcgaagttcaacaagaaatttgccggtctcggcacgcgccgcaaataagggccgcaagctttcgaatgaagcagaaagaggggcgcatagcgcctctttttttgttgcgacggagttatgttgtaacataacatgtcatgttataacataacaaaatatgtgccttttgcgcagccgtcgaaggattacgcttcccatgtcccgcctcgccttctcgcctcgtctcaccatcccgctcagttcccttcttcggggaggctctgccaccttgctcggcagcacggtactggcagggggattatgcggatttgtccactttgccgaagcggctgatctgtcctcggccgatgtctccctgccgccgctttccgtggtgtccaatgcgctggatcaggcacggagtcagattcaaccctctctgggcgcaacaacctaccatttcagccggaccgcactggaaaccatcccgcagggagataatgccccgttgcagcaggtgctgctgcaagccccgggcgtagcgcaggacagtttcggccagattcatatccgcggcgatcacgggaatgtccagtatcgcctcaacggggtgcagttgccggaagggctgtccgtgttcgggcaggtgctggaaacacgctttgcgcacagcctgtccctgatcatgggcgctctgccggcgcaatatggcttccgggaggccggggtcgtggacatcgtgaccaaaaacggcaccaccgatcccggcgggcagatcagcgtttatggcggtgcccgcgattatttccagcccagcttcgcttatggcggtcgtaaaggggccgtcgattacttcctgactggtgactacctgctgaaccgggtggggattgaaaacccgaccagttccttcaatgccattcatgaccagtccaatcagtggcacggcatggcgcagatttcaggtatcatcaacgataccacccggatcagcacgatcgttggatcatccacgcagcatttccagatcccgaaccggcccggcctgttgccctccaacggatacagcgtcaacggaattgataccaaggatagcgcaacgctcaatcagcgtcagcgcgaaattaccaatttcgccattctgtcgctgcaaaaacactatgatacggtagacgtgcaaagctccgtcttcagccgttacagcagcctgtattatgcgcctgaccagattggtgaattgctgttcaacggtttttcacagtcggcggcgcgcggtgtcacctccactggtgcgcagaccgatgcaagctggaaagtttcggaccatcatacagtgcgcggcggctttctggcgacgatcgagcgcgcaaccttccagaccaacagccaggtttttgctacggatgacagcgggcaggttgcatccggtgcctctccctactccatctatcagggtggcggcagaactgggggcctgtatggtatctatctacaggacgagtggaaaattctgccacgcgtgaccatcaattatggcgcccgtttcgatgtggtcgatgaatatacgcacgaaaatcaactcagtccccgcgtcaacattgtctggatgccgacggaccggacctcggtacatgccggctacgcccgctattttaccccaccgactttcgagttgctcagcacggcctccattgccgcattccagaacaccacagcggcggcccctggcggcctgctcaacaatacggtcaaggccgagcgtgccaattacttcgatatcggcatcgaccaacaattcctgcccggttggcgcggtggtgttgacggttattacaagcaggccaccaacctgctggatgagggccagttcggagcaccgatcatcctgacctcgttcaactatgcgcgtggctatgtcggcggtgtccagttcgataccaccttcgaccgtgggccatggtcggtctacgccaatgttgcctggtcaaaggccatgggcaaggacatcgtctcggcccagttcaatttcgatccggaggagctggaacaaattaaaaacagctatatccatctggatcacgatcagcgtatcacagcctcggccggagcggcctatacgttcttccatgacacacatcatccgctgcgcatgtccggcacgatgctgttcggcagcggtttgcgttccgatggcacagtaccgaacggaagcgccctgcctgcttacggaacattcaatttttcagccgtccagacgctcgatcttggtttcggcaagagcacccagataaggcttgatgtcatcaacctgttcgacagcacctacatgctgcgtgacggcaccggggtcggggttggcgcaccacaatacgggctgcgccgaacgatcctggcagggctgacacaaagattctgatttacagaccggttttttcctcttgaaaccggttctggtctcgctatctcataacgcatcgggatgcccttccggggtctcgatgccactcgggaaccggccttatggcggttcaggtctgtaaccttgcttaagcaggaggttgttatgaatagttttgattttgctccgctgttccgcagtgcgatcgggttcgacaggctggcgcatcttgccaatactgtctccggaaatgctgatgtttcgtcctatccgccctacaatatcgaaaagttgagcgaggacagctatcgcctcaccatggcggttgcaggctttgaaccgacggatctcgatgtcatcgtgaaggataacgccctggttgtatcaggccgtctttccaacgagcagaaggaaagtgaagttctttaccgcggcatcgccggccgcgcattcgagcgccggtttgtactggccgatcacatggtggtcgattctgccgatctaaagaatggattgctgcatatcggcctcaaaaggatcgtgccggaaagtgcaaagcccagaaaaatcgagatcggaacttctaaggagcagcaggtcctgacccagagtgttgcacaggataatgcaacacaaaatcagaatgggcaggcagcctgaagaaccgttttgacaagataaaagcaccttggtgccacggacagaaaggggctggtataaccagcccctttttatcgcgccagggtagatatcagtcccgtgtgctgacttcccatccagcatggagcacccctgaacgggtcagcagttcttccatcatctgatccatttcctgcggattgactgcagtactgaccaattgcgcgaccagttccccggtatcattcggccctttccgctcgtcaatcgatgcggcactgtatttatgatcctcaagaaattcagccagcaggtcgcgcgtttgtggaatctccgcagagggacagatcaccctcacttcataatgcgcttccgatgccatttcattgaatggagtacggttgatggcattggccagaggacgcagcagcgtattaccgatcatgacgaataacgtcagcagggcagcctcagccaccatatccgctcccgcacaactaccaaccgccgccgaacaccagagggtcgcagccgtgttaaggccgcgaacattcatcccctccttcatgatcacacccgcacccagaaagccgataccggaaacgacataggcgatgacacgcacagcgccttcggaaccttcaatacgcatggccagatcgacgaaggtagcagcaccgatggagaccagcacattggtgcgcagaccggcggtccgctgccggtattgccgctctgccccgatcaatgtcgcaagcagaaaggcggctgtcaggctgatcgccgtatcggcataggattggggatcaaaggtctcgatgaaacgcacgctcaaccctttccgtctgataaccgggagatgcatgtctgagcatcccccgttccaaggccgaattcctgtggaatcggcgcaaggcgaaccgcggctctgcatggtggatgtcagccggtcaagcacatttctgtgacagaagcctttccggtgggacgcccggcccgctatgagccgtttggtccaagccctttgaaaatcgcctcgacaccgccacgatgggcttctcgacgggcaatagcctgttcaacccgcagaatctcggctttcaagtggacgatatagtcccgtaattcattgatcccgagcggatcgagtatcaacggccatgaaccggtgggagggcggggaagatcatcatcctgcatctgcttatccaagagcctggggtttgaacgaagcaccacgcgccgggagaaatcatatggagggatcaggtttatgacacagcccggcaacagcaagtcttgacccggcatggcgctcaggtccatatgcccgtcatcccctactcatgaacttttttctgcctggtcaccgcgcggccgggcgaggtgatgaaacagcatgactctgccattgatgccgaaagccaccgcggtttggctgatcgaaaagacgggtctgacctttacgcagatcgccgaattttgtggcatgcaccctctggaagtgcaggcgattgccgatggcgaggtggcgcaggggattgtgggatatgaccccatcgccaatggccagctgacagccgcagacatcaaggcgtgcgaggctgataccaaccgccacctgaaactggcgccatccgccattaccttgcagaagcgttcaaagggtgcacgctacacccccgtggcaaaacgcaatgaccgcccggatgcgatcattttcctgctgcgcaactatccccagctatccgacgtgcaaattggcaagctggtcggcaccaccaaggataccatccagaaaatccgtgaccggacgcactggaacagcgccaatatcaagccgcgcgatccggtgattctgggtctgtgcagccagaccgacctgaatgccatggttcagcaagccaatgagcgtctgatgcgggaaggacaggaagtaccgcagccgcttcagatcgaagatgaggataataccccggtctgattgataacctgctgaaaaagacgacaatgcgggccggatcattcgtgatccggcccgtcttatgtgcggtgtatggtccaggtggtcaggcctgctctccgtgatcttgctgaagcctgtccagctcctccttcagcttcagcttttccagcttgaggcgtgtcagagtatcctcatcgggtctgggacggttatcttcctgggcgatcttgttttccagggcagcatgacggtctctcagagactcaatccgtccagtcagggacatccgcttcctccattctgtgctgtaacaggcgggaattgagcagccgttctggcgaaccccgtcctgcctcatccatcaagcctagccacagcccctcgccgctgtcagcccctttgccgctttttacgcccgacattgcatcggaccattgcgaagcaggcccaagcgggatagaggcattctcttccactgccccgagagtgtcatttcaagccatgctgaaagaccgtgacgccctgcttcgacagcttcatgaactgcgtagtgagcatcgcgacctcgataccgtcatcagccgtctggccgatcagggcgcactggatcagttacagcttcagcggctgaaaaagcgtaagctgctcatcaaggacgaagtaagccgtctggaaagtaatcttatcccggacaatatcgcctgatcttatgaacgccgtgcatagttcctcctccccgctggtcgggatcatcatgggcagccagtccgactggccaaccatggtgcatgctgccgagaccctgaccaaactcggcatcccgcatgaaaagcgcatcgtctccgcgcatcggacgccggatcggctggctgattatgcgcgtacggcgtccagccggggtctgaaagtcgttatcgccggggctggcggagcagcccatctgcccggcatgtgcgcggcatggacgcgcctgcccgttctgggcgttccggtggaatcccacgccctgaagggcatggacagcctgatgtccatcgtccagatgcccggcggcattccggtcggcacgctggccatcggcaaggccggtgccatcaacgccgctctgctggctgcctccatcctcgccctgtccgacgccgccctggcgacgcggctcgatgaatggagggctgcccagaccgcatcggttgctgaaacagtagacgaaacagcctctcttccgcgataagcctgccccatgacaattgcccttccccccaatgccaccatcggcatcatcggtggcggccagcttggccgtatgtccgccctggcggctgctcgccttggctatcgctgccatatcctgagcgatgcaccggattctcccgccattcaggtctctgccgcccatacgatcggggcctatgacgatccgcaggctcttcgcgcctttgccaatgccgtcgatgtggtgacgttcgagttcgaaaatgtcagcgccgaagggctggatctgctggcctccctgaaaccggtccatccctcccccaccatcctgcgtatcagtcaggatcgtctggcggaaaagaccttcctgaatgatgccggcatccctaccgcgccgtggcatgccgtcaccagccgggccgagctggatgaggctgttacagcgctcggttatccctgcatcctgaaaaccacccggcttggctatgacggcaagggtcaggcacggctcaacgggccggatgatctggatgaagcgtgggagactctgtctccacgcccgctggtgctggaaggcttcgtagatttcgcgatggaaatcagtgtcgtcgtggcccgcagtgcctccggcactattgccgcatttgatacggtggaaaaccgccatcgccatcatattctggacctgacgcttgcccctgcccgcgtgccggaggaaacagcccgggctgcccagaccatcgcccgtaaagtggcagaagcgcttgggctgatcggcctgttagccgtcgaaatgttcgtggatgcgcaggggcgcgtgctggtaaacgaaatcgcgccgaggccccataattccgggcactggaccatggatgcctgcccggccagccagttcgagatgcatatccgtgccgtggctggtctgccccttcccccggcaatccgccattccgatgcagtcatgcgcaatctggtgggtccggaagatgttgcgctgtggccggacattctcgccacacccggactgatcccgcatctttatggcaaagccgaagccaggccgggccgcaagatggggcatgtcaaccgattgttcccacgcggcgcccttcccggcgatctgggaattgcggatgcgctgggaaaactggccagagaggcggaataaacttttcctcattgaaagagacatgtctttttgacagcgattgtccttctgctcctgcagttgggcaattgctgttttcccgtcagatgtcggccaaattcaagaccgctccttgtcgagccataagatcgggtgccacactggcgtcaaaggtcggcccgacatggctaaccaagaaacgacaggaaacgtgccatggcgaagattgcggtcaaaacgcccctcgttgatctcgacggcgacgagatgacccggatcatctgggggttcatcaagcagaaactgatcctgccgtatctggatatcacgctcgaatcctacgatctcagcatccagaatcgtgatgccacagacgatgccgttacggtggatgccgccaacgcgatcaagcgtctgggggttggcgtcaaatgcgccaccatcacaccggatgaggcacgggtgaaggaattcggcctcaagaaaatgtggcgcagcccgaacggcaccatccgcaatatcctcgacggcacgattttccgtgagccgattatctgcgccaatgtcccgcgtctggttccacactggagcaagccgatcgtggtcggacgccatgcctatggcgacatataccgcgctgtcgaactgactgtgccagggccgggagaggtttctctggtctatcagcccgccgatggaggaccagcccagacgctggaggtgcatcgctttaccggagaaggcgtcaccatggggatgcataatacccgcgcctccatcgaaggctttgcccgcgcatcgttcaattacggtctggcgcggggatacccggtctatctctcgaccaagaacaccatcctcaaatcctatgacgggatgttcaaggatattttccagaccatttatatcaatgagttccgggaaaaattcgaaaagcgcaacctgcactacgaacaccggttgattgacgacatggttgccagcgccctgaaatggaccggcggttatgtctgggcctgcaagaactatgatggagatgtacagagcgatatcgtggcacagggctacggttcactcgggctgatgaccagcgtattgatgacgccggatggccagaccgtggaaagcgaggccgctcatggaacagtcacccgccattaccgggaacaccagcaaggccgtcccacctccaccaaccccattgcctccattttcgcctggacacgcgggttggcttatcggggccggttcgatcagacccctgatgtaacgggctttgccgaaacgctggagcgtgtctgcatcgaaaccgttgaatcaggcatcatgaccaaggatctggctttgctgatcgacaagactcatccgtgggaaactacggaatccttcctgaaaattcttgatgaacggctcaagaaggccatggtctgacccggacctttacgccggattgaccgacaggaacaaaaaccatgcaaagacgcggctttttgatgacctctctgataggtggcttcagcacggcggccggagcagcccatgccgacgctattcataccggcacaaatgggatcacagccggtgagcagcgcatcaaggtgagtgacggagaaatccccgcctatgttgcgtctccgcagggcaagggaccattcccgaccgtgctggtgatcgaagaaatctttggcgtgcacgaatatatccgcgatgtctgccgccgtctggcccatgcagggtttatggccgtcgcgccggagctgtatgcgcgtctgggcgatctgtcgaaaatgagcgatgtgcagaccattctgcgcgacgtcatcagcaaggcgcccgatgccactgtgttcgatgatctggatcatgccgccacctgggctgccgcgcatggtggcagcgccgacaggctcggcgtgatcggtttctgccgtggtggccgtgatgtgtggctgtacgccacccataatccgaaactgaaagcagccgtcgcctattacggcccggtcaagaccgaggataccgcgatccagccgcactctccgctggatgtggcggatcagctgaaatgtcctctcctcgggctgtatggtggtcaagacaagatgatcgacccggccgacgttcagaaagccgccgacaaggcaacagcggccggaaagcgggtggaaatcgtcaattactacatggccgatcacggtttccacgctgattaccgcccgacctataacgaggcggtcgctaaaaatgcatggaatcgcaccctcgcctggctccgcgatcacggcgtccgataacgcagcatctctttttgtgtgagatcacggggcctgagatcacggggccatgtcatcccagttgatgatgcggattatggccggcggccaaaagcctgttcgattttctgatcggtcttgaactggctgagcgcatagacggcccaaatcgtagcaggcaaccaaccaatcaaggtgacctgaaggatcaggcagatcaggccggaaatgggccgtccaatggtaaaaaaggtcaaccaaggcagaatcagagcaatcagcagacgcatagtcctatctccatagtatggacgtgatgatagacggaaaaagccgccccggtcaccgaagcggcttttctgttgttctcgaacgcggcaagcaatcaagccgccatagcgtcccgcacagcctgcaaggccgcatcggcctgcgcggcatccggtccaccggcctgtgccatatccgggcggccaccaccccctttgccaccgacagccgcactggcagcccgcaccagcgtcacggcatcaaagcggctggtcagatcggcggttacgccgaccacgacgctggccttgccctccgccgtggaaaccagcgcgacgacaccactttccaattgacgggcgatggcctcggccagacccttgagttccttgggtgcaacatcacccagattacgggcggcaagcttgaccccgccgacttcctcgaccttatcagcggcaccaccggttgccagcttgcgctgggcatcggccaactgggcttccagcttcttgcgttcctcaagcagggacgcaacgcgcgttgtgacatcaccgggtgcaacacgcagcagggatgcagtctcctgaaggcgacgctcggcctcggcaatctgggccagagccgcttcaccggtcaccgcctcgatccggcgcaccccggcactgacggcgctctcacccgtaatgcggaacagcccgatatcgccggtacgcccgacatgggtgccaccgcataattcaatggagtacgctggcttgccctcctccaccggtgcccccatggaaacgacgcgcacttcgtcaccatatttctccccgaacaacgccatggctccttcggccacagcctgctccggcgtcatcaggcgagtgttgaccgggctgttctgacggatcaacgcgttgacctccgcctccaccacagccagatcgtcacgggtgatcggggttggctggctgacatcgaagcgcaggcgatccggcgcgttcaggctgcctttctgcgctacatgcgtgccgagacgacgacgcagcgcctcatgcagcagatgggtggcgctatgatgggcacggatggcactgcggcgctggtgatcaaccaccacctctaccggctgaccaatctgggccaaaccgctttccacccggccgagatgcacgaacacatcgccgagctttttctgcgtatcggaaatgataatgcgcaacccgttgggtccagtgataatacctgtatcaccaacctgaccaccgctttcaccatagaacggggtctggttaagcaccacggcaacctcggttccggcaggcgccgtctcggtcagcgcaccattggcaaccagcgctatgatttcggcttcggctttctccgtggagtagccgaggaactctgtgccaccgacgcggtcacggatttcaaaccacacgccttcctgagcggcatcaccagagccggaccaggcggcgcgggcacgacggcgctgctccgtcatggcagcatcaaacccggctacatcgacggcacggccctgctcacgcagagcatcctgagtcagatcgagtgggaaaccatatgtgtcgtaaagcttgaacgctacatccccgctgagcgtctggccctcccccagcttgccgacctcatcggacagcatggcaagaccacgatcaagcatcgccttgaagcgggtttcctccagccgcagtgtctcggtaatcaaggactgagcctgcaccagctcgccataggctgcacccatctgccgcaccagcgcgggcaccagacggtaaagcagcggctcggtcatgcccatcagatgagcatggcgcatggcacggcgcataatacggcgcagcacatagccacggccctcattcgagggcagcacgccatccgccatcaggaagctggtggagcggaggtggtcggccaccacgcggtgactggtcttgtgggggccatccggatcctgcccggtggcttcggcactggcgacgatcagggcgcgcagcgtgtcggtatcatagttatcgtgcttgccttgcagcacggcagccagacgctccagacccatgccggtatcaatagaggggcgaggaaggtttacacgtgtaccgggcggcccttcctcatactgcatgaaaaccaggttccagatctcgatgaacctgtctccatcctcatcggggcttcccggcgggccgccggggatagagggaccatgatcatagaagatttcggaacagggtccgcaagggccggtatcgcccatgcgccagaaattatcagaggatgcgatacggataatgcgttcttccggcaatccggcgatggatttccacagccgggccgcatcgtcatcatcctgatagaccgtgaccagcagcttttcggccggcagaccgaactcgcgcgtaacgacgttccaggcatgggtgatcgcctgttccttgaagtaatcgccaaaggagaaattacccagcatttcaaagaaagtatgatgccgggcggtgtagccgacattatcgaggtcgttatgcttccccccggcgcggacgcatttctgggaggtcgtggccctgctgtaaggccgcctttcctggcctgtgaacacgttcttgaactgcaccataccgctgttgacgaacagcagtgtggggtcgttacgcggcacaagcggagaactgtcgaccacctcatgcccgttacgggcgaagtagttaaggaacgtggcgcggatatcgttgctggtggccatgcgacgatcgagaacctgatcatgaagggcgtcagccaacaatggcatcagccggatgaaaggatgaacgcgccaagtagcccatacaggcaaatcggtccatccccgcgcaggcggggaacacggcgatactcctgagaatagccaaatatcagccggttcatccccgcgcaggcggggaacacagttgctcaagggagcccgggtttggcgttatcggttcatccccgcgcaggcggggaacacgtcagtgtgcatattgtgctccctcgtgattccggttcatccccgcgcaggcggggaacaccctgtggtaacgccggtatcgagggcgatgatcggttcatccccgcgcaggcggggaacacggcgcacgcaacaccagtatctcgcccagcgccggttcatccccgcgcaggcggggaacacacgctgggttcagcgtagagcggctcgaaatccggttcatccccgcgcaggcggggaacactcaacctctcagcattttccctatttaagtgacggttcatccccgcgcaggcggggaacacctgatcgctgacacgtcgcatgatcgcatcggcggttcatccccgcgcaggcggggaacacagcgccgactaaggcaaataaatggcggaaatcggttcatccccgcgcaggcggggaacacatttgccaaataatttcatggaccgaccagcccggttcatccccgcgcaggcggggaacacatcgcagtcgctgtatcagcagtcaccgactgcggttcatccccgcgcaggcggggaacacctccacgcattcgtaaaatgttcagatgggcgcggttcatccccgcgcaggcggggaacacaaaaatgctcggtgggaagcgccctgtagcggcggttcatccccgcgcaggcggggaacacgaacggtgggatcaccaataacgccggagcgtcggttcatccccgcgcaggcggggaacacaacgccgaccgatcatccaggacagaagatgccggttcatccccgcgcaggcggggaacacactcgcgacgcgcgcttttatcacggccgcaccggttcatccccgcgcaggcggggaacacgatacagggcgctggcgctgagtgtgctggaccggttcatccccgcgcaggcggggaacacggcgctcccctttctttcttagatacagaggtcggttcatccccgcgcaggcggggaacacgagactctattttttttcccattagtcagcgacggttcatccccgcgcaggcggggaacactgccagcgcatggcgcaggagcgcaacgcgggcggttcatccccgcgcaggcggggaacactatttttgcgaaaatcccgtcatgggttttcgcggttcatccccgcgcaggcggggaacactcctgctgcgacgaggaagaattcgaatttttcggttcatccccgcgcaggcggggaacaccttgagccgatgaatgtagatcgcatttctaccggttcatccccgcgcaggcggggaacaccgaggcggccatccgctatccaggagcagcatcggttcatccccgcgcaggcggggaacaccgtagcatcgaacccagatcagcaggagagagaggttcatccccgcgcaggcggggaacaccctgagctgctgccagcaccgattgtggcggccggttcatccccgcgcaggcggggaacacaccgcgaagccgcgcgcatgtgcctcgctggccggttcatccccgcgcaggcggggaacaccgttttcctacccgcatacggcctatttccaccggttcatccccgcgcaggcggggaacacaatgcgcagctgctcgatctggcgcgcggtggcggttcatccccgcgcaggcggggaacacaccgtaaccggtctcacgacctgcctcggcaccggttcatccccgcgcaggcggggaacactttcagaatacggttccgggtggctgcgcagacggttcatccccgcgcaggcggggaacactcgaagccaagaacggcggttcatcgagcgatcggttcatccccgcgcaggcggggaacacctggaccgcgctgcgatatatgatcagcggcgcggttcatccccgcgcaggcggggaacacgaccacaaccgagtgctgatcaatcgcctgcatggttcatccccgcgcaggcggggaacacggaaaaatatcagccatcctgacatcagccgccggttcatccccgcgcaggcggggaacactcttcgcataagtaattgattcaaaatattttttacattgtcaaagatcttaccgacagaaaaagaggtttttaggccgacttttcgggaagaaaagttacgagcttcagtccatcaaaatcaatgggcatgcggcggttgcgaccaaaagtgaggaagtcatatccctgatccgttggggccttccacaccatgacggcgtcgcctgtttccagaccttccgtcacctggcgccagatcatttcacgcgtccgagccgaatagttgccgacatagacaccggccctcacttcaaccagccatgcagcaagtctgccacgcaggcgtggcggcgcattggtgacaaccacaaccatcatccgcgatggccctcatcgccagacttttcttcgtcaaaagcgggtagagcagcctcgggtgggggctcgggacgtggaatgtccgcagcagaaagaacgtcctcaatcgcgggaataatacgtccaagaagtcccgtccgacggaacatgtccctgcaggccaggcgaaccgcccggtccggtcccatgtccatacgaccttttgcagcttgtccggcaatccggaatgcttctggcacaacggtttcgagtttgaacaggtccgcaatatcataaacaaatgacagaggcttgcctgtatggagaaaaccaatagccggagcatagcccgctgccagaacggcggcttcagataacccgtgcagacaagcagtggccgcagacaggcagcgattgggaatatcgcctgcatcccagtccttgggatcgtagagacgacgcttccacggcacaccatactgctttgccagaagcgcgtagctttcccgcacgcgcacgccctctattcctcgcaactgttcgatcgaacggcgcgatggtggttcctcaccgaaccgcatggcatacatctttcgcacgacacgcagtcgggctgcctcatcaagcgcaatccgggcctgccatagcagtttgtccgaacgagcaccccctggctgtcctgccgaatagagccgcacgcctgcctcgccgacccagataatgagggtccctgtacgagctgcaaaggaaaccgccgcatgtgatatccgggcgcccggctccagcatgatcccggcgatgccacctatagggatctgggtgcgtgttccgtcggcattgacggcgacgaaggctccatcgagcacatcaagccgcgctcgctcgacaaagatcagagaggcccggtctttcagcgggatgagtttcggcggagcaagaccgggaatcccgctccctttgctcatcatgccctccggatgatcatcagaccgcatccaaacgatttcgcccggccaaatccctgcgccagattcgtgagaaaaagcgccgggtcagtcatttcaagatgacccgaaagatcgagaatcccgagcgtcatcgcattgcggtcaatggcccccaaacgtggcagcgacaattgccgataatcctcggcaatcgcggtgataaccctgaagccgcttttttctccctgctgttccagccacgccttccctgccgaggaggcgatttccatacgacgctccgcacgctcactctgttccaaagcgtctatgggcgccttgacgacgtcttcccgtttgccaccacgcttcatacgggtcgcattggcgcggagcaggaactcaaggcgggcgccaggtgcgaggtcaggtgcataagacttgatccgatgcggctggaaaagatcggactgaagcggcggacgtgcagaaagcgtaaggaagctgccgtcccgctcctcccgccagaggaaatcccgttttctttcctcgctgtcagcaaacaccgaccagagtagatggtgctgtgcggacacccgctctccggacgccctccccccggactctgagggtcgcagtagtacggccaaagcccgcgccgaaggattccgggccaggcggagatggctgaaatagagtgtcatgtcagccacctgccatgatgttgacaggacgcagaccaacgcgccgggtggcaaaatgccagctgctacggtccagcggaacgtcagtcacgacctcaccctccggatcatcagtaacaagcaggtgcgcctttacggattccttgcgccaaagaggggctttcagatgttccagcgctgcctccgcagaaactgcttcgacaatcttcgcccccgtcggtgcggcaagcggacatgatttccgtccgacatagagcgtgaaatgcggttccagcagcgccgccacaatcctctccaaccctgcgccccgcaccgcaattccgtaaaacacgctggtccgataatcacggtgggtgatggccgtgttggttctgccgcgcgcgtccctcaaggcttccggtcgggaattcgggtttttcgcggcagcggacggaattgtctcgatggtatggtaatcgcgcaggggcgcaccggcatcgaagatcgccacatcgatcgacaggacatcaagcgcagaaaaatctccgtcccgctcgatccccagcgccgcgcccatcagcccgatgatcgccgatcgggtaggccatatgagagaacctcgccgctcatgtcctgcgagttcacccatcgagccaagtgaggcagccagaccaaacaccagaaagggctgctgcatcatgccccccgtacggtcgcgcccacgaaggccgtgatctcgtccaacgtgccgcccttgcccacatgcagcttctgttccgacgtccagaccttgccataggcgtcatcaatttcccgacgggtcttctccagcgcctcgactgactgttcaagcaggcgctctcccctgaccggcgagaagaaggcaccggacaaatcgcggggcgcctgtgttccggcctcggccagaatgtagtgcgcaagcgggtggtgggcgaaactgttctgcttacccttcggcgttgtgcgggccagcgccgccgccagcgcttcgatccccttcaccgccagtgcgcggtccccggcgagattgctgatgagcaggtcacagttcacgcagacatattgataatacacgccggatccgaaagaggtctcgctaagatgcgctgctcccgtttcctcgcgcgtgttgagatcatcgacggcggagaaccagtcctcctccgactgcgccatgtgtgtggtgatggcatgcgccacctgcaccgccgcgtcgcgattgtaatcagacgagcccgccagcattcgcccgaacatggcgatatcgaccgcgccatcggcccggcgcagaaccatctttttcagttctttttccgctggcaccttttctccggcggcaattttcccggccagttcttccgccagcctccattcttcaggtgagatgaaggcgagtgtcgtaccaatgcggttttttgactccttgctggacgcttccagcttgccgaaaatcgccgcgacctgatcggcggcgctgcgggccttcccctcgcttacgccgttcctgatgagatgctcgacaaggttctgatacagccgtttggtgcgtttcccctcatgatcagcaaggtcgagggcgaaaaaggtgctctcacgcagggcgcgcttgatggattgggacgacatccgcaggcgcggcacccccccgacaattgcctgttttgggcgcccctgatcatcacgattgggattggaaggaccgtaggtcgtcagaaggtggaattgcagaaaagtcgtcatcagacagtttccttcatatcatccttgggcgcatcggcatgaaaatagccaaagcaccaatttgtgcgtgttttgtcgttccagtaccagaggtcgcgcgccagagccccgacattgcagcgccggtcggccatcacgatggcgcggcgcatcaggtccgtcagattttcaccttccgcacggatgagtttttcaaaacgtccgcgtgaaagaaccggctcttttccgcccagacgatgcgcaagcggtgcggcatcgtcctcccttacttcagcaagaagacatgccagacggacgagcttttccgtctctctttctcctcccgatacgcagagtgcctgtgcaagctgatgcacggccggctcgcagagggctttgatcgggtcggcccgacgcaggcgtgcagacagtgcgcgggcggcggtattcgtgccccgtggtttaagatattccgcccaccattcgaaggcgatggtgcccttttcctctctgctcatgcggctttcctttttcctgttttcggcagcggaagaccaagcgctccgaaaatctcgccaccctcttttccgtagcctgcaagcaccaaccccagatatcgtcggccctctgtgatacgcccgattgctttcacatcccgctgattcaagccgggaagcgcctttgcatcgaactgtccgagtgcttgccggcgaagatcagccagccaggcctccgccgggtcttcgccacgctcgatcgcctgaacatgagtgaggaatttcgtttcagtctgacggaaaaactcctcccgctcggcttcccgcgcttcgcccccagcaagaacaggcgtaagcgcattacgcagggccaccgctacggcatcagccgcctgaatcagatccacaatcctgtattccgcttccgcgggtattgctgacaaccggcgctgacgtgaaagaatgaagtcacggggcttcatgttatccatcgaccagccagcgacgaggatggagcctccaccaattctgtcctcccgcaggcacaatgccagttcggagagatcgctccctttttccttgaccaccacaccaagccagttgcgatagccgaaatgtccggcgcgagggtgtttcggcagccattcctcgccggatttctttcgataataggggctgagtggatgtttccagagcgcataatccgtgccccctggtttttggatcacgccggttaccgctccctcattgtgcgtgagacgcagcctgcggggcattccaaaaaacgcctctgctccgaaaagctcaccgtccggcggaagagtctgctgtccggtgtgggaaacacgggtcggccgcatccagggcagagtttccattttcgcggaatgtccgcacgacacattcacccagaccagatcccacagcatccgctccggatcgaccagcgtgaccattggtccaccaccgcgcatcgaggtaaaatttcctgcaccgcccgctggggcataagactgaaatgtgtaaagcgccattgccgcaattggaaaatcgagacggtcataccggctgcgatgcaccatgacatccgcatttttgcgcgctgtttctactgcggcgctgtcgatgaacagcatatcgacagaactggctttacccgtgaaaggctccagatcctgaaggaaacgcggcccatcaccgacaaggttgaacgccggagcgtagggtgccagcttttcttgcaaccgttgtgggtcgggatcgcgtcgtgcctcccagtcctccccgtcaacaggaggatcagcgagaaaaaccagcccgatcagaagttcaaggcaggctatattgaggtcaggacgcggccagtcgggctgcaccacatccggttccgccatctgccatggtgcaatgacccgccgcgatccatccgcgcagagaacaggaatccattgatcgtcaatgagattgagagacacgcaatgatctccgattgctgcgccaggtacgaaaatgtgttcgaagcagcaatgtgacaaagatacttcgtcgaaattgcaagaacctcgggaaccgtatcattgtgacacacatagaatgtgtggcttatacagatattttattacttccaaccaacattttacttggttggaacaagacgggatttatatattcagcggttctgatggagatcttctgtcaggactgttttcgccataaaccctaacaaattaggtttcaaatcctatctaacctaaacatttaaattttgctcattgcatatccccgcttaggcggggaacaagtctgccccacgaacagctctaacccaaacatggaccatcttcgtttttatacagaaacaaacacaagaccgcactcctcgtcataattcaagccttcacagatgctgccatcttcatcaacagggcacagcctgatttgcgcgcgcttccactctggccagtctttggtgatcttcatgatctccggcgacgattgatcggggagtggcaaggcatccagcttcttacggtgggcagagacgtcggaaagcgcccaggcatcctcgccttctccttccgcccacgggaccagaccagtcctcgtccgacgggccaggcgcaggacacgcacctcttctcccagtcgggtgggatagtttacatcgtcatcgccacggcctgccttgcgatagccatccgtgaacttcacgatattatgccaggccagccccctgtcggcgctgtctttgccgtatttatcctgttccgcctttagaagagcctccggtaccggctctgtatccgttccatagactgcttcaatcagcgcgcgctgacggtctggcgtcccgatctgtccttgtgtgaacaagacgcgtgcgctccgccagacatcggcaagcgcgtacacccacgcgccttttcccagcgtaccgtgcagccatcgttcatcctcaaccagcgaggggtccggtgagagaacatacagcaccggccccgcaaccggacgaaccgagaccggccggatatccatatgtcgccacagacgccctgcccgctggatcagcgccgcgatgggcgcgatgtcggacaccatcacgtcaaaatccagatcgagtgaagactccagaacctgtgttcccacaaggacgaagcctgccctgcccttcccgtttttcccgaccgttgccagaatctctgcctcgatccgtttgcgatcacacaaggcgaagcgagcgtgaataagccgggcctccacacctgcggcacgaagagcctcgacagcctcgattgcgtcatccaccgcattacgcacccacacgcaggccgcaccctgcgcagccatccccgtcagaagcgtaaccgcatcagctgccgtatcgagtctttcaaccttcaccggccctttcaccggatagtcttctgccgggaactgcgtgatggcctcccctcccgcaatagtcagggccggataggcgggattgtcggacgccccatcataggtcgccagcaacttgctgcggaggctcataggcaacgtcgccgtcagaagaattgcggacccacccgcagccctgtgcattttcaaaagggccgtgagttcttctgcgatatatgcctctcccatttcatggacttcatcgacaaggagaatcttcgatgacaggccataaatgcgtaatgtctgaaaccgaaccggcagcacggacagcaatgcctgatcgatcgttcctattccgacatcggccagcaatgcgcgtcggttgccctccgccagccaatccgaggaggtaatctctcccggtccgccggttctgcttctctgcacgagctcgcgaaatggcaccgatagcccggcacgtccatgcgccaatgttacagaaggattgtcgaacatgcgtccgacaatgcgcgaagcgcggtcaaacattgcatcggtcgtcgccattgttggcagagcatcaaacaaaccgcgtcccttccctgcctggcagaaacgatgcacaaggataagcgccgcttccgtcttgcccgtcccggttccatcctccacaatcgccagtgtcggcccatctggcagagcgatggttgagcaagccacctgcatggggcgcagcacgaaatcgaacagttttccttgccgcaccatggtgccagcgattcccgcctcgacgacggcgcgggctgcaatggcacgggtctgttgcagataagcggcgaggctgtccgcctccgtctttggcgggaaccatcccaaattggacccgacccagtcggctgccgcgcagaagcctgccagccaccaggagagcgttgtagcctcggccagtgtcagcccttcgagcgaggcttccggccacagatcaaagaatacgtccatcagcctcgcagccggttcacgaccttccccaacgcatttcaatgccctgacgagttctcgtggcaaacgcgcttctggtggaagagcaccgagcatatgctccgacgggcgtccatgatgtccggctatggctgcgtagagcattttccgcaccagcggtgttccgccaagacgggctgctatccgcgcatcttcaacatagaacaggacttcgctgagttcccagtgacggaaccccggttgcgccacaccttcgcggagcatggcgcggaagctctcactgatcttgccgatatcatggagcgccgtcattacaaccagcgcatcgcgaaggggacgtgccacgccgaatggctcaatcagcctttccgccaccgcagcaacatcaagcatatgaaaggctgccggatgttcaggaccatccggagtgaccgagcttttacccggccagtttttccactgcattacgcagctccatcaacgtaactgtccggagatgtttaatctcatggataggtaaaaattacggcaatataaaagacacaggattaaaaggtgcttcggcaatcctggagcatgcaccaccctacacttctcaggaagaggcggaccaaaggtgcgttgatataatagttgctacgctctgaacggtgcttggaaagtagacctttctccgaaagctgattggcatatttacccaccgtctgacgcgctatgcccaagtcggactgaacagactcgattttcgtatagggatgccggaacaggtgttcagcagcgtcttgcagtaagtcttttacagttctgtccgcatcggccgcttcatggtggccatctgcgcccacatgctctcgattaaaaggactattcccgcgcacgcgggggaaccgcagctatcccacgcgcttcatcaacagatccaggactatccccgcgcacgcgggggaaccgcggccgagacgatggaaaccgggcgcaactcgggactatccccgcgcacgcgggggaaccttgacgcgacaaattttgctcgtgcagccggggggactatccccgcgcacgcgggggaaccttgctatagtttatagggagcgcgcgggacgctggactatccccgcgcacgcgggggaaccccgccgtgtcaggcgtgtcacacggacagaggaggactatccccgcgcacgcgggggaaccgcgggcgctgcggtcacaaaagcgaccgcgctgggactatccccgcgcacgcgggggaacccagcgcgtctctcacgccgcgcggtgcatggcaggactatccccgcgcacgcgggggaacctgactgagggccgcgcaggccgagacgttttagggactatccccgcgcacgcgggggaacctgtcagaggcgtagaccccggcagtatcccgggggactatccccgcgcacgcgggggaacctctagggctgatattattgatttcaaagaacaatccctattttccacattttgagaaaaatgcaagccggctttttcagcgccggtaaggaagggggagaagcaaagcaagcggcaccttgatcaacccctgctcccccgtaacaatgaccatggtggaaggggcaaaatccgcaaacatctcccggcatgcaccgcaaggggagacaacggcaatatcctgatcgggttcatcctgtttgggatgacggacggcaaccaccgtttcgatgtcagccgccccttccagcttggcccggcccagtgcaatcgcttctgcgcaaatctgcaaacgccccaccgtcgcgccaagatgaaggccggtccatatacggccattggcatcccgcaaagcagctgccaccgtatgccataatgggcgataatgctgccgcatgaccgccctcgccacctcaaccagttcaacgtcagcccggtccagcgggcacgctgcggcatcaagtcgtaacctcgatgccagccgcgttttttcctgtctgttactcagccgtttccgcctcctcagcgtccggtgtggtgatcatggcgttctgcacggtgccagactgctccctgatccggttctcgatcgcattggcgatctccggatggtcacgcaaaaactgcttcgcgttttcccgcccttgcccgatgcgctggctgtcatagctgtaccatgcaccggatttctctaccacattggccttgacgccaagatctatcaactcgccgaccttgctgatgccttcaccatagatgatatcgaactccacctgtcggaaaggcggtgccagtttgtttttcaccactttcacacgggtctggttgccgatgacttcttccttgtccttcagctgcccgatacgacgaatgtcgaaccgcaccgacgcatagaatttcagcgcgttaccacccgtcgtcgtttccgggctgccgaacatcacaccgattttcatccggatctgattgaggaaaatcagtgttgtattgctgcgattcacggagccagtcagcttgcgcaaagcctgactcatcagacgggcatgcagaccgacatgactgtcacccatttcaccttcaagctcggcccgcggcaccagagccgcaacactatccaccaccagcacgtcgatcgcaccagagcgcaccagcgtatctgcaatttccagtgcctgttcgccggcatccggctggctgatcagcagattatcaacgtcaacaccaagcttgcgggcataaatagggtcgagcgcatgttccgcatcgacaaaagcacatgtaccgccacgcttctgcgcctccgccactgtatgcagggcgagcgtagtctttcctgagctttcagggccataaatctccacgatccgtccgcgtggcatgcccccgattccaagcgcgagatcaagcccgagcgaaccactgggaatcacctcaatctgctcggcgacattgcgcgcgcccatgcgcatgatcgagccttttccgaaagaccgttcgatctgtgccaatgcggcatcaagcgctttattcttttccatacccggacatgtcctcatgcatagccgcgcccagcggccgattcacgcagcgtcttcaatcagtttagccctgcaggaagcgcatcgaaagacgcagccattcccctttatgttcataatatgttctagtcatatgccaattgcaagccgtaaccccagccctttccatgatgctgccggcacggttacagatcaggattcttttctccgccgcgtaaaaatatcatggccgccaccctgtcagcgggaccattttttcttgcagtgaggggaatagcactctattgaccgccgccttggcccaaggggacgattcagtccaaccggccgtctactggtaggaaggagaatgcgatgaacgcactcaacccgctggggatggtctcggaaaatccgagcgaaaaccagaacgtgactgaagccgccgcccaggccaatacgcaggtttctgcggccgaaacggaagagcgcaaagattatttcgtggagcgggacggcatgaagtttgccggcacgcatcttctggtcgatctttggggcgcgaccaatctcgacgatcccggcatgatcgatgtaaccctgcgtgaagctgcggtaacagccggtgcaaccattctgcacagccatttccatcatttcacaccgaatggtggcgtttctggcgtggtggtgctggcggaaagccacatctccatccacacttggccggagcgtaacttcgcagctgtcgacatcttcatgtgtggcgcctgtgacccgcataaatccattcctgtcctgcgcgccacattccagccggagcgcatagatctggatgagcagcgtcgcggacgcgtcgtctgagaaatgtaacctgacacctttatggtgtcatcgttacgcgctatttcatccggcgcactgcacgacaaaaaaggcgatccagagggcaacctccggatcgcctgatttttggagaacgcttcatgtctgatcaaaccacctcctctactggcacctggatcgctgaaacgctgtattctgactgggggcagcaattccgcgtcggcaaggagctggcccgcgttaaatcagactttcaggacattgtggtgttcgagagcaattctcatggtcgcgtcctgctgctggacggtgtggtgcaaatcactgaagccgatgaattcgtctatcaggaaatgctgacccatgtgccgctgatcgcccatggcgcggccaaaaacgtgctgatcatcggcgctggtgacggcggtgtgctgcgccgtgtgctggaacacaaaaccgtcgaacgcgccgtcatggtcgaaattgacggcgaagtcatccgtctcagccgcgagttcatgccgggcatcagtggcaatgcctggaacgatccacgggccgaggtcatcgttggtgacggcatcgattatgtaaaaaaagccgctgatggcagcttcgatgtcatcatcgtcgacagcaccgatccgatcggcgtgggcgaagtgctgtttacggatgatttctatcagaatgcagcccgtatcctgaccgcccgcggtctgatcgtgaaccagtgcggcgtgcccttcatgcaggctgatgaattgcgtgaaaccagcctgcgtcgccgcaacttcttcccccgcgtgggtgcctatgtcgcagccgttccgacctatgtcggcggtttcatgactttgggcttcgcgaccaaggatgctgattttacacaggccgatctggaaacagtgcgtgcccgtgcccaggcggcagggatcgccaacacacgctattggacgccggaagtgcatgtcggcagcttctatctgccgccctacattgccgagcagctgcctgcctgatgatgccgataccgggggcggaggatacaaatccgccaccggaccagctgataaagggacgaaaaggccgctcctggaaaggacggccttttctgatcagcacacatcacccgtcaagacgggtaaaatgtgtgatcaatcgtcgcggtgaactcgctccatgcgctcatgccgttcctgagcttcgagcgacagggtggcaatgggacgggcttccagacgtttcagcccgatcggctcgccggtttcctcgcaataaccgtaggtaccgctctcgatccgctgcatcgcctgatcaatcttggagatcagctttctggcccggtcccgggtgcgcagctcaagcgcacgatccgtctccacactggcacgatcggtaatatcggcctcatggatgccgccttcggaaaggctcgccagtgtatcgtcggcttcccggagcagatcggcccgccagcgtaacaatttctgtcgaaaatactcaacatgaagcgggttcatgaattcttcggcctcggaaggcctgtagtccggtggaagcgtcaccatcatttcgctgcatccctgcgtggcgattcggcgggcttatacagggggtttactctctcaacaagagcaccccgattgccccctccttttcacgcttgagaaacattgctgccatatcagagtcgctatggtggcgatgttgtgtttcatctcgaaccaactcatctgtatcctgagacggcggcgagcttctccgtttcccaaaatctgagaattccggttttctgacctggatatcgccgccgtcgccccctccgcctcccccatccgccattgagtatctgccttatccgactcgtcgactggcagacgcggtcgctggaaagcagacccgggagggatatatagtatttcgatgcatatcttttttattcagccagcagccaccgatccaaccgccggcggacatcgctacaaccgtgaactgatagaagcccttcaccaaaaagggcattcagtgactgatatcaccctgaaggcccgctttgcccatgatgccaaggcggcagaagaagaagccggacaggtcttttccaccctgatggcatcgtccggtcagaacagccgcatcgtgattgatggcatgtccctgcccgcttttcatcatctccctccctctgacctgcgttgcctgacgccactgatccatcatcccggtgcagctggtcagcgcggcgattgttctgggcctgacatgaatgtccaacaggcggaacagacggttctgtcagccgtatcccatgtcgtggtgacacttgagcagacacgcggccgcctgatcagggaatacggagtggccgatgcgcagatcagcgtcgtggaaagcggctttgccgcctatgccccggcgcccggcacacgcaaccgggataacagcagcccctgcgaaattctttctgtcggcacgctcgtcaaacggaaaggatatgatgtcctgctgaaagcccttgcgcgactgaccgatctctcctggcagctgactattgcaggcaacacccagcgcgatccggcctatgtggacgtgatccgcgaacaggcggagcaggcaggtctttcctcccgcgtgaggctgctctcctgccccggacatggggctttgcagacattatgggatgctgctgatctttacgctcaggcgtcatggtgggatggaccgctctcggcagccctgcaatcgctgcggcgcggtattccgctggccatcacagcctcgcaagaggcagcgatgaagctaccgctgaatgcaggtgccctttgtgcccctggtgattacgaaacattgtccaaagtgctacggcgcctgatcttcgatgattcactcagaaaatcttacgccacagccgcctggaatttcggcagcggactgccgggctgggatatgcaggcacaggcctttatccatgcgctgccgccgacgggcttttgattgaacccattcctctcaatgtaaaaagggcgcctgcaaaaggcgcccttttcatctgcgatccggattaatcaggaccggtgagatcgctcagttcagcgtctcgggatcagaggtttcgagaacatccagcagatcgctgtccttcttcgaatcctcggcgggtctggacggcttacgaccgcgacgcggcttgaccgctggggtatccttgccctgcgttgccggagcttctgcactacggctcctgcgtggagcgcgacgcaccggagtgagcagttcgtcctgagtttcctcaacaactgaagccgcacgcgtacggcgcggcttcaccgcgctggtgaccttacgggctgtaacgcgcggagtgcgggtcgtcgccttcgtcgcacgcgtggccggtgcttttacggtacgcggcttgcgggtcaccgcacgggtgcttgccgtctttgccgtacgggccggtgtcgcagcgcggcgcgtagctgccggggtacgggcggcagtcgcacggggtttggttgcacgggtcgctggtgccttcaccgcacgcgttgcagtccgcgtggtggttgcacgcgttgacgtcgccctcttcgcgacaggggcttttttcacggcagaggtggtgcgggttgtcttggcgcgcgtggttttcgcacgcgctgacgtggcgcgtggcgtgacagcacgtgcctttttagttgacgccaccgtacggcggctggccgttgcggttttggcagcaggcttgcgcgcggtggcacgggttgctgtcgttctggtggcggtaatgcgctttgtggcgggtgtgcgcttggtggctgcggcccgctttgttgtggtgttggctgttgtcgcccgggttgcaggcttacgtgtcgtcgcagccgtcttacgtgtcgtcgcagccgtcttacgtgtcgttgtcttgctggtcgccgcacgggtcgccttgaccggcgtggcccgggttgcctttttccggacagatgcagccccggtcctggtggaagctgctgtggaagctgctcttgtagacggttttttggaggtggctttggtcgcggtctttgtcgccgtctttttggcagccgtgctccgcgtcgctgttttggcagctcccctcttgggggcggcggtaaccgcagccgtgctccggcgtgcggtcgtgctgcgtcgcgtcgttacagccgcactgctacggcgggttgtcgaacgcacggccataggttgggcgcgtggcgttccattatgatcgttatcattactcacttgaggaactcccctttcggccgaaccactggccggaaaaatcatgctgatcatgtagtcttatacgcgtatcgaacccggaggccggggaaactcaagctgtgctgataaagcccctcttcgtcagccaagcctgctgcattccagttgtgtgtaaggcttaggtgcagcgtataaagcgcctttccaacctgctttgccttttctgcctcttaccgtttcccatgctgaccggctttcatgacagatcgatcaaaaacgacggtatcatctgagataacatttttcttcttgaagtgccctgccctgtcccggcagccgccagaaccaacgcaagacaggctcgacagcaagtttcgattcggatgaatcgctcttcaagcgcttctcttcgctctttcgaaccgatcctgtcaataaaaacaactggcagccagttcagttccgcaatatgcaaagaggcttttcttttttcggtttgcttttttgcagtctttagaaaagaaaatctgatttagcccttttcttgcagataaaattctttcatgcatggcccatacagtagcaaccccggcataacagcaacctgccagccgatatgcgaagagttgtatgctctgtcctttcatgcgcgatttcatccaaaatcaatctggactaaaagaagcgcatgagcgcaaagcaggacgacacgcaaccgatacaggccgcctccaaaagactgctgaaagtcattctggagggagaagccctgaccagactctcgcctttacaggagatggaccgcgctcaggctgtcgccgatctggaagccgaaaacgtgttttcacttgaacgcccgctccccggtatgacacccgtcagtgaacaaggtccctatgtgcttcatctgtccattcaggaaggacgcctgatcttcgatatccgtcgacaggatgatacctttctgaccgtgctggcccttgcactgggaccgttccgcaggctcatcaaggattatcatctgctggtcgacagctatgtaaaggctgtgcaggaggcaagggaagcgcgaattcaggcgattgatatgggacgtcgcggcctgcacaatgagggggccgaactgatgcgacaccgcctgaatggcaagatttcaatcgactttgaaacggcccgccgattattcacattggtatgcgtgctgcatcagcgcatctgaagaatagagtaatgcgttaaccccgcagcacgccgcgctacgctgcaccgatcacggccctgtatttcgaggaaccacacatgaagattgatggcacgccttaccgcagcgtgtgggtggatgatgatggatggagcgtccgtattattgatcagaccaaactaccctggagcgtcgatctgcttcggctgtcacggctggatcaggttgctcacgcgatccggtccatgcaggtgcggggcgcaccactgattggagccgtggctgcatacgggttgtgccttgcactgcgcgacaatgccaccactgatgcgatggagcgcgctgcggtcctgctggcggaaacacgccccaccgccgtcaacctgcgctgggccattgatcgtatgctggcccggctgcgcacaacctcggaagccgatcgcgtcgccatcgcctatgatgaggccgccgccattgccgatgaagatgcagcccagaacgaggccatcggcaggcatggtctggaactgatccgcgaccgtgtccgtcccggacaacccgtcaacatcctgacccactgcaatgccggctggcttgccactgtcgattggggaaccgctctcgcccccatctacatggcgcatgaggaaggcatcgacgtgcatgtatgggtcgatgaaacccgcccccgtaatcagggagcgctgctgaccgcttttgaactcggcaaacacggtgttccatacacactgatctgcgataatgccggcggccatctgatgcagcatggcaaggttgatctgtgcatcaccggcgcagaccgtgtcacccgtaacggcgatgccgccaacaagatcggcacgtatctgaaggcgctggcggcaaaagataatggcatacccttctgggtggcactcccttcttccacgcttgactggtcgatccgcgatggcgtgaaggaaattgagatcgaggaacgttccgctaccgaggtcacgaccatgagcggtcgcgccatggatggcagtgtcatgaccgtacgcattacgccgaaagacagcccggccgccaaccccgctttcgatgtcactccggcccggctgctgagcggattgatcaccgaacgagggcgctgtgaagcatccgaagaagggttgctcagcctgtatccggactatcgcatctgatgcgcgcctcggtcggagccgcctctgtagcgtgtctcctgatgctgacagcctgctcctcctccagatcgagctctggtggaggagcaggttcatcggcgacaggggcctatactgccgccaatgaggcgcatatacccgatttcgcacgcatgcatttcgctccgttcaaccgtgccgatgccattggtctggcttcagcagaatggcgtgcattcggcagtgaagttcatgatgaaccgccaggcgagaatcctgatatgccgcccatgctgcgaccggaccggcagcccggattatgggagaaagtcggactgttctggtggctcgggcaggatgccgataccaccgaaagtctctggtcgggggcctataccagcacagggacgccactgcccgacaaggatattcatccctggtcagccgcctttatttcctatgtcatgcgtatcgcaggggcaggtgcacggtttccgtattctgcctctcattccacctatatcaatatcgccaaacagatggcgaccggcgcgcagagcggctacgccgtgattgccgaacgtccgggagaatacgcaccggttcccggcgatctgatctgcacagggcgcggcaaggcagagcgtctgacttatgattctctcccgactggcggcttccccagccattgcgacatcattgtcgctgcccgtcccggagaactctctgtcatcggcgggaatgtcgcctattccgtgtccatgaaacacgtgccgaccacaccatccggcatgatcgccacaccggacgggcagtcggttgacccacgttatccatggttcgtcgtactgcgcgtaacctatgatcaataaagcctgatcagcggacggggctccctccccgcctgttttcacattaacgctgctgccagggcagaccttcagctttccatccggcggcaacgccacgatggccatttgcatcgacggggccttcaaatccttccgctatattatacacatgctcgtaaccggcctcccgtgcagcaatggcagccgccatgctccgggcaccactgcggcagagaaaatagatgtgatgttccggcgtcagcccggcctgacgcaactcatcgacgaaacgcggattcacctgcatctgcggatagacctgccagttgatcagagccggtttctgctggacagaggaaagatcggggatgccgacaaacacccattccacatccgtacgcacatccaccagacgtgcttcggggtcggttttcagggccgaccaggcatcgaccaccgggacattatccaccatgactatcttctccattccgataactcccgatcatcatcgggaattaacctgatatgcgtcgtatcgcgatgctttttgcccgctctttctatagatatgaatccgctgttgtaagaggtgtccagcatagggccaaaaaatgagccttatgaaggaacaccccgtttcaggagagtttcgctgatgagcacacgctctacctttgccgccccacccgttgctacgtcgatgcttcaggccatcggcaatacgccgctgattcgtctgaacagggcatcagacgctaccggctgtgaaatcctcggcaaggctgagttcatgaatcccggtggttccgtcaaggatcgtgcggctctggccattattctcgatgcggaaaagcgcggcctgctgacgcccggtcaggatggaatcatcgtcgagggaacggccggcaataccggcattggtctcactctggtcgggcaggcgcgtggctatcgcagtgtcattgtgatgccggaaacgcagagtcaggagaaaatcgactatctgcgcatgatcggggccgatcttcggctggttccggccaagcctttccgtgatcccggcaattatgtgcatgtttcccgtcgtctggccgaagaaaacggctgggtctgggccaatcaattcgacaatctggcaaaccgggaaggccatcgtgaaaccacgggccgcgagatctgggaacagacgggtggcaaggtggatgctttcacctgctcttgcggcacagggggaacgctggccggtgtcgcccttgcgctcaaggccttcaacccggctatccgtatcacactggccgatcctcatggcagcgggttgtatggctgggtgaactccaacgatctctcggtcgaaggcagttctgtcaccgaaggaatcggccagtctcgtgtcaccgccaatctggaaggcgtgcagatcgacgatgccgtccgcatcagcgataccgacgccttgcgacaggtttatgatctgctgcgggaggaagggttgtccatcggcggctctgccggcctgaatgtcgccgccgcgatcgaggtcgcgaaacggctcgggccgggacacaccattgtcacgattctttgcgatggcggcgcacgctatcagtcgaaactgttcaacccggctttcctgacggaaaagaacctgccggtgccggaatggcttgcggcataataacccgcttttaagactgaaaaacaggctgacccaaaaaccgcccggcaagttttcctgccgggcggttttatattgtttcagggctgggccggtttcggcgggtttaccttgaggccgggcgcaggcggcagctccgtatgcttcatgaccattgtgcgcaggctggcatcacccggatcctgcaacttcagcgtctcaccatctgccgatgggacgaaggtaaattcatcgtccagcttgtcggcatgaagctggtacgccccgttttccagcgtccacggtcccagactatgggtgacatgatccgctgccctgtcattctcatcgcctttgtaaatctgttccagacgataccaggccgggctgccatcagtgtgacgcatcaaggtcaatacaaaggtctgcgttttgcagacggcggtacaggcggtcgtgccactccagcgacccatcggctcaaccggcagcggctttccgtccgggccttttttattcagcaataacggcggcggcggagcattccgatgctcctgaattttcacataagcaaatccagcgcccagaatcaccagaggaggaacggcaatacgcaatacacgccgccagtcgattttgatcgtcatgaaacacatagcctcgataaacagggcctcgataaacgcggaaagcgcgcctgcctgactgcttaccaagcacagggcatggcgtcacgccctgccacctctcctccgctcctcctttatgcgtatagatcggcttccacggcgatggccgatgcgctacgccttaacccgatttccgacaagcggagcgaagccatggccgagacacctacacatagtgaccgtaaccttgcactggaactggtgcgtgttacggaagcggccggactggccgcctcccgctggatggggcggggcgacaagaacgccgctgatggtgcagcggtcgagggcatgcgcaaggctttcgactctgttgcaatcaacggcaccgtggtcatcggcgaaggagaaatggacgaagcgccgatgctgtatatcggcgagaccgtcggtgctggcggcccggccatggatatcgcggtcgatccgctggaaggcaccacgctgaccgccaaaggcggccccaatgccatggcggtgctggcgctggccgaggctggcaattttctgcatgcccccgacatctatatggacaagatcgcggtcggcccgggcctgccggacggggtggttgatctcgataactctgtcgaaagcaacctgcgcaatctggcgaaagccaagaaaatggagctgtccgatctggtcgtctgcgtgctggatcgcgaccggcacaaggaaatcgtcgccaaggcacgtgaagttggcagccgcatcatgatgatcagcgatggcgacgtattcggtgccatggctgctgccatgcctgataccggcatcgacatttatctcggctccggtggtgcaccggaaggcgttctggcagcagccgcgctccgttgtatcgggggccagatgcaggggcgtctgatgtatgaatcgcaggagcaggaagaccgcgcccgcgccatgggtatcaccgatccacgtcgcaaatacagcgccgaggaaatggcaaagggcgatgtcatgttcgccgccaccggtgtcaccggcggtccgatgctgcgtggcgtgcgtatgttcgctgccggagcgtatacgcattccgtggtgatgcgcagcaagtccggcaccattcgctatgtcgaggcctatcacaacttcaataccaagacgtggtaatactctgaccgtggtctcatcctccgttctgcgcgcggaagcctccaccactgttacggacgctgttcttggggtggagcggagcctgaccggtcgtgcgtggtactggcgcatgcccgcaggggccgatattgcagccatagagcggcttgggctggccatttcgcagcggcacggggtgagcgatctgctgggtcgtctgatcgcgacacgcggcatcgggatcgatcaggccgatacattcctgcaaccgaccctgcgcgccctgatgcctgatccttccgttctggccggcatggatcaggctgctgcccgcattgccgccgccatcacggcaagggagaccatcgccattttcggcgattacgatgtggatggcgcctgcggcacaacgctgatgctgaccgtgttgcgcgcctgcggctgtccggtgctgtatcacatccctgaccggctgagggagggatatggcccgaacgcccctgccctgctgtctctggccgagcgtggggccagtctgattatctgcgtcgattgcggcaccgcggcccagacggcgctgtcagccgtgtctggccgagccgatattctggtgctggatcaccacaaaagcgacacgctgccccctgcggctctggccaccgtcaatccgaacgggcctgatgatcgctccggcctgaccatgctgtgtgccaccggcgtggcgttgctgacctgtgtagccacttttcgccagcttcggcttaatggctggcaggggcatgaagggccccctcccgatctgctggaaatgctggatctggtggcgttggcgaccgtgtgtgacgtcatgccgctgaccgggatcaaccgcgccttcgtcacgcagggcctgaaggttatggatcgccgcaaccgtatcgggattgccgccctgctggaggtggcgcagatgaccgggcgggtgactgccagcacctgcggcttcgtgctgggaccacgcatcaacgcagccgggcggatcgacagcgcggatatgggtgttcggctgctgaccgcaacagacccgatcgctgccagagacattgcccaggcgctcgattccgtgaacgggcggcgtcagaccgtggaatcctccatccttgatgcagcggtcagggaggcagaagcacggatcgaagcaggggatgccgccatcgtcattggtggcgaggattggcatccgggcgttgtcggcatcattgccggaagattgcgggagcggttcaatcgtccagcctgtgttgcgggttcggctgacggactgctcaagggatcaggacgctccgttcccggaattgatctgggcgctgccatcatcgctgcccatcagcacggcctgctgcgcagcggtggtggccatgccatggcggccgggttcgcactcccccctgaaagcatgcccgctttccgcacctttatgaatgagcgtctggccgcagcggccttgctgcccaaagccgccgatctggcgcttgatgccagcctgggtgccggggctgtcactgtggccatggccgaggaactcgcccaactggcaccgtttggaaacgggaatgatgaaccgctgcttgtcctgccccgactgcgatgccgcagagctgagcggatcgggcgggacggcggcacgattcgtgcctttctggagagcgaatccggttacaccatcaaggcgctgctgttccgtgccaagccagaggatatggctgcaccaattgccgatatcctgttgaatcgtgaattacgcccacttcatctggccggttatctgcgtgccgaaacctggaacggcacgacaagcgcaaacttttgcatttctgatgctgcgctggcttgaccgcccgctcagcctcgggtaaccacccgccacgccaccgcttccggccagaccatcggcccggtgagacagtgtcccgttcgtctagaggcctaggacaccgccctttcacggcggtaacaggggttcgaatcccctacgggacgccattcaaatcattgaatattttgttttctccacatatggctcagatgctccatagaccatctaaagggctaaagtgcgggttgccgggaataactccgccggtttcttaaagtgatcaattgcccaagcatcaacagattgagcagaagaacagccactggctgatcgggcggcccttgattctggaaacattatgaaaaaaacttctgctgaccgcccgaccatccgccgtttgatgcgttagtggaaaaattccgttttccgcttccaagggcagtcttcccatgaactcagcctggctctatcccctgattctcattgcgggcgcattacaggcctgggggccgccgatgaacggtgccctgcgggtttcgctgatcaatccatggctggcgagcattgtctccttcctgccgattcttgccgcccttctggtgctttggctgtgtatgccgaggcccatgccaaccgtggaaggcattgccgccatgccatggtgggcacctttgggtgggctgatcggtgccttcgccgtcgtggccgggctgatgttcgtggacaaggtaggggctggaacttttgcaggcctgaccatcactgccaatattttgatgtcgctcgccattgaccatttcggtctgctgcatgtgactccgcatacaatgtcaccgctgcggatgctgggagcagtcctgatggtctccggaattgccctgatcgccagattttaaagagaaattctctccgcttacaaattctgcttacacaaaatactttgatgccggatgtttcatcacaaaacgcttgaaatatttctctgtcgaaaaatgatatccctgctgcaacgtatcaaagctgatgggcctgagcagggagtatccattgatgcatgtgccacgtattcactggctgctggatcgtatcctgacccggatcgtccggagcggacatctggaagtccgcttttctgacggagaaatccgtcaatacggggccggttcttctccctcggcctctatggtgctccgttctcctcaggcggaaaggcgtctgaccctcaatcccatgctggctatgggcgagctttacatggaaggtgaactggagacgccgggatgcacgatttatgatctgctggatgtgctgacgcgtgactgtctgaataccggacagccctggatcataaggctgtttaacatgctacgccaggcacgaaagcggttggatcagtttaaccccgctggacgttcgcgacgcaatgtcgcccatcattacgatctggacgggcggctttacgcacattttctggatcatgacaggcaatattcctgcgcctatttccccaccgggcaggaaacgctggaagaggcgcagcgcctcaaaaaacggcatattgccgccaagttgaagctggatcgccctgatctggatgttctggaaatcgggtctggctggggcggtatggccctgcatctggcccgtaaccatggtgcgcgcgtgaccggactcaccctttctaccgaacagttgaacctttcgcgtcagcgcgcggcagaagcagggctgagtgatcgtgtccgcttcgaactcatggattaccgcgcatggcgacagccggccgaccgcatcgtttcagtcggtatgttcgaacatgtcggcattggccactaccagacattttttgagactgtacgggacaggctcagaccggatggtatcgccctgattcacgcaatcggtcgcgccgagggtccgggcgccaccaatccatggatcgcaaaatacatttttcccggcggatattctccggccctgtcggaagttctgcctgcggtggaaaaatccgggctatggacgaccgatattgaaatcctgaggcttcattacgcactgaccctctcgcactggcgtcagcgttttcaggaggcgaggccgactattacctcgctgtatgacgagcgtttctcacggatgttcgagttttatctggccggatgcgaacttgctttcagaaatatggggcatattgtctggcaattgcaggtctcgaaatccctgaccgcccttccgctgacacgcgattatatgttcgaggcggaacggcaagcagaagggtgaaggccgcgcctgcaggcgacaggacgcttaccagccgaaactacgataatacggcccaccccagccccattgctgccagccaaaaccgggatagccccatccccatggcaccccgccccacccccagccgcgataatagggatatgccaccccccaaccgccgccaaaggtggctccgaatacggtggctgcggcaatggtcgatgccagataaggagccgcatatccaccataggccggaggataggcgggtggataagcgggcgggtaagccgtgccatcatatacggggatagaggccggttgaggctgagcagagggactaccccccgccccggtcacaacgcctttgcctgcctccgggcccgtggtttgcgccacggccggcatgggcacataaacaccattatatccgaatgaatcataggtgcagcccaccagcaaccctgacagcatcaaggccaatatcggcgtgatcggaaccgcctttctgcgccactgctgcaagaccggcatgacagcatctttcctctttgcctgcatgaagacatgctacccggtcagccgatcagaagcgacttactgatcggacatgcattttcctgttgcatggggtgattgtcctgcatcaacgctcatgaggccacaaaaccatatcgtccgcgggggcttgcggctatggtgggcatgcggggcagaacttcaaaaacttgatacactttcttctgcaagccgttgtatctactagcgcttgtcagtgatccaagcattctggacgggtttatgatcttacggttggctcgcttctttcttctcatcgggctgaccctgccgggtgcggtgagtcatccctcaaccgcccaggccgagggactggcttttgtcatcaacagcaacgacgcgaccatcagcctgatcgacatcaccagccgtcaggaagtgaagcggatccccgtcctgcgggagccgcatcatatggcgctcacaccggatgaaaaatccctgctggtcggggatacggccggtaatacgatgttcttcctcgatcctctgaccggggcagagcagaagcgtatcgttttcagcgatccataccagatccagttcagcccggatgggcgttggctggtgtcagcagcgctcgcccgtgaccagatcgacatctatgacgggcacagcttcaagctgctgcaccgtattcaggcgccctccatgccgagccacatcaatttcacgccggacagcaaggtcgccttcgtctctcttcagaaaaccagcaaggtcgtagccttcagccctgagacgggtaaaatcctgtgggagcagaaatccggccgcacccccgccggggtgctttatctgaacggaaagctgctggtcggtgatatgggcgaagacactatcgccgtcatggacccggtcaccggaaagctggaacgcaagatccgcaccggtaagggagcccataacctgtttctctcccctgatggcaaggttctgtatgtctgcaaccgcgtgggcggcaccatcagcctgctcgaccccgcaaccctgacagtaaagaaggaattcgccatccccggcggcccggatgatctggatttcgccccagatggatccatctgggcgacgcgccgctgggcacatacagtggccatcatcaatccgaaagacggcagcttcaccacgatcccgaccggtcgctcgccgcatggaatctggctgaacacgcatctggctgctcccgttagagccgcctccacccgcgcaccataaaagccgatcaccacaggtttctcgatgttcgatccctttgacagcgcagcaggctggcttcaggaacatctgctgatccccctgctctggcagttgaatctgatcgaatgggaggatgtatcctacggatgggcgttgatcgccatgtatggggtggcgcaggtcatcctgatgtatgcgatctgcgtcccactggagaaatggcgcccggtcgaacaatgggaaaataaccacgctgtgttgaccgatgtgctctataccgtcatctcgcgtgtcggtgtgctgccactggtcagctttgtcgggttttatcaggtacaggtgctgctcaatggctggctgaccgatcatggttacgtgccccccacactggagcggttcatcccatccctgaccggccatccctatgtgacgtttgcgatctatgcactgattctggattgcgccgattactggcgacatcggctcagtcataagttccgctggtggtgggcgcttcattctttgcatcatgcccagcgacagatgacgttctggtccgatgaccgtaatcacctgctggatgatttcatctccgcactctggtttggagccatcgcactgatgatcggcgtaccgccccttcagtttccactgctggtgctgctgcttcgcctgatcgagagtctggcgcatgccaatgcacgaatcagcttcggccgcatcggggacagactgctgatctcaccgcgctttcatcgtgcccatcacgggattctcgccgcgggacaaagaagctgcaattatggtgcggtttttccttactgggacatgctgttcggcaccgcggatttcagccgggtctatgtgcgtaccggcgatccatccggtgaggaggcattgcataccggcacctatgtccagcagcagatggccggattacgtcgcttcatccgctccctgcgaaagaaaaagccacaaccttcctgagcattttggctcatcaggaaaagcgggcggccccctgacaggaccgccctgcccccgttatttcgcctttttggcaatgcccgccagaccgccttcataaataccagcgatcaccttggctgcttccgcatccgatgcacccttggcatcgaaatgcccgacccatgtcacttccgagccgcccttggcaggagttacgctgatggtggatttgtaattagccaccggcaaagggctttcctgaatcgtgtaggtgtaggattttttcgcatcattgcggtcaacctgctgctccacgatggttccaccacctttcagcgacaaggtacgctgctcagcaccagccacatcgaccagctcgcatttggtcacggccggatgccatgtggcgatgccacagaatttgccgatcgtgctccatacttttgcgggtgacgcggcaatatggatcgacttggtaacatccacggccaaagccggggtggcaatcagggaggccagcacagcaggcaccacgacacgctttaacattcaacgtcctccagacattttttgacctcgaccggaatggccatggcgcaacccttccgggctgacttgctggcagcatggaccgtatcattacggtttcaaagtgtaaaaatcgtgccattgataaagcctgccggaaagtcttgaagccccgccatcctaatgagcctgactaggcgactaaaaaaataaaactttcagatcactgaacactggcgcttcttatattaagaagaaaattaaaataattatgcactcaataaaaaaaacccgccaaaattgacgggtttatcagagttcagtgggctgatctaatgatcagccctaatcattagccttatgccaaaagcatcaggcactcagagcaaacgccttcatttcctgataaacttcatgctctatcaggcgcatgcgaatggcttctagctgtctcccatcttctacacgcggtgcgcagtagcgtgcaacagccacaccgttccgcttccttccacgagctttcaccttcgctgcaccttttccagtataagtatgtgcattgtggaacatgctccggttgttgtcctccacatagctttcagacgcagcaccctcggcaaacaccacatcatgcgtatcaagctcgatatgcacgtagctcactgtctccacatgctgttcctgaacgatggagacaccgttcaccagacgaccggccggaaccagaacaccgtcaatgaacatcgcatggagtggggagaccagcaggtcacgcttcggcaacacaccgtccaaagcaccctgacggatacgaaccggcagcacatcacgacgaccctggataaagcgaccattatagctccgacggcccagccagcggatcggacgaactgcctcacccgctgtgatcacgtgatccccgatctgcagatcttcaaccggaacctcaccacgatccgtcaggatcagcgtgccatgcacatagcagggcgtgccgtcatcatagaccgttaccccattcccgccctgagcctgacgcatcttgtagttctgatcatgtgcattcggatcaagcttgatcgagtaatactgggtcttggtcccgtcactggccacatgagacaggatcaggaagacatttcccccattactcaccacatccaccacgtcggaagcctgagaagccaatcccatcagcgtaatggattcaccgttaccaaaatcggaaacagtcgcggccaatgctgtgcctggcgtgctgatgataatgttaccagacccgacacccgcagaactcgtgccacccaacgtaatcgtgttggaggaatccagggtctgcgagaccgtcactgtgccattcgtctgcatcaggatattcgtgttggtcagcgtatccgccaacacccatccatcacccttcacgttgatcgtctggaacccggtatattgggtcccaaacccgctcagagtggtgccagcaccatccaattcaagcacgttgccagtgccggcagcgacaacatttccacgaatggaactaccgctcgttatcgccagacggctgttgccagcaccaaagttaatcgccgtacgggtcacaccggctacaatctgagcagcaaccgaaccggtattaataaccgttccaccagcggtcagtacgatagcctgaccaaacgcacctgcagcgcttatggtgccactgttcgaaacagttgcaataccacttgcggaaataccatttgaaaaagcaaaatcagacctcaacaatccagcattattgaaggtgccggagaccatttggactgctgtattacttgtgttgttggctataatcgttccactgtttgttatggaagcatttaggccagcagcaataataatggcatttgctccactgccctgaagcaggccaccattgctgagggtagaagaggcacccaatgagataagcgtactctgcggctgccctcccaatattgtaccattattgacaacatttacggaagtacccgtagaaacaatagcaggtgagaatgttccattaccaatattagctcccacagcgtttgtcagagcagcaccggaagtcatcgtaataacaccggctaatgttcctgtgttattaatagtcccactgttagtaagcacagtcgatgaggcaattgaattactacctgcgaacgaccacgtagctcctgcatcgacagtagcgttctggaagccgagatattgcgtgccgataccgctgatcgtgcctgcggaggctccggaaagcaattcgagtgtattcgttccggcactattggccgtgacgcttcccgtgatctgggagctgacacccagctgaaccaggttgataccgctaccctgcagggcaatagccgggccagaagaacctatgatagtaccgtaattggcaaccgtgccagccaaagcagagacgataccggtggtgccaccagagatgtatccacccacctggttggtgatattggcattgccggccgcagtgataccgaaagcaccacccttgatggtaccgctgttcagaatgctctgcgtaagggtcgtaccggtgaactgaacgccgattgaattaccgacaatgatcgcagaagcccccatattctggatagaccctgctcccatcacaacgcccgtgctggcgctggtaatagacccggaattagtcagcagattggatgcattaacattctggaagacgacgcctttgccataggcaacattggtaccgacaagtgttccggcatttataatcgtgcctgcatccatgcccagaccagcccaaccgcccgagatcgaacctgtagagctattcgtggcataattattggtagtatttccggttagataagcccctgcatttgaattgcttgaagaaataattgagccagtattatataaactaccagtgccataagtatgaataccatcattgaatccactgatagtaccattattaacaatataattatttgtggtgccggaagcatcaatagcatgagaagcaggatctgttgtttggataaatcccgacgaattatttgtaatggtaacgaaaccaccactgatactgatcgcattactgcctgtaatagtgccactgttattgatactagcgccgccagagccaataatagcctgaagagaaccagagattgttccaccagcctgattagtaacaatcagacttccagcagcgctaataccgatattaccacccttaatggaaccgctgttgttaaccagaccggttccagcggcggtaacaaaaacaataccaacagtggcgccactaagaacagcactagcggcattcgtaatactaccaccacccatccaaacggcactattaccaccagtaatagttcctgtattattcagaagattagaattatcagcagagaaaatatttacgcccataccatactgggcattgctggcattaatggaaccagcattggagacagtaccagaatacattccaataccgtaattgccaccctgaaccaaacctgtagcgctgttagttgcaaagtttccggtgccattcatatacacgccactgaatgaaccaccgtttgaagagattctaccagtgttttgtagtgtatttccaccaccggagccgagattagcaccatcagtaaaggctatgatagtgccgttattgacaagaacatttcccgttccagcggcagtaataccaaaagtacctccagtggtaacagtcgactggatcaaacctccggcagcgttggtaatatggccattaccagagagagaaatagccttatatgaggtaatatttccgctattaataacagtggcaccagtgccatttgattggatggcagcatactgagttcctgtattagtaatagaggaagttatagcattttgaataacaccactacctacaataataataccatttgtagcggccagtgtccctgtattggtcaggtttccattattggtgaaggaagtgaaattagtgttattcccagacatggtccatgttgcagtggtatccacgatacctgtctgaaaacctgcaatttgagaaccactgattgtaccagccgacgaccctgccagcaattcgagagtattgttccctgcgatattagctgtagcaacacctgatatttgagcagcaacacccacctgcaacagattggaaccattaccattcatggcaatagccgtgccagatgaacctataatagtcccgttcgtgttaatagttgccggctgttggacaatgataccgatattaccagagatgtaaccacttagctggttagtaacattgagggaaccagccgcgctgataccgtatgtcccaccttgaatagtcccagtgttttgaacattaccagcagcagcagatgagataaataggacaccataggccgcaccactgatacgggctgaagtccctgtattctgaatggttcctgcgcccattataacagctgtgctagcactgctgatggcacctgtattaatcagctgattactagcattggccaaaaagaaggttgcgcctctgccaaaggtagaattactggctataatcgttccggcattattaatagtgccgccgtccatgcccaggccaaatcctccgcccagaacaagcccagtatttgaaatactatttccactatcatgcagaaaagcaccactggtagcagttccagtcgtctgcaatgtacctgcattgattagtgtgctgttgccaccaagattaaccgcatcagatccacccttgatcaagcctgcattctgaacatagttatttgtgccgccaatattaacaacaaaaccagtaccatttgaaattatctgagcactagcattattggtaatagtgccagaagaaagcagggtaatagcacctactgccccaattcccaaggcctgaatggtgccactattattaataacacctccgctaccactagcagtaatagcgtatagattactagcagcattacttattgtagcagtatttgcatttgttagagacgccgtactggtatttaatataattccctgagcggctgacaggcttccttgatttgtaagcgcgccattgtttacaagtgaagtgaaattgccgttaccggaaatcgtccagactgcaccagcatcaatagaacccgtctggaatccaacgaagttagatccattaatcgttcctgcagatgctcctgaaaacagttcaagagtattggttccagagctattagctgtggctacaccattaatctgggatcttactcccaattgcagaagattgatgcctgcaccgcccatcgcgatagctgtagcgccagcgggagtgaccgtcccataattagtaattgtattattgctgccagatccaacaatagtaccaatcactgaaccagagttaatcaaaaggccgttgttggaaagtgttaccccacccgacaaagtaccaacggtagtattactgatggttccactgttattaaacacacctgcgtttgtaagcagaccactgtttgtaacagtatagcctgcagctatactattgctgcctgaaagggaccagcttgcccccgatccaactgtaacgttctggaaattagtatagcttgttccaatgccactgatcacgccggcattagaagatgatagaagagataaagtattctgagctgtagttccacccattaccagcccggtgaactgagcacctgcaagcaattggagcaggttctgcccactgccaccaaaaataacagctgtgccccctgcacctcctatactaccagcattggtaatagtccccccagcctgcagattgatggcaacaccagatccagaagtacctgcaatggaggcattggcatcattaacaatagttgccgcagccccagttgcataaatgccgatcagaccaccagaaataaccacaccgctggcgttggagacgtaaccaccattcagcagcccgataccatagctagtgacaccggtaatagcgccaatgtttgtgattgtaccggcagcaccattgatcatgatcgcgctatcatcaccactcacaggaccagaattgataatcgtcccaccagcctggaatgagataccatatccagcaacagttccagagcggtgaccaaacagagtaccttcattagtaacggaacttgcctgaccactaatcgcagcaccattcgaattaataatggcacttgaaagagcattagtaatggcgccactaccaacaaaagaaataccaccataaatagcagaagaatttactataaaaccgctattaatgatgctgccagtacttacaagcgtactacggttaataagtgttcccataacattcaaagtcaacccgggaacaaaagaattggtaccactcataacccaattagcattctggtcaatctgagtgttaataccaacgtattgggtacctattccactgatcgtgccagtcgtcgagccagaagcgagttccagataattgagtgtaccttgagcattgacagtaccactcaagacagcagttggaaccaaaatcaagcgattggaactgacacccatcgatattactgtgccagtactgtctggatttagcgtcccaacattagacaacgtacttgaaaatcctaaattaattttaccggtaaatgtaccagtattagtcaatgttgccgcatttgcagcaaatgttacagtactgtctattgaattagaccctgtcagattccagtttgcattgctcgcagcagtaatctggttaaacccgacaattgttgacccaattccagagatggtaggtaggttaccggcctggccaccaaacatattaaggcgattaagaccaccagcagcgataacagagccgacaatgcctacactgttattgaggttcaatatgttggtaccggtcccgcctaaataaacggctgtgccaccggcattagaaatcaaaccgctatttgtgacagtgccacctgaaccgaggctaacggcaattgtaccagtctggagcacagttccagtgttgagcagaaccgcatttgttccacctccattaatctgtccattaatagtaccagcatttgtaatggtcccatttgaaaccaaggcaacattaccagccaactttgctgtagatgcattgctcatgctgccagcaattgtcaaattacttgcaacgctgatactgccactatttataagagaggcagattgagcaatcgtattggtcccattaatcgcccaatttgcaccgctatcaatagtgacagactggaagccgatatattgtgttccaataccactgattaccccggtagaagcaccggaaagcaattcgagtgtgtttgtaccagcagtattggcagtaacattgccagtaatctgggagcttacacccaactgaaccaagttggccccagtgccctgcatcacaatagcagtaccagaagaaccaatgatagtgccactgtttacaactgttccgggaagcgaggagacgatgccagtgctaccacccgaaatatatccgcttgcctggtttgtaacgatagcgttcccagccacactaataccgaaaactccaccctggatggtgccgctgttaacgaccacacctgacgcagaagcggagataaactgaacgccgtaagaattaccactgataacggctgcggatgcggtattgtttaaagtaccaccacccatcacaacagctgtactttggcttgtaacagtcccggtattattgactgctccatttgtaccaaaaacagcaagacctttacctgtagaagtcagtgctacagtcactaagccggcattatcaattgtgccggaatccatacccaggccccagccgccgccgattacagtaccgctagccgcattcgaaatgtaattgccggtaccatgaaggaaggcaccgctggtatacgttccttgtgtttgcagcagcccggtattgataagggtattgttgccaacagccgaagcaacaagggtagaacccaaattcacggcatcactaagacccaggatagtgccatcgttcctgacatagttaccagcgccatcaaatttgacagcaaaatcagcactcacaagggttgcccgcacagtagcactggcaatgttggtaaaagtaccaccaccactgcttagactgatgccaccgccattaataaggccggcattataaatattagcccccgcactaccaaaaatagcacgtgaagagccagatatagtgcccccaacctgattggtaacgatcaaacttcctgcagcgctgattgcgtaattattagcctgaatagtgccactgttattaacggtcgcggaaagcgcagactggatgccaaaacttccagcagatgagataagaccagtactcagattgctaacagcgacagccccggctgcgctgatagcgttattaccactgagaatggtaccactattggtaactgttccagttacaatcgtagtaacgctacctgttactagcgatgagccagtgaacagaatcccatacgctgcaccgctgatcgctgcagatgtaccattgttctggacactgcctgcacctagcagaacacctgtcccaacacttgaaatcgctcccgtattaacaagactgttagttacattgacatcttgaattgatacacccaagccaccattaggatttgtagcggtgatggtgccagaattattaattccgcccgcacccatggtaatggcgttaccacctgagattaagccactgtttgtagcagtgttgccataaccatcaagggcagcaccattacttccaacgcctccaccttgaattgtacctgtattaataagtgtattactattagtaagcgttgtggcattgttgccacccaaatggactccatcaccagagccagttattttacctgcattattgactgtgttattgccgttattaatctgcacagcccaattattgccggactggatcaaacccgaggcactgttggtaacaaagccaccgttaccactcaatagtgtgacaccattaccttggatcgtgccagcgttagaaattgtacccgtagaaccactgacagcattattagcgcctgaaatagttccaccggcttggttggtaacaaaaattgttcccgcggctataataccctgatttgcaccagagataatcccactattattaacagaaatactaccaacagaggtaatacctatgttaccacccaaaatcgttccggtattatttacactaccatttccgacaagagtagtactaccattagtcacaccggcaaatatgataccagcataagtgccgttgatataagcatttgcagcggtattgttaacaacaccgccacccatgctgattgccgtagatttacttgtaatagttccagaattatttacttcattaaaaatatctacagtataaatattaacgcccataccaaactgagtattggtagcgttaattgttccagcattattaatggtaccggaatacgcaccaagaccaaaagcaccaccctgaatagaaccagccacgctgttagtggcataagctccggtgccattcagataaacaccgctgttattaatgttagatgatagaatagaaccactattatataggctattattagagccaccaagattaactgcatcgttttgagcagtaataccgccaatattggtaacaacgtttccagcgccactagaggtgacaccaaaattattacccgttgcctggatctttccggctgcattattggtgataacagcattgccggacaaagaaacagcgttagtcgaaataacagtaccactgttaataaaggtagcacctgtcccagttgaccaaatagcatactggttacctgtcgtggcgacagaagctccggtagcgttgataaaaacaccggttcctgcaatgacgacaccattcgtagcagacaataaacctgcgttggtgacagtaccactggtagtaaatgagttaaaactaccgccaccattgattgtccacgtagctcctgcatcgacagtagcgttctggaagccgagatattgcgtgccgataccactgatcgtgccgacggaggctccggaaaggaattcgagtgtgttagtcccggcattattggccgtaacgcttcccgtgatctgggagctgacacccagctgaagcaggttgataccgttaccctgcagggcaatagccgggccagaagaacctatgatagtaccgtaattggcaaccgtgccagccaaagcagagacgataccggtggtgccaccagagatgtatccacccacctggttggtgatattggcattgccggctgcactgataccgaaagcaccacccttgatggtaccgctgttcagaatgctctgcaccagagtcgtgctggtgaactgaatgccgattgaatcaccgacaatggtcgcagaagcccccgtattcgtaagagaccctgctgccatcacaacaccggtgctggcgctggtaataagcccggaattagtcagccgatttaatgcatcagcattgaggatgacggcgcctttgccataggtggaattattaccgataagcgttccggcatttataatagtgccagtatccatgccgagaccagcccagccgcccgatatcgtagctcctgagctattcgtggcataattggcagcattgccgtttaaataagcacctgcattggaagtgctcgaagaaataattttaccagaattatacagactaccgatattataactatgaatagcatcatttgttgcagtgacagtaccactattaataatagtattatttgcggtgccggaagcattaatagcaaaacgggtagcatctgttgcctggatcaatcccgacgaattatttgtaacaataacaatatcaccgccgatactgataccattcccacctataatagtaccactgttactgatactagcacccccagagccaataatagcacgagtagcgccagatatatatccaccaacctgattagaaacaaacagactgccggcagagctgataccaaacactccccccgtcacagtcccactattagtaatggtgccgttaccaaatacagccccggccccactaacagtaaaaataacaccgatggaggtccccccaatagaaccagtgttattaatattgccagcacccatataaacagcagtatcagcgctggtaatacggcccgtgttgttcaaagaattgatggtatcggtactaaaaatggttacaccgcggccacctggtgaattggtcgcattaatcgaaccagaattgaaaattgtgcctgagtacatacccagaccaaagttaccaccctggataaaggctcccacgctgttggttgcatagtttccgctgccattaagataggcaccactgttaccagcattacgtgaaactaatgaaccagcgttactgaggtaattattatttccacctaaattcacagcatctgttgctgcggtaatgccaccagcattaacaacagtaccattggtggatacggttacgccaaaattagcgtcgagaccagtgatagtaccattagaattgttggtaatgctggagctatcaccggcaaagatgccacctgcccccgatatgctaccactattgttgacggttccctgggcgcccatctggatgccccaataggcagcgttaccgctgccaccactaatggatgccgcagtcacattgttgataaggccgccacccgccagactgatgcccgtcgtggtgcccgagacagcaccgctgttgttaatggtccagagtgttgttagagcacttgctacccccaccccgttggtatttgaaacggcgacaccagggttgatataaatcgggttcgtataggcgttagttagaataacacccgaagtggttgaagtaagattgctcattataaatccaccctaaactaacccaataagattcaattttcatatagcagatatcagtttttggatttttacataaaaatgggtttaaaaacaagagataatattatttatgatttgttattttaaataattaaaactttaactttatttttgcttttgacgcacttttctactttacatcaataaatttctcctctggttaaagaaaatttcctttagatgtcaatattaattttaattaatataaataaattattttcaaaattatttttattaaataataataaattaatttttttgaattatttcattttagatttttaaaaattttctaatgtaaatttaataatacgaataaataattttgacgtgtttaaaatattttgtattttatatagaaacttacaggtgaataatgagatttaagtttcacattttacttgcgctatgcattctctctaccaccctttcgtaacatcctgcttcagcccagacaatgactcttagaaaagtcgttgcgctggttcggcacagcatacgctcccaggatataggtgctccaaacagcctggctgccccttattcgccacttaactggccgacctacggggtatcgaagggtaacctgaccgcgacaggaacggcctttgccaaaaatatgggaggatattatgcggatctgtacgctacgcttggattaaaggctgcatcacaatgccccccaacaagtaacggggtctttgtgtggtccgacaacagaacaccacgtactatagcaaccggaaccgctttcttgactggtgcttttcccggttgtggattatcagcgcatttttaccagtcaacttccaatgatccacttttttattataataatataagcctcacagccggaacacccagccttagcatcgccccacagatgaatgtgatgatgcaaatcatgggagccccggctggagacacttatacaagttccaataatccttgtaattcctcaacctcccccccttcgcaaaccacttgcgcagatgtcggagattatgcagatgaattcaggctgcaatatgcttccggcctgtcagtcaacaatattgcctggggaagctggagctcccttggcattgccaaacaacagatactgaacgaaattcagctttatactcagtggtatatggcagattacagagctcagagcccgaccgaaaattgagttgagcgatttcagtcagttgtgattcaccgggggttgcgaagaccacggggatcacatgggctggaccgaaaccgctcgccggagacatgacagaagagggctgcggtacgcaagcgactgcaccgatggggaataggcgctggttgctccgtttctggcccgaacgacgaaggtaggccgcccgcggctccaccgggcacgggatgtgtggaacgcgatccagtacctcgcagcgacggggtgccagtgggcgcagttgccccgggactttccgccgttcacgacggtgcagtatcatttctaccggatgcgcgacagcggcctgctcgatgcgatcaacgcggtgctggtgaccggggtgcgggtcgcggagggccgcgaggccgaaccgacggcaggcatcatcgacagccagtcggtcaagaccaccgaggccggtgggccgcgcggctatgacgccggcaaaaagataaaggggcgaaagcgtcacgtcgcgaccgatacggcaggcaatctgctcgacggactggtccgtcctgccgacatccaggatcgcgatggcgcgccggaactcatcgcacgctgccgggacgcctatccgtcgctgtcacgcctctttgccgatggcggctatgccggacagaagctggcgaccgccatcgagcatctcgaccgcctcgcaatcgagatcgtcaagcgctccgacgcccatcgcccttcgacttcgctcaggagagccttcgtcgtcctgccccgccgatgggtgatcgagcgcaccattgcgtggctcaatcgatgccgccgcctcgccaaggactgggaggcaaccatcgcctcatccgaagcgtggctcctcatcgcttccatcaggcgaatgacccgacgcatcgcaaagatcgaattatgagtcgggctctcagacgaatggggtcgccaacggcacctttcgttccgaaaatatcgccaaccagatcgcgctggctttgtctcaggtaaccactcctggaacatccggggggccgcctactgcacgtttggttctgtttgtaggacacgattccacggtccaggctctgggcagcctgatgaatgcaagctggacctctccggatggcgtcagtaacgattcacctcctgtctccggttttgtttttgagctttatagcgatagcagtggcaatttctttgtccgcccccgttttattgccgcaacacttgaccagatgaggcaaaaccggcgcctgaccgccaatggcagcaataatcccggcaacagcactcttatcattcccggttgcacgacacagagtgtcgacagatgcagcgccagcacattcatcagcatattgaataccgccattgccagcacaggcatcacgccttcggcggtgccatataactgagtatcggcttatcgcggcttttttttaccctagaatgtatagatgacaacaaccaccacgaattccggaaccatcagcacaggaatcgtcactgtttccggttccgaaatatacaccaacaccacaacggggctgatcactgttccggtaaccggaacagaatatggtgccgggatcatcaacagtggcaccatcctcaacaacgcagccagcaccggggccacgacggccgtttcattgaatgacaccggcagtgtggcaggcagcgccacgaacatcgacaataatcaaggcgccctgattcaggggacggattatggtctggatatcgaagcggcttcttcatccctgaccctcagcattaccaaccaggggaccattctcggcggtgccggagatggtagtacaaatggcgttgccatttatggcattgccaacaccacccttgtgaacaacacagggggcgtgatttcaggggatgataccggcatcaggcttggtgtgcctgccgccaatacctctccggtttcttatagtatcaccaattatggaaccatcaccggtatcaataacaccgggatcgatctggcatccggcggcacagtcaccaataatcatggtgcagtgatcaggggttactgggccggggtggccatggtggcaaacagttcccacaactcggtgacaacgggcggcactgttatcaccgatggtacaatcatcggtcagaataacatcgccattcagttggcggcgccggtttctatggagccttatagcaatcaggtacagatcggtaccgatgccgtgtttgaggggatcgtggatggcggcgtccccgccagcagcacagtggcatcaagcgctttagtattgatggcagcgacctcttccgacaccaacaagaccggaaaactcagcggcatcggcacggagttcgtgaacttcagcgccctttcgctcgccaatggagcaggctggattatcgacggagggctggacagtatcagcaccgtctcacttggggccgcctctgaactgacgctggctggtacaggcactctcacctccagccagacgattgcgttcaataatggcggttccagactgagacttgggaccggatacgccctgaatgccgggaacctgcaactcggtcagggggcggataccatccaggtggcggatcagtctttcaacctgaccgccgggagcggtgccctgacctttattgccggctcgggaaaaagcaccattacgggcggttccggtgccctgactttcactggcggaagcggtgccagcaccgtcacaagcggcgctggcggaggcaccctctccggcggaagcgatggcggcaatctgcttgtcgcgggtggaggcaacacgcaactccgtgcagcaggcaatggcgatcagttgtttggtgccagccatggcagttccaccctgatcggtgcggccaacggtcaggtcagcctggttggcgggaccggtaccgcactcatcgttgccggctcaggcgggggtgccatttatgccggctcgggtagcagcactgtatttggcagcaatgcaggcggattggtcggaacgggcaccggcaacagtctgctggtcaatatgggacgcagcacaattgccggagaaaccggcaccagcaccatattcggcagccaatccggacagaacacggtattcggtggaaccggtgccatgcagcttgccgaaaccggaggcagcaatctcgtgatgggcggaggcggtgccatgaccctgtttggtggcgttggcaacgataccatcctcaccggccaaggcgggatcatgacggctttcctcggtggcaatcagaatttggtgggtctggggagtgccaacaccacggtcgtggcaggctcaggcagcgatgttttcgccgttaccgccggtgcgggcggcggtacaacaacgatttatgatttcgaccccagcaaggataaaatcggactgttcggctaccaaccctccgagatcagccagaacgttaccaatggctcgttgcaaatttcgctctctgatcacaccgtcatcacactgtccggcgtgaccaacgcacagggaagcatcctggccacctgatttcccgacccccgatttggcaggctgatctccctgctactttaacgtgacgcttcctgaggttgccgaaacctgatcagacgaaacgatcaatacgaagatcccgactgtttctgtttcatcagactcgtgatcagagcatcggcaatcttgtgagccgtattcttgacatcggtatcggtactgtacccggccagcacaaaggatgccgcggctacgtacgggttgagcatgagaataccacctggtttcttaccgctttgtgcttcggagttcatggtctcaagcaggaccggcggctggttggtcgaaaggttttcaaccgtcgtttcaatttgcaacgatgtttgcccgctgccgaagccgatcatggagcgtttcaaccgattgccttcatcaatggaaacgaatctgccacgcacaagccaccctgctgtcggagttggctcacccggttgcaggcggcgtgccgtcagaccggcttttgccagatccgcgacaagtgtgttcgccatgagttcaacgaaatcatgcacctcatcctgttgagaggtaaggatatgctgttttgcaagcagcccttccgcatgaatcgtttcaggattgagtgtaaaatcggcaacatagacgacaggcggcggtgccccatccgtagagtgatagacctcattcgactgaacccttgccgtggcgcaggctgaaaggaaggccagcatgatggcgccaagaaacagccgaaaaagatttatcatcatgtgtcccttaatatttcagatgcctgcaatgcggatgattttcagaaccgtcgctgacggacggcccgggccgaatgtcacctcctcctccaacgcggccccaagcagggcctctgcgaggggagaagcatagctgatcaggccctgtttcggatcggcctcatcttccccgacaatgcggtaggtcacggtacggccccccagcttcaacttgacggtatccccgaaagcgacctcctccgcattctccggcgcggttggcaccagttgagccgaggcccggcgcgccagccagtagcgcagatcgcgggccaggactgcccggcgctcgctttcctcaacagtggactgtttttcttcagcgagagccgtttgcaaccgggcaatttccgcctcgatcgccgtcagaccgctgagcgttaccagattggggcgatcactgatcggacgctccggcaattcagcggcctgagccgccatcgcatcctcggaaacgaaagcacgactcatcccgccatggctcccgatgtcagcgtaaggcgggtccgcacacgttcagcccccatcagggggagcagagcagccagttcaggcccatgctcctcccccgtcagcgccagacggagcggacggaacaaggcgcggcccgatcggtccgatgcctccttcaccgcgcgcgtccagacagaccatgtggtggtatcccacggctcctgcggcagcagagggagggcctgcttcagcagggcattatcctcatccgtcagaaccggtggcacaatgctgcccgcaacgacatcccaccagagacgtgcctcagccagcatatccagattgccgcgcacagcctcccagaatgcttctgtcgcaccctgcggcaaacggtcctgcacggcgctgaacggcatagtctgcaaggtgcggcgattcaacgcggccagctgactgccatcgaaccgggccgaggaagcagaaaacgcatccagatcaaactcctgcgccagttccgccagcgtcaatggctgcggatcgcgggaggagccgagccgcgccagataggaaaccagcgccaccggctcgatcccatcccgtgccagactgcgcagggtcaggctgtcgatccgcttggagagcttgccgccatccgcatccatcagcagcggcagatgcgcaagcgcgggagccaccttgccgagtgcctcgaacaagtcggtctgcacaccgctattgctgatatgatcctcaccacggatgatgtgggtgacaccggttgcaatatcatccaccaccgaggtgaacgtataaagcggcgtgccatccgcacggatcaccaccggatcggagatcgcctgcaacttcacctggcgcggccccagcacgccatcgcgccagccaacagtgcggtcggacagaagaaaccgccaatagggccgcttgccattggcttccgcctgagcacgctgctccggtgtcatcttcagcatggcacggtcataaaccggggcacgtccctgcttcagacgcaattcacgcttgtagcgtagttcttcctcgctttcgaaacagggatacagacgaccggaggctttcaaagcgtccgcagcagcttcatagcggtccatattgtcgcgctggcggaatgtatcggcccattcaatccccatccagcgcagatcctgcgcaatcgcttccgcatattcatcgcgggagcgttccagatcggtatcgtccagccgcagagtaaatttgccggaatagcgcagggcaaacagtgcattggctactgcaatccgggcattaccgacatgcagatagcccgtcgggctgggcgcgaaacgaacatgcaccatggatcaatcctcctgcccattatcatcatcggcagccgccgaggcggaggaggacgcaccctcctccgcatcatcatcatcatcatccgtatcccggcgtggatcgagcaggcgccagtcccggtcttcccctttggcaggttcacgggcgaataccccgacttccgcggcgctggaccagccatgctcgccaccatccaccacttcagcatcctctccgaaagcagaccatgcggccagcacgtcggccggggccataccggtttcgcggcaccgttcgaggctgtcacgcacatagcggcgcgcaaaggcattggcgtgcatcagcgtcagaaaacctgacacttcctccaccacgcgatcttccagcgccgcatcttcgggggccgacagatcgaggatgcgtacacaccatccaccatcgggagaaaacagatcactcaaaccagtctgcctttcatctgggcgttctgaacgcccggcgcaccaaaacaggaaacccgcccggctcggtggcgggcgggttggaagcctatcctatagtgcaattgctccgccgatagaagcaagacgacggaaaggcagacacgccgtttatgccgcctgcggctccgcctggaccacagcatggcgatgatcatgaatcagcgtatggagaaaggccagcttcgcctctacagcgctgttcaagacaaaaggatacagatcagcctcccccatgctccggttgagactgttcacggccaccgtcagcggaacccaggcggtgatcagatcttcgatacgatcaacctcatgggggccgaaatcaattttcgtcgccatttcaccgctggcatcggcctttgcccgcacctgaagcccgaaggcgttggcagtctccagcgtatcgacgatatgcaggtaatgcgcccatgtttccgcgaaatcctcccaaggatgcacgctggcataggcgctgatgaaattctcctcccaccccacaggggggccgttttcataccggttctgcaaggcctgctggtaatccagccgctcatcgccgaataccgcacggcattcttccagacggtcgccatcccgcaccagacgatcccagaagaaatggccgacttcatgacggaaatggccgatcaaggtgcgatattgctcgcccatctcctgctgcatcttggcacgctcggcatcgtcagcctctttcagcgcgatggtgataacgccgttatcgtgaccggtcagtaccggctcctccggagtgtcatccttgaaatcgaataccagcccctccggatgctcctgtaccgtcggcaggggcagaccgagctgaatcagcgtataaaacaggcgatgtttggccaactcaagcttctgccatttctccagattgccgggaatagacagatcgggaatggtccggttatggcggcaggccagacagaaccggtcggcactcccagtcgggaccagccagttgcagccatcattcactacattgtcgcagaaacgataggtgcctccatccgccatggcgcggaacacagctgttccatcttcctcaggttccatcggctccagcgcgctgagcgaagccgtctggggaatatatcccagcctgtgcccacatttgccgcattcccggttttcgaaatacagcaggtttccgcaatggtcgcagttgaagagcttcatggcatgatccgatccggcaatttgcaggctttaacgccagccggcatcagggtttccacgccgcgccccctgcagatgagatcagcgatccttgcggaacagaaactctcgtccaaccttcacccggttctttccatcataggcaatgatgtccgctgtcgcatatgtttcgctccagcgttcggggataaagctgcccgtgccgaccacatcgatcggcgcatgcgcatccgccatgacccggcatttttcagcgctgaagccggaggacgccacaatccccactttggggaaaccggcctcgtccagcgtatcgcgcatatgccagatggatgctgccgaaacaccggtgccgaccagataacgcagctcgtcctccgaccggtagcgacggattgcctccggcgcgtgcttttcaaggacggcgtaactcgcggaggggcttaaaccctccatgaaacgtccaccatgggtatccaggcgcacggcaagactgccggacgcagccctttccggaaaacgaccgcagacggtcagcgtgtctgtcagttccagaccgaaataatcggccagaatagtcattttctcctcgggaaatgtttcggcgaacatttcgcaggcacgcagggtcgagcctgcgtagcctatcaatgcatgcggcatagtgccgaaaccggaagaagccccgaaccagtgggcggtggcatcattggcattgccgataaagccttttgccccctcccgccgggctgccgcactgccaacggaagcggcataggccatgatgtcctccatttccgcccccgcacaatggcgggcttccatggccaaaaacgcagattccggcagggcaaggcacatctggctggcattcagcgccgcaacacaggccgggccgagtttctgaagcagaattgtctccagatcgaccaatgccctgaaactgccggatatatacagcagtggctccccggccccgacccagtccccctccttgtgtagggcctctatcatgacctgctcgccacgccgctgcatcacatcatgcagccactccgtcgccagcctggtggctgacagaaccggacgccgcaggaataccgcataagtgaccggcacatctccaaaccgggaaacgatggcccgcgtacggttgaaatacgcatcggtgcggctcgctatatcctcatcgctgtcgcgtgcctcatgagtgccacccatctgtcgctctttgcgttgttacgggatggatttgctgacatggtgcagacgctgcttcaactcactcgccagcaggaacgccaattccagcgactgttcggcattcaggcgcggatcacagaaagtttcataggcgcggccaagatcggtctcggtcaggcgatgagcaccaccgatacattcggtcacatcgcggcccgtcatctccacatggataccgcccgcccaggttccttcctgcgcatgcgcgtcgaagaagccacgcacctcgccaaggatactgtcgaaattgcgggtcttgaccttgctggtggtcgagatcgtgttgccatgcatcgggtcgcacacccacactaccggcacgcccgagcgcttgaccgcccgcagcaagggcggcaggcgatcccgcaccttatccgcgcccatgcggctgatcagggtgatgcggcccggctcggcgcgcgggttcagcaattcgcacaggcgcaccacctcatcaggatcggcattcgggccgagcttgatgccgatgggattatggatgccgcgcatgaactccacatgcgccccgtcgggctggcgggtccgctcgccgatccagatgaaatgcgcggagcagccgtaatactcgcccgtggtggaatcgatccgggtgaaggcttcctcataaggcagcagcagcgcctcatgcccggtgtagaattcggtttcccgcacctgcgcagtgtctttcaacccacaagcgcccatgaagcgcagcgtttcatcaatgcggctcgccatatcccgatactggctggccagcggggaacgctccacgaagccgagattccagcgatggacctcatgcagatcggcatagccgccggaagcgaaggcccgcagcaggttcatccggccggcagactggaaataggcggtctccatccgtgccgggtccggcacgcgatcctccgccgtgaaagccgggccattgatgatatcaccgcgatagctgggcagggtctccccattcaccgtttcagtatcgctggagcgcggcttggcgaactgaccggccatccggccgaccttcaccaccggcaggccggcgccgaatgtcagcaccaccgccatctgcaacagcacccggaatgtgtcacggatgatattggcggtgaagtcgccgaaactctccgcgcagtcgccgccctgcaatacaaaagcccgcccctgtgccgcttcggcaagctgggccttcagacggcgcgcctcacccgcaaaaaccagcggcggataacgatgcagacgctgctcgacctcactcaacgcagccgggtccggatagacaggcacctgcaaaatcgggcgctcacgccaggtttgcggtgtccaggccttggcagcacccggggcagagggtccggcggtcatgatcgtatccattgcgtatctcgttccggcaaattccgttctgtccaaccggagacggcatttctctatcgcgccggccggacaatccttccaagctaccctgcacacggcgccccgtccaattgttgccgtttcacgtcaggggtgtgcctccggcaacgctgcatgacgggcggtcctctgaattcacaataggaagcggtatccttaacgtgacagctttacgatccccgaatcgcatcctccaccaaggacagccttcttcatgagtggtcagcctgtcagttcccgcctgccatcaacccgcttctcttcctcccgatgggcgacaagactgttcgattttttcgaggacggggtgatgctgatcctgaccatcgtcatcgtcctgctggccgcgctgtcgctctggagactggtggcatcgctggtggtgatgctggccgagcatgggctgaacccctccgacccccaggtgctgcaacggattttcggcatgatttttaccgtgctgatcgcgctggagttcaaacattccctgctgcggatcggagatggtcgggaccggcccgccattcgcatccgctccgtcatcctgattggtatgctcaccacggtacgcaagttcatcatcatggacatcaaggataccggcatggtggagatgctctccctctctgccgcaatcctgtgtctggggatcgtatactggctggtgcgcgatccggctccgcgtctgccgggggagccatcctgaatgtgatcacgtccctccctcgccgccatctgatccggctgctatgccggaaccagccgaaagcaggcgggtttataccgctccggtaatgagaccgcacggagccagtcaggagatcgcatttttgcaggccgccgagcagcccactgaagtcatcgacccaaccgggcaacgacaggagcgtaaccgccgcaaactgcgccgggtgctgttgcccaccatcggcattaccctggttctcggatccatgtttgccatagggtatcattcctatattctggtgcgcaccaatacgatcaaactctccaacgaactgctcaacgcgacacagaattatatcgctcaggaagtcacgacctacctttcacctgcacagcttggttcccgactggtgcaggatctgcttcaacatggtgcgctcgacaataacggcaagctgttcaacttctacgcgggcggcatgctgcggcaggtgccacaaattcaggctttctatctcgccaactcggatggtgattttgcactggtacagcgggacggcaatggcggaacggagatcgtgctggtgtccgccggacccggcggggtcaggctccgttccgttatgcgtaataatgccaatggtgaactgatctccagcgacccccccagccccgatccctatgatcctcgcaccagcagctattatcaacagcccgtcaggaccaggcagccatactggtcgccgccctatattttcaaacccaccggacgtccggtcattacgacgtccaccgcctatcataatgcggatacccgcgatcacgtcattgccgtcaacatctcgctggatcagctatcgtcctttctcgattctctgaagatcggtgagcacggttatgcggtgattgcacagaaaaacgggcagattgtcgcgtcgcgtgatgtgctgggtcaggccgcgctcgatcccgtcaaggcgcacatcgccgctgagcccaaaaccgggcaggacactccgctctcccgtgctttcaatatctttcatgtcagcggatacggaccaggcagctttacccttaaacgcggtcaggacagcgaggattatgttttcatcgccgccaggcttcctgccggagcgcccgactgggtactgctgatcgtattgccgacaaaggattttgcagctttcgggacacgggacagccgcagcatgctgctctactccggcatgacggttgcgctggccatggtgctggccggtctcctgatccgtcagggcagacgggtcgagcacgtcatggatgttctgaccgatcagaaccagcgtgccgaggacgagcgccgatccctgcaacaattgatgagtcatcccgacattttcgacggcaacgaggaagcgccgatcctgactgaacatctcgcctcggtcagtcaggcacagcgtgccagcatctggcatatcggcagaaacggacgaaccctccattgtgaagatatctatgaccgtcgcagggacagccatatgggcggcttctccctcggcatgacggaagcaggaccattgctggaggccatcgaaggcggcgaagcattcacgattcaggatgccgctgccgatccccgtaccgagcggctttacaggctgcatatgagaaacagccagacacgctcgctctcggtacagcctatcccggatcaggacggttttgtcggtgccatcatgctggaagatgccgggcggctggcggagtcccgccatatcgtcagtattctcagcggtatcgtcggcatccgtctgcgcagccagaccgaggcagcaatgatgccggacctttccatgccgcagaccatcgctacgcagtctgcccctctacaaccgatggcaacagagtccagcctgctttccccccatgatcagcctgggtgggatagcctgcaaaacggcgtgtttccttccatcgtggcgatggtcatcactttcgatgtacagccgctggccatgagcaatcaggccgatcaggcagccatcatccgccttgtcggggacatggcctcggattttcaggagatagcccgcacacacgatattttttccctcaaactggccgggcaccggctgttcgccgtcagtggatgcagcagcacgcctgatcctcaggcagcattgcagatgggggatgccgcactggcgatccgtgatgcgtgcatcacgcggctggcaggagaggagatcgatccaaatttccatatcggcattgatgtcggcccggccatgggggcatggctggggaaagacccggccgtcttcaacatatggggccaggctttgcagggagccgaggccatgacacagggcaatgccctgcctggctccattcaggtcaccgaagcggcctacaagctgttgcgcagccatttcctgttccgcaaccggggtgcgttctacacgccgcaaaccggtatcagccgtgcctacagcatggcggggcggcaataatgcagacagccacgatcccggcacagagtttcgcacgggtgcggctgtttctgcgcgtcatcggacgcggcacacgcaacatgctgcgcttcctgctgatcatggtcgctgccagcgccggcgtggtgctggaggtcgggcgcccgtcctgctggcggcgaaccacaagggccgcgttcggtcagaccctgcatcaggccgcggggggcggcgtgatcagtaccctgttcacggcgacactggtcgggatcgctatgatttcgcaggccatctactggcttggctttgccggcatggtggagagtaccggcacgatcctggcaaccattctgctgcgggaactgtctccgattctggtcgggatcatcctgctgggccgcagcggtatgccaatgatctccgagctcggcatgctcagcgccaacggacatatcagaaccctggaggcccagggaattgatccattcattctgatcatcgtgccgcgcaccatcgctttcaccgtcagcgccttcacgttggggatggtgtttgcggtgacggccctgtgtgtcggtttcgccgccgccaccgaggaaggactaatcacccagtccctgtgggggtttctgaccagtgtcaccggatcgatgagtgaactggattatatcatcatccccttgaaactgatggtggtcggctttctggtcgggctgtcgagctgtctgaccggcttgtcggcccagaccgataacgatctgcaggccctgttatcccgcggctttgcacgtggtatcctgacagtcatgatcgtgaacatcctgttcaccgtcacggtatagccccatgtcccgtggtctcaccgttctggaacttcgtcaggctcaaccggatttcgccctgaccggcctgccgcaacgccgtatggacatgcggctgcaacagggcgaatgcaccttgctgaccacccatgcccagatcaccgccactgccttcgccagcctgtgctgcggtatacagcacccttcctcgggagcagtactgtttcaggggctcgactggacgcagatcaacacgctggaacaatatgccctgcgcggaaggatcggccgcacctatcaacgcggcgcgtggaataccttgagcgggaccgaccataatatcctgctgccccgtttgcatcacaccagacagaagatacccgatctgattgatgaagcggtcaaactctgtcttgaatttggccttcccggcctgccaaccgtgccccctgcccatctgtcagagactgatatggctcgcgcaggctatgtccgcgccttcatgggacagcctgccctgctgctgctggatcctcccccggcttccgagatcatgcccccgctgctggccgccctgacacgtgcgctggatcggggggccgccgccatctgcttcaacaccggacgccataactggcgtcccttcgccgatgcgttttcacaccggtttttattgaacgataacggcctcatcccgctacgggtatcatgatgcagcactccgatccttccacgcctcccggtacgaccatccgcccgctctatggacggcgatataccgatgaatgggtcgggtttctggtgctggcctgcattgccgtgtttgccggggcggtgattgaggccgggtttctgcgcgactggctgaaacctcccggagaactccgcatcctgctgccacagacaggagtgggcggcctctcccccggtgcggatgtggaggtcatggggattcacgccggcatgatccgccgcatgaagctgaatgccgatggcgagatgtacgcactggccgaaatagacccgcaggcggaaccctttatccgccaggacagcaaggccacaatcaaactgcgctatgcggtggcgggggctgctttcgtgtcgctgacacgcggcaccggccaacctttggactggaattatgccgtgctgtccgccaccaccgaccagaacccgatggagatgctatccagcaccatcaccgacatccgcaaacaggcgcttccgctcctgcataatgcccagatgattacggaaaacctcaatgccattctaaaaaatatccgcgacgggaaaggcagtgcgggcaggcttctgaccgatgatacgctggtgaaagaggcggaaagcagccttgcctcccttcaacaggccatggcgcggcttgatccaattgtcgaacacgcggacgggctgcttgcctccaccaatgttgttctcaacaacatgcggtctgcgaccggcaatctttcaaaagcatcgaaggatttgcccggtgtcatgcagaacgtatcgggcatcacaaaggatattcccccgctggtattgcaggcgcgggctacggcgcgtgatcttcagaagctgatcgagcaggtgcgcagcctgtggattctggggggcagcagcacaccaccagccgatatgagacggctgcctccctcggctgtacagccatgatacgggccagcgccttaccagccttgttcatgaccacgttgctgctgtgtggctgcggaggacatggcacgcaaaccctgccacaggatcagaaactgtccaacgctttcgatacgggccttcaggcgatgcgcttcctcgccaccgatcaggcggaacagaatttcgaggccgcctatcaacaggcgatgctgagggatgatgcatcggctctgcacgatgccggatatgatctggcaaccgcccagctggcacatggcaagctgcaacagagccttgacactcttaaacgcacccgtaccgggctgctgctgcgcaatgatcatgccgggaagcctctgctcgatctggtggaagcgagcgccctgtatcgcgcccatcgggatgccgaggcatggcaggctgcttcccgcgccttgcacaccaccgatccggccctgcacgagcgtgccgccttcgtcgccgggctgattgccgaccggcagaaagacctctccgccctgtcctcagcccggcagcagattgatcctgccctgtctccggtggcagccgccgatgcaaaggagctggatacgcgccttgccatgcagcgcagtgcctggaaagaagcgatcccagccgcttctgatctggctgatcagcggcgcgcattgctggattatcgcggcatgcgcactgcgcttactcttgcggaggatgcagccatccgcgcaggggatgtcacattggccaatgctttccatacccgtgccgtccaaagcgctgaagccgcccggcctgcacagaagcagatcaaaaaccagccgtgaccagccggcttacgaccttgggtttacaaaaccgctgcactgcctgtcctgaagattctgatcacccgaccgttctggtgcggctgcgcatggtgacaaactcctcggccgcagtgggatggatgccgatggtgcggtcgaaatcctgcttggtggcgcctgtcgtgattgccaccgccagaccctgcatgatttccggcgcatcttcgccgaacatatgcgcaccgatgattttctggctggcctgatccaccagcagcttcatgaaactgcggcgcttgcgaccgctgatctggtgtcgcatcggtgtaaagccggtcgtgaacacctctgtcggaccatttttctctgcttcttcctccgtcatgccaacggtcgcgatggggggagtcgagaaaaccgccgttggaacctggtggaaattccatacctgaccggcatgcccggaggaaaacagcctgttcgccagcatatgcccttccgccagcgccacgggagtcaggttcatccggttggtgacatcgccgatcgcataatgacccgctacattggtttcccagcgatcatcaaccggaatggctccatcttttccggtctcgataccagcttccttcagacccaacccctgcgttgccggtacgcgcccggttgcaaaaaataccagatcaaccgtcagggtttctcctccgtgatcgagcatcacgaccctctgcccgtcatgtttttcgatcgcagtaatggtgctgtcaggatggagacgaataccatccgccgcgtaggcatcagccagagccgtcctcatgtcgccatcaaaaccccgcaacggcagagactggcgatagatcagatccacatccgcccccagcccgcgaaacaatccggcaaattccaccgcgatatatccgccccccagaatagcgatccgacgcggcagggagggaagatgaaacgcatcatccgaaacaatcccaagctccgcacccggaatatcaggacgcgaggggtgaccgcccgtcgcaatgacaatgcgctccgccgttatttcccgtgccgtgccgtcaccgctggtcagacgcaaacgatgcggagccagcagagtggcgcgggcatcaatgatatctgctccggcactgctcagtatccggcgataggctccattcagacgctcaatctcccggtctttggcggtgatcagtgcggcccagtcatgttcgccgcgctgcgtgttccagccgaaaccgtggctgtcctctacaaatccgccatattccgccgcctgcaccataattttcttgggcacacagcccacattgacacaggtgccgccccagaaacgatcctcggccacgccgacgcgtgccccatgcccggctgcaatacgggcacagcgcacaccgccagagccgccaccgatgacaaacagatcgtaatcataggccatacgctgttccttctgctttcctgcgtctctgcccaagcggggatcgctttatagagggcatatagtgtttgcctccattgcgtattaccctatccaaggctggctgtgataccgggggcacgtctataaggggcaagagatatttttcatcaatggaggatgaccagagtggtgaatattttttccctgtcgtgccggtcatctgttccggcttccctgttgatgatgacagcaatttttttgccggctgtcacatacgccgaaggggttacgctgcatcggcaggcagcgattgccccggatatcgccgcttttccccgcccggagggaaatacccctgcccttcagcgcatcaacaaggcacttgaaaaagccgatgcccgtgtgctgagcgcggcaaaggggtgcaaaggaaatgcaactgaggatagcctcaccaaagccgatggctggtcacgcaaaatcagcgtcaccatgaacgggccaacttatctgagctatttcgtctcggattttgcatcctgtggcggggcgcatccggattatggtttcttcccgctcgtctacagcctcgaaaccggttctccggtcaactgggtccgggttctgcctgcctccctgatcagcaaggccagtctggacagtgcggaggatggaacacagctcggtgtcgtgcagtctgccgcgctgatgaagctctaccgggcttcctatcctcgtcaaggcaatgccgatctcgatgcagacgccgtgaaagaatgtctggcctccgtcctgaccgatgaagtgcccttcatgctatggccggatgcgaaacagcacgcactgatgatccagccatccggtctgccccatgtggtggcggcctgtgccgtcggtgttcccctgaccacggacatattgcaaaagaacggggtatcgagcgcatttctgtcggttctggaacaggctcgcccctgatctcagacccacctctcagagcatcacgccccatcagggcaccacaccccaggagggtggctccagatccgggcggaagcgcatgcgagccagatcctcgcgaatgtcctctgccgcgccatggggcggcatcagcagttccggcatgctgagatcatgaacattcccggcgagcagaaggagattctgctcaccgcacataccttcctcgaacaaacgcaggttttgtccttcctgttgtaaccacgcatcgactgtgcggaacaggcatgacagcgccactctgttcgcggtggtttccagcacgttcatcaccacgaaaccgccttgaagccgtgtggcacaaagctgaaaaaacgacagatcgagaaaatgaggtggcacttccgatccatgaaatgcatccacaatgattgcgccatagcgttgatgcggattgatggcctgcaaaaacgcgacaccatcggcaatatggcatggaatatcggaaggtaagccgaaatgcgaccgtgccagttcgaatgaaacggggtcaatatcaacgatctcaaccgcccgcccggcccgatgcagcatcgttgccaatgaaccgccaccgcagccgatcatcagcactggctcagtcagccctgcatcggtctgcatcaaaaatccgaacaaggcatgtgcataaggcgcgtagctgacgccttgtgcatcggcttcactctggcaggcgccacgctgccagtaaatatgggcacccgttccgggatcgcacccgattgtgatatcgccgaaagcagaaaaggcgatactggacgtcgcagcaagctcaatcaaaacaccgtcagcctgtggacaagagaaacagggaaagtagctcctatcacagaccagccgttacggggaaggatagcagccgggggctaaactaccaccagacgtaaaatcagactattttttctgcagacacccgctcatgaacgctgtgcgaagctttgagtcgagctttttttcgctggccttggcgttacaggatttcatgcgctcctgcgggttcatgcctgactgggtgagacagccgctcatgaaagcacggcgttcatctcccccaacaccctgatttttggcatcggcgttacaaactgtcatgcgctgttgttgacgaccctgtttatcagtctcctctgccgcctgcgcgtggccggaaatgctgatcagcagcatcaccatgactgtatatggacaacgcttcgcccagactgccattttcatcggcgggtttccctctgttcaaaacgattttcgtaagcagaacaaagccaacacggaacaggctgtcaggttttggtcagaggttatttttcttcatgcaggcctgaaaaagacggtcacgcaccagattgggggctggtcccggaacggatgtcgtatccttcagggcctgattgcggcattgggctacgatctcgtccctgcgcatcatctgtgccgaacatgctgacagcaacatgattgtaatcataggaagaagccataccattgcttccatagatacccgtttcatagcaaactccataattgttttattgaagtatcaaaaataaactcaaagttgatatttcaatttttaaaaaataaacaaagccaaatagagaaatttattttacactgctctgataaattcatcattttaatcatctccaggacttgtctgacatggccaaaccagtttccactttacagatccggcaacaggcacgtggcaatacaatgcagacgcctgatcctcacagagatcaaggcgcgaacaatccacttcccgcccccagcattcggacactggaaaaccctctggccccggaaatgttcgtcgccgaagcccatggtttctttattcatatggggaatgtccatatcactttcgcgaccccgcgcgttgatcatggcgaggaaagtgccaccatcaaccgcgctgttgtcggccgcgtggtgatgcctctggcaaccgcacagaattttgcagtcggtttatatgattttctggcgcagaatggttttacagtcgaaaagccacgcagcaaggatttgcagtaattattcaggccctatcaacgcggcaggcggctctacgcgccaccccaacacaccagagcagtcgtagccatgagcaatccagcccccacccgtgtgcgcagcatgtcggcatacggtcaccttgtgatgtaatgcagccaacgatgaatgggcctttgaacgatctttgaccgtttaatgtatcattttaccatctctcacggaacatgtccggaccgtcaagtttattcctgctgccgaaccgaaaatgggcagcccgaccgcttcatgcccttccctgcccgatatagccgtcattgacataggttccgggcgcatgtcccagcccatggtcacagacatgtctggcgtcgcatttttccggtgccagagccgtcacccagtgattccagtccgtccaccagctccctgcgatctcggtcgtgtcggccagccattcctccggttcatccgccaggcaatcattgacccagtatccgtatttgccgatacccggcgggttgacgatcccggcgacatgccctgcgcctgacaacacaaaacgccgctctccgcccagagcctgcatccccctgtatatcgtccgccatggtgcgatatgatcttcgcgtgtcgccagaaaataagcaggggcggttacgcgggagagatcaatcggcgtgccagccagcgcaacggcattcggcaccaccagcagattgtcccgatacatcgtacgcagataaaaaatatgcatccgggcgggcatacgggtcccgtcgctgttccagtgcaacagatcgaacggcaccggcgtctcgcccatcaggtagtggttgacgacaaaagaccagatcagatcattggcccggagcagattaaacgtctccgacatttctgtaccgtccagatagccacgccgattcatgcgggcctccatatcccgcagctgctcctcatcaataaacaccgagatttcaccgggatcacaaaaatcgagcatggtggccagaaatgaagtggaggccagacgatcatctccccgtgccgccagcacacccgccgagcacccaagcagcgtaccacccagacaataaccgatcccgttaacctttcgctctccggtaaggcgggcaatctcgtccagcgcctcaaacaccccctctgtcatgtagtcgtcgaaacttttcccggccagcgtctcatccggattgatccagcttatgacgaacactgtatgcccctgcgctgtggcccagcggacaaagctgttatgaggttgaaggtcgagaatatagaatttgttgatccagggcgggacaatcagcagcggacgacgcagaacccgttcggtctgtggctcatactggatcaactccatcatcgtattgcgatagacgacgaagccgggcgaggtagcaattgtctcccccgtacggaaagcctcgatatcggtcatgcggatgcgcagacgcccacgcccgcgctccagatcggccagcagattgttcagcccgcgcagcagattttcgccgcgcgtgtcgattgtccgcttcagcacctgagggttggtcagccaaaaattggctggactcatcgcatcaatgaagtggcgcgtgtaaaaatccaccttgcgcgcggcatcgggcgacatgccgccgacctgtccgatctgatcctgaatgaagcgggcggacagcaggtaagattgccggataaaatcgaaaacctcgttctcccgccagagtggatcacggaatcggcgatcacgcttacgggcctcctcaccagtgccggtcagcgtcacatccggcagatcctcctgcgggggcaggcccatcatacgacgcgcaccttgctgccacagcaccagataatcccgccagaaaccaagctgggcctgtgccagacgggccggatcatgggccagacgcgccgccatttccagaaaggcgccgccgatccgcatcatatacggcgccatatccgccagcggcaggccatcagtagcatgaccggccaacagggcttcaaccggcccttcctgctccacccgtgccagccagtcgaggacaaggcgccgggaacgctccgctattgaagccagtaccggcctgatatcctcatgaggccgttcctcccctgtctgcatatggcgtttctttcccatcgcaccggttcagatgccagcccttgccccccgggcgaaattcaaggactctttcagcatgatgaccgcttcatagcgctcataaagcattgcgggtcttgagggaaagccgcctccgtccgatgatgtgggtgctgaagcggaacatacgatgcaacgaaaccatttctttttcagagcgatgccccatcagagcgcgctccgtccaggacgactgaaaccggttctggctattctggggagcctgctgggcggcctgtccctgagcggatgcggccggaatagtggtggcttcaacccggtgggctggtggcatgatctgaaaggcggcgccattgccgggcaacgccccccgccgcccggcgtggatcaaccatacggcaatttcgcctctgtgccgcctcgtcccgtgatgccgacccaggcggagcgggataaaatcgccggccttctggccgctgccagaagcaatgccgagtatcaggcgaaaactgatcctctgccctctccgaacaccccatcgccgcaagggggagataaaaaggcgaccgcaggcaaggacagtgctgcgccttccgatcagggcaaacaaccatcttcagggtcgtcgccgaatgctccggcctcagcggctgcttcgacccggaaaccggatcaggatacggctccggccaattctgcgccttcttctgctgcggccccatctgcgaccgatcccgccgcagaagacagtggtatttccgccaatatggaaggggcaacggccaagccacccgcaacgccggcagccccccctccggctaatgtttcgctggcacaggccgttaaagacgcggacaagcctgttaccgctgatgcaggtatcacgcgcctgcccgcccagccttatcaatcgaaactggccaacaccgggcctgcgccttccattccaaacgcgcctccacctcccccgaatctgtccggcgtcagcgttccgctgcgtggtccgacgccccatcccacgcctccggttgctcctcccgggccgcccgtgttgctgaaaggggctgccctgcaactcacgcccgttgctttttctgccggatccgcagtcatcaacaaggatgcaacccttgtgatcaatgcatatgcactgaaacatgcgggccagaacatcgtggcaatcggcttcggggaagccgtcaataccagcctgaccgcccagagtgatgccatgaaactggcgcttgaacgcgcccgttccgtcaccctggcactggagcgcgccggtatccctgccagccatgtgcggatggaagccgaacctttgggtacaggcggggccatacgcctgaccaactgatcctccttccatgcacgcctgaggcgaatcaggcgtgaattccctctctgcagggagttctgtatagaagtttcccttcacctttcagcgtctctgaccggattgcatccatgcccgaagagtttcaccgtatccgccgcctgccgccctatgttttcgcggaggtgaatggtgccaaggcccgtgcccgtgcggcgggagaggatattatcgacctcggcatgggtaatcccgacggccctacgccaccgcatatcgtcgccaagctgatcgaggctgtgcaggatccccgcacccatcgctattccgtcagcaagggtattaccgggctgcgcaaggcgctggcgaattattacgagcgccgcttcggcatcaccctgaacccggaaaacgaagtcatcgccacgctcggctccaaggaagggctggccaatctggcggccgccatcaccagcccgggtgatacgattctggttccgaacccgtcctatccaatccatcagttcggcttcatcatcgccggagccgccgtgcgcagcattccggccacaccggatgagaccatgctgcgggcgctggatgtcgccgtcaggcactccgtaccgaagccgaccgcgctgatcgtcaactttccctccaatcccaccgcctgggtggccgatctcgatttctaccgcgagctggtggcatttgcgcgcaagcacgagatctacatcctctccgacctcgcctatgccgagatttacttcggagatcgcgtcccgccctccatccttcagatcgagggggccaaggatattgcggtggaatttacctcgctctccaagacctattccatgccaggctggcgcatgggctttgcggcaggcaatccgcgattgatcaatgcgctgacccgcatcaaatcctatctggattatggtgccttcaccccgatccagattgccgccgtcgccgccctgaacggcccgcaggattgcgtcgccgatatgcgcaagctctacaaggaacgccgtgacgtgctgatccgcggcctgcatgccgcagggtggaatgtgccgtccccggaagccagcatgtttgcctgggcacccattccggagcaatacgcgcatctggggagtgtggagttctccaaactgctcctctcccgcgccaaggtcgccgtggcccccggcattggcttcggcgagtatggcgactcccatgtccgcatcgcgctggtcgaaaatacccagcgcctgcgtcaggccacccgcaatatccgcgccttcctgcaaggccattccaatgttgccgagccggatagcgatcccggtgccgataccaacgagaaagcttccgaacatgcctgatacatgcctctcttcctctgcttctccgctacgtatcggtattgccggactgggcactgtgggtgcgggcgtggtacgcatcctgacggaaaatgcgcctctgctcgcggcgcaggccggtcggcggctggatctggttgcggtttctgcgcgtgatcgctcccgcaatcgcggggtcgatctgggtggcgtgcgctggtatgaagatccggctgctctggcctccgatccgaatgtcgatgtcgtggtggaggtcattggcggctcctccgggccggccgccactctggtcgaggcggcgcttgaggctggcaagccggtcgttaccgccaataaggcgctgatcgccgtgcatggcgcacgacttgccgcactggctgaaaagcatggcgtgccgcttaccttcgaagccgcggtggccggcggcattccgatcctgaaaaccatccgcgaaggcctgagtgccaatcgcatccgccgtgtggccggtatcctgaacggcacctgcaactacatcctgaccgtgatgcgggaacagggccgggacttcggtgatgttctcgctgaagcacaggcactcggctatgccgaagccgatcccagcttcgacattgatggggtggatgcagcccataagctggccattctggctgctctctctttccgccgcccggtctcgttccaggatgtccatatcgaaggtattcgcggcatcacggcccttgatatcggatttgcacagacgctcggctaccgcatcaagctgctgggcatcgcccagcacgatgtggagggcgtatccgcgcgcgtccatccctgcatggttccggaaggcacctccattgcgcatgtagacggcgtattcaatgccgtgctggcagagggtgacttcgtaggcagaatccagatggaaggccccggagccggcagcggaccaaccgccagcgccgtcgtggccgatctgctggacatcgcccgcggacgcgccggaccggcctggggggttgagtcctccgcactgactcaggcgcaggccgtgccgatcaacgcacatcacggagcctattatctgcgtctcatggtggtcgatcgtcccggcgtgctggccgatgtaaccgccattttacgcgatcacggtatttctctcgaaagcatgctgcagaacgggcgcaatccaggtgagaccgtaccgatcgttctggtcacacatgaaacaaccgaagcatccatgcaggatgcgctcatcatgatctcggaactcaatgcagtgcaggaacgtccggccctgatccgtatcgaaaagaactgatcttagggatcatttttctactctatgatctgatggaaactgcctgatgaaggaaaatcctctgtcaggcagtttttttaattatagacccgtttgaccgtgacaggcttacggaatatttgatgataaagtgaatttgaataataaatgccttttatgtgcttatttttgcatgggaatttttcctccgaaatgaattcttctgttccttacagaatcaaaattatttagccatatttctgataggtatgattaaattgtattttataatataatatcctataagagattgaaaaatcattgttattttttcaaatctcattatgttcagtccggaatatggaaggcaaataattttttactaaaaaattgccatgaagactttatttgcctaataatagtcagcctattttttagcaggagaggcaatttgtcggacgatacccccccatcccgtctgcttgaattaacggcccagatagttgccgcccatatcagccataattctgtgcaagctgaagcaatcccttcatttattcagcagatacatcatacactcagcacgatcgggacacctgttgttgagccggaacgtttgaccccggctgttcccgtcaagcgttcagtttttccggattacattgtgtgccttgaagacggcaaaaaactgaaaatgctgaagcggcatcttcaatccgcctattccatgactcccgagcagtatcgtcagcgctggagcctcccacctgattatcccatggttgcccccaactatgcagagcgacgctccagccttgcgaaacagaatggtctgggccgcaaaacgcgcgaggagttcgatgagattgaagcccctgcggcgcctcgtcgacgtcgcaagacaacagcctgaaacgaatagaccgcgtctcatctccatgaggcgcggtctattatatccgggttcagaataagcgcaggccggggtctcctccccggcctgtttcattattactggaacggatagtaacggatgctgaacatcgcgatatgcgcatgggcaaccggtgagccgcccagtcctttgaacgcagtccgctcggtataggaatactgcaggccggtttgaacggtgccgtacggccccttcagggctctccaccagaacccggtggttccctgcacgataccagacgtattaccgacacaggtgccagcggcagcaccttcgatcgagcatccgacattgctgtaaagcgggctgccgtagccgtaacctttaccattcgcgctgtaggaacgggagccttcctgctccgtgcccacataggcatagaggtcgagcgaaggacggggatggccgaccacgcccaccatggccatgacttccggcaacggaaccggatcgccattgcggcccaatgtcgcatccggcagctgggagctgccgtagcggccgataccaacaccggcaaggaagttaccctggagggtaaccttcttgttgaacatggggatgacgaaggatgcgccaccaccacctgccggaacgacctggctggtgccgctgccgttatacgtcacatgcgtgcgcaggaagcgcgccacaccgaacagttcgtagtggccatagcccggatcgaaagcaaccttcgcggtgatatcgggtgccggatcaagagaatagttattggtgccggcataaccggagccaccagcctgagcataggtgacggtcgcaccacccagagccgtatcggtcgccgactgaccagccgtcgtcacctgattaggaccgacatacatgctggtctgcggattttcgaggcccatagcaatgttgacgcggtggttatccagcgtcttccacagacggatctgcggctgacgggtccagacgaagcccggcacgtactgggcatcgatagtgaacggtgtcagttccttacgcggcgtgatctcggaagtagactgcgtcaacagcgaccaggtctgaccagccagcagatggaggcccatatcgctgcggtcgatcgtcaggtaaccatgacgaagacgcgggttataactgttgctctccgtagagtttgcagtcggtgcagcgccgaggaagtcggattccagataggcggcaagatgggtgtatttgcccacatcagactgtgccagcagcgacacacggctctgacgcgctgtctcgcggaattccgaaagattgccagccacgttattgcggaacgggatgccgttccagctggaggcgatatcagccccttcactggttgtacggaacacactggccgcttcgataaagccaccgactgtgatcgtcaccgggcccaggcgcagagcaccctgggtcttgccgccatccgccagctgcgcagaagttgcgctgtcataggccgggctgctgcgcgtgatgccgacgatactgccaaggttaccggcaggctgcatatccagcgcatgcgtcgcctgacgtgcggcggcttcactgcgaatagccgtttcctgagcctgctttgcctcctgatgagccgcgacaatatccttgtcacgacgagcaagctcggaacgcacatggtgcagctcgcccttcaaagcctggatctgtttctcgatggccacaaccttgtcgtccatgctgtccgcatgggcggtttgaaaactggccgcggcaactgccgtcgctgccagtaagctgcacttgaatgctgaatgcgccttgcgcatgagctccccgctataaatcgtttcggtgagcggctcattacggccagacacagttcgataaaaatgaagcttccaagacattgtgaacatacaacgaacatttgatggcaagaagcctgctagatcagccgttggataatgaccggccacgttgagacttccattgagaatcacagaaacaagattaacgatgccgggatattttgttttcttatcgaaatatcaacaagctgggccatacgacattcacatccagtcatgtgatgcaggaaggccgatgctctgcccgcccccgatgtcggtgacggcatgatcaatgaattttcattttccatcccttacacaccgcctggatttcagcgatggtaaaagccgaagacattatttgagaatgcagattttattttccatgaccccagatcaagcaccctcccaacaaaatgcgctacgccggctatggcgttgggcgtttctcggcgcaacgggcggtaccattgctattgggggattcgcatggggatttaccgcttacaaaaacatgcccgatccggtgacactggcacggctggcttttgtcgagccatcccaacggggaacactttttgcaagccgggaaattccgccttcctcctatccgcgtccgttccaggagaattttcgtccctggatcaaaaccgtgccatggaaaggtcagcaggtctccgttcaacaattccttgatacaaccaggaccaatgcgattgtcgtggtcaatgaaggagtcatcacacaggaatggtaccgcgatggcatggggccgaatacactgtttccgtcgtggtctctggccaaatcgatcgtttcactcatggtcggccaggctatcgggcggggattgctgcatgaggatgacaggccggaggctctgctgcccaaccttcagaaagcaggcattgatccccgcattactgtgcgcaatctgctggatatgaccagcggtctggcaatccccgagaactacaatccctggcgtcctttccggggcactgccgggatgtacctgacgcatgatctgggggcctatatccgtgcccatcactctctggcctttacgccgggcagcaagggcgtctaccgcagtgtggataccgagatcctcggcctgatcctgtcgcgggtagagcatctgacactatccgaaatcctgtcgaaaggcatctgggatccgatcggagccaagcgtgccgcatactggaatctggatcatccgggggggcgcgaaaaagcattctgctgcatcaatgcggctgcacgggattttgccaaaatcggacagctcgtactggatcgcggccgtgtcgggaacagacagatcgttcctgaattctggatcgagcgcctttacaagcccgcgcctgcccgggtcgacgggctggaatattccgcccaatggtggcacacggaatcggatatcaacgatatctccgccatcggggtgtatggccagtatatctatgtcgatcctgtctcacgcagcgtcgtcgtcaaactgagtgattacggcgccgaacaggatgaggccgagaccctcgacgttctcaacatcctggccgcagcagccaaaaattaaagcgcctttcccactcaggagccgggtggaaccaccatgcaggaaagctgcctgcgactgagttcattacaggcctgactggcctgtgcagcagtcagctgggtcaaccgggcacgatagagcacatttccgccaaaaggtgctgttgtcggtatcgtcacctgtgcattgtgcaacaatgccggggccgcattccgggctccgctggccacggtctgtgccagagaacggctggcgaaagcaccgacctgaacggaccaaccacctccggctgcggaggtagccgggatcaccaccggagctgtcggctgataacgtgacgcaaccgttggcggcgtcatgacccttgcagtcggataagatgaagccgccccatagctgttcgtctgcccggaaggatagagactgccgccatagggtggaacaggtggaggcaaggctgatgcagacacgctcccctgtcctgttgcaacctgcgcccccatatcccggcatggtcgggagggatcgaaggccgaatccttgtcacagttttccgcggtcggcccgtgcgacacgaacggttgtgcggcccctccgtaagaagccagtgtaacgcctcctgtcatgccactggctgcaccaggctggcaggggcgcgacggatcataggccgcatcagaatcacaggcggaactgctggccgttgtggcaaaacgtcgctgaggggcagcctgtgctaccatcacgggcgcagatgttgcgggagaggaaccgccccccagacgaggtgcaatgatcgagacataattgacagtctcacccggcaggccgccagttccgttcagataggaagccaaccgccccggccctgcattataggccgccagaaagccgggagaaccgtactggtcatacatttcccggatataggccgttcccgccagcacattgttatgcgggtcgtacggatcatccccgaggtgataacgatcccgcatcagggaatatgtaccgggcatcagctgcaacaatcccatagctccggctgaagaaacggcggtggagcgtccggcactttcctgccgcatcacggcacgaatccagctttcgggtacagaaaagcgttgtgatgcttccttgatgtatggcccccatggatcggagggcggaccagggggtgtatattcaccgcttgatccgtattcctctccgccactgccgtcatagggaacgccaccataggaagaggcagaccgcccggaatgccccccacaggccgccaaagcgcacagggcaccgagactcgccacagtgccaaggcgcctcgcaaaaaggccgagcgacccgttttcgggcatttcgttccccaaaccctgcatatccgccttcacgggtttccgaaagatgctgcagcatcctagagatgacatcatgaaaatgctacaagcatctgatgcgacttggcatttgcgttcttacttctgcctttccgtgatattcctgctgcagtttggaacagggacggcatcttgccttcagcagatcaccccaatatgcacgcatcatgagccagacatcttcctcctccccttctttgcgcattgagaccctgtccggagaggcgcttgttccagtgcttcccgcgcttgcccgcctgcggctgagcgtcttccgcacatggccctatctgtacgatggtgatcaggcctatgaacagcgctaccttcagacctatgtgcgcagtcccggtgcaggggtggtgctggcatgggacggagcgcgcgctgtcggagcctctacctgtctgcccatggttgaggaggaagaaaatgtctccgagccgttcaggaagcgtggatgggatccggcgcggtttttctatttcggtgaaagcgttctgctgcccgaatatcgcggctgcggtgttggtgttgccttcttccgggaacgggaagcccatgcgaaacgcgtctccaactgcgactacgccacgttctgctcggtgaagcggcctgagaatcatccgtcccggccggcagactgggtaccgctgcatgaattctggacccgtcgcggcttcacgcccttcccctccctgacctgccgcatgtcatggaaagatgtcggagaagccgaggagaccgaaaaggaactgacattctggatcaaatccctgtccggtgcccctctgccggaagagagcaagggatgagcagcatcgcaaaaaccctgaagatcggtgtgctggcctatccgatcgaaggggtcacgctggaaggctacgccgccaagctcgaccgcctggtggccgaagctgccgccgctggagccgaattgctgctgatgcctgaatatgcctgtgtcgaggttgccggcggctatgtttccagccccgatgtcgatgcggagctgaacgcggtctgtgcccgcgcggccggaattctggcggcccagcgggataccgccgtgaaatatggcgtctggctggcccccggctccgtgccggtgcgcgggccgaatggcatcacgatcaaccgcgccccgctctttgcccctgacggtagcgtcgcctttcaggacaagcgggtgatgacacggttcgaaaacgaacactggttcgtctcgcccggcgcgccaccggggatttttgaaaccccgtggggcaaaataggactgactatttgttatgataccgaattccccgccctggcccgtgcgcaggtagaagccggcgcctggctgattctggcgccctgctgcaccgatacgctgcgtggctataaccgcgtcggcttttccgcccgggcacgggctctggaaaaccagtgctatgtcgccgtggctcccacggtgggcgatgctgcatggtcaggtgcactggacaccaatcgcggctatgcagccgtgtatggcccggtggatcgcggctttcccgaagatggcatgctggcccgcggtgcactggatgagccgggctggatttatgccgcgcttgatccggcgaaaattcaggacgtgcgagtcaatggcggcgttttgaatcatcgtgactggccggcatcggtcggccaatgcgccatcctgccacgcggaccactggaaatagcgtgagcggagacaacgcgtgacagctccgctgatctatatcgtcgccggcgagcatagcggtgatgtactcggcgccaggctgatccatgcattgcgagccatcaacccgtcgatccgctttgcggggattggcgggcctcgcatggaagaatgcggcttccagagcctgtttcccatgcatgagctggccgtcatggggctgattgaaatcctgccacgggtgctgaaactgcgacgacggttgcaacagacggttcaggatattgaaacccgccgccccgatctggtgctgaccatcgacagtcccggcttctgtctgcgtctgttacgcgccatacagcctttcggcatcaaaagggtgcattacgtcgcaccacaggtctgggcgtggcgggaacatcgcgtcaaacggtttcccggtctgtgggagcggatgctctgtctgctgcctttcgaggaaaaatggtttgccgagcgcaatgtgccggggcaattcgttggtcatccggtgctggaatccggggctgatcagggggatgccgcccgattccgcgcgcggcatagtctggccgataatgcccgcgttatcgtgctgatgcccggcagccgggccaatgaggcaggcaggctgctacccgtctatggcgagaccctgcgtctgctgatgcagaatatccccaccatcacgcctgttattccactcgcctccagcacggcgcatacggtgcggggggctgtctcatcctggccggtgcaaccgattttcatcaccgacattgccgacaaacacgatgcgtttgccgccgccgaggccgcattgactaaatccggcacatcaacgctggaattggccatgggcggcgttccgatggccgtgacttaccgcgtcaaccgcatcaccgccatgatggcacgcagattgatccgtgtaccgtatgtcgccatggtcaacctgctggcaggccgtgaaatcgttccggaacttcttcaggaaaactgcacgcccacaaaaatagctgcggttttaaccagcctgatgaacaatgcccctgatacaaatggcatgggtgccgccgacagccagaaacaggccttgaaggcagtggttgcttccctgcatgcgcccaatcggcatgcgtcagatggactgccctcctctgccgctgcggcctccatcatggaggtgctgggccaataatcatccagctgattgcggttggtaaatcgacaacaaccatcagggatgttatcgatacacgtattgtttattcctgattgcataaggttgagtgattgtgaccctgctaatgccgctcgccatgcatgaaaaagaaatcgagttattgaccacctttctagggtcgacccaaaattatgtcgaattcggagcaggaggcagcacctgccttgccgcccaacatgtcggcaaaagcattcatacaactgattcctccatcgactggctacagcatgttgaaaacacctgccgttctgccaacacacccgtttttcctgtcacgcggtttgttgatataggcccgattactgcattgggtggaccaaccgatttaagcaagcgtcctctctggcccaactatcatgaggaatgctggggtgatcccgcctggtcggaaggcgacttctacctggtggatggacggttccgtgttgcatgtttcatgcagattttactgcatgctccaacggatgcatgcatcgccctgcacgattacacgacgcgtcaacattaccacattgttgagactgttgcgcgccccatcgcccgcgagcgtgatttatccattttcgtacgtcgttccgatacacgtccagtcactgtcagacgtctgttggaagaatatcgttatgaagtcgcataacagttgatcaagggctttatcaaggcatttcagccagcctgaccaaagggtgcacgtcatgcatgccatgacaaagtacctcctcaacagccttttcatgatatctggcgtaggactgacacggtctgatgatcgcgtgttcgattctctccggcctgcattattctgatgttgcgtcaagaatgccggaactaccatccgggcagagccctatctgggtttacggaagtacgggttccatcgcgatggccatccagccagagatcctgatcgacaataagctagttggcgcagcgatgacaggcagcacattttgcgccgatatcctgccgggacaaatcagatatcttaaatatatcacatgaaaaataataaatattccataatcaaacaattatttccttgtcaggatttttgaatgtaaataagggtaatcttgattatggaaagcacccattatggccactctcccaaacgatcctcttttcaaatatcagtggggtttgctgaacacaggtcagtttaacggttatattgctggaattgatatcaatgttctcccgttatggtcagaatataccggcgctggagtgaaagtagccgtcgcggataccggatttcagcttgatcaccccgactttgccgggcgcgtcgatacaacagaaagctgggatgccgtcagcgatacaccagggggaggccctgttactggcaatgacaatcatggtacagcagtcgccggcattatcggcgccggtatcaacgacgctattggcgggacgggtgtcgccccaggcgtaacactgttatcattgcgagttttgggcaatcagacggatgacagccgggatagtgacgcaacggaaaaggcaacaaccatcggcttttccaaagcacttctggcaaatgtcgatgtcatcaataacagctggggaccgaccaatcccggcgtaggcccaaatgccaaaactgttttcagtgataactggtcaggcggccagaatcaggaaggcatcgccatctccgcactcgcgacttatggccgacaggggaaaggcactgtcatcgttttttcaaacggaaatgcccgcaaatatgatgacgatgccaatctgaataataataccaattcaagatttaccattgctgtcgctgccattgatggaaatggacactattcgtcatacagttctgcaggcgcaaatctgctgatttctgcaccaggaagtgagggaggaagcacaaccacgcccacaggcgggatcgtgacttctgaccggacaggttcagacggttacaacaaaacgccgggtaatgcgggtaataatacatatggatttaacggcacgtcagcagccgcgccttttattagtggcgtagctgccctcatgctgcaggccaacccctccctcggctatcgtgatgttcagcagatcatggcctatacggcacggcagaatgatgcctccgacacatcatggttggacaatggagcccaaaccggcaatggcggaggtctccatttcagtcgcgattatggatttggactggttgatgcacatgccgctgtgcgggtcgcagaaagttatggcgtgctaaccgaatatggcatgaaaggcttcagcaaatccgaactgaacgttacacagcaaaatgtcaattttactccctccagcccgatcaccatcgcagccggacaaagctatacattcaatcccggctatcagaatctgatgagtgtggagcatatcgatcttctgttatctctcaatgcgccggatacgagtgcgctgacagttaccctcgaatcgcctgccggaacatctgtcaaccttgttgaccaaacgccgaatgtctctaaagaatcagccaacgttgcatggccgggatctttcagccttggcagttttgctttcatgggtgaagattcgaccgttctgtccagttccggccagattacaggccgctggcatgtcacgattaccaatcagggcagcacaccaatttcactcaactccgccaatcttggactcagcggcagccagtacagctataaatcctttctctacactgacagctacgcagatcaggtgactcatgatcctggtcgggcctatgcaatcgtgcccagcgccaatacagacgtcatcatgaatgcctcggccgtgacaggctccgtttcagccgatctgccaaacaacacaatcagcatcaacggggttaagacatatgtctcaaccacccatgcgattccttcttctgggttcacgccatcaattgacgcatttttcagcggtgatggaaacgatacgctggtcggaggcaccggacagcttctggctcccggtcgtgggaataacagtgttctgctgggaggcagcacgggaatcgctcagtctatcggtaatgataccatcactgcgcttcagggggctgctacggttaatgcctccggtcatgccgcaatcttctccaatgcagcccagctgaatttcgtgggtacgggaggggccagcaccatcgttggtggaacgggcacattatcggtcaacggcggcagcgcacacgtcaccgtcttcggcagcagtggcggcaatgataccattcttggtggcaacagcgggaacaaccaactggctgccaatggttccggatcaatactgtttggtgaaagcggctccagcgttctttatggcagcaatacaggtgcatcgaccctggtgacagccggagcaaacaacaccgtctttggcggcacaggtagcagcactatcctcagcaatggctctcacgatctggtggtgatggatcagggcgccaccaccctgttcggtggtcagaatgccgccatcttcaccaacagcgccaatgccactatcgtcggagagacaggttcctacgccgtcggcttcggcagtggcaccagcaacgcatgggccagtgcctccaccgatctgttcctgttcgccaacggacaggccggaggaaacgtcacaatcagcaatttccaggtcggaaaagatttcatccagttacagggatatggcgacaacgtggtgcagactgttctcgccaacgcaacacaaagtgcagccggcctgtcgatgacgctgagtgacaatacgcacattactctgacagggatctcctccctgaacagtaacagcttcatggtctaaaagcaggcaagaaagaagaggggacagaaggtagttccctcttcctgacctgccgttatccctcgtgacgtatgaggccggaggcctccagacgggcacgagtatcattcatactctctgctacggccagagccgcagccagggcgcgcctgccagcataggcgttcaccagaaccggagcaccatcgaggatcgaagcggcaaaagcctcatgctccgccgccagagcgtcatgatccttccaaccggtttcctcgattcgggcaccctgtccgccgggaatgggcaggccgcgatcccgtccgatcatcatcagtttgcgatccataaaattcacggacatgtagccattctgcgcaaaaaggcgcatttttcgctcggtcttgagcgaaatccggcttgctgtgatggtcgccaccgctccgttttcgaaacgcagcctggcattggcgatatcctcatgcggcccggcaacgggggcacccaccgcatccaccgacaggatcgggctatcgaccagcgccagcaccagatcgagatcatggatcatcagatccagaatcaccgagacatcggtgccccgtggcttgaacggcgcaatgcgcgtagcctcgatataaagtggccgctccatacggttcgcaaccgccgcgtattcggcggagtagcgcaccagatgccctacttgcagcacgcgccttttttcctcggccagcgccgccagccggtctgcctgctccagagtggcagcaataggcttttcgatcagcacatgcagcccggctgccagagcacgctcggccagtgcgaaatgcgcctcggctggggcggcaatgacaattgcatcgcactgcgccagtaaggcatcaaagcccaacgccacagttttcgtttctttcgccagcaccagcgcccgcgtctcatcgggatcgaagatgcctgccagcaccgcccggcggcttgaggcgattttcagggcgtgaaaccgcccgaaatgaccggcaccggcaagcccgatgcgaagggtcgatcctgaaggcagcgtatcatgtgtctggctcatggcctgccggtttagcaggggttgcggcgtttgccagcctcctgccggcccggccttttatttattgcgaagagatgccgccttgccatgggaggctcgcccgtgtcatctgccgccccaaatggtttcctaaccgcataaaatcgcggccccaccgccggaggaacgttctgccgtgctgtatttcagccgtctgaaaaccacgacgatctatcttgtctgcctgcttggcatgttgctttgcctgccgaatctgatggcacgcccggcggcatggctgccctggcgcacggtccatctcggccttgatctgcgcggaggcagctatctgctgatgcagatcgacatgaaagccgtggtcagggaacggctggagtcgctgtcagacacggcgcggcaggcgatgcgcaatgcccatattttctataccggtctgaaggcggaaccggatgccaaccgcatcgtgctgagtccccgcgatcccgcccagctgaatgccgccgtcgcggcgctcggcaaggcggtcgagaatgaggtctccgccaatggggtcagagaggttgaggtcaaggctctggagggcgcgcaagccggccagatcgccttgatcctgcccgaagccgctttgcatgaccgggcaacggctgcggtgcagcagtcgattgaaatcgtccgccgccgtatcgaccagaccggtgtcgtcgatccgaacattgcccgccagggtgaggaccggatcgtcgtacagcttcccggtgtggacgatccgcagcggatcaaggacttgctgggcaccaccgcgaaaatgactttccatatggtcgatgcgtcggccacccctgccgccgtgccgccggatgatattgcgctgccggaggagggaaccgggcagaagctggtcgtcaaacggcgggcggatgtggatggcgccgatctgaccgatgcccggcctgtgccgaaccagcagcgtgccggtgcatggtcggtcagcttcacattcaatggcgtaggcgcgcggaaggtagcagacatcaccgcagcccatcagggtgagcgtttcgccatcgtgctggataaccgcatcatcagcgcgccggtcattcaatccgtgattccggatggacgcggcgagatcaccggcaatttcacggccaaaaccgcgcaggatctggcggtgctgctacgcgccggtgcgctgcccgccccgctttccgtggttgaggaacggagtgtggggccggagttgggggccgacagtatccgcgccggagcctattctctggcggctggcttcgtactggtgatcctgttcatgggcctgttctatggcctgttcggctggatggccaacctcgcgctgctcatgaacctgttcatgctgctcggcgcgctgtccctgctggaagcgacgctgacgctgcccggcatggcgggtatcctgctgacgctgggtatggcggtggatgccaatatcctgatcaatgagcgcatccgtgaggaaaccaaagcaggccgtccacccgttgcagcgatggaggccgggttcaagcgggcctgggccactgtgctggacagcaacatgaccgcactgctggcccatgtcatgctgtttgtgttcggcaccggcccggtgcgcggcttcgcggtgacgatcaccgtgggtatcgccaccacgctgttcaccaatttcatgttggcacggctgttgatggtgaagtggttcgcccgcaaccgtcccgctgaattgcccgtctgacgcgctgaatcggaaaggaaacagagagatgttcatacgtccgatgctgcgcatggtgccggatggcacccgcatccgcttcatgaagggccgctttgccggtctggcgacctctgccgtgctgtccctgatctccattgttctgttctttcatcccgggctgaacgagggcatcgacttccgcggcggcatcgtgatcgaggcccgcacccagggaccagccgatttcgacaaaatccgcgctaccctcagcgccgcccatctggaagccgccggggtgcagcgtttcggcgccgaggatgatgtgctgatccgcctcgactcccagccgaacgaagccgccacccagcaggctgccaacacggtgcgcgaaagcctcgccaaggcgctgcccggcaccaaggtgatgcgggtggatgtcgtgggggccagtgtctcgcgggagctgttccgtgatggtatgctggcgctgggcgtcagcctgctgatgatcctcggctatatctgggtccgtttcgaatgggaattcgcggtcggcgcagtggtcacgctggtgctggatgtaaccaaggcggtcgggtttctggcgctgacccggatcgagttcaacttcgtcatcatcgccgcaatcctgaccatcatcggctactccaccaatgacaaggtggtggtgtatgaccgcgtgcgtgaaaacctccgcaaatatcgcaccatgcccttgcgggaactgatcgacctctcgatcaacgagacgcttaaccgcaccctcggcacctccatgacggtgtttctggccagcttgccgctggcgctgtttggcggagaatccctttccggctttgcgtggacgatgctgttcgggatcgtggttggcacctcttcctcgatcttcatcgcggcaccgatcctgttactgctgggtgagcaccgcctgcggcgtgataccgttgctcccccgggtgctccctcgggcgctccctcgggcgctcaaaaaacagccaaaggctgacgggctttgtccggttccatgaggctccccctgcccggcccgattgccgcattgctgaccccggccagaatgcagttcctgcgtttcggcatggtgggcgtgatggggtttatggtcgataccgcgaccgtctatgcctcccgttactggcttgggctatattgggccggaatcctcgcttattgcgtggcggccagcgccaactggctggtcaaccggatatggaccttccgcaaccatgccgcgacggatggcaagcatgcccatgccggaaaacaatgggccaaatttctggccgctaatctggtaggggcggtgcttaatcgcggtacctatatgctgctgatcaccattgtgccgttttgtgccgcccatccggtggttccgctggctgccggtgcgatcatggggctgggtgtgaattatgaactctcccgtcgcgtggtgttccgctgatgcaggaaagcaagctgctggtgggcatcgtgatgctgctgtcatgctccggcatggtcctgtccgcgcccgttctggctcagccggtgcagattatcggccctgccggcaatggttgcatcgccggggcacaacgtctgcccgatgaaggaccgggctggcagaccatccgccgggaccgcagttccttctggtctgccccggtaacgatcaacggggttaaaacactggccacgcgcctgcatgcacaagggctgccggatttgtatgtcggcgatatgtccgcgccacatggcggcaggctgcccggcggccatggcagccaccagaacgggctggatgtcgatctgtacctcgacctcaccccgcgcccggcattgacgccggatgaacgtaacgttctggaaccgccctccatggtctcagccgatggcaacagcctcagcccggcctggacgcaggatacagtgacgctgctgcatatggctgcaactctcccgaatgtggatcgggtgctggtcaatccggtgatcaagcgcgctttatgcgaacaggtcagtggagaccggagttggctgcatctgatccgtccgtggtggggtcacaaagcccatatgcatgtacgcttcagatgcccggctggtcagacgctctgtgtgcaggctccaccgccgcccacgggggatggatgcgataccacgctggcatggtggttccagccccaccctgctccaccggcagcacctccccggcctccagaggctccccctgccgcctgccggcccattctggctggagataccctgtctgctccggagaccaggccatgagtttgtcgccgccgctggtctcgatcgtcattgccgcgctgaacgaggaagccaccatcgaccgggtctgtgacgagttgatcgacacgctggacgggttcatccccttcgaggtcgtggtggtggatgatggcagcaccgatcagacgccgatacgcctgtccatgctgcgtacaagacatccggccctgcgcgtgatccgtcatccgaagcgttgcggcaaaaccgccgccctgttcaccggtgtggaagcagcccggggaacatggatcgtcaccatggatgcggacgggcagaacgacccgcgcgacgtacccgccatggtcgccgccctgcggagtgagggcaatcgctccccgacaggaaaagcgcctctggtggcgggaattcgccggaaccgcatcgatacgcaatcccgccgtcatgcctcccggcttgccaacggcatccgcgcccgactgctgcgggatgactgccccgacacagggtgcggcgtgaaagcgttcagccgggaggacttcctccgcatgcccgctttcgagggcatgcaccgcttcatgcccgccctgttccgcagctatggccataccatcgtgctgcaaaccatccatgatcgggcgagattggccggacagtcaaaatacaccaatttcggccgcctgatggtcgggatcagggatacgctgggtgtgatgtggctgcgcaaccggataagattgccgcaggacagtcgggaagtctgagaatccgacagcacgccacccgcatgtcatacggtcagataacacaggtgttgctgctaattcatttcgtttgcttactatttcatgcgatgagcagtccgttgcattttcaacgatggatctgatcatcatgagccattcttctggctgcctccgtcttatcgctggaagccttttgatgggcggtgcgctggctggctgcgccgatcactggatcaagcccggtgcaagccagcaggaataccagtacaccatggcccagtgtaaagccgagggctatacgcatatgcccgccaatgcggtgccttaccagctgaccaatggatcttataccagtgctggaatcgagtgcaaaaaaaccagcagcgggggcaatgactgcaagcagaagcaggtttatgagccgccgatctggggtacccgtgatgcgaatgaagacgggcgcaacgcggtcatccgggcttgcatgatgcgcagcggctggatgctccaggaataaagcgcccgttctgatcacgaagccgtttttgtagcgccgttagtgagccgtctcactgacggcgctcttgcatcatggctgcggatcatctcccctaaccattatgggaatcgaccagaccagtgcctccatcctgtcgcctgcatggaccatggccagtgagggcatggtggcaacactcagcctgtcgggtgaatggactgtcgcatcgggtgggctgaacacccgaccgatcaatgcctttccagttggcacggaacgattgctgatcgacgtttccgcattgcagcgctgggattccgcgctgatctcctttctttggtcgctggagcagcgatgcaacaccagcggaatcacgctggataacagcacattgccgcactctgccagaggtctgctcgccttgctgccggagcatccacacccatctgcccccgctccggcaaagcattttgcgccggttcaggccatcggtgcctcgaccctgtccatgctcacggaatgcggcaccgtgacggagctgggcgtggaaaccctgcgcggtgcaggggccaccctgtttggcggacatggcatgcgctggcgcgatctgctgcgtgatatcagcgatgccgggccttccgctttgctgatcgtgggcatcgtgaattttctgatggggtccatcctcgcttttgtcggcgcggtgcaattgcgcaaattcgccgcagatatttacgtcgccaatctggtagggctggcctcggtccgcgaaatgtcggcggtgatgacagccatcatcatggcgggacgtaccggcggagcctatgctgcgcgcattgccaccatgaccggaaatgaggaaatcgacgcgctgcgcgtgttcgggattccggtctcacgctatttgctactgccctccatcgcggcgctggtactgaccatgcccattctctatctgtatgcctgcctgatcagccttgtcggaggctatatcgtctcacaggggatgctggatgtgaccatggccggtttctggaatcatttgttcggctcagtccatatcgaccagttcgtattcggctttgtcaaaaccatcacctttgccatgctgatcgggctggtcagctgccggatcggtctcaaggccggacgcagcgccgccgatgtcggtgtggccgcaacccgcgccgtggtcagcggaatcgtcggcgtcatcgcgctggattccatgttcgctgtccttgccaccatcatcgggatttaagcttttgcaaccaggcgatcatcccgacaacgcgctgctcggcatgcgagacgtcacgctgggattcggcccgaagatcattcagcgcaatttgtctttcgatgtgcgcaaagggtcgatcttcgccgtaatgggtggctccggttgcggcaagagcaccgtgctgaaaagcatggtcggcttgctgcgccccaaagcgggccgggtctatgtggaagggaatgattactggggcggcagcgatgccgaccgcaccgcgaccggccgccgtttcggtgtgctgttccagagcgcggcgctatggagttccatgaccgtcggcgaaaatatcgccttgccgctggagatgtttacgaaactggcgccccgccaaatccgttcgctggtggaattgaagcttggtctggtcggaatgtcccacgcgatcgatctgatgccgtctgaactgagcggcgggatgcgcaagcgtgcagggctggcgcgtgctctggcgcttgatcccgacatcctgttcttcgatgagccatccgccgggctggatccgatcacgtccgccaggctggatgatctgatcatgacgctgcgggatggtctgggggccaccatcgtcatcgtcagccatgaactgccgagccttttcgccatcgccgatgacggtgtgtttctggatgcgcataccaggaccacgatcgcccatggtgcgccacgcgacctgcgggatcattgcgacgatccacaagtgcgtgccttcatgaaccgcgatgccctgaacacggagaactgaccgcatggtcaatcgtcaaaccgccgttggtgctttcgtcataggcggatttatcctcggtgccgccgcgctgatgacattcggacatttccgtttcttctcacagagtatccgcgccgccgtagtgtttcagggatcaatcagcggtcttgccgtcggtgcgccggtgacgtttcgcggtgtgcgggtcggcgccgtggaaagcattgccatcaatttcgatcaggaagatcaggccgcctatattcctgtggtgatcgaccttgatcccgatcaggtgacggtggtggaaagccagcatgagaacaacagcacgctcgatctgaaacgactgatcgcccatggtctgcgcgcgcagttgaacatgcagagttttgtgaccggccaatccaacgtcaacctggatttcgatccggcttctcccgcgccgctgcatccgcgtctcacaagcctgacggaaattcctgtcaaaccctcggctattcagaagatgaaggatgtgctggctgatctgccgcttaaggaacttgcaggaagtgccagcgctgtgatggacaatatccgcatcctgtcgcaacgtctggatgatgatctgccaccgttgctggccagcattcgcacttcctccgagcactcccaaaagacattggacgtcgttgcagagacgatggttgatcttcagaaaaacctgtccacaacaattaccaatctgaacgcgctgctggtgaacggcaacagacaactcgatgcccgcagcgccgatgcgcatgtcgccttactgaacattgcccgcactgcccagcgtgcgacctccacgctcgataatctgcgctccatgacagcaacaggatcggaaagccgcgtcaatctggatgatgcactccgtgacattgccgccgccgccgccgccctgcgcggctttgccagcgatgtggagcgcaatccgcaactcctgctgaccggacggaaacaatgagacatccttcagctctcgctctctccgccctgctgctattcgcgggttgtgctgctccagccttgcgcgtctatacgctgagtgcgcaggaatcccgcgctccggcgcctgaatccatccctgccagacagatcatcggtctgtcacgggtgcaagtgcccgattatctcgacacacaggacattatcctgcgccatggtcaggaactgcatcgcagcagcaatggccgctgggcgaccagattatcgctgggtatcacagccgccatcggtgactgtctggcagcccgctggccggatgcccagatcgtacagggaccacagagccagtcaccggatagccgcatccagatcgttgtgacacgcttcgatgtcggcgaggatggtcaggccctgctggaagccggctggaccatcacccggatcggcagcaaacacccaccggaacgggacaggacggtgatcaccgcctccggacccgtcaaaaccgatgatgatattgcccgcatgatgcgcagcatgctgctgcaactggctgaccggatcgtccggccagccaagtaaggcaaaaacccgtttattgcgcctttacgggtgaagatgcgttgccaaccggtatcgggagggagacaggtgcatcattttcccatccaccgccaagcgccttgtaaagctgcacaagattggtggaaatcgcggcatcgctatcggccagatcacgctccgccgccagcaactgacgctcggcattcagcacatccagaaacgtgaccagcccgttgcgatacgcattctgtgccaagccgacagcacggcggtcagcatccacgctctgacgcagggcttcgttgcggcgctgctcgtcttcataggcagccatggcattgctgacatcgtgaaacgcttgcaacactgtcttgcgataggcaatggcagcctctttctgctgctgggtcgccatatccagattggccttgagacgcccaccctcaaaaatcggcagtgtgatcatcggaccgatcccatatgtgttcgatccccagttgcccatatcagcaaaggtcagcgcgctcatcatcagattggcattgatgatcacacgtggcaggaaactggcctccgccacaccgatattggcggtggcttcgtgcagggtcgcctcggcctgccgaacatcagggcggcggcggaccaaatctgagggtaacccgaccgggacgcgcggtggcactgggggcacgggacgcggcacgatcagctcccccgacaaagcctgaggagcctgcccgagcagcaggctcaacgcattgatcagggcggtctgctgtgtttccagtgccggcaacgccgattccgtcagagccagctgggcgcgggcattttgcacatccagatcagaccccaagccacccgtctgccgctgccgggccagattcaggttttgccgtgccacctcggcattgcggcgcacgatgtcgatatccgcctgcacattgcgcaaacgcatgtaatccagcgcgacctccgccatggcgctgaccagagtggcacgccgcgcttcctgattctgctgaatctgcgcttccccggcctcgatatgccgccgcacacggccccagagatcaatttcccaactggcatcaataccatagcggaaatagtcgatcggggggacttcaatcttctgcccggattccgccagcaacccgttcaatcccgcctttcccagccctacctgcaaagagcgatcactgacaggcttgagtcgttgataggacgcggccccgttcagggatggaaacagggccgcacgggtaccacccagctgcgcccggctttcagccagacgcacagtggcggtttgcacatccagattattggcggccacccgctgctccagcgaggtcagcacgggatcggtgaaactgctccaccaactggcttccgtcggttcagggacgacatggctggcgatgggctgtgcctcaaaatgcccggcacgcggcgcccatggttttgctgcttcatcctgccggggcggcacaaaggtcgggcctatcttgcagccggccagagccagcacaatcagcgtggaaccggagaacgagatccggcgtgctgtcttccgcaaccaaaacggcatgaaaaatccttatcaggcaggccaccggaagccgaatcatctttctggatcgcgaccacaccaccagattgaccgaccggttcggtcattttcttttgacaaattaatcaggacgggcaaatcgtcaattgcacggccagcgtccctgctgcccatcatgaccctgtgtggaggcgtgacttgctatcatgagtgttatggagtgtctgtcgacggagaaacgcagccagatcctggccggcgcggcaaaggtctttgcagaagaaggctatgaaggcgccagcatgtcgcgcattgcgcatgaggccgctgtctccaagggcacgctctataatcatttccagaacaaggcggatcttttttccgtctatgtgcaggatgcctgctccacctctctcagccatgttttctccaacgtgaaggaagatggcgcaccggaggaggttcttctttcggtcgcggatcgcatgctgaccatgatgacagacccggcctgcatagtgatttaccgggtggtcatggccgaggcggcgaaatttccccatgtcgcgcagaccttctatcaggcaggccccgccgaggcgatcaggcgcctgacactatggttgacaggggccgccgctgatggccgcctaacggtggaagatccgcaattcgccgccgaacagttcctggcccttgttcaaacccgcaccgggctgcggcggcgtctgtgtctggatcacgacgttgatccggcattccgggactatgtcgtccgggaaaccgtgcgtatgttccttgatcgctatgccccccacacctgacagaccttcatgtcattagatgttgcgaaatattcgcaactttactaagcgactgacctcaggccgccattatacggccagacagggaaggttgataatatgcagggacgcagatggggagttttctcccgcatcatggcggccatgatcggcggatattgtgcgaccctcgccatcaatgccgccctggccgtgctgctgcccctgcctcgtgccgaagccgtcattattgcggccatgctgtcttttccggttttcgcgggggtgatcatctgggttttcgccacgcgcagcgccagccgcgcctgggcgggcctggtgctggtaacactgccctgcgccgcgcttggttactggtccgcaacacatcccgcgactcctctcaccctgcattctgacggcggcacgaaaggaaaacaccgatgaaaaaggggttcgtgcagtccatgacctggctgcatagctggagcgggctggtgttcggctggctgctgttcgcggtgtttctgtgcggcacgctgacgattttcgacaaggaaatcagccagtggatgcggcctgagcttccacccatcgccatggatacggaaacggcagccaaagccgcctccctctatctacagacgcaggggctgcttaatcaggccatgcgggaggtcactggccacgcgccgacaaccaccgccgatccagcaaagccacgcaccgggaccaatcggcatggagtccgccgctggctgatcactcttcccacaagacgcgtgccggaactgcgggtggcagcatccggtcctcgtcgcgagggcacgctgattgatcaggtcacgggtgcaccgcttcacatccgacaaagtcaggggggagcattcttcttccttttccatttcaccctgtttgccgaccggaccggagaatggttcgtgggggccgccgcgatggccatgctcgccgccattgtcagcggcgtgatcattcacttcaagcggttgctgaaggatcttttcaccttccgccccgcttcctccccgcagcgttcatggctggatgcccatgccgccggagccgtgctggcactgcctttccacaccatgttcgcctataccgggctgttcatcctgttcacccagctgatgcccagcgggatcatggcccgctatcccggtcagatgacgcgctttgccgaggaagcagggattgccccctatgcccgtccggaaaccggaatgaccgctccattgctgccgctcgatatttttgtccgcaaggcggaagcccgtatggggccgggcagcgccggttatatcgcaatcctcaatccgggagaccgggcgcagacggttgaaatctatcgctatgacggtgaccgtgtcgcatggagccgtgatcacatcgcctatgacggcaccaccggagacatgctgcatgaagcgatcatgcaaggtggggtctccaccacggcccatactctctgggggttgcattacgcccagttcggaggccggccggttcactggctgtattttctcagcgggctggccagttgcgggatgatcgccagcgggctggtgctgttcacgatcaagcggcggcagcggcatgagaccgatcctgtggcccatgcgctttttctggccgccgaaaaattgaacgtcaccttcatcgccgggatcagcatcgcctgcgtggcctatttatgggccaaccggctgctgccacccgatctgccgggacatgatcaggcggaaatcaaaatcttcttcgggagttggctgctgacgctgttgcatccgctgttccgttcgcctcgccgggcctggctggaacagctttccctgctggccgcgctgttgctgctgctgccctttctgaacatggccacgacacaaaccggcctgacacacacactgctcgatcacggtgcggaacgggactgggcgcgggcaggcgttgatctgaccggtttcatgctcgggctggccgcgggctgggccgtctggaaaatcgcggtgcatcgtccgaaaaccactcgttccggtcgttcggcggtcacggcaggagcctgaagaacccatgatgcctccccttgctctgctggccgcttttctgatcgctttcgctgcttttaccgccatcgcatggagcatggagcggcataagcggcaaatggcaccctcgatccctttgaaaaaaaaggaaaagccggactggcatgaccagattggcagactcgccggatggatcgggctggtggtggccttgatactctgcgccatcgggtttggctgggccgcggggccggtcgcatggtttggcgtgctgacaatggctgccatcacgctggcattggttttggcctatcgtcccgtggcaacccgtcaggccgctggtatggcttccttgctggccgcgttgctctgtgcagtgtccctgctgtcctgatccatcgccagacgacgttttccccagatcatcggctccagcaccgaaagcagagccgaaagcgcaagccatgcccccgccacagccagagagggcagaaacgaatgcgtgtactgataaagcgtccctgccatatacgggccgaccacctgcccagccgcatatccagccgtgagcatcgccaccagagagggatcatgatagcggtttttggctgcatccatgctcagcatcacgcccagcatcatggttgatccgaccagcacgctgctcaatgccagcccggccagagaaggcaggaaaaccgggatcacgatcccgactgcctcacacagatagaccaacaccagcgtacgcgcatgatgccggggcggcacaaatccgcacaggatggtggacaagccggccatcaaccccatgacaggccagagaaactgatccagcccaccgcccggcagaacctcccgcgcgatcagcggcagaaaggtcgccggcacgatataacaggcccctgaaattccataggcaaccgccagcatcgccttcggaagccggaattgcggaccactggcgggcgtgaaaatatggagcggcataacaatggggggatgaacgggcatattctcccgccatgacgcagccagcaccagcgcaccgccgaaagcagccagtattcccagccagagccatatcccggcaaccctcattccatgcccggccatcatgggcaccaaaaggcccgtgatcatgatgccgaagccgggaccgctgaaaacaatgccgcgccagtggccatgaccggacgctacgagacgccgcatgctccaatgcgtgataccaaccagcccccatgcgctggcgacaccggacaggaaacgcagcccctgccacgccggatgatatccggtcatccccataccgatcagacccagcgcggtcaggaccatcccccatagcagcatgggacggctacgttcccccgctgccataccgctgagcgcacccaccagatagccggcgagattaaccgtcgccagcaatgagccgccatggaccgtgacgctcccctcccggatcatcaggggcaggatagcggtatacgcgaaccgaccgaaccccatgatcaggataaaacccagcataccggccaatgccgtcatgatggccttgccctgggcagcagcaatggtcacgcgggaagaagtcattgcctgctccgctttcataagcttgcttatgaaactaagcccatcacagccgggacaaaagccttctcgtcgcgacagtgatgcaacgcagcctcgttgatggtgcagacaaagcctcaggcagcatcatgcaacagggactgccgcggattggcttccgattgttccggctgatgatcacgcaggaacgcctccagcgccggatcgaccgtgccgagaaccagacgcagtgtgacgatcgcatccccggccgccttgccgccatgggccggaacgccgcgtccccgcaagcggagtttggttccgctatcgctgtgtggcggaaccgtcactgttaccgccccacgcggtgtaggaacctcgattttcgcgcccagtacggcttctgcgtaggtgatcggcacatccagatggatggtctgctcctcccttcgatagatgggatgcggtgcaacagataacgcgatcagcacgtcacctgccggaccacccgcatggcctggcgccccctgtccacgcagacgcagcacctgaccgctttccgcgccgggaggaatctgaagatcaatcgccttgccatcgggcatcgtgatgcgctttttaggcacgccattgaccgcctccagaaagctgatcgtcatctggtaacgggtggattggccttttgccgggccacgcggacggccaccattgaagagatcgccgaaaagatcggcaaaatcctgtccctcgaacggattgccctgctggccctgagcagtacgggagtatccataggctggcccacgctcctgtccggtggcatcaatctcaccgcgatcatagcgggcgcgcttgtccgtatccgacagcagggcatgggccgcagaaatatccttgaacttcgtctcagccactgtatcgcccggattcacatccggatggtatttcttggcaagccgacgatatgcatcccgaatgtccttcgcggatgcgtctttcctgacacccagcgtctcgtatggatcagccacgcagtctgctccctcaacccttgaccgggttctgatatcggtatcgtgatgagttttgacgagagggtcacgatacgtttcctctcccagtcctcgcagacctaatccgctttggccatgcgttgcatcaggcaatccgtgcgcaaacggccatgatagcgggtccagctctgtgtctctccgaacagcgatatgccgatatagccacgcacccgcaaatttccatccggcccgatccacagggatacgctgtaccagctgcccttgcggggatcgagaatcctgcccggccaatgtccgtctgcatcgcggggaccagtttcgatgatggtctccccacattgtgggcgcccccagacatccaccggcatcggatcatccggatgatcaagggtgatacccttgatacgaccacatagccccaattgacccgacctatcgctgcggggcttgcactgcaccagttcgatcaccgcttcccgatcctgtgtaagccatggacccagtaacggatcaggctccgcgctccatccccggcatggcatcagaatgagcgcagccattaaagcgccctgcaacaaccgacatcgcatgtgattgagacaagatgctgatagcatgcggatcatacccttttgttgcgatgttcagggctggcgtggcaacagggtggctgcccccagtggtcgggcccggtagagatgataaatctcgatcacccgcccatcgtgctgtcttagcacatcccccagactctgaaggtcagcccaatccagcggatcgggaggttccttccgctttgctgtttcaatcagcaggaccgatgcgccatccgctttgacgcaaggtagacggaacaggcgccagcgaggttccataccccatgcctgaacatcaaccggtaaataaacagccaattcagaggcaagatcgtaattatcggccacgacggctttcatgccgtttgccctggcgagttctgccgccttctgcgccatggcttgccatccccccatgcgagaagctgccgggtccagtttcggcggcaagggcagaggcatcagggtcgcctgcatatagacaagtgcggtgatccccagccccagcacactcgcaacccggaaccaccgccagcccggcagcaatccagccgccgccagacaggcagcaggataaagcagggcgggccagttggcctgcaccctgtcacccagcgcatgttccagaaaaatgattcccggcagagtcagggccgccagcaacgcggcggtcgccagttcagcaggctcaacctgcctcctctgccgcaaccagatgcgaaaagcctgaccggccccagccgcacaaagcagaaaaacacccggcgttgccagccctgcctgcccgccaagcaactcacccagatagcggaaagtccagtgaaaggctccgttacggccaccctgcttgataaaactggcccagccatgctgcatattccacaggatcaccggggagaacaagaccgccgccaccatcaggccggcccatggttgccaacgtctgacccaacggaacgacgctttctgatccagcagccacagccccatccccatgatcggcagggccgccgtatatttgctcagtaatccgcacccggcagccagtcctgccagcagccaccatcctccctgccccaccccatctcgtgcagaagccacgatgcgtccgagagcaaacagcagcagtacgcagaaaaacagcagtggggtatccggtgtcatgatcaccgaacctgcccccagaaacagcgtggcattcagcagcagcgccgctttcagcccggccgtgcgggaggcaaacaggtctgtcccggccttgaccagtaatatggacccgagcgccgccgatactggccccagtagtctgacacccagcggaagccatgcggccccgtcaggcaccagagtagtgccaatccttatccaccacgccaccatcggtggatggtccagataggacagatccaaagcacgcgaccatatccagtaataggcctcatccggcgataacggcatccatgccgctaccgccaatctcaccagggttaggaccgtcagagcggcgatccatggcactcctgccggccgcctcgccttctccatcagcgcgcacgccagatcagggtggcggagacggtataattccacaccagcccgatcatggcccctgtcgcaccggcgaagctccaggcgcgatccatttcatagatcatctgggcaatgccgatattagctgccgcccccaacccgcacaccaggaaaaacataaggcggccaacccatagacgcctgcccctcaagcgctgatccgcataagtaatgcgattattcagctcgaaattcattgccatggcgacaaccgtggccagaagctgggccagatgaaaatgcatgaacggcctgacggttatcagcaccgccagatgcaccacaaggccaatggctcccacccccgcaaaggaaagaaaacgcagcggaaccaacccgtgcaaagccttgtcgaccagcaaggccatgaactggatcagaaccagcgcattcaacttgctctcgcctgccacacggtcccggaaacggcacggcacctcccttacgcgcagaggctctggtgaagccagcagcagatcgagcagaattttgaaaccctgcccggtcagacgcggggccagagcctcaaaccggtcttgccgcatcataaaaaaaccgctcattggatcagagagcggaaccggcagcatcgcctgcgccagccgtgtccccccctgtgacagacgatgccgccattctcctgccaagccggatgcatcgcccccttcaacatggcggctaccgaccgctacatcgcaggcaccactcctcagcaggtccagcatcggacgaagggccgtttcgtcatgttgcagatcaccatctatcacagccacaaacggggaagagcacgccaatgcgccctcaatcaccgctgaggacagcccccggcgaccgacccgcttgatacagcgcacacggtagtcatgcctcgccagatcacgggccgcatctgccgtaccatcagggctgttatcatcgacgaacagaacctcccaccgacaatccttcagggcctgatccagctttgcgaccatcggagcgacgttcgcccgctcgttatagcagggaacgacgactgtcagttcaacgccatctcgtctgactggaccggaacaggcatttgtccgtgaggaaacaggttcgaccatacgcagggcatacagcaaggcaaggttagtcggaagagagtcagattaaaaagtagaaaattaaattaataatataaattattttgttaatttaattatattaataactataaagaaattaaaaataacatctcaaataatgctagatttttgatttttttttggatagttatgcacactatagagagtcaggaattttagaaatggcttcaaatgtaactgttcccgggggcaatacccctctgtcaacagtaagcctagattacaaccgcaatcttgcgcccattacgacgcagttgttgagttctatctatgcagctgcggcaaataatacccttcaagcggtggacaatccgactgcagcaccaacagttgaagcagccaatgccattgctttaattaccaccagcatgtcgtctgtgccgactggtttttccagtatgattatcggcgcgacctcgcagccgggcgctgtcagtaatgttgttgttaataataccaatacgatttccaatcagtcagtaatttttggtactgcgggcggctatctcgagactggcgcaggtcaaggtactattctgggttctctcggtgccaataccattatgggtacaggtggcaactggactattcagacagacggtagcagtccatccatcggcggaagctatatcaaaggtcagaacagcaacattgttctgaatgctctcggtactgatacttatattggcggcactggcagtgcaaccttggctgccttttcaggcggttcgcttttctttggcggcaaagcgggaacacagaccgtattctcgaacaactcacgcgcaggcagcggtaatgcaacctatgttggcgcttctggcgacagcaccgtctatgcaaataacgtaaatggcctctatcagtaccaatccggatcaatggcgtttgtcaatggttccggcagcaatacaatgtttggtggatcgggtgcatccacattatttgccggaacgggtcaaagtcttttcgtactaagcaatggccaaacgaaatttatggcgaccggtggctcgcagactgtctacggggcaaatgtagccaataacggatatttcagcagcaatgccaccataaatcttgttggcaacacaacaggcggtaatcagctggttgcagtcgggggagataatattctctctactgccttctccgacagcggtaatatcttgaaggccggtagtggcagcgatacgctgttcggaagccagggtaatggtaatgataccatgttctctggaaccggctccgcgacaatgtttggtggtggcggaaatgacatattcgttctctccaaagggatgcaggccactacaatctttaacttcaatacatcttcgaccttgtcactgaatggatggggtgtggatgcggaaaacgcggctgtcaccaatcaggtcaatgatgccgctggcacccgtctgacactgaatgacaatacgactattacgttgatcggtgtaagccatctgaattccggtcaggttttcaattcctgatttaaattttctattttattctaatgtaaatggcgctgctctttatgtgagcagcgccatttttttgattactttatgcactacataaaacgtggcgacgttaaaaactcgtctctgttatcttcaaactccacatcacgatgtacatgaaccgacatcaacagcccgaatccgagcatcgcgcataacatcgcggaaccgccatgcgataccaatggcaacggcacgcctccgaccgggatagcgcccataaccatcgcaacgttcaccacaatatacatgaagaaattgactgataatcccaaagccagtaaccgcccgaactggtgacggcaacggataccggtcgccataccgctcaacacgatcagacagagcagacagagcagagcaacacccccaataaatccgaactgttccgaaaatactgtaaagatgaagtcggtttgcttttccggcaggagcgccagattacccctagtgccatccagaatgccttgtccccacatcccccctgagccaagaccgatttttgactggataatgttatagccagcccccagcggatcgctttccgggttcaggaatgtgatgatgcgctgacgctgataatcatgcagatgatgatacgcaaaaggggcgataccagccaccgccccaagaatcagggcaaatttccacagcctcacccctgccgtcataaagacggagccacccacgatggccgtaatcacagcggtgccgagatttggctccttcaggatcagcgctgcgggagccagcactgcaagggtcgggacgatcagaaaaaacggcctgccaacctgctcccacgacgctttgcggaaccaggcagcgagggcgaggaccagaaacagcttcatcaactcgctgggctgaagctgcaaaggccccagttcgatccatctttgggcacccttgccgatatgacccatacgggccaccaggaccaacagtcccaaagcaaaaaaataggcaggccacgcgaaacggcagataatccggatatccgtcatggcaatggccagcatcatcaccatgccgacggcaaaacggatcagatgcttgtcggcatacggtgcggatccaccccctgcggcataaagggccatatatcccgcccccgccaacaggcagagcaacaacacaaaaaaccagttgatccgccagagtttattgacgaacgctgctgaacgatcattcagcaggcggcgctcataaacccccattatcctttctccgcgattgtctgtccgggttttttattggccggatcgcgtgagagcacatccatcatgatgtccctcgccaccggggctgcggcctgggcacccgcattcccatgttccaccacgactgccagtgcatattggggatcatcataaggcgcatatgcgacaaacagcgcatgcggcctgaattcccatggcagattttcggatttaaaattaccgcgctcccgcaattcacgggaaacgcgacggacctgcgtagagccagtttttccggccatctgcactggcaggggaagtcttgccagtggcgcggtaccatgctgctcattcacaaccgcgaacatccccccccgaaccgctttcagggcagcctgaggaatatcgagcgccggccaatcctcgggtcttgtgccgcttcccaccataccaccgatgcttctggtcagatgcggctgtatggcccggccggtggccagacgagccgtataagtcgccagttgcagaggcgtgacctgaatatagccctgcccgatcccggccacgatggtatcaccgacattccatggatgtccctttgctgcccgccatgcacgggtgggaatcaatcctcgcttggcatttggcagctcgatcccaagctcgacccccaaacccatccgatttgccacgttggcaatacggtccatcccgacccgacgtgcgacctcataaaaatagacatcacacgaaaatttcagtgcctgatgcatatcgaccgagccatggccgtatttggaccagcaatggaagcgtgccgtcccgacatcgatatagccggggcagaatacccggtcacctgccccgataagctgggactccataccggcgatcgccacacacatcttgaaggtcgatccgggtgagtagatcccggccacggccttgttgatcaacggcgcacggcggttgcgggtccattctttccactggtcctgagaaacgccatgatcgaaaagggatggatcaaaggaaggattggtggccatggccagcacctccccgtttttcgcatccagaaccacggcgctggcactttcatcccccagccgcgctatgacggagcgctgtaattcagcatcaattgtaaggccgacctcgctaccgggcatgccttcctgccggtccagctcccggatcacacgtccgacagcactgacttccagctgcatcgcccccgcacgaccacgaagaggctgatcgtgaaacttttccaaccccgcccggccaatccgtacccccggcaaggcaaggatcggatcatcacccatatcgtgctcgctgggtggggcaacatatcccacgacatgcgccagcgtatcaccgtaggggtaaacgcgggtcgtgccgacatcaatcgcaatcccgggcagatcgggcgcattaacctcaatcagcgccatttcttcccagctgaggtaatccttgatgacaacagggataaagcggcgatgacgacgtatatcgcgggctatgcgggcacggtcatgatcatccagagggatcaatcgatggaaattatccagtgtggcatccggatctccggtttcctccgtcatcagggttgccagccaatgcagcctgttggtagcaacaggcctgccgaaacgatccagcacatgaccacgcggaggcgcgatcaggcgctcgctgatatggttggttttggccagtagcgcatagcgttgcccctccacgacctgcacctgatacagtttggccgccagcgtaccgatcacaccaacctgcaaaccggccagagccaaagcccgtcgcgtaaagacgccgctgcgtttgatttcccgcttcataccggatccggatccgtgataccgcgatgcgcgcgggtaaagaaaaccgccagagccggataaaacccgatgctgagagttgcaagcaacagggcaggtccgggcggcatgatggtgagggtcagaagggactgcataaaccagattaccgcagtgcagaggctggcgaccagagcataagccagccagacgatcataaagccctgctgactcagtccccgtcgcagacgcagggccattgcctgcgccgccagcagagcaagttcagaaacaccgatcgcaaactgccccaatagatcggccagaaccccgatcagaaacacggccaggggcggcatcgcgcgggggcggaacagggaccagaaaaagacacaggccagcatcgtagccggtggcagttccgcctgcgcgggaagaccgagcggcccattgagcatcaacagcagcaggatcgttgtaaccactggcagactgcttcgcgccgcatggtccagacgtcggaacagggtctgtctcggcgtaatgggattgacccgccgggccacacgatccagtggcttttctacgggcatgacgcccccaagccgattaatgcacccgggcggaggatttctggcgcggctccacccgcgtcaccttcgcatccggtggcaggataccatgcagaccgtaatcgaaaatacgcaccgcctccagccgcgacagatcagcgaaaggctgcacttcgggcacgtgattggcgttatagtgaacaatccccacaggcagattggcaggaaaagcattagcttcggcgctcgtcaccacccgctccccctccatcggttgtgcattgtcgggataatagagcagacgaggcctcgtaccgttggtaccgaccagaatggcgcgggcctggcttttacccagagaaaccggcacccggctgtttatatctgtgatcagcagaatacgcgcacttctgttgccgacctcgttcacccgcccgacaagcccgcgatcatccagagcgatttcacccttacgcacaaagcctccgccacctggagcatgcggtccggtcgataggagcacggagcgtgcataaatgccgcccgcatccgcaacgacccttgccgtgacatagggggcaggtggatcgggcagccagtgaagctgtgccttgagcatggcattttcgtcatccagcgccaacgccacagcctgccaccggcgcaggcgctgattttcctcacgcagcacggcattgtcatgggacagggtcgtcacatgccgcacattgtcaaaaaccgtgcggatggcgctgatcggcgcatcaagcgcggcatagatcggagccagaaggtccgccgccgtcgtacgggcctgctctgccagcctgacatcaaccttgccaagcagcatcaaagcaaaggcggcagccatcaggaccggcaaagtcagccgcgccagagcctgccggacgggaaccgataaacggatcaagcctacgctcgctcctcaaaatcgcgcgggtataagtcgtgccccggctgatacaggaagggaaccagcctcatcattctgctccctcgccaaacctaatacatcgttgtcagcacattgcgaagccgcttcatctcctccagcgcccggcctgttcccagcgccacgcattgcagaggatcctcagcaaccgccactggcaggccggtcgcatctctcaatacctgatccaggcggttcagcagcgcgccgccacctgtcagcataatacctttatcgacaatatcggctgcaagttccggcggcgtgttttccagcgccaccttgacggcctccacaatcgccgtcaccggctctatcaggctttcggcaatctggcgctggctgaccaccacttcacgcggcacaccgttcatcagatcgcggccctttacctgccgccacggtccatcatcatcgtcccatggcacgctggctgcaccgatatccatcttgatccgctcggccgagctttcaccgatcaaaaggttatgattccggcggatgtaattgatgatcgcctcatccatcttgtcgccaccgacgcgcaccgaacgcgcatagacgatcccgcccagcgagattaccgcaacctcggtcgtgccgccaccgatatcaacgatcatgctccctgaaggctcggtcaccggcagaccggcaccgatggccgcggccatcggctcctcaatcagcagcacacggcgcgcgcccgcgctttcggcactttcctgaatagcccggcgctccaccgcggtggagccggacggcacacacacaatgatcaggggagaggcaaagcggctgcggctgtgcaccttgcggatgaaatgcttgatcatttcttccgccacctcgaaatcagcgatcacaccatcgcgcagaggccggatggcctgaatattgccaggcgtgcggcccagcatgttcttggcttcctcaccgactgccagcacctgcttacgaccgcgtgaatccgcaatggcgaccacactcggctcggcaagtacaatgcccctgcctttgacgtaaaccagcgtgttggcagtcccaagatcaatggccatgtctgccgacatgacgccaaggaggcgagaaaacatccgcggaggcctctgaaacggaatggaaaggggccggctgggcttagcggggctgagcgcacagggcaagaggcagcaacaaccgatccactatcggaatatgatcccaaggatgcataatggcttcataatacagatcatcccgggattatgctcgttgcctcctgcaaacgcatcccagccttctcccaaacgttcatccatcgctatcggcacgcaagaggttcggccacctataaggcttcaaagtatagtggtcggaaatgccccgtgcggagccagaggagaacgatatctcacgggagaggaataagctgatgcgtatgattgcaaccgttgcccttatcatggcgctgggaagcgccctgtccgcatgcggccatgacatgggtacccgcgcgttgagtgggggcgccatcggcgctggtggtggcgcattgatgggtgccgccaccgggggcaatgccggtgtcggcgccctgatcggtggagtgggcggtgctgctgttggcgcagccactacgccgcagggtcgccgatactgaaaccagccctgagaccggcctcttatatcaaaaaggcggcaggttctggagcctgccgccttttttttgtttatgccgtcaaagcctcgggctcccgccggtcacgcttgaccagcagcttgttgagtgcgtgcacatacgcacgggtggaggctaccatcgtatcggtatctgccccctgcccgtccaccattttcccgttttcttccagacgcacagtcacgcgggcctgcgcgtcagcgccgtcggtcacggcaccgacagagtagagcttcagctccacatcatgcgtaaagattataccgatcgcgttgaaaatcgcatcgaccgggccatccccctgtgcatccgcctgcttcaattcaccatcgacttccagctcgaccgccgcggtggctggaccacgtgagccggcccgcacctcgacagagacaaaacgaatgcgctcatggctccggttcacctcatcatccaccagcgccacgatgtcgtcgtcatagataacttttttacgatccgcgacttccttgaagcgacggaaagcgtcattcagggcgttttcacccagctcgccatagcccagcgccttcagcttgtcgcggaatgccgcacggccggaatgttttcccatgaccagcgaggatttggtccagcccacgctctccggtgtcatgatctcataggtcgcagcgttcttgagcacaccgtcctgatggataccactttcatgcgcgaaagcgttccggccaacgatcgccttgttcggctgcacatcaaaaccggtaatggaggccaacaatttagaggtacgcagaatgttttccgtcaccaggccgctgacatagggcagtacatcgtggcgggtgcgcagggccatggcgatttcttccagcgcagcattgcccgcacgctcgccaatgccgttgatggtgcactccacctgacgcgccccacccttgatcgacgcaatagtgttggcaacggccaagcccagatcatcatgattgtgagccgaaaaaatcaccttctccgcccccggaacccgctccttcaacatacgaaagatgcgttccatatcctccggcgtggcatagccgacagtatcggggatattgatggtggtggcaccagccttgatagcagcctccacacaacggcacaggaactcgggctctgtccggctgccgtcttcggcggaccattccacgtcatctgtaaagcgacgtgcctgctcattgccctgaacgatcagctcaagaaccgtttccggctccatccgcagcttgtatttcatatgcagcggtgaagtactgataaaattatggatacggcgccgtgccgccggacgaatcgcctctcccgcccttgcgatatcatcgcgaccgcctgtgcgggccagacccgcaacgacggggccatccttggcaaattttgccgcaatggcattgacgctttcccagtcaccaggagaagcaaccgggaaaccggcttcgatcacgtccactcccagctccgcaagcatgtcggccatacgcagcttctcatccagattcatggagaaaccgggggactgctctccatcgcggagtgtcgtgtcgaaaatgatgattcggctatcgtcaatatcaccgaaactggggtggctgatggtcatgatgcgctgtatccttggcgatcagtcgtcgctgcttcccttttagacggtccaggctaggctgggaccgggcagcttccgcatggcggatctgcacttgagcactcctaccgcatgcaccacaaaagcaacagcagcggggagaagctatcccctgagcacagccgaccgtaaacccggctatatgctcaggggtacgtaagtcgaaggataaagcggaaggcagagataccggcagcacagcatgagttatcccccctgctgataatcaggccctgaaaaccgggcactatggctgctccatcattcattctgaatccataaagcggccaggtatctttttgcaagtacaagttgcgggacaatgactggaaagctttatcctctcatcggcatcgcacataacgaaaatcagggtttgaaagctgttttttgatgatcacataaaaaataaagccgctacatatgatatgcagcggcaaacaatgaagaaaatagcttaccatcaaaaagatctaataattgaaacaactcttccaaatataaaacattcagaatttttgtcatatcctatatttttaatttctatatcagaagaactatataaagcattatcactactaagtataaaattattattttgttttgatttaatgcgttttacatttataatttcattcatgacaacggcataaacgccatcatatactacagattcatttgtatcaataacaagattatcttctttataaatagtaggggtcatattatcagccaggacattaaatataaccaacccgtttacccccttaaagcagctttcgacaaactggcgctcaaaaagataacttttgggaacaatttcctgatgatcattaagatatgcatatttgcttgccacttccttatcaaaataaggaagattgataatatctttatgaccaagatctgcagcaatgctgccttccggggtaaccttttttctacctctacctgttgcaagccactccacgctgacgccacacgtttctgccagcgcaacaagagcactcactttcatctcttgcccagcgatatagcgattgagatttccgaccggaatacccgattcttttgacaacaaattattgccgccaaattctttcattatttgccgcagtcgctgcgatctttcttttacttgaagaaagtcactccgattattcacatcactatcctgataaagaatatcatcattcatatgaatatcagagttcatgttttccatattttggcaaaccatccaagatatccgcttaactgcagataatcatttatattataaatttatactatgattttcaaatttttatttaaatataatctaacctccaaatgaattttaaacttttgctggccaaatattgtcggacttgaccagcaaaattactttagaaaccaagcaatatttaatttgttaattaaacaaatcataaaagttgataacggtcaaggcaaagaaaaataaaacgaaaattttctttttattattaagtttcgttttatttttctatttttagatcaaaatattgttatttattttgatttaattatcccaattttgatatttttgatcctgtttctaaaatcaagtttgctatttttgcacgaatggcttctagctgtctcccatcctctacacgcggtgcgcagtagcgggcggcaggaataccgttccgcttccttccacgagctttcaccttcgctgcaccttttccagtataggtatgtgcattgtggaacatgttccggttgttgtcctccacataagtttcggaggcagcaccctcggcaatcaccacatcatgcgtatcaagctcgatatgcacgtagctcactgtctccacatgctgttcctgaacgatggagacaccgttcaccagacgaccggctggaaccagaacgccattgataaacattgcatgtagcggggagaccagcaggtcacgcttcggcagcacgccatccagagcaccctgacggatacgaaccggcagcacatcacgacgaccctggataaagcgaccattatagctccgacggcccagccagcagatcggacgaactgcctcacccgctgtgatcacgtgatccccgatctgcagatcttcaaccggaacctcaccacgatccgtcaggatcagcgtgccatgcacatagcagggcgtgccgtcatcatagaccgttaccccattcccgccctgagcctgacgcatcttgtagttctgatcatgcgcattgggatcaagcttgatcgagtaatactgggtcttggtcccgtcactggccacatgagacaggatcaggaagacatttcccccattactcaccacatccaccacgtcggaagcctgagaagccaatcccatcagcgtaatggattcaccgttaccaaaatcggaaacagtcgcggccaatgctgtgcctggcgtgctgatgataatgttaccagacccgacacccgcagaactcgtgccacccaacgtaatcgtgttggaggaatccagcgcttgcgagaccgtcaacgtgccattcgtctgcatcaggatattcgtgttggtcagcgtatccgccaacacccatccatcacccttcacgttgatcgtctggaacccggtatattgggtcccaaacccgctcagagtggtgccagcaccatccaattcaagcacgttgccagtgccggcagccgtaaccttaccaataatggcgctgctgccgctgatggccagacggctgttgccagcaccaaaattgatagcacttctgaatgtgctttgggtctggattgttccagtattaacaaccgttcctccgccagtcagcacaattgcttgactgagcgcaccgattgcactgattgtcccggagttggtaatactccccacgccgctaacactaataccagttgactgaccaatgtcagcactgatcaagccggtattgctgatgactccagagacaattgcaactgcggtattggttgcaccggtaatagcaatcgttccggtattattgattgttccggcggctcccattgtcacgccggtagaggcagagcctgatcccagtatctgtccactattgaccagcgttgcgacgttacccagtgaaatcaacgcatttataggctgtccaccctgaatggtgcccatgttagtaatggccacaccagttcctgcactaaagatagcagaagacaagtttccgttcgagagaacagctgttgccgcattggtcaatgcagcatttgcagccatcgtcacagcaccggcaaaggagccagtgtttgtcaaagtccctttattgagcaatgtggagttggaggaaaccgtattgaatcctcccgcaacccaagatgcgccagcatcaacgaccaggttctggaagccaatatatttgacgcccaatccactaatactgcccgccgaactgccggagagcatttcgagtgtattggtgccggccgagttagcaacagcggtgccgatgatacgggatgcaacgccgagctgcagcaggttggttcctgtgccggtcatatagattgcggcgccagcaccgttcgtaacattggcggttccggcagccgagatagtgccggagttcgtgatcgtgccacctacatcgagacggatacccgtgccggcggtgcctgctacaccgatgctgccagtgttgataaccgttccgcctgatgcaagacggacggcattcagaaagccgatacctgcaccggttcctgtttcaaggatggtgccggagttgttcagataatctgccgaggtattcgaaagatagacaccgctggctgctgtaagagtgccaccattatcggtgataagcccggcattgatgacggtgcctgcgacagtcgtattaccgtaaacgctgacgccaaccaaattgccggagatcgtgccaccggcagagttcgtgacccggccacccgtatcaaacagcacgccctgactagcgcttccagtggcattgacgacaccgctattaacaagcgtggccgcaccgcccattcctctaacggcaataccaccggagccaaacgcaataatgctccctgcgttattgatggaaccaccattgacaccaacaccgtagcttccaccccggatcagtccgccagcattgttggtaatgacgttaccggtgccaaacaagaaagcaccactttggctggtagaactggacagaatggtgccggaattgaccagcgtgctgctggtgccattgaccccatccgaaaccgagctgatcaggccggagttgttaaccgaaccacccgtgcctgcattaactccgcgatagctgctgctgataatcgtgccggcattattaataatagcaccagctacactagtattaacagcaatagcatagccatttgcaacggaatttgtaatggttccaccagacgcattcgtcagcatagccccattagacaaagtaacagtcgtaccattcagggttcctgtatttgtcagtgtgccgctattgagcagattattaaaactgcctgttccggacaaagtccatgttgcacctgcatcgacagtgccggtctgaaaattaaggaaattggaagcattgactgttccggcagatgctccagacagcatttccaacaagttcgtgcctgatgcgttagcggaaacggccccactgatctgggaactgaccccaatttgtagtaaattagagcctgcaccactaaagacaatagcagttccgccattggttccgatcaaaccataattggtgacagtgccggcgccagcaaaagaaatattgtttccggctgcagccgttccaacaagcgtaccatagttgacaacggtatttgcagcacctgcaccaacaatgctcccatttacacgagcactgttagaaacagcggcactatttgttagggttatggggcctgtaagggttgcattagttgaatttatcaccaagccactgactgacagtgtgccattattatttaatgtgccgttgttagtcagcacatagccagccgccagagtattgttacccgtcatagcccagtttgcattgctggctacattgacggtctggaaattaacataactgacaccaagaccactaatagttcctgtcgttgcagaggacattaacgacagggtatttgtccccgcagaattggcagttaccaaaccaacaatctgcgaactagcagctaactgaagaagattttggcctgttccgcccataacaacagcggtaccgctctggccaacaattgaaccaccgttggtaattgtgccggaggataccaggctgatgccgataccggaggcagatgtcccctgaataaggccaccagcgtcattagagataatggccgtattcgtgccagtggcgtaaataccgactgtaccaccttggataatggcacctgcaatgttgctgacaaaacctccgctcagcagtcgaataccatctgccacgctaccagtaacaataccggaattataaacagtagcagggttactaccaaactgaataccacggaagcttccttggataagaccagtgttagtaatagttccactgctggcaacggaggctccatatccggctgtgccactccctgaaagcgtgccgctattactgatagtcacttgctgcccagaaatcgcagcaccactagaattaaagactgctccatcactattggtaaaccgaccgcctgcaatcagactgactgaaccgttaactgtaccatagttatcgatcaggcctgtatccagaattgttccgctattatttataatgccgcgattctcaagcgtgcctgcgacactcattgtcaagccgcttgcaacagaattgctgccaattactgtccaataagcattctgatcaatttgaacattaagaccggtatactgagtgccgattccactgatcgtcccgcgcgttcctccagatgccagttccagtatgttagccgctccaacagccgccactgttccattgacgactgccgttggtaccaggatgagccgattggcatccgcactcatcgaaagggcggttccatcagaattcgcgatcaaactaccggtgttgctcagcgtactcgctgtgctcagggttagtctgccagtaaatgttccggtgttggtcaggctcgctcccgtcgcaacgaaagtctgactggtggaaatcgagttaccaccggtcagctgccagttagagccggaggcagccgtaatctgattgaaaccgacaatagttgaaccaagaccagagagagtgggtgtattggttgcccctcccccaatcagattcagacgattgacactccctgcaccgatgatggaaccaatgataacttgtccggcattcagattcagaacgctggtcccgacaccacccaaatagacggcggtgctacctgcgttggagatggtaccaaaattgctgatagtacctgtactacctaggctgactgcaattgcgccggttccagtgacagtgcccagattgttcagtagcgcattcgtgccaccgccattgaccatgccggaaattgcaccggtattgttgatcgtgccaccggccgagaaaccaacatttccattgaaagctgcactggcagcattggtcatgatgcccccaactgcgagggtaccgctgctcgtcaatatgcctttgttgagcagagtattaccagcaacaatcgtgttgcttccgcccatattccatactgcaccggtatcaacaacagcattctggaagccaagataattgatacctaatccgcttatagttccggaaagggcagcagacagcatttcgagtgtgttggtaccggccgagttagcaacagcggtgccgatgatacgggatgcaacgccgagctgcagcaggttgtttcctgtgccgctcatatagatagcagcgccagcaccgttcgtaacattggccgctccggcagccgagatggtgccggagttggtgatcgtgccacctacatcgagacggatacccgtaccggcagtgcctgttacgccaatgctgccagtgttgataaccgttccgccgagcgccaaccgaacggccaccagaaggccggaacctgcacccgttcctgtttcaaggatggtgccggagttgttcagataatctgccgaggtattcgaaagatagacaccgctgactgctgtaagagtgccaccattatcggtgataagcccggcattgatgacggtgcctgcgacagtcgtattaccgtaaacgctgacgccaaccaaattgccggagatcgtgccaccggcagagttcgtgacccgaccacccgtatcaaacaatacaccctgactggcgcttccagtggcattgacgacaccgctattaacaagcgtggccacaccgccaagtcctctaacggcaataccaccggagccaaacgcaataatgctccctgcgttattgatggaaccaccactgataccagcaccgtagcttccaccctggatcagtccgccagcattgttggtaatgacgttaccggtgccaaacaggaaagcaccactctggctggtagagctggacagaatggtgccggaattgaccagcgtgctgctggtgccattgacgccatccgaaaccgagctgatcaggccagagttattgatcgcagcgcttgtgcctgcattaatgccacggaaagagctgttggtgattgtgccggcattgctgacaacaccgccggttccggcaatagcgatagcatagctgctcgaactgctgataatcccgccagcaaggttggaaactgttcccgtcccacccagagaaacgccaaagtttgcgccagaaatcaggccgctattggtaatagtcgcaactgtagtagccgaggcatagacaccccaaccaccactggaactgatcgtgccagtattgctgaccaagcccgacgtacccaaaagaacgacaccggcaccaccagtcgcgacaccgcccgtgatggtgccggcattgacaacggtaccattcgtgatttgcacgccatagccgttgctcagctgggcacggatcagaccactggcctggttggtcacattacccgtgatcaggacaccccacggattagcgcccgtcgcaaggatactacccgcattgatcactgttgcttgaacgctatcagaagcaatgaccacgttgcccgcgctgacgatggtcgcaccagccgcgttgctcagcagggcaccattgatcagtgtgacattggcaccattgatagtgcctgtgtttgtcaaagatccgctgttacgcaggttggtaaaggtgctgttaccacccagcgtccagctagcaccggcatcgacagtgccggtctggaaattgacgaagttggaaccactaatactgcccgccgaactgccggagagcatttcgagtgtgttggtaccggccgagttagcaacggcggtgccgatgatacgggatgcaacaccgagctgcagcaggttgtttcctgtgccgctcatatagatagcagcgccagcaccgttcgtcacattggcggttccggcagccgagatagtgccggagttcgtgatcgtgccacctacatcgagacggataccgatgccgccggtgcctgttgcaccgatactaccgctgttgataacagttccgccgagcgccaaccgaacggctgccagaaagccgaccgctgtagcggttcctgtttcaaggatcgtgccggagttatttacataatctgccgaggtattggaaagatagaccccgctggcacctgcaagagtacctgcattatcagtaataagccccgcattgatgacggtgcctgcgacagtgctgttaccgagaatagcgacagcgttgaaattgccggagatcgtgccacccgcagagttcgtgacctggccacccgtgtcaaacagcacgccctgactagcgcttccagtggcattgacgacaccgctattaacaagcgtggccacaccgccaagtcctctaacggcaataccaccggagccaaacgcaataatgctccctgcgttattgatggaaccaccattgacaccagcaccgtagcttccaccccggatcagtccgccagcactgttggtaatgatgttgccggtgccaaacaagaaagcaccattctggctggtagagctggacaggatggtgccggaattgaccagcgtgctgctggtgccattgacgccatccgaaaccgagctgatcaggccggagttgttaaccgaaccactcgtgcctgcagcaatacccactaccgcggcggtaattgtgccggcattgctgacaacattgccggttccgtcgatagtgatagcaaagctgctcgaactgctgataatgccgccagcaaggttggaaactgttcccgtcccagccagggaaacgccaaatcttgcgccagaaatcaggccgctattggtaatagtcgcaactgtagtagccgaggcatagacaccccaaccaccactggaactgatcgtgccagtattgctgaccaagcccgacgtacccaaaagaacgacaccggcaccaccagtcgcgacaccgcccgtgatggtgccggcattgacaacggtaccattcgtgatttgcacgccatagccgttgctcagctgggcacggatcagaccactggcctggttggtcacattacccgtgatcaggacaccccacggattagcacccgtcgcaaggatactacccgcattgatcactgttgcttgaacgctatcagaagcaatgaccacattgcccgcgctgacgatggtcgcaccagccgcgttgctcagcagggcaccattgatcagtgtgacattggcaccattgatagtgcctgtgtttgtcaaagatccgctgttacgcaggttggtaaaggtgctgttaccacccagcgtccagctagcaccggcatcgacagtgccggtctggaaattgacgaagttggaaccactaatactgcccgccgaactgccggagagcatttcgagtgtattggtgccggccgagttagcaacggcggtgccgataatacgggatgtaacaccgagctgcagcaggttgtttcctgtaccggtcatatagattgcagcaccagcaccgttcgtaacattggcggttccggcagccgagatagtgccggagttcgtgatcgtgccacctacatcgagacggatacccgtgccggcggtgcctgctacaccgatgctgccagtgttgataaccgttccgcctgacgcaagacggacggcattcagaaagccgatacctgcgccggttcctgtttcaaggatggtgccggagttgttcagataatctgccgaggtattcgaaagatagacaccgctggcagctgtgagagtgccaccattatcggtgataagcccggcattgatgacggtgcctgcgacagtcgtattaccaaaaacgctgacgccaacgaaattgccggagatcgtgccaccggcccagtttgtgacctggccaccagaactaaacagcacgccctgactagcgcttccagtggtattgacgacaccgctgttaaaaagcgtggccgcaccgccatttcccctaacggcaataccgccggagccaaacgcaacaatgctccctgcgttgttgatggaaccaccattgacaccagcaccgtagaggccaccctggatcagtccgccagcactgttggtaatgacgttgccagtgccaaacaagaaagcaccactcaggctgctggagctggactttatagttccagaattgaccagcgtgctgctggttccattgacgccatcggaaaccgagctgatcaggccggagttattaattgcagcgtttgtgcctgcattaatacccactgccgtactggtgattgtcccggcattgctaataaccgcactagtgccggacacaaatacgccatagctactgctaccagtggcagtagcgctgataatgccgctagtttggttagttattgtgccggtgttagcaaatgagacgccatatgtggcaccagatataagaccactattgatgacattgccgctgctggtcgtgttgccaaatacaatgcctgcagatgctgtgcctataatctgtgcggaagttcccgtgttactgactgtacctgaaccaataaacacaccataggtcgagccgctgatgaggttggtattgcttaccagacccgcacctgaaagccaggcgcccttaccactatttccattggcaatcagtgtaccagcattggcgatagtaccatttgcaatacctgcaccagcaaagccaccctggatcagtccgccagcactgttagtaatgacgttaccagtgccaaacaggaaagcaccactctggctgatagagctggacagaatggtgccggaattaactagcgtgctgctggtgccattgacaccatcgaaaaccgagctgatcaggccggagttgttaaccgaaccactcgtgcctgcagcaatacccactaccgcggcggtaattgtgccggcattgctgacaacattgccggttccgtcgatagtgatagcaaagctgctcgaactgctgataatgccgccagcaaggttggaaactgttcccgtcccacccagggaaacgccaaatcttgcgccagaaatcaggccgctattggtaatagtcgcaactgtagtagccgaggcatagacaccccaaccaccactggagctgatcgtgccagtattactgaccaaatccgacgtgccagcaagatagacaccagcaccaccggtcgcgacaccgcccgtgatggtgccggcattgacaacggtaccattcgtgatttgcacgccatagccgttgctcagctgggcacggatcagaccactggcctggttggtcacattacccgtgatcaggacaccccacggattagcgcccgtcgcaaggatactacccgcattgatcactgttgcttgaacgctatcagaagcaatgaccacgttgcccgcgctgacgatggtcgcaccagccgcgttgctcagcagggcaccattgatcagtgtgacattggcaccattgatagtgcctgtgtttgtcaaagatccgctgttacgcaggttggtaaaggtgctgttaccacccagcgtccagctggcgccggcatcgacagtgccggtctggaaattgacgaagttggaaccactaatactgcccgccgaactgccggagagcatttcgagtgtattggtgccggccgagttagcaacagcggtgccgatgatagcggatgcaacgccgagctgcagcaggttagctcctgtgccactcatatagattgcagcaccagcaccgttcgtaacattggcggttccggcagccgagatagtgccggagttggtgatcgcgccacctacatcgagacggatacccgtaccggcggtgcctgttacaccaatgctgccagtgttgataaccgttccgcctgacgcaagacgaacggccgccagatcaccaatggctgcaccagttcctgtttcaaggatcgttccggagttgttcagataatctgccgaggtattggacagaaacacgccatgcgcagccgtaagagtaccaccattatcggtgataagtccggcattgataacagtgccggcaacagttgcagaggtactgaaaaggctaatggcattgaaattgccggagattgtaccaccggcagagttcgtgacccggccacccgtgttaaacaacacgccctgaccgaaggttccagtggcattaacgacaccactgttgacaagtgtggccgcattaccaagtcctctaacgccgctaccaccagagccaaacgcaataatgctccctgcgttattgatggaaccaccattgacaccagcaccgtagaagccaccctggatcagcgcgccagcactgttggtaatgacgttaccggtaccaaacaggaaggcaccactctggctggtagagctggacaggatggtgccggaattaactagcgtgctgctggtgccattgacgccatccgaaaccgagctgatcaggccggagttattgatcgcagcgcttgtgcctgcatcaataccacggaaggaagtgctagtaattgtcccggcattgctgatgacagcgccagttccagcaatggtgatagcataactgccgccgctgataatgccgccagcaacgttgttgatcgttccagccgcggcaaggctgataccaatagtgcttcctgtaaccgcacccgtattattgatcgtccaggctgtactaaggctgctctgtatcccgatgccagcggtattcgcaactgtcgtccccgccagaataagaatcggatttgatgaggcagtcgtaagaataacacccgaggtagtggacgtcagcgtggtcatatcacaaccgccttaaaaaattaaagaaattaacaatattctgttagattggcaccaagtatattctcacagtctataagacacatcatgtgatattgtaaatataaatacagttaaaatgtaaaatttttaattttttactgtattatttgttttatatcaaaaatattattatcattatattgtattttatttttactatattaaaatcattaaaatattaatttttttacaaaaaacttcattttcaaaagttataaaagctttcaatatcaatataagcatattttttacatttttagttttttggactaatttataattaataaaaattaaatacgtttacaaaaaaaaatttagaacaaatagacattataaattcatgatgaattttatttcataaaataagaaatattctttgaaaattaaaatttaaggtttatatattttaaaataatttatttatttaaaataaatatagaatttatttaaattataaaatattttattattttatattatatttttccaaaaatatctttttaaagtaaataaaaaagttttataaattaaatattgatataattaatactgatggatgattgaaatttatagttttcattgcaagaaattctgctttattaaatttcatgcaaaatttaaatcaccaaaaagatcaatcattataattgcatccaatttgaataaacaaaaattataaatttcattttgaaaaaagtaatttacattcaatttaaaataattatgatatatttttgtacaaataatatattatttttataatagatgcggatgttaaaaaattattttactaaatgagacatagatatttataatttctggacctatatttccaatcgagactttatattatttccttgatatgcttaaattcatcaacgaagtagaattataacatacatgcaccattgcagcctacaaatgccaagagtgacgtcactctctccccaattaacatgcaagccgttatgtacttagtcagatcagtcatctcttgaccatcatgatctggctatactgcatgttaattcagcctaggccgataaaaatgccaacagatcacggtttaatctgtctctagcggtaaaatagagtccatgaggctccccttcatattctttcaacgtggcatgagggatcagccttgcagcttcatgggccgtgatgtcggggggaactgtcgcatcagcatcaccgtgaacgatcagcgtcggcatggtaaaatggctcatatctgcccgaaaatcggtggcactgaaggcccttacacagtcgagcgttgctttgggagaggcctgcattgccagaccccagctccattgcagtatgtctgatgtcacctggaaattcagcaagcctgccccgaagaaaatccgcccgaagccagccatgaaactggcccggtctgatcgaattgaattgatcatgtgatcgaaggccgccccatcaaccccttccggatgatcctccgtccgcaacagaaatggcgttactgcagcaatcaacgcagccttgccgatacgagcagcaccgtgccttgataggtaacgcgctacctctccaccgcccattgaaaatccgaccagagccgcatcgtgcagatccagcgcattgatcatatcagcaaggtcatcggccaatgtgttgtaatcatagccagtccagggtttatccgatcgtccaaagccacgccggtcataggcaatggtccggaacccatgctctgcaagaaacacctgctgatattcccacatatcggcattcaggggccaaccatggatcaggatgaccggacgcccctgcccccagtcgttatagaaaagccgtgttccatcgcgcgtctcgacataggccatgctggattttcctctgcttttgctcggcagtcacagactgtcttattctgagaggaaatagcaacgcatcgagaggcaaaaagtaagacagacttcattccccgaaaacgtcatggaaacccgcgcctgttggtgcgttcacatgctatcgcagttgcgccggcttgctggcaggtgtgaccgaacgacaatgcgccacgaaggaggccatttatgcagacagttcattcccttcgcagcctgttaggtgttgccgctctcgcaggaatgatgcttgggggtgcaggccacgcagacgcggccaatgcccgacatccgcgccataatatcgatcgtcaggtcgatcagggcaatgacacgggcgatgaagcaattgaagcgctgaacgcgcagcaattgcagagcattcgtgccaccaacggccctgctctcggcacggcgccggtcggtagtccagcgatgccatatcctacaggtgcgtatccgcctgctacaactggtacttacgcacccccaggcacgccaaactatgcaccgccagtcaccccttatgtgccaccgccgccgggctattaccccgccacaccagcccgttgagttcacctggctgataaaaggcgtttgatgcctgattgtttcgtttcccctcgttccgtagcaattcaggtagtcaaataaaaaacacccccgtcacaggacgggggtgttttcatttagtccgatagaaaagatagaaagaaaagatcagttacgggccttgtcgaccagcttgccctttgcaatccacggcatcatggcgcgcagacgctcaccgacctgctcaatctgatgctcgttattgcgacgacggatggatttgaagctggcgccgttgaccttcatttccagcatgaagtcacgcacgaaacggccgctctggatgtcttccagcacgcgcttcatctcggccttggtttccggcgtcacgatgcgcgggccggtcacgtattcgccatattccgccgtgttgctgatcgagtaattcatgttggcgataccgccttcatagatcagatcaacgatcagtttcacttcatgcaagcactcgaaataagccatttccggagcatagccagcctcgaccagcgtttcgaagccggcgcggatcagctcgaccagaccgccgcacagcacggcctgctcaccgaacaggtctgtttcgcattcttccttgaaggtggtctcgatgataccagcacggccaccaccaacggcagaggcgtaggacagcgcgatttccagcgcattgccggatgcattctgcgccaccgcgaccagacacggcacgccgccacccttctggtactcgccgcgcacggtatgcccagggcctttcggcgcgatcatgaacacgtcgatgtcggagcgcggctcgatcaggttgaaatggatgttcaggccatgtgcgaaagccagcgctgcgcccgggcgcagattggcgtgcagatgctcgcgatacagatcggcctggctctcatccggggtcaggatcatcaccacatcggcccaggcggcagcttcggcgggttccatgaccttcaagccctcgccctcggccttggcaacagcggaagagcccttgcgcaggccgaccaccaaatcctttacgccgctgtcgcgcatgttcagaacatgggcatggccctggctgccatagccaatgaccgcaaccttcttgcccttgatcaggttcagatcggcgtcacgatcgtaatagacgcgcatcggttcactccattctctcggcggccatggttgtcagaaaggccacgtgttgcgggcgggccagactttcccccggaaagccagccagcaattcagtcaggccgttcccgatcaacaggggacggcaggtggttctctagatcgttcccgcgccgcggagaatagccgcaacgccggtacgtgatacttctgccagaccaagcgggcgcatcagttccaggaacgcatccagcttgtccggatcgccagtcatctcgaacacaaagctttccagtgtggcgtcgatgaccttggcgcggaaggcatcggccagacgcagcgcctccacccgattttccccatgcgccacgaccttgatcagcgccagttcgcgggccagatatggcccctgcatggtcagatccatcacacgatggaccggaaccagacggtcgagctgcgccttgatctgctcaatcaccatttcggtgccggaggtcaggatgttaatacggctacggcctgcataaacaccatcatcgctctcgaccgaggccacagtcaggctgtcaatgttgtaaccacggccggagaacaggccgatcacccgtgccagcacgccgctttcattgtcaacgagcacggagatcagtgcggtgcgataggcaccggcatcgtgctgcttctgcgctgcgctaccttcctgagactggttgcgcagcagatccttcataaggaggggcatgttcctggacatttcgatcagaccaacatcatgccttcatcggtgatcccgccgctctgttcattacgggcacggtcgttatgttcagggcccaacagcatttcgttatgtgctgcgccggagggaatcatggggaatacgttttctttctgatcgacgagaatatcggcgatcaccggcctgtccgtggcaagcatttcgtgaataacacggtcgaggtcgtcaatagtcttggcgcgcagcccgacagcatggaagctttccgccagcttcacgaaatccggcagagcagcgctgtagctttcggaataacggccgccatgcagcagatcctgccactggcgcaccatccccatatattcgttgttgaggatgaaaatcttcaccggcaagcgatattgcgccagcgtacccatttcctgaatgttcatcaggatgctggcttcaccggcaacatcgattaccagcgcatcgggatttccgatctgggcacccatcgcggcaggcaagccataccccatggtcccgaggccgcctgaggtcagccagcgattcggcgcatcgaagcggaaatgctgggccgcccacatctgatgctgaccgacttcggtggaaatgaatgtctcacgcccggtttcacgggtgatctcatacagacggcggatggcgtgctgcggcttgatgatcgcaccccgcgtgccagactgggtgtatttcaggctatccaccgcccgccattcgtcgatctgccgccaccactgcgccagaccctccttttcaggctcggtgccgtcttccatccagcccgtcagcagcgcttcaatgatgcggcctgcgtcaccgacgatgggcagatccacccgcacattcttgttgatgctcgacggatcaatatcggcgtgaattttgcgagcgaagggactgaacgcatcaagccgcccggtcacacggtcatcgaaacgcgcaccgatattgatcagcaggtcacagccatgcaccgccatattggcttcgtacacgccatgcatgcccagcataccgatcgagagcggatcattcgccgggaaagcccccagacccatcagcgtggtggtgcaggggaagccggtgcggcgcaccagatcacccagggtctgcgatgcctgcggcccggcattgatcacgccccccccgacatagaagacagggcgcctggcacgtttcatcatcgccacggcctcagcgatgcgggccggatcaggctgcgtcaccgggcgataggaacgatgtggtttctcggatttctcggtgtaggtcgccttgccgatcacgatatctttaggcaggtcgattaccaccgggccgggacggccggagcgggcgacatagaaggcttcatgcacgatgcgcggcagatcggcagaggagcgcaccagataattatgcttcgtcgcggggcgcgtgataccggtggtatcggcctcctgaaacgcatcattgccgatcagatgggtcggcacctgaccggtcaggcacaccagaggaatgctgtccatcagcgcatcgaccagaccggtcaccgcattggtggcaccgggaccggaggtgacgagaaccacacccaccttgcccgtactgcgggcatagccttccgcagcatgcaccgccgcctgctcatgacgcacgaggatatggcggatgtcattctgcttgaacagcgcatcataaatcggcagcaccgcaccgccgggatagccgaaaataacctctacaccctgatccttcagcgcacgaagcagaagctccgcaccgggcagagcctccgtctgggaaggatcggacggcgttgccgccggtatgctttcggacatgttcgactaacccctcggcggaccggcgcacagatacccggtataatcgcgcgaaggctgagaggtaatcgtttcagggtgtccgggtcaatggaaagcacgaataaaattgagcatatcagccatacttctttctgaaagttgctgaaatgacgcaattcgcgcatcaatcgtatacagaaaggggggtttcacgaacggacggttacgaaaccatgtcgcctgccgcttcgtgtagcggatcgtcgcctgagccgcgcgttgcatggcctcaggcagggagatatctccgcgcaggaaagccagaaactccggcaccccatgcgcccgcatcgccggcagagacgggtccagtgcctgaacgcggagggcctctacctcggccagtgccccattgtccagcatcccatgcaaccgtgccgtgatggcctgccgcaattcctctctcggcgggtcgatccggatggcggcgaagtcccagccaggcaaaggtcgagggggttgattctgccaggctgacagacctgattccgtgccacgccagacctcccatgccctggcgatacgctgactgtcctgcggtttcagccgtgctgccgtggctggatccgcctctgccagacgggcgtgcagcgattccggcccaagctccgccagcaagctgcgcgcctcctgccttgcctcttctcccggatcggggatgtcggcgaaaccatgcatcagggcgtgaaaatacaaccccgtcccgccgcacagaatcggcagccggccctgctgccagctttcctccatcgctgttatggcctgatcccgccaccatgccgcactgccaggctgagacgcggggagcacgccatacagacgatgcggtacccttgcctcttcctcttggtccggacgagcggtcagaatccgcaattcgcggtagatctgcatggaatcggcgttaatgaccgtgccgccaagcctctccgccactgccagagcaagggcggatttgccgctacaggtcggaccggccacaaacagagcacgtttttccttcatacccgcttttctgtcatgattgcccggccatgcaaggtgaagctgagatgaactctgaaagcatcgtgatgctcattgcggcacagccgggaagtctgccggatgatctggtggaatcaacgcagcgcgccaccggtgggggcaccctacgtgtcctggcggccggagaagccgtcgaatggtcctctcccctgtcaccggaaacactccgccctttattgccgctccatacattggatgaggcaaggatcgaccatctggtgcaatccgccgccctgccgcgccgtaaacgcctgctggcagccgatatggacagcacgatcgtggtgggagaaacgctcgaccggatcgccgccctgcacgggtgtggcgccgaagtcaccgcgctgagccaagccagtgtagaggggcagattgatttcgcctcatcccttcgccgccgcatccttcttttgcaggggatgacggtagatgccatcggcgacatcattcgcacgatcacgctgaatgaaggggctgatctgctggtccgcaccatgcaggcgcacggagcatatacggttttgatctccggcggcctgatgctttgcacatcacaggcagcctcactggccgggttcgacgcacatcatggcaatgaggtgctgattgaaacgggacgcctcaccgggctgctgcgtgaaccggtgctcgatcccgaccgcaaaagacagatcatgctggatcatgccgcagctttgggcctgaccgccgctgattgccttgcaatcggcgatggggcgaacgatctgccgatgctgcaagcggctggtcttggcatcgcctttcatgcccggccagcggtaacgcaggcaatcccgaaccgcattacccatggcagcctgcgcgctgccctgttcgcgcagggctatgtgctgtgacttacgccgcctgttccagttcttcccccagataaagcgcggcgagtgcgccactgcgacggacatcctccggcgaggcatgcagcgccacgaggccgtgttccagcacatagacatcatgggcgatctccagcgccgcctccgccccctgttcggcgagcagaatggtaaccccttcccggttcaaatcctgcaaacggctgaacacctcatcactgaccgagggggcaaggcccatcgatggctcatccagcagcagcaggcggggcgaggccatcagggcccggccgatcgcagtcatctgctgctccccgcccgatgtcagtccagcggcaacctgccgcttgtcccgcaggcgagggaagatcgtgtagaccagttccagcctgcgtttccattctttccatcccgcacccaccgcatgagcgccagtgcgcagattctcctcgaccgtcagggaggggaagcaatgccgcccctccagcacctgggccaggccggagcgcaccagttgaaacggcgcgcggtcggctatgtccagaccatccagcaggatacgcccccgttcgagcttgccacgctcggcggcgagcaggccgcccgctgctttcaacgccgtgcttttgcccgcaccattggcacccagcagcagcacgacatgccccgcctcgacgctgaaggaaacatccttcagcgcgaggatcgcatcgttatagacgacacgcagatgctctgcctgtaacaactgtgtccggctcataatccccgttcctccttcaggaaggctggtccagcgccttgcagtcacgcggtgtaatgttgtgagtacgggcgtaattgttggctgacttctcaatcagaggccgcagcaaggcgcgatccgcatggatccagtccgtgatcggcgtccatttcgtgccgtcccattgctggaaacgcacagcgccacccccttcatgatcagcgcaggacagtgtgatcggctggatcagccccgttgcacccaattgcgcaatacgggcatcgtcgagcttgagatgctcaagcccccattgcacttcctctcccgtcaacgtgcgatggccgaattttgcctggcccgtgcgaatggcttcaaccgtcagaatgccattgatgatgccaagattgtggtacacgctgccgatacgggattgatcctgaagattaccctttccgcttttgtaaacaatctctctgatttctttcagaacagggaactgatcccctgccggatgtgtcgtcactgcgacatagccttttgctgcatcccctgccggacgcacatcttcctcggaattgctccatacattgccgatgacgtgatcaaccgggtatccggtctgcacggccgtacgcagggccaccggattcatcacaccccacccgcgaagaaccacgaaatcaggcttcagccgctgaatctgcaaccactgggattgctgctcactgcccggatcaggaacctcgatctctgttacgctgaatccgaatttctttgccagcaaagcaaaaatcggaatcgtctccttgccgtaaggggagccgtgatacagcaccgcgatcttcgcgcccttcaacttgtcggccccacccagacgctgaccgatatagttgacgatcgcggaggtctcgctccacggattcagctgcaacggaaagacataaggaaacaccgcaccatcagtcgtgtcggtacgaccatgattgagcgtcaacatcggcaccttgtccttcgccacacgctccagcatcgcataggcgataccgacactcatcggattccagaccgtcggcgggggtcgatgatttttcaaacgctcgtagcactcaacgcctttttccacgatgtatccggtttcgcattcgctccaggtcagttttacaccgttcaccccaccatcacgctcattgatcagcgtcagatagtcgatatagccaccagccccgccagtgccgcccgccgcataaggcccgacgcgataggtttgcagcgggaaatactgctcatcggcccatgcgggaaaggaggacgccaaaccagtccccagcgccaatatggcaacagcagagcgtacaaaagaacttttcttcatgacactatttcctgagagagagattttgaaaggctgagcttgcgcgtagcctggcgtgggcgcagcagggcggacaagccgtccggctcacggatcagaatcagaacgatcaggccgccaatcagcattttttcgatattggcgagttgaccggaatcaatgaccccaccgccgatataatctgccagacgtgagagcagcagcggcattgccaccatgaaagccgtgccgaaaaatgctccgacaaaagaacctgcgccaccgataatgacgatgaacaggatgcggaaagacaggttgaggtcgaacccggctggctcaacagtacgcagataagcaaaagcccataacacaccagctacaccgcagaaaaaggagctaacggcgaaggctgtcagcttggtacgaagaacgggaacacccactacagtggccgcggtttccatatctcgcacggcaatccagtcacgtccggcctttgtgcgggacagacgcagcagcaccgctgtcagcaccacgactactacagcagcaaaaccagcccgtgccacgggcgtatcgaatacaaacgatccgatcttcaacaccggtgcactcagcacaccggacggatcatccagcgaaaaccagccgatattggtcagcaaccatggcaccagaaactgcgcagccaatgtggtgacagccagatagaaaccacgcaggcgcagactgggaagtcccacgaccagaccagaagccgccgccaccagaccaccgaacagcaaactgaccagttgcggcgtacccggcacataggcatccagatcataggccgcgaaggcgccgatggccataaatgccccggttcccagcgataactgcccggctcgccccgtcaccactgtcagccccagcgcagcgatggagagcgacaggaacggcaggatcaccgcatcacagatatatgagagcattgtctgcttttccctgtcttacacacgctgcgtcgcaccgccgccgaacagcccgttcggacggatcagcagaaccaccagcgccagcacataggcaaaccagctttcgataccgttccccagcacatcgccgagatagacctgcgccaacttctccgcggcaccgatcagcaggccacctgcaatagcccccggaatggagccgaacccgcccagcaccagtaccggcagcgccctcagcaccaccagcgacaacgagaactgaaccccgaggcgtgcgccccacagcaacccggccaccagtgcgacaccaccggccaccgcccagaccagcgcccagatgcgtgtcaggcgcaggccgattgccagtgccgcacgctgatcatccgcgacggcgcggaatgccagaccggctggcgtgtactggaaaaacagggccagcaccgtgaccagcacaccggccacagccgccgccacaagatcgagcctgctgaccagcacccctccaagggaaaccgggctatccgaaatccccagcgataacgcgtgtacatcagaaccccagacaagctgggaagcaccttcgatgaaatagctgacgcccagagtcgccatgaacaacacgatggaaggacgcccgatcaacggcctcagcacgaagcgttcaatggcgctgcccaacaggatcaaggccagcagtgtcaccagcacagccagccagaccggcaggccacgctcgaccaggctgacataggtgagcgccgcaaacagcagcatgctgccctgcgcgaagttcagcacgcccgatgccttgtagatcagcacaaaccccagcgcgaccaatgcatacatcacgccggaaagcagaccgcccgtaagaaccgccagaaaaaagctcatatcgccctctcctgttggattgcctcatggctgcgctgccccaaataggcagccagcacagccggatcggcacggatctcggcaggcgtgccgtccgcgatcagccgcccgtaatccaagaccacagcccgatccgcgaaactcagcaccagcccgatatcatgttcgatcaacagaatagcaccgccacgctcctgatgcgcatgacggatcagggcagcgagttcatgccggtcctgtgcttccatccccgcaaacggttcatcaagcagcagcagacgcggacgggccaccagggcgcgggccagttctacccgcttacgcagcccataaggcagggaggccgcggggcgatccgcgatctcccacaggccaagctggcgcagggtgatatcggtttcctcccggccacggtcgcggatacgccgtgcatgaggcagattgaaaaactccgccagaacagaggccggtttcacatcgggccgcgtcactccacgcaaaccgagcaacacgttttcccgcacgctcagcgcgccgaacagggccagattctggaaagtgcgcgccacgccctgcgctgccagacgctccggccgcatgcgccggtatggcacgccatcatagcggatcataccatgatcaggctgatacaacccgctgatgatgttgatcagcgagcttttacccgcaccatttggtccgataatggcccggatttcctgtcgcccgaccgtgaaggacagatcggacaacaccaccgcccggccaaagctcaggccaataccttccagcgacagaatgggatgattctgttcgcacgtgctcatagcggcttcagccccagtatagcgccgaccggaacgatcagggcagcaccgacataccacccatcccgcgggcgtcgggccgaataaggattataatagctgtcaggattgagcacatattgcaccaccggctccagcgcgatggccgaaaacacttgtacatgagcgttgatttcgaaaatcgccttatcacgagaaaaaccggctcctgatccgccagcctccgcatttgcctccgccagatagcgggcaaagctgccgttcatccgcacccagcgcaacttgacgccaaaacggtcataaggccgtgatgcgaaaggtgcgtgcagattggcacccacaaacaaatcggactgaaaaggtactgttgaatcaaaggaatatcccaatccactgtacagcgaaatcgctgcaggattggattttgaaggacgcaggctgtcagcatccggatgtccaccatccgcacgccacacaacctgttcggtgttgatgacaattccctgcgtgccatgctgattacgcaccggatcgcccggattgagcccccgagaccgtccataagcagtcgtgtcattatccggatgagaactggaattataaaaaccggtcagagaatatcgaccgggatataattgcgtctcatatccggtcttgtggccgatctcgaccaatgtcagcgcacccggattaggctcctgcccccaatcccagccgctatgggcattggcatccggatgggccgcaaatgatcctgcctcgatataagtggtgggtgtcagtgcataactgacgcgaccaccccacattgaataaagcggcgagatatacccggcattgtgatagagaatattgttgtagcagctgttcagtgtctgacaggtcggcaaggcaaagaagcggttcggatgcgtacgccccagctcgatgttcagacggtcattgaaaaacgtctgctcataagtcagtgtcgataactgttcagaacgcaggttataggtggtctgatatcctgtgctactatctgaaaactgctttgtggcctctatattattcgcacggaggccaaaaaatgtttcctcgaaatgcagccttgcatggtggatgcccagaattttgtcgaggtcgaaatccgcacctgtcagcaggtaagtagaattgaccgtattgccggtatcctgaccaacactcgggttggagctgaagaaatcgaacagggagacgtggaaggaaataccacgcttcagcagagtgcgggccagcggtcccagcggaccttcatcattcctgatctctttggtctggatcggcttgatcagacccggcaccacacgtgggttgggagcatcagagatggcggaaccgggtaatctggtggtcccggagctttgcgccatggcgggtccggccatcaatacacacccaagagcgaccggtggcagcgttacggcaaggcgggagctggcgcgtacgcgatcacgtacccgttggaatgacatggggatacacactttttcagaaagataaggatcggatagctgatcacacgccgaagcgtgaaaattacatcctacacaggttgttcattgtaaaattaaccattcatatctgtgatatttattttgttaaatcaacgaagaatttacgtcaatactgatttataaaattttcgtaaaaatattatataacgaataaaaatagtgctttatccgcaaaaaaaaccggctggcgataaccagccggctccataaccttcctgtaccctctcccccgcagggcacaggcaatcccgcgctcagctgagcggcagcggtacccagcgaagaccgtcctgtccctgaatcaacagaagaacggatttacggccctgtttacgcacggcttccagacgctgggtgatatccttcggtgcagccaccggttcctgctgcacctcgacaatgatatcgcccggtttcaggccccgttgctccgctgccgaaccggaagcaatgttggcgatcaccacgcccttctgatcaccctgcagattgaaatgctcccgcacctccggcgacagggccgcaaccgtcacgccgagttccctgataacaagctgggcgctgtcatgactgccgggtttggccttttccgcggcagcctgtttgacatcatccggcatttcaccgacgcgggcatccagcgtgacccgcttgccgccgcgccataccaccaccggcacggtctcgtcgatcggggtttccgccacaatacgtggcaaggaatgcatatcctttacatcctgattgttgaatttcaggatgatgtcgccgttctgaagatgggccttgtccgctggaccgccctcatttacgcccgcaatcatggcgccgttggtttccttcagcccgagactttcagcaatttccggcgtgacctgctgaatccgcacccccagccacccacgccgggcacgaccgaatttgcggatctgatccaccacgttttgtgccagcttcgagggaatagcaaagccgataccaatggaaccgccggagggcgaataaatggcggtgttaatgccgatcacctgcccatccatgttgaacagcggaccaccggaattgccgcgattgatggcggcgtccgtctggatgaaatcatcatacggcccctgatggatatcgcgcccgcgcgccgaaacgataccagcggtgacggatccccccagaccaaacgggttaccgatcgccagcacccagtcccccacgcgctccttgtcgctatcgccgaactgtacggcggtcagcggcttgtccttgggcgacgtcacctgcaagacagcaatgtcgagccgttcatcccggcccagcactttcgctttgagcggggtattgtcctgaaggatgacggtgatttcgtccgccccgtcgatcacatgattattcgtgacgacgattccctccttcgcatcgacgatgaaaccggaaccgaggctttgcgcccggcgcggtgctccttcttctccaccatgtggctggccgggaaggggatggcgattcataaagtcgcggaagaatttctcgaacggggatcccggggggaattgcggcatatctggtcccgggccttccggcccacgggcaatggtcgtggtggaggaaatattgaccacccccggaagcagcttttcagccagatcggcaaagctggcgggtgcttcgcgcgcctgtgcatccatggcgggataaagcggcaaaccgcccggaaccagccctgttgccagcgggatcatcgccgccagagccagccctgcccgcaggcaacggctccggcgctgcaatgccttgtcggctggatgcgattcggtctgtaggggggtaggataagtcatggaccagataatcctccggtagactgttcaggcgccagatacgccgtcattcaaagacctgttggtgccaattctgcgcgtggcgccaaagacgggcaagggtcacgaagacaggaaactgttctccgagcttcccactcataagtagtaccttctgctgcaagttgcagaaaacaggtcttgccagaaacaaagggagcaaggcagaaaaatggcttatgcctcccttgccaccctacttgtgcaatcttgctcttgcgaagggcggctgccacgcctatcccgcggcaacgccccggaaacagcctgagcgcaaaggcctgagcgcaaaggaacatcaattatgaacgataccccctccccccacggaacgccgccggacgcgcaattgagggaggtgctgcgtgcagtcaccgatcctgcaaccgggaaagatattgtcagcgccgggttgatcgacagtatccaaagccgtgacgggttggtacaggtggccctgcgtgccacgcgggagcgggcggcagagatggaaaccgtgcgcaaggctgctgaaaccgtgctgtcacgccagcccggtattcgcaatgccaccgtggtactgaccgcgcatcacgacgtcccgcccaccaccgcacaggcagcgcacggccatggtcccggccatggtcagggcgcccaaccccgaccacgactgctgacagaggttggagccgtcatcgcggtagcgtccggcaaaggcggggtcggcaaatccactgtcgcggttaatctcgccgtggctctggcacaaatgggactgaaggccgggctgctggatgccgatattcacgggccgagcctgcccctgctgcttggggaaacccgcaagccggaagcccgggatggcaggctgatcccgatcgagacatggggcctgaaggccatgtcgatcggttttctggttgatcagaacgaggcaatgatctggcgtggcccgatggtcatgggcgcattggaacagatgatgggacaggtcgcgtggggtgatctggatgtgctgatcgtcgatatgccccccggtaccggcgatgcgcagctcaccatggcgcagcgtgtagcgctggcgggggcggtcatcgtctccacaccgcaggatctggcgctggcagatgcgcggcggggggttgccatgttcggcaaaactcatgtgccggtgctggggatcgtggaaaatatgagctatttctgctgccccaattgcggccatcgcagcgaagttttctctcatggcggggtgaaggaagaagcagaacggctggggaccgattttctcggtgaaattcccctgctgctcgatatccgtgcagcggcggattccggaacgcctgtggttgccgcagcaccggccagtcaggctgcgcaggctttctccgagcttgcccggagaatctgggcaaaaatcccttcgaaacggcagagtggccctaaaatcgttgttcaataagcaggtacggcaggaagagttttttacaggccctgcccacctcgctgctgaccaccgtgctgcccgctggcaggacgccgcaacagaatatccatcaatccggcacggagatttgcagcgattctgacatccgttgcggtccagacgaggctttgatcttcaaccgtctccgtccatgcggcaaagctgctgcgcggagacagggtgccgtcctcaccctgtaatttgccgccatgtggattaccggcccatgtaaccgtgctgatggtttcctgccggaaaaacaacagataatcagacccttcaggagaaagcgggacggccagcacaccgggcggaaagtgtggatattgcgcaagcgcgggaaacactgtccttatccgcgcagaggcataaagctcgccacgccgtgcatgatccagcaaaccgaccagcgtcatgatcgcagcctctgaaggaaccagttgatacgctgatacagcgccgctcagcacgactgccacaccgtcacacgaaaccatatcggctatcgcggccagatggtgccgcaatccgcctccaccctgctcccgcagtgcaggcaacaaatcttccagcaagtcgcgcagacgctcatcacgctcctgctggatttccccctcccggctgtccagcagcagggaaaacatctggccaaacatctccatgaccgcccggcggtctgcggcaagccagagcggacgcatggcatgacaggcaatcagcccccataactgcccgctgcgcaggatcgagatcgaggcagaagccaccacgcccatattacgcagatactgcacatgcaccggcgacacggcccgcaaagtggaaagggacatatccagcggttccgtctgctccggcagagacagaagggggcaggtttggtcctctgtatcaccaatcagacggagccaactgcgctcgtacagcgtcctcgcctgatgcggaatgtcggtggccggataatgcagaccgagacaggattctgtgccggaacgcagactttccgccacgacctcccccgatccatcctcggcgaaacgataaatcatgacacgatcataaccggtcagggcacgaatctgccgcgtggcttcctgaaaaaggggggctatgccccggctctgctgtaaccgtccgaacatcatcctgacggtgctggaaacatcactcccgccgctcttgccgcataccgatggctcggcctcgatcacataagtatcggccatgatatggatggaaaaatcataaagcgcggactctgcatcatggtggagcttcaaaccaaacagacgctccgtcattgcggcactgcccagcatctgcacggcaccccgcagtgcatgaaccgtttccggtggcaacaacgtgatcagggaggcgcccaacaccttggaagccgatgccggaacatagtcggcaatgttcgcggacacatgcgtcacgttccatagacgtgagaccgcgatcagaaaaccatgaggctgtatggcaccgggcatgtggatcggttcacgatcacactcggtcaggggaagcatctcttgtcgcagaggcatctggggataaccgttcttgaaggtagccgccaagccgtattatttttttaatgtatacaggcttcacttgcttctggctatcgcatcatgatgaacagttagtgagccgggaacttatttctttaggcgcaatataaaaaaggctccggcacgtatgccggacccttggtggtcatgactgacttggaattagaaacggtattccagcgtactcagccagaaaaatccatctttggcaccgaccttgcgcatgccgtccgacaggaacatatgggcgaaatcgttggtgaatgtcagatgctggtcaatccgcagcgccacggaaagctggggattgaaaccgatgaacccaccctgcaaattgccgcgcggcggatagatgcggttggtgccatagaccgtatcatccgtgttggcgcgccagttgagcggaaggcgcgcacggatggcaacggcgctgtgcggcacccaaagcaggttcggccccacggaaatcaggttacccggcgccagataggtggatgagtccagatagctcgtcgatggaccaaaaggcgcgatatacgtgccgatactaccggttttatcgttataattacccccagagtaatagtcggcctgtatcccgagggaaggcgtaccatacactttgctgaaccgccatgcgatgacgttattcagggcaaaagcctcaacgggacgggtggtgccacttcctttgggccggaactcgccaccctgataggtaccaccaaggctgaattctatcggaccagccttaccccagaaccgcacgccgacattgtcgcgatgggtcgtaccggcagcagtgccgcccaccttggcattggcgatcgaggcactggagccattcaccagatagcccatgtagtacagatcggcgaagatctgactggatttgccgaggaatttaaagctgggcagggcgtagctgccatacgcaccccacagccggttcccccaggattcacggaatttgaatgctccggagcggctttcatcaacggagacgaagtcgaacacgtcgacgcggaagcgtgaccacacattataggcccgcacaccttcccaactctgcgggatattcgggttgccgcgatcgaaaatcatatagttcggcacgtccagaaactgctgccggccgacaatgataccaccctgaccgcccagaaccttacccttcacttcggcaaaaaggttcagaaagtccatattggtgcgctgggtgcccccatagccaaaataattatgcccccatgcctggccactgatgacatcggtataaatgcgcaaatgatctcccagatgcacatcggcaccatactggctgcgcaacagcagacgatcagagcttttcttcgactgatatccaaaaaacggtgcctggtcgaagaaattacgcagacgttcgctgccgttgaacgtaacgtagatggagccgctatcattcagtttgacgaattttagcggatcgaagaaatccctgcgcagggacggattacgcagatagctccagtcctccgcccagcgaacctgaccatagcgagccacggggccgaaaccggcagccaccccggcctcggcattgaatacgccccatggcccctgatgcacggtggggatctggcccggcttgttcttctgcagcttcaccagttcaggatcagccgagatgtccggcgcactgccgagggttgaggaaacgcggtttcctgttgtctgctgatcagccgcccatccttgcacagggcacaatgacgatgccacgctgagaccagccaccgacaacaatccaggcacagacatccggggcagacggctgacgccgcgcgtcctgaagaccttcgacatgacaaagtaattcctgttttaccgcccggcggccgtgattggtcactgccgccgcttagggaaacttcaataaagcccgatccagaccgtcaggtctcacgcatagtttgtttctatggcgcaacagattatcgcgacataaaatttcaacaactggcttgctcaaccatatgagtgaactgaacctgacggcgagatgtcatattttttattcaaattatgtcaatctcattccatattcacatcaaaatacgatccaaatagttgcaataaagtcacaaataacaatttatgatcgtattttataaagggtgtttttgttcagcacgagaccgaaataattgacttgcttcgaataattctcattggcgaaaagattaaaaatgattaaagcggccctatgaaaaacaaggtgccctttcctaccctgcaccacaggcatttccacagtatgatgctgtggcaggccatgccaggctggtgcttattctggcagcgaggacattgatgctgtgtagggccagaggcaagcgggcagaaaaccgtttttcctgtcttgctgccctggtcattctcattcagcttgtcttacctgtctgggtagcctggccttccatccatccctacgcatgggcactccatgcggccagacatgacaccttcacgccacagagccccctttgcacgcatcgaagtgcagacaccacgcatggtgtttcaaaaataccttcggacacgagggaaatccctaccggccataagcttgctgatccggattccctccccgatatacccgccggggattgccacggccatgacggctgtccgatctgccgccttgccgtcatgcctgtcctttttcctgcagcggaaatcaggctggccgcattcagccacacatactctgtccgcctcgtgtggcctgtatcagatgatacgctgtcaacacatgttctgcttctggcccgcgcacgggcgcctcctttttccgcatcgtgattctcctttcatccggcggatacaggcaatcgcctgatccgccttgttgtcacggcttcctgcggcatgaaccgcgtgactggccagagcgccatcatgctgatgcagccgccttttgagcgaaaaccacgatgtcatccctctttcgtcccattcctcgcgatcgtcagccggttgcatggcacatgcgacttccatccctgtccttgctctggattgccgccatgcccggcctggccgtcgcccagcaattggaagcagagagtcctgaacttccgaccctgtccgtatccggccaagggggaaaacaggtccataccacgccctcgcaggactttctgatcccggtgacacgcagcgccaccagaaccgatacacccgtccgcgatgtgccgcagtccgtgaccgtggtgccagatcaggtcatgaaagaccttgccgcaacccgcgtcgataccgcgctgcgctatggtggcggctttgatgtcggcaatacgtttggtggattgtcgctcgataattacgtggtgcgcggttttgcgacctccgaatattaccgcaacggctttgctgccggggcgcgtggttatcagccgatgccggacgcatccactatccagaatgtcgatctgctgcgtggtccggcagccctggtgttcggtcgtggcgatccgggtggcactttcaatatcgaaaccaaacagccgcttgatcaatccgccgtcagcgtcaacagcatattcggcggctacgccctcgcacgcggcagcgtcgatgcgaccggagcgctgaacgccgatcacacgttgctgtatcgcctgaatgttgccggcgaacgcagcggcagtttccgcaacacggttcacagcaaccgccaggttgtctcccctgtgctcagctggcgtgcttcccccaacaccaccgtcacgctggaaacccagttgatgcaggcagatgcgacgtttgatcgtggcgtcgtgcccatcaataaccagcttggcccggtacccatctccaccttcctcggtgaaccggatgacaagctgatccgcaacaaaagcgctgttatccagttaagggtggatcatcaattcaatcagaactggagcctgcgtggcggggttcaggtcatggacggtgccctcaccggttttgcgaccgagggggcaagcctgcccgccaactccgtgttgatgtcccgctcccgccggtatcgtgactatcattggaacgatctgatcgcccaaacctacgccaccggccatctcgccaccggaagagtgcggcatacgctgctgctgggagccgaattcgaacgctataccgagcgcgaattgttcatgagctccaacgccaagcagtttccggatctcatcaacgtgctcaatccggtttataccggcctgacacccccgctcggcatcacgaacgatacgcaggagttgagttatagcggcgcgctggtggcgcaggatcagatggatctcacccggcggctcaaattcctgctcgggctgcggctgaattatttcaatcagcagatcgtgttgcagaacaggaacaccaccaccagccagtcggatctggtgccgacaccgcgtgccggactggtttacgaagtttccaatgccgcatcggtctatgcgagtgttgctcaatccttcaagccgaatagcggcgtcagtgcttccggcacggccttcgcgccggaacagggaacggcttatgaggttggcaccaagctcgatctgatcgacaaccggctgagcattcaggcggccctgtttaccatcgacaaaagcaatgtgctgacggtcgatcccaccaacgccaatttcaatatcgctgccggcgaggcacgcagccggggcttcgacgttgccatcgccggatcgcccgcccccggctggcaggtcattggcggctatgccttcaccgatgccatggtgaccaaggatgcacagcttgcctacggcaccccgctgatcaatgtgccacggcataccctgtccctgctgaatgtctatgaagtccagaccggcccgctgaaaggtcttggggtcggggccggggtgatttatcgcagcaaccgggctgccaccagcaatgatggcggcatcattctgccctcctatgtcacgctggatgcgctggcctactacaagctgacgcaacatgtgcagctggcagtgaatgcaaccaatctgacggatgctacctactatgccaatagtctcggggccttgcgcatcatgcccggctctccacgtaccgtgttcggcaatattaccttcaacttctgacctcgcctgaccggaaaagcgccggagcaacagaaaactgcatgctccggcacttaatccacacgctaatcgttctgattttacgattaaaatgaacacattaaactgttagtcagattgatctgatctctgtatcttttcagcgggagatcggatcatgacgctggaacagttacgtatcttcatcggcgttgccgaacgtgagcatgtcacacgggcagccgaggccctgaatgtcacgcaatccgcagcctccggcgccattgccgcgctggaggcgcgctatggcgtcgcactgtttcatcgcatcggacgtgggatcaccctcaccgaagccggtcgcgcctttctggacgaagcccgtctcgtcatgcggcaggcggctcatgcggaaaaaatactggccgagttcaccggcatggcacgtggcacgctgagcatcgtcgccagccagacgattgccagttactggctgccagcccgccttgccgctttccgcacgctttatccgcagatcgagcttgaactggggattgataataccgaaggcgttgccgcccggcttctcgacggttccgccgatctcgggtttatcgagggcatgatcgacgaagctgcactggcccgatgggtggtggcgaccgatccaatggtgctggtcagccacgagaacgccggtcctgtcgatacgcagtggttgcgcaccgcgcgctggatcatgcgggaacaggggtctggtacgcgatcaacctgcgacgggatcataaacgctcatgggattgatccggccagcctcaccattgccatgacactcccatcgaacgaggccgtgcgcagtgcggtcgaagccggggccggcgtggccatgctgtccaggttggtggtggagcgcgccctgacagggggtaatctcatcgaactaccgcttgttttgcccgaccgctcgtttcatgcgctgcgccacaaggaacgctctcgcagccgcgccgccgatgccttcaccgatctgatcaggggactgaaatcatgagcaccttacaggctgtcatttcaggtctcagacctttcagccgcctcgatcacccgagggaaatcatcaggcagtttacccccaactggtttgccgcgaccatgggcaccggtattctggcgctcaccctgccgcaggtgccgggcatcggcccgacgctgaaacccgttggtgaggcattgtggttcctcaacatcgcgctgttcatgctgttcaccctgctctacgccgcacgctgggtactgttcgggcatgaagcacgccgcattttcggtcataacacagtctcgatgtttatcggcaccatcccgatgggactggccacaatcatcaatggctgtgtggcgttcggtatggatcgcttcggccccggcatcatagccgtggccgagatgatgtggtggatcgatgttgccatgtcgctcgcctgcggtgtggccatcccttatctgatgttcacgcgccatgagcacagtctggatggcatgacggcggtctggctgctgcctgtcgtggccgcggaagtcgcgggcgccagcggtggtctacttgccccccatctggcggacagcgcgaatcagttcaccatgctggttacatcctgcgtgctgtgggcctgttcggtgccagtcgcgttcagcatcctgaccctgctggtgctgagaatggcgctgcacaaactgccgcatgacagtatggcggcctcctcctggctggctttggggccaatcggcaccggcgcgctcggaatgctgctgatcggtgcggatgcgcccgctattctggcacagcatcatatggccgccaccggtgtgacagtgcaggggctgggtatcatggcggccctgctgctctgggggttcgggctatggtggatgatgttggcgaccctgatcaccatccgttactggcgcgccggggtgccgttcaatctcggctggtgggggtatactttcccgctcggtgtctacacggtggcgacattccggcttggcgtcatgcttgatgccgggttcttcagcctgatcggcgccttcctggccgccattctcacggcaatgtggctgctggtcagcgcccgaactctcctcggggcatggcaaggcaccctgttcgtctccccctgcatcgcgtcagggaagtgatgcccagcctgaaggctacaccgccccgaccaacccgcgtgcaaactccatcgcgtcgaaaggacgcagatcgcccgctttctcccccacacccaccgcatgcaccggcagaccgaaatcctctgccagtgctacgacgatgccgccacgcgcgctgccatccagcttggtgacgatcaggccggtgatgttcaccatgtccttgaacacccgcacctgctccaccgcgttctggccagtggtggcatccagcaccagcaggatcgaatgagggacggtttcatcgtgcttgcgcatgacgcggatgatcttgctcagctcctccatcagcgcgcctttgttgtgcaggcggcccgccgtgtcgatcagcagaatatccgcctgctccgcctgcgccttggccagcgcatcaaaggccagcccagccgcatccgcaccggcggggccggagatcaccggcgcaccgacacgctcaccccagacctgcaactgctccaccgctgccgcacgaaacgtgtcacccgccaccagaatggagcgtagcccctgatctttccagctctgtgccagcttgccgatcgtcgtggttttgccggtgccgttcacgcccaccatcaggataacatgcggtttacgcgtcagatcaggctccagcggaatagccaccggatgcaggatccgggcaatctcctcggccagggcagtcttgatctcctcctccgtcacttcccggccaaagcgggtacggcggaaagcctcgatcacacgcgccgcaaccgaggtaccgagatcggcagcaatcagagcttcctccagctcctccagcgccgcatcgtccagccggcggtggctgatcaccgaggtcagattggtggtcagcttctgcgtgctgcgtgcaagcccttccttgagcttgctgaaaaaaccgagcgccattcaggctgtctccacttcatcggccaccagaccacgctggtcggccccaaccaccatggcttttatcagacgccccggctccgtcgggcgggacaggcgggtcgggatgaaatgctcgctatgccccgcctgctccgtctccgtcagcaggctgatggtccggccgagctgaacggtgaaaaacggctctgcctgccgggctgcttcctcccgcaatctggctgcacgcgcgcgccgctccgccacccggatcgcaggcatgcgggccgcaggtgtgcctgggcgctcgctgtagggaaaaacatgcaggaaaggcagctgcgcctccctcacgaaagccagcgtttcctcgaacaatgcctctgtttcagtcggaaacccggcgatgacatcggcaccgatagcaatgccgggccggagacggcgcgcccgcgccacggtctccagtgctccagcacgggaatgacgtcgcttcatacgcttcaggatcatgtcggagccagcctgaaggctgagatgcaaatgcggcatcagacgtggttcctcggcaatcaagtgccacagatcctcgtcgatctcctccgggtccagcgaggagagccgcagcctcggcagctccggtaccagcgccagcaggcggcgcatcatctgccccagccccggcgcgcccggaagatccgggccgtaactggtaatgtccacgccggtcagcacgacttcctgatagccgcgctggaccaaaagacgcacctgatcgacaatggcaccgatcggcacggaacggctggggccacggccaaacgggataatacaaaaagtgcagcgatggtcacacccttgctgcacctgcacgaaagcccgcgcccggcctgcgaattccgtcaccagatgcgcggctgtctccttggcctgcatgatgtcggagatggcagaaggcgcatccggtgcccagctttccggcttcagcttgtcctcattccccaacacccttgtaacaccgggcagagcggcccagcgtgccggatcgagctgtgcagcgcagccggtgaccacaatctgcgcctcgggacgttcacgatgcgcccggcggatagcctgtctcgcctgacgctccgcctctccggttacggcacaggtattgacgatgatcgtatcgctgagagccgccgcatgcccccgcatgacctcgctctcatagctgttgaggcgacagccgaaggtcaggatattgacccccgccgcctcagacgccgacacggggggcggaggaatatcctgtatcacttcgtcagcatcatggctcatcccgtgatgctttccagcgcaatgcggccatgaaacactgtcgcggccggcccagtcatcagcacgtgtccatcctgttcccgccagtggatcagcaattgaccgccatccagttccaccacagcctcccgctccgccagaccacgccggaccgcattcaccagcgtagcgcaggctccggtgccgcatgccagagtcagcccggcaccgcgttcccatacccgcaaccggatatgagagcgggacagcatttgcgcatggccgatattcgcccgctccggaaacaatggatgacgttccagcagtgggccggtcaccggaatatccaattcagccagatcggctacaaagaaggtcgcatggggattccccatggaacaggcagccggcatcttcaaaccaggcgcttccagcggcaggaacagcgtatccatctcccgcgccaatggcacatcgcgccagcccagccctggctgccccatgtcgatgcaaatgccattgccattgatctccgccagcagcaggccggcaacggtttccatgcagggcgcggcgatgccatcccgatgcagcaaatccgccacgcagcgcgtggcgttgccgcaagcaccggactcactgccatccggattataaatccgcataaaggcatccgcgaccgtggatggctccagcacgatcaactggtcacagcccaccccggtacggcgatcagcgatcgctgccgcctgggagccggacagagcaaggctcggccccttccgtgcatcgaagacgacgaaatcattcccaagcccgtgcatcttgatgaaatcgatcaacatgccgtccttatatgggccatgctgtgggtgggatagagatttttataacagaaaaaatctggttttctggttgggtagcgcggcaatgggatctgccatcagacgactctgatcagactcttctgatcaagcattgtcatttatccgcaaaaacattattttgagcgttatcgtgtcggttctctgtggtaaatttcgatcatgctttgaagtaaaataagtcttgcagtactggtaatattaacagatttttagattaaggccacagatgaagaccgcagtcgctgctatttttaaaaatgaagagcacgatatattatcatggattgcatggtatattaatgtgggatttgatacacttattttgttcaatgattcttctacagatcgatcaagatctatcttgagcgagtgcgctctgcggtatgatataagaattattgatgtccctccaaccgatgaatatcatatttatcggcaaaaaaactgctatattgaaacacttaatatttataaagatgaatttgactggattggtttttttgatttagatgaatatttatttttgaatgaaaatgaaactcttcatcattttcttgacagaccagaggatgtaggcgcactagctattcattggtgctgctatggacccaacaattatctcttcaagccaaaaacgcatccttttgtagcttttgataagcattttcccgcctcccagcctatcaacaggcatgtcaaaacacttctgagacccaaagcctggactgggaaatgggacaatgttcattattttgaggttgctccatatcgttatgttaatgcctgcggcaaggaaatctcgtgggctgatcctcgcggaattaccagcacagaggcagattttacgcgggcaaaaattctgcattttcagtgcagaagccttgaacagttccttgcccggttaaaaaaacgccccgatgttccgcagacaatcacgccttggctcggagcacaggaaatggcaaccgtttatgatccacatcccgggcaactccaatcccggattgaggggatcatttatgagatccagatggcagtcgtaaaagcccggatggcagacattatcaacagctttccacatcatagcccccttgaaaaagcaattttcaagtataatttatcatctcccgtctccatatttgcaattaatcagcaaaaaaaagcagagaacaaaattgattttttttcaattaagacgtttgaaggctacgatttaggttatgatacaatcaatcgctgctttaggaatggccctatcggcgaaaatattcttcctgttatcggtgcaatttttgcggagcaccccttcatggtccatcttattgtaccaggggctaaagaagcgcttcttcagatcaatggcgatcccagaaagagcaaatgcctgcgctacgaaagagtcaatgtaaaagatcacgaaggtattttctacttgcgtcatccagacagcaagtttttcatatgttgtgaacccccatatcatggcggaaaagtgacgtgctcacgcactgaacccaaatcatgggaagaattttctttacttcctcttgaagaccataaagcacctcggaatatcgagcacagttttgttcaaatgctccagaatccaaatctcctcagtaatgaaagcgacataatttcaatatgctatcaattattaataacgaaatatggtcttgataaaatgcagaatttttcacttccttattcaacataaacaatttacagatattatttgcattattaatttatgatataacttattttttattttttaaaaacacaactgatagaaatactattaataaaatatatttctttaaagcgatgctgtaagatattatagcatcgctttaggtcattaattaaatatgaccttgccggatcatcaatactattggcctaaaaactgatcagaaatgattagggcattcttttaaggcccatatactgtcctattcttgcataatgatcgcgctctgatttgatacgaccgcatgacatgtccagcccgacctgatggtaagttctggtgtaaaaaccgcgttccagtttaaaggccgcccggttatcaaaaaagccattgttcatatagtcattataaatacctatattcccaaacaaatcaaaaacggatgatttttcaggataatattcaatatattcctcaatattcagacttctaatataatcattgatatacatctctccgtcgggtacaatttcccgcagcttatcaggctccatcggctgccaagttgtacgaacaggatcaagatagtcacgatactggtcgacatgagttccgtaataaacagggaacatatagaatttataccttggatcatccaaaggcagcagcatactggtcgtatgctgcatcgggttcaggacacctgcgatcgggaaatgaatggtagtggcattggacatccacgctgccatccatgagaaggtgctgatacaaaggacgatatgttttgatttcctcaaaaaatcaaagtcctctcttactccgcgagactgtatgaatgttgcgtgagggaaaaaggaccgcaattcggtcatatagggggattcatcaagctgcccatagaaaatcggctttttcccggttttagcaaccaagtaataataatattccggcggaagaagcgtgtaatcctgatggataccgcggagaatttcaccaccacggatattgatgaccagttcatcatcgcctcccccatcaccgttaggaatagcggagaaaaactgttcgtaatcaagctcttctctggtcgggaagttttttacatgctgacaatatccctccagtgagataaatttggcatccgaatgacggaccgcatgcgccagaccgggagccggcacatagccggcctgacgaccatttgcataggctgtattatgcagtccccatcctgccagtcgtatatctggcagatcgatcccgaatattgggatcttgacattagtaatgtcgccataccccaagtgtttcctgatcttgagcgcactcaagtacatcataaggatgttaccaggatttccttgagcccatattttaattaaaaagttcatttttaccgaaattagtagtaattgctccacaaatagtatagtgaaaatttcaaattgccaataaacaaaattgaactcactctgatttggtcccaaaaaaatacttttatctgccaatgtcctgaatcatattactagcactcacaaacgttaagtttgcctctatcgccatgcagaggccacatcgttttccacttgccatctccactccggcacgctaagtccccgccctgttcgcgcgcctgggcctgtatgggcatgcccggccgcagcaacccgtggctcctcctgatccaagggtcagccgacgggctggataacatgaaggagaatcaaatgcccaagctgaagacgaagtcttctgtgaagaagcgcttcaagatcacggccaccggcaaggtgctggctggtcctggtaagaagcgtcacaatctttccgcgcgatcccagaaggcaaagcgccagaaccgtggcagccaggtgctgacccatgctgacggcctgaccgtcaagcagtgggccccctacggcctgaactgaggagagcgcatccatggcacgtgtcaaacgcggcgttaccacgcacgcccgtcacaagaaggttctgaaggcctccaaggggttcttcggccgttcctccaccaactaccgcattgcgttggagcgtctggaaaagtcgctgcaatatgcgtatcgcgaccgccgggtgaaaaagcgtgatttccgcgctctctggatccagcgtatcaatgccgccgtgcgtgagcatggcatgacctacagcgtgttcatcaacgggctgaagaaggccgagatcgacatggaccgcaaggttctggccgccattgccttcgacgacgccgctgcttttgcggaaatcgtgaagaaggtgcagggcgccctggctgcctgatcgccctgacagggtgatcgaaacaggctggatgatcttcattcggtctgcttgaataccaaaaagcgatggggtttcggccccgctgaaatccggggccctggctccggatttttcgtatgtggagttgccatgtcggacgatctgaccgccctgcgagaagaaaccgatgccgctttacgggacgccgctgatctgcgcgcctgggatgctgtccgtgtcggtgtgctgggcaaaagcgggaagctgaccgctttgctcaaaacgctggggcaagcgactccggaagagcgaaaagagcgcggcgcggcgctcaaccggctcaaggaagccctgagcgaagctatcgaagcccgtcgggtagagctggaatccgccgctctggaagcccggctgaccgcggagcgcatcgatatcacccgcccgccgcgcccacgcctgaccggcgcaatccatccgatcagccgcaccattgaggaaatgaccgcgattttcggtgccatggggttcagcgtcgctgaaggtccggatgtggagggggactggcataatttcggcgccttgaacattcccgcgcaccaccctgcccgcgccgaccacgacacgttttatctgccgtcagagcaggaaggtgcggccccccgcgtgctgcgcactcatacctctccggttcagatccgcaccatgctgaatgccgagcctccaatccgcatcatcgcacccggccgcacctatcgcgctgatcatgacgccacgcacagcccgatgtttcatcaatgcgaggggctggtcattgggcgtggcatcacgctggggcatctgaaaggcacgctgatcgactttctgcgcgctttctttggcgtgcctggtctgccggtgcggttccgagccagctacttcccctttaccgaaccctccatggaggtggatatcggctggaaccgcaagaccggggagctgggcggtggcggcgactggctggaaatcctcggcagcggcatggtacagccgaaagtgctggccaattgcgggatcgacccgcgtgagtggcagggctttgcgttcggcatgggggtggagcgcgtgacgatgctgaaacatggcatcgccgatctgcgcccgttctatgacagcgatctgcgctggctgcgtcattatggtttcaatccgctggcccccgtcagcctgcatgaaggggtgtgagccatgaaattcaccctgtcctggcttaaggaccatctggataccgatgcctccctgtcccgtattgccgagaccctgacggtcatcggactggaacttgaaggcatcgaggatcgtgccgccgcactgaccggattcaacatcgcccgcatcgtcagcgcggagcagcatcccaatgctgatcggctgcgtgtctgtcaggtcgaaaccggcacggagcgcggcacgattcaggtcgtctgcggcgcgcccaatgcccgtgccgggatcggcgtggtgctggcaacacccggagcagtcgtccccaccaatggtatggtcatcaaggaaggcgaaatccgtagcgtggccagcatgggcatgatgtgctcggcgcgggagcttggcctcggcgatgagcatgacggcatcatcgaattgtcgcccgatctgccgctcggcaccccctatgcggcgctggccggcctggatgatccggtgatcgagatcagcgtcacgcccaaccgcggggatgcgctgggcgtgcgcggcatcgcccgcgatctggccgccgccggtctcggtaggctgaagccgttccagccggttccggtcgcagcctctgcctcctccgccattcactgggcgatcgaggatcgtgaagcctgcccgttcatcctgggccgcacgatacgcggcgtgcgcaacggcccgagtccggactggctggcagcacggctgaaggccatcgggctgcgtcctatcaacacgcttgtcgatatcaccaattacgtctgcttcgatctgggtcgcccactgcatgtattcgatgtcgcgcgggtgcagggggatacgctcaccgtacgacgaggcgcgggcgagagtttccgaaccctgaatggcaaggatatcaccgtcacggcggaagattgcgtgatcgccgatgcaacgggcgtagagtctctggccggcatcaccggcggcgagcgcaccggctgcaccgagaccaccaccgatgtgtttatcgagtgcgccctgttcgatccggtgcggatcgcccgcagcggacgttatcaccagatcagcaccgatgcgcggcagcgtttcgagcgtggtgtcgatcaggccctgctgcctgctgctctggaagcagccaccgccatgatcctgagcctgtgcggcggtgaggccagcgccatcaccagcgccggagtggaaccctcctggcagcgcgacgccacgctgcgttttgcccggctggagcaactcggcggcctggcggtgcctccggatgaagccgtcggggctctggaacgtcttggtttcggcatcctgtcccgaaatgcggagcatgtgacggtctcggtcccgtcctggcgtaatgatatggcggtccgctcaccgctcgacttaccctcgacatgcgatgccgcgcgcgccgccacactggcggaagccgccgccgaagccgagccggaagccgaactgatcgaggaagtgctgcgcctgcgcggtatggatgcgattccggcctgctcgctgccggtggatcatgccgtaccggcggcctcattgtcgccgcgccagacccgcgcggcgctggcccggcgcgaactggccgcatccggcctgatggaatgcgtcacgttcagcttcgtggcacatgaggtcgccgcccggttcggcggcaccgaggaaagcctccgcctgctcaatcccattgcctccgatcttgaccagttgcgtccgacaccggtggcaacgctggcgctggcgctggctcgcaacgcagcccgcggtctgccggaagcggcgctgttcgaggtagggcctgccttctctgccaacgggcaaagtcaggttgcggccgccatcctcggcgggatgacgcctcggcattggctggaaccggcacgttcactggatgcgatggatgcgaagggctatctgttcagccttctttcggcattgggcgtgccgatggacagtctctccgtcaccgccgacgcacctggctggtaccatcctggccgctccggtgtagtacggcaggggccaaaaaccgtgctcggcacgtttggggaattgcatccggcgctgatcgaagcgatggatctgccctctcccaccatcgccttcgagctgtttctggaggcggtgcctgaaccgaaacgccgccgccgcgccgcaccgaccctgccgcctttccagcctctgacgcgcgatttcgcgtttctggcccaacgcggcacctcggccgacgccctgctgcgggccattcggggggcggatcgcacacttatcacccgcgtatcgctgttcgatgtctatgatggcgacaaactgccggaggggatgatctcgctgggggtggaagtgaccctgcaaccgctggaacgctccctgaccgatgcggagatcgaggcgatcagcgccaaaatcgtcgcagccgccggaaaagcagttggagccacgctgcgttaaaaaaccagccgcccgcatgggtggcgcaagctttgttccccagaaagcctcgccgggatgatccggcggggctttttgttttcaacacatgctccccttcgaaaatcaccgggcgggaaggccatatcagggcttcgcgggacggtattttttgcgtatcaggcgtccatgaccgacattcccatcgaccgtatccgcaatttctcgatcatcgcccatatcgaccatgggaaatcgacccttgccgaccgcctgatccagttgaccggcgcattgtcggaccgcgaaatgaccaaccaggtcctggataatatggagctggagcgggagcgcggcatcaccatcaaggcacagaccgtgcgcctgacctaccgcgccaaggacgggctggtctatgcgctgaacctgatggacacaccgggccatgtcgatttcgcttatgaagtcagccggtctctggcggcctgtgaaggctctctgctggtggtggatgccagtcagggggtggaagctcagacgctcgccaatgtgtatcaggcgattgatgccaatcacgaaatcgtgccggtgctgaacaaggtcgatctgcccgccgccgagccggaccgggtgaaaaaacagatcgaggatgtgatcggcctcgatgcttccgacgcgctgatgatctcagccaagaccggcctcggcgtggatacggtgctggaagcgctggtcacccgcctgcctgcgccgaaaggcaatgccaatggcgaattgaaggcgctgctggtcgatagctggtacgacgcctatctgggtgtcatcattctggtgcgggtgaaggatggcgtgctgcggcgcggccagaaaatccgcatgatgtctaccggcgcgacctacaccgtggatcaggtgggcgtattcagcccgcgtatgacgccggtggagacgctcaatccgggagagatgggctatatcaacgccgccatcaaaaccgtggccgataccaatgtcggtgataccatcaccgatgaccgcgtgccggcggccgagccactcgcaggcttcaaaccctcgattccggtggtgtggtgcggcctgtatccgatcgacgccgatgatttcgaaaagctgcgcgacagcctcggcaagctgcgtctgaacgatgccagcttccatttcgaggccgagacctctgccgcactgggtttcgggttccgctgcggcttcctcgggctgctgcatctggaaatcattcaggaaagactgagccgggagttcgacctcgacctgatcgcgaccgcgccatcggtggtgtacaagctccacaagaccaatggcgagcatctggagctgcacaacccggccgacatgccggatggcagcgtgatcgagaaaatcgaggagccatggatcaaggccacgatcatggtgccggacgattatctgggcgcgatcctgaccctgtgcagcgaacggcgtggccagcaggttgacctgacctatgtcggcaaccgggcgatggccgtgtatcggttgccgctgaacgaggtggtgttcgatttctacgaccgcctgaaatcagtcagccgcggctatgccagcttcgattaccagatggatggatatgaggagagcgatctggtccgcatctcgattctggtgaatgcggaggctgtggatgcgctgagcttcatcgcgcatcggagtgcggctgaaaaccgtggccgacagatctgcgccaagctgaaggagttgattccccgtcagttgttcaagatcgccattcaggccgccatcggcagccgcatcatcgcccgcgagacgctgggtgcgctgagcaaggacgtgaccgctaaatgctatggcggcgacatcagccgcaagcggaagctgctggaaaagcagaaagagggcaaaaaacgcatgcgccagttcggcaaggtggagattccgcaatcggccttcctcgccgccctgaaaatggataactgaccccccttgcattcccccctcagggtaggtaatagcaccccaccctggcatccggagagatggccgagcggcttaaggcgcacgcttggaaagcgtgtgtgcgtgaaagcgtaccgtgggttcgaatcccactctctccgccagcggcctgaattttccaatatcatagcgtatgaaaatcggctgatttctgccgatttttggcgtgttattgttgcatctcgacgcatcccgttgcatggtatcccacgcaccatgtggtaactagtgtgggataatattgggcaagctttccgccacttccgtgaaggcctcaaaggagccgggccgctatggcgacggcgacggcctgtaccttgtcataagtccccggggcgggaagtcctgggtttgtcgcgtgcagaaggatggcaagcgccgggacgttggcctggggagtgccaagaaggtgtccctggccttggcccgtgagcgcgctgcgaaggtgcggacacaggttgaggtggggcttgatcccgttgccgagcggcggaaagaggccgggatacccaccttcaaggaagccgccgcgctggtgtttgccgagcacaaggcgagctggcggaaccaaaagcaccgggcacagtggctatccacccttgaaacctatgcgttccccacgctgggcgatctatcggttgccctcattgacggccaccatgtccgggatgctgtgatttccatttggctggaaaagccggagacggcgcggcgcgtgcgccagaggatcaacacggtcatcgactgggcaatcggcaagggataccggacgacacccctaccgattgcggcgatgaataaatcgatgcccaaggttaaggccaagggggtgcaccatacggccctgccctacgctgaggttccggcgttcgtggctaagctcaaagagcgggatactgtggggcggttggcgcttgaggcgctgattctcactgcaaccaggtccggcgagattcgcggtgcaacctggggcgaccttgatctggacaggggactatggacgatccccgccgagcggatgaaggctgggaaggagcatgttgtcccgctgtcatcggccgccctgggcgtgttccagcgggcgcagcgttacagggaggcgcggagcgagttggtatttcccggtcaacgcggcggcaagccgctttccgacatgacgctgaccaagatttgccgcgacatggaggttgccgccgtgccgcatggctttcgctcatccttccgcgattgggtggccgatgagacgaattttgacggcgacatagccgagatggccctggcgcacgccattgggagcaaggtggaagccgcttaccggaggggcaacctgctggagaagcggaaggcgctcatggaggcgtggggcgattattgctgtttgaaggtgtctcaacccaaggtatagccgtcctacatcaaccaaaagaaggtttttgctgcatgaatacggaatgggatgatttgcacaacatcgcggcacgcatcatttccccggatagtatttcaataggcaaggctgaattaagacaggcggcttcgagagcgataaaaaagatacgctggataaagttcctatccattgaaggagctagcttatttgcaggggtatttcttgcgtgtttggctggatatatcttttttcatctgcatcactcgccgtaccacccgtataagttgttcagggttgcatattataatctcacgattccagcgctcctgatgtcgattatatctctgagtgtgccagaactggcgcaattcagacaaccgttcaaatcttggctgcggctacctaaagagtgccatcccgaggcgctcaccccgttgttcgacagtcttgctgccggggattgggaagcaaaaactgagaaaggatttgtcccagagtatctgtttagaagtgagtggcgcatcctactggttgctggcgccgagtataagcaaaggcggcggtgggtcagctattggtggagagaccggtatgacggagacattaaggcgagagctgtgcctcgcaccctcgatgccccggagcgactattgcaggcggatgcaacccagccaatttcttctaccgatacggcttctgccgtggtcacttcagaaaaagtagttgtggttgcggcccatgagaagcctgatctcaacaaagaccctcgatatgactggctggctggtgggacctatcaagaatttcaggctggtctcgaccaatttctaaaggaaaaggtgccagcgcatcacgaggcggctctacggcgagcgcttaccatcggacgcgaagaattgcgcgaaggcaacccgaggaagacgctgacactcacgatcaaccggataaagtacgaggtcgagaatatgcccaggataccgggggtatctctacccgccatgagcaaatcgtccctcacgaatctgctccagggcacctatggcagcacctcattcaagcactattttctcgatggaaggcagtgcaaaaccgaataagagaagacaagatcgtacaagtttcgacaaagttgaacggcattaaacaactgattttgaacggttttttgtttgatgcattatcgtcgtgcaacttgataagggttagcacgacatgagtttgaaaacctttccagacccccttctgacaatcgaggacgtactgcgtcttacgggataccgtagcagaagttcaatatatcgcctcatgaggcagggaattatgccttgcccgattgtcatcggcggcggacgtgtccgctggcgatcaggcgaaattcatcaatggcttcaacgcctccccacccagacctattcctgatgggctgatccggtttcgctgctcttgcgcagtccggagccgcccgtcgtcttcctaacaaattgatctcgacgcattcgcgcccttagcgcggaaaggatgcttcatgcttgttttccagaatattatcgcccgtttgcatgtcaggttcctccccgaggatgttgcccgttttaccgtgcggacgacgccccgcatcgcccgtttcgtcacgccgatcatcgagaagctgatccgggatgacaggactggcgagacctaccggtttgccgtcgccctctggcaacgctgggacgtaccgccacttaacgtttaccttgggtcgagttccctctgccgcatcgatggcccttcaacgttagacgagagcggctaccgcccagcgggtggcttggtcgagacgccaggcttgaccgcacacctctcgcctgacgaggcccatgacctcgataaccgcatcaagacggccatcgaaacgaccatccgaaactgggcagacgagacgaatcgcggtcattggaaaaccctcccccaacatcagtaccggggggcagaagatgcgtaagccccggaagctttgcctccacgagagccccgatgctgcgcatcggggcaaggaaagaagaacacaccgcacgcactggcctgcggctgagcttcgcggttttttgcgggtgcgatccgggtgcgttcatggcgcacgtcccaaacccgacaccatcccaggtatggccgaggatgcgcgccggatgcggggggaggacggaccatgaagttcgcgttcagcactccgtgcgcgtccccttggcgctcgataaagccctgcggcatgctgcccaaagccgccagattaccccctatgctctgttgcagcagtgtgtgcgagccgggcttgcttccctttccggcgaacaagcagagctaaaattcgcagccgagatggctcaagagctaggcgggttgaccgcccggttggcccatgtcgagcgcctgactgagcgagcgctgtttaccacgtgcgccgcctacacctacgcccgggccgccgctggtccccgtaccgatgaagtcaatcttattgccgaaatcaacgccgccttcacgcgccaactcaaccttgccggagattcgtgatgtccaaagacagcagcaaccgtgcacatatcgccgccctgcgggcgcgtgaccgcgtcgatggtcaggttcagttccgcttcaatgcccgcgtgttggccggtagcgcgctgcttggcgcgctggccttgggggtaattgttaccagcccctcacaaatggaggccgacaccgaatatggcatcgccgccttcaccagctttctcttgtcagatatgccgtccgaccccttgatgacgattacctggaacggtcaggcaggccgcacgggggtcaaagaatgggcggcgttccagccattgcgccaggatgcggcaagctttgcccgcaccctcgggctgggtggcgcactgggctttgccgggggaatggctggcctctggctgaccgctgaccgacggcggcgcaagcaagaagagcggctggcggatcgggtcatgcggggcacgcgcgtggtcagtgaggcaaccctggctagcatgaccgccgaggaaagcgatgagccgcgcctgcaatttggtggtgttaccttgccgagtggattggaaacccggcacaccgccctgattggcacaactggcggcggcaagacgacggtgctccggcagcaactggacgtgatcgaggccaggggcgaggctgctttggtgtacgacaccagcggcgagttcgtggcgaattattacaatccggcacgcggtgacatcattttgaacccgttcgatcagcggggggtgttttggagtcccttcgccgagatcatccacccggccgatgccgaccggattgcccgctaccttatcaatgagaccggcgacgaggataaggacatctggctggaaacatcccgcaacctggtggccaatgttatgcgcaacctgtggcgggaggggcacgggacgctgcaagccttgctaaacgcgctccagtcgatgccgcgcaaggagttggagcgctggctcgccaacacgtcatcggcccgcaccttcgagaaggatgccgaccgcgccaccgccagcgtgctgttcatgctggtcaaggcggtcaacatgctcatgttcctgcgcaaggcccctcgcgacggtgaagaagccttttcgatttcccaattcttcaagggcatcgaccagcataagggccgcaagccttggatattcgtgcccaggaaggaagattgtttcgaggccatgaagcctttgatggcgctgtggctggaatgcgcggccagcgccatgctcggcctgtccgccagcacaacccgcagggggtggcttcttctggatgagctgcccgatcttccccgagtccaaaaccttgaacgcctcgcgccgcaaggcaggaaattcggggcgtgcataatcttgtcgtgccaggcgattggccagatgcgcggacattacggccccgatggcgccgaaaccctcctgggttgctgcaacaccaagttgttcctgcaaatgagcgaccacgccagccgggaatgggcggccgcgaccattgtggcagcgccgaggtggaagtgcccactttcagcgagacgttcgatccgaatacaggtaaaccgcagcggaccttgagcacgacgcgcgaattgcgccccgccgtgctggagagcgatctgcgcttgccgaaatatactggttatctgctgttgcccgatggcttgccggtggcgcggatcaagctgacgaatgaccatatcatcgcgcgcggccccgcccggcagcctgacttcatccccgccgatattgcggaaacgctctggggcggattgcaggaagcccaggcggccaaggcggcggtaacgcccgacgcccccgtgcagggtacaattcttgggccagggccggtgtgatggtagcgacgatctccgccctgaccagcgccgggcaggccgccagctactatgaggcagatgactattacgcagagggtggcctcgccccctcggaatggttgggccaaggcgcgcaggtcctggacttagccggggccgttgaccacgagcaattcgcccgtctgctggagggccatgtcgccgggcaaagcctgggcacgatgcgcgagggcgagtgggagcatcggcccggctgggatgtaaccttcagcgcgccaaaatccgtgtcgatcatggcggaggtggcgggcgaccgtcgcctcatcgccgtgcatgagcgggcggtgaaaaccgccctggggctggcggaacagcattttaccgccacgcggcttcgggaggatggcagcatccggcgggaggcaactggcaatctggtcatcgcctctttccggcatggcaccagccgggcgctcgacccgcagcttcatacgcataatgtcattctcaacatgacccgcgacaaggccgggcaatggcgcagcctggagccgcgcgctttctaccagatgcagaagctgatgggggccgtctaccggcaggaactggccgccgaggtgcagcgcctgggctacgcaatcgagcgcggcaaggattcgacctttgagattgccggtattggcacggaaacgctggaggcgttcagccagcgtagtgctgccattgaggcgcgactggccgagcggggcaaaagccgggaccaggccagcgccgccgagaagcaggttgccgcgctggatgcgggcggcgggcgcgtcatcgagtgcgacacgcgcgaggcccgctttgcccagatcgcccaggattacgccagtttggacaccaaagagagacgcaaagcgctggtgatcgagccttcccgcgaggggcgtgatgtgttgactaaggaaatccgccaccgcttggcggaaaatggcgctctgcatggccccaccgttgagaccgccaggctggtgccccgtgacctgacgcgcgctgaggccaaggacgcgcacagctacgccatcggagataccatccgctttgccaaggattatgccgacaaaggcgtgtcaaaggcgcaggcctatcgcgtggtgggcatcgacaccaaaaaggccgccttgacgctggccgatcagcacggcggggccatcgactggcggctgcggcaatggggcgcgtcacactcccaggccttcaccagcgaggtgatcgagctgcgggcgggtgaccaagtgcagtttacccgcaatgatcgtgtcttgggccgaatcaacggccagcagggcgaggtcatcgccgttgatccggcaacgcgggaggccaaagtccagcttgctcggggcaagatagagacgttggcgctggataatccccgagaccagcatatcgcccattcttatgtcgccactgcctttgccgcccaggggcgcaccgccgagcgcacattcatccacgctgatagcgccgccacgaacctgctggaccagaagagcttctacgtcgcgctgtcccgcgccaaggacaccaccgccgtctacaccaatgaccggggcaagctggttggcgcgctgctggagcgtgcgggccttaagcaaaccgcccttgctcctcaattgaccggcgggatgccaagccgcgccgagcagaaccgtaaagcagtggcatctcatggtgtggcgctttgagcctaaaccagatagcctagcccaacgatgtggagggatttccggcgacccggcctccccttgaatcaagactatatatataggcatggggcatgaacgctgttgaaattgaacaggccgtcaccgccctggccgagcaaccgtttgacgcggctgagttcccgtttgccttcctgcaagcctttgggaacaaggaaaccaccatcaagcgcctgcgcaagggcgagtccaacaagtccgacattgctggaccttggggcggcgtgcttcaggccaataacatccacatcgctgtctgctccccgggggaagtgcccctgacctttgccgccctgaagtccagcccggccaccgcgcgggccaaggcgcggtttgtgctggccacggacggcatcacactggaagccgaggatttatcgtccgacgaagccccgattgcctgtgcctatcccgactttcccaaccatttcggctttttcctgccgctcgccggcatcaccacggtccgccaaatccgggaaagctcgttcgacatccgcgccaccagtcgcttgaaccggctttatgtggagctgctgaaggacaaccccgaatggggcaccgccgagcgccgccatgagatgaaccatttcatggcccgtctcatcttctgcttctttgctgaagacaccaatattttcaacggcgccgggctgttcaccaagaccatcgagacgatgagcgcgaaagatgcctcgaacacccatgaggtgatcgagatgctgtttcgcgccatgaacaccaaggaggccgagcgtgccgctgccggcatcccgcgttgggccgctgtttttccttatgtgaatggcggcttgttctcaggcagcacggccacgccgaaattttcccgcatcgcccagcgctacctgctctatgtcggtaacctggactggacgaagatcaaccccgatattttcggctccatgatccaggccgtggcggatgacgaggagcgcggcgctttgggcatgcactacaccagcgtgccgaatattttgaaggtgctcaacccgctgtttttggatgatctgcgcggcaggctggaggaagccggggacaatgcgcgcaaattgctgaatttgcgcaaccgcatggccaaaatccgggtttttgaccccgcctgcggctcgggcaattttctggtcatcgcctataagcagatgcgggcgattgaggccgagatcaaccgccgccggggcgaagccgagcgccggaccgaaatcccgctgaccaatttccggggcatcgagctgcgcgattttccggcggaaattgcgcgcctggcgctgattatcgcggaatatcagtgcgatgtgctttatcgtggccaaatggaggcactggcggaatttttgccgctggatgcccagaactggatcgtctgtgaaaatgcgcttcagttagattggctgagtgtctgcccttcgacggggacgggcgtgaagctccatgccgaggacctctttcatacccccctcgaccaaccacagatcgattttgaaaacgagggtggggagacatatatttgtggaaacccgccctatgtaggggacaaaaagcagaacgtcgaccaaaagcaggatattcagaggctattcgcgggacggacagatcggtggcggtccttcgattacgtttgcggctttttgtttaaggctgttgaatatggcgcaaaagttggcaactggtcagccgcttttgtgacgaccaactctgttacgcaaggcgtccaggtctcacaattttggccgcttgtgatgaaccaagccgaaattcgttttgctcacacatcatttaagtggtcaaatctcgctgcaaaaaatgccggcgtaacatgtgttattctcggtcttgcctcacgtagcacaaagtcgccaaagactctctttttcggtgatgcacggcgaaatgttgctgagattaccccctatctaacgtccggacatacagtattcgtccaagaattttcaaccccgttatctgcattgtcggaaatgttgcttgggaattttgccaaggatggcggaaaccttttgatagatcgcgatgatttagaggcaatcgatcgcatcggcgccgggttcctgcggccaatatacggagctcaagagtttatcaaaggtattcagagatactgtttttgggttcaggaccacgacatagagaatgcgcgccgaagcaaggacttagttcgacggtttgatcgtgttgccgaatatcggcgccagagcgtaaaggccgcgactgcggcctgggcgacaaagccccataggttcgtcgagataaggtcacgtgactataccagcgccataatcgtgcctcgggtcagttcagaaggccgggattatctgccaacaggattattgcccccgcgatcaatcgtcacggaagccttcgccctctacgacgccccgctctggaacatggcgctcatcgcctcgcgcctgcatctggtgtggatcgccacggtctgcggcaagctggaaacccgataccgctattccaacacgttgggctggaacaccttccccgtgcccacgctcaccgagaagaacaaagccgacctcacgcgttgcgccgaggagattctgctggcgcgcgaggcgcatttccccgccaccattgccgaattgtacaacccggctaacatgcccgccgatttgcgcgcggctcatgagcgcaatgatgaagtgctggagcgcatctatatcggccgccggttcaggaacgacaccgagcggctggaaaagctgttcgccctctataccgagatgaccgcaaagcaaggcaaagccgccaagggcaaaggccggggcggggcgcgcgcgggccagatggccacgccgggccaagaggacgcacttgtttaaccttgacttgataccattttatggtactaaatgctgatgcaaaaacggcacgccaagacgcttgaggcgatcttccgccgccccgtttcaggcaccatccgctgggccgagattgaggccctgttcgtggcgctgggtgcggaaattctggagcgggaaggctcgcgcgtggccgtggtgctgtttggcgaggtgcaggtgttccaccgcccgcacccctcgccggagactgacaagggtgccgtggcggcggttcgccgctggctggaaaaccatggggtgaagccatgaatatgttggagattgatggccacaaggccgttgtgcagttcgaccccgagatcggcatgttccggggcgagtttgtggggctgaccggcggcggggatttttacgccgatagcgtggaagggctgaagcgcgaggggcgcgtctcgctgcaagtgtttctggacacctgccgtgagcgcggcattgcgccttaccgcgcgttcagcggcaagttcaatgtgcgtattccgggcgagctgcacgccgaggccgtgcaggtagcggcagcgcgcggggtaagcctgaatgagctggtgcgcgaggcgctgacccatgagctgagttcttgatcgggttttgattttagcaggcagggcgcagggacgaaaaatgagatttgaagatatatcaatgagttattctgctttcggcgccgctgtttttcttgattgggttttgattggagcgctggcatgagcgcgattccctccgtttcggtctcctatgcccggagcggaaactcgaccaaggccaatgagctgggcatgcgcccgatgcaggagcgcggctatgaaaagcggggtgagcaatatctgctgatcaaatcgcccccggcctcgggcaaaagccgggcgctgatgttcattgccctggataaactccagaatcaggggttacgccaagcgatcatcgtggtgccggagcgctccattggcgccagcttcaatgatgagcccctgagccagtatgggttctgggccgattgggtggtggcgccaaaatggaacctctgcaacgcgccaggcggggataacgggggcaaggtcaattcggttcaggcttttctggatagtccggacaaggtgctggtttgcacccatgcgaccttccgctttgccgtggacaggtttggggtggcggcgttcgataaccggctgatcgcggtggatgagttccaccatgtctcagcgaacccggataataagctgggcacccatttgggccagttcatcgcccgggggagcgcgcatattgtggcgatgaccggctcttatttccgtggcgatgccgtggccgtgctgatgccggaggatgaggccaagttcgataccgttacctatacctattatgagcagctcaacggctaccaatatctgaagcagctcgacattgggtatttcttctatagcggcgcctatgccgacgatattttgaaggtgctggacccggatgagaagacgatcatccatatcccaagcgtgaattcgcgcgaaagcacgaaggataagatcagggaggtcgagcatatcatcgaggcgctgggggagtggcaggggatcgaccaggttaccggctttcagctggtgaaacgctcggatggccgtgtgctgcggattgccgatttggtggatgatgacatcactaaacgcgaccgggttgccgccgcgcttaaggatgccagccagaagaataaccgggaccatgtggatatcatcatcgcgcttggcatggcgaaggaagggtttgactggatttggtgtgaacatgcgctgaccgtcggctaccgctccagcttgaccgagatcgtgcagattatcggccgcgccacccgcgatgcgccgggcaagacccgcgcccggttcagcaacctgattgctgcccccgatgcgtctgatgccgctgtgaccgaagccgtgaatgacacgctgaaagccatcgccgccagcctgctgatggagcaggttttggcgccccggttcgagttcaagccgaaaaacccgaatagcggaccaacgccggggcttgattatggcgagggaggatatgatccggcgaagtgcaatgtcggattcagtgaggccacgggcaagttcgagatcgagatcaatggcttggcaacgccaaaaagccccgaggccacccgcatttgccggcaagatttgaacgaagttgtcgccgcttttgtacaggataagcgcacggttgagcgggggctgtttgatgaggaactggtgccggaagagctgacccaggtgcgcatgggcaagatcatcaaggagagatatcccgagcttgatgatggcgaccaggaagccgttcgccaacacgccatcgcggcattgaacctgacccaggccggcaagaagaaggcgacgggtgacgatgacggcacgcccagcccgaatacggcctttgttgatggcgtgcggcgctacgtgatgagtgtgcaggacttggatatcgacctgatcgaccggatcaacccgtttggcgaggctattgcgatccttgccaagaccatggacgaggagagcctgaaacaggttgcggcggtcatcgcgggcaagcgggttagcctgacgcccgaggatgcccgtgatttggccaaacgcgcgctgcaattcaaacaagagcgcgggcggttgccctccattacctcaccggatgcttgggaaaagcggatggccgagggggtggccttccttgctcgcatgaaagcggaggcagcccgtggctaaggctaaattcaccgaggacgatgacgcgcttctcgatgagcttggtgttgaggttgaggctccccaccacggtagtcgaacgccaaaggaagagcgcatcattgccgggtttgaggaaatccagcgctttttcgatgaacatggcctgccgccgcaacatggcgaagagcgggagatttttgagcgcttatatgccgtgcggcttgatcggcttcatgaacaggcggagtgccgtgcgattttggaacccttggaccaccagggactgctcaaaggccaggtgaataaaaaggccgtggagcctgacgagttggacgatgatgagcttctggcacagctcggcatgggtgcggccacaccggatgacatcactaatctgaagcacgtccggtccgtggcagataagcgcgccgccgaagtggtagccaatcggaccgtttgcgccgatttcagcatcttccagccgctgtttgccgaggtacgggccgatcttaataccggcacgcgtgagacccggcggtttggtgaaaacgccgagatcaagaagggggagtttttcatcctgggcggccagtttgcttatgtggctgatgtgggggaggagttcgtcgcagaatatggccggccagaccggcggctgcgggttatctatgacaatgggacggaaagcgatctgcttttaaggtcattccagcgtgccttgtataaagacgaaggcgggcggcggatcaccgatcctgcccttgggccgctgtttggcgaccaatgggagccagatgatattgaaagcggcactatctatgtgctgcggagccattcgacacacccgtttgtctcagagcatcgtgaactaattcacaaaatcggcgtgactggtggcaaggtggagacgcgcatagcgaacgccgcgcatgatgccacttacctgctggcggatgttgaagttgtcgcgacctacaaactggccgatataaatcggaccaagctggagggtatatttcacagaatttttgccccagcccagcttgatctcacccttcaagatcgctttgggcatcttgtccggccaagggagtggtttcttgttccactacatgtgattgataaagctgtgcaatgtatccgagatggctcgattgcccacatgacctatgacgtgaaaactgctagcatgatgaaactaggccagtagttctgtagcacacccgcacgacagtcctgtgcggacagttaaacagccggtctcttcacaaccaaaagattacttgcctacagaattgtggtgattcataaagctgctcggatataggcgacggattagcgttggacgagaatgacatcaaagctgcggtactcaattacctcttgcttcagggcaggataaaacgcggctgtgccatcgcaaatgaattcgccttacggaaggccagcgttcgggctgaccttgctatacttgagcaaagattcattggcatcgaaataaaaagtcccgctgatagtcttcgacgcttggaaactcagatcaactcctacaaagagtattttgatcaagtcatgatgtttgttgcaactaatcacgtcaagaatataaacttgaatgactaccaaggcgtcgaagtttacgctgtaggtcagtcatcacatattacaccaattagccaacaaactgacagtaaacaagcctctggcgaagcccttcttaagctcttaaccaaaaacgaacgagagcgactttgcgttgatgaaacgccaatgcaggaacgtcgggcatttgagctggctttttctaagagatattgtgaaacgagtgaattgttttggaatgtcgtcggaaaacgaagaagaattaaggtgctcgatctccatctccttagtaaatatcgtccacagagggaagctgcgctctttttaaagaagcagaatgaacagcgctggacgcaatggacaagcgagattatgggcttgacacctacgacagtctagcgcccttaatcagaccactcatcgtcagtatcatacatggcgtcggggttgccgtaaaagagctgccggtgaagatgaatgtttattctagccgcagttgatctttttggagaaacgattgcagaatgatccccaagagctgtacgctcaatcatttgagttccccaaattcgtagatcggcatcccaatccgatgaacggattacatcctgagcttgctctatgtaagcggctatccgatcttcgccatcttctgatcgaaaaaacttccattcacctctaagtgggtagtcaatgcggggtatagggggacctcctccccctaattgcctttctgctcgtgcgcttccacggtcgctatagatgaggcgcgtaccagcttttgatgcagcattgttaaatgctacccgttcgtaaatctcttggccggtacaagtcccaaaactgtccggaaaagatgatgcagatatagaaatgaagctttggggagccacttgcagaacttgctgtgacaaatccaaagcgcgaccttcaacagcgttggcatcacgaatttttccgaaatcaagcaggaacacgacgccgcttccagcgtcggttaatgttcctataatttgagccaaggccgttaaaccggcaaagcctgcttgctcaacagatactatcaaccctcgccccaacgagtgcaaacgtgaaacctgagtgttaagctgagtaggagtatgaagctgaacggcagggataaaattgctctgattctcgatgaatttacaccaagcgtcatatccattttcagggtttcgtaatgctgcaagctgctgatgtacaggacgatctccaccgttttggtcaggttccgcaagagttacaaagcacggcctatcgccataactctcttccatacgagttaacgcgctactcagatgatgagcagttgtccacgggcccaactgaaagaacggcaacaacaaatctttgtcacgttcggggagttcttccagagcctgcatttcagcagggcgaagcgacaaaagaggaatataattgacttcgtctaacgccctcaccgttaactcctctgtcccattttaggaaataccgagcctaatcttcatggctgcttcggatacttcaaattgatcggcaagatactcaacgggattttcgatttttagggttcgagcagtttccaacatctcttgcacaagttcctctggcatcagaatatccgccgccagtcgattggcctcggcctctcttctatctgaaagagaagagcgatacaaaacatcatcttctattcctgacccgatatgatcgcggtgaagcagataatgagcaagctcgtgggcagcggtaaacctctgtctgcgagacggatcatgcctattaatgcggacaacgaatcgcccctgctgcactccattcggcctaatttcgccagaaatacccggcgcgagagtcgccgacttcatttcaagctccatttcacgcgcgacggcaccaatcttaaccggcgcctcaaactggtgggcttcgattgcttccctgatttccctcgggagtgacagccattctctactcggcataagtcacatcctccttagctctcttcattttcgtcaccctcgtcatctcgccggaagtcttttcgagcgaaaaccacattgtcgactcgtttaagaacaagttctcggaatgatttagattcaaatttcgacttcaagaacttatctgtcagttcttcgaaatgagcgcggatgtctccgtcatcaagtctttcgtcaatacggtctctggcggctgtttcggcggccttctttgttaaacctctaaactcagcccaccccaaaagagcagcaacagcaataaagaaccccaaaacagccagtattactgcggtagccccgagaattgtggcggcaaggtccgagtagctcatatctaacgaactgtgggtaaagtacacacgttgaattagttcgacgccagcgccccccagaaccgcgcccaaaagcgtcgacaggaaagtcttgatcatcttacccttcccgatgccatacccaaagccacataccctccccataactcaattcacgatttgcagaaacgggtaccttgtggcgggttcccttggaacagacgcgcggccaaagccacaaaacataacctataatcgagcggacagaacatatcaagaacgattttggcgggcaaatttagtaaggtttgttgttatgcatcttaatggctgtttccccacagtacgctgcctgctttctcaccaactggatgcgcttcttggatgggtagctgcgacggtgagcctttaaatgtcccctacggtatgggccgattctggatggccatatgttccaaattcttctgccgctaactctcgctcgcttctgcattgggacggggtcacgggatgtcaatcgacattttgtggtaatttatgtgggataaaatctttttataaaatataatatattgaaatatatgataaaaaataaaaatgcattcggacaccctctccgccagtcgcatcttccagatgatgccataaagtaccaaaagtcttgtaatctctcgataaaatgccgctttatcaaaccataagatacgtagataaactttatctacccgggcaatcccgggactaatccgggaccagaattatccctttgagacaaaaatcgggactaatttctaacgccgattcgttgattcacgaaatcaccatcctgcgcgcacaaaaaaagccggggacatgccccggtctctttcgtccagattggtgatggcggtcagtgggccgcggcggcagtcgcagccgcaccgacagtcaccgacggatcatgcgccagcagttggccaagaccgacttccacagccgacgccagcaccgccggggcgacttgcttttgcagatactccacgcctgctgccatagccgccgcacaggatgccgaatcagtgatcggcgccagccgcaaccgaggcagaatacgccgcaccaaccgcctgctgcccccgcccccgaccatccacaaggtcgaggcggtgatggctgatcctgtgcgcctgcacagccagctggggtatgatactaatttcgtttttggctgccgagacagcataaagcccagtaccagtctgacatatggctgaaagtgggattctacaatgcaggattgcccgtgacatacggcgggccggcgcgcatgtacaaatggtaatgaaatccggacatatcccaaactgtttttgaaaaccccatacgcgtatttctgacgcttttgcgttaatgatgcctgtgtggcaggcgatgagataacgcggccgtaatagatgcctgacataaaattgttattgtaatggctccgcaatgaatagtgtagtatacataaaaaaaactccgacatcccataatattgtaataaaaattgattttgtttttttaaataaaaataaaaatatcttatccgttgtattctatcgttttatagaaagttatttcatttattttattttaaaaaccaaaaaaaatattttttattttttaaaatttgtattcatttataatattttccaaaattaatataaaattcgtttaaaaatttgtcacttctcaaaaatgagaatcggaggcactataccgccatggcaaaaggatggttggtcatccagtcatacactgaatttgataagaggatggttttgtcttgtatctgtaaacttcaggaaagtggacgcaatgcctgaggcactgaagcagaataacgaagccatttccgaagaggaactggaagccgccaatggcggtggatttagaaccgctgttacaaaaaaagcaaccaagacgattgccaaggccgggatcgaggttgctgctgagaaggtagccggtaaaaattcataacgtttttaccgcttaagagtgtgtcatctatttttaaattcaggaaagcatagaccatgactgacaaactgaaccagaacaacgacgccatttccgatgcggatctggagggcgttaacggtggtggttcctggcaaaggggcgacggtggaaaaatgcagtgggttgagcagaaagccagcgggaatgcgggaaatttttccgcttcgcgtgaggcaagcaaccagcgcgttgtgagagacaattctggtaatatcctcaaggtctatcgccatgatggccagaaagaatatgaagttacgaaaaaaagataagatcatcattaggtggtcgtaatttttgtggatgacatgatactggttgaagggttcgtttaatcggtcatgttatttgaaacgagcacggcatgcagcgttgcatgccgtgcttgtgtatttcagacagttttttgctaaaaatcgtgtggattggcatcattcatttctttaaggaattaggtattttatggtggcaagccaatcttcttcccggcctgtccgcaatcgtcgcagggggctgttccgtcagcaatctctgaagcagctcgacaaacctgaagattttcaggttcctttgcgggtcgtggggccggtcgattggttggtgggattgctctgcctggccttctgtatctcgatcatcctgtggtcctgcatctcgcgataccgggaaaccgtgcaggggcgcggtattcttgtgcgcaccgatggtatgttcatcggcatcaacgcaccgaaagccggatggattgatgaggtcgttgcgcaggggcgcaaggtcaaggcgcatgatctggtcgcatcccttgcgacgccggaggaagatgcccggatacaggatatgcagagccgcattgcccagatagaaacccagcaggcctccatatcaaagcgttatatccagagaattgctgtggaaacacgcgcgcagcaacgcaggcgggatgagcttcaggaatccgcggggttgacagagcgccgtatcgcagaggcagccgtcaccctttcaaaccgggaatatctgttcaacaacggcgccggcacgatagaccgtgttcatgaggccagagagcgtcttttcgcatcgcgggaggcactgtcccataccagagccgatcttgcgtctctggacagtgttcttttgtcgctggaaggacagcgggatctggaactggagtctatccaccggcagcttcttgagctgcaagggcagttggaacaggccaagctggcccggaagctggcggatgaaatccgcgctccccaggctgggctggtggcactggtgccggtgacgaaaaatgctctggtcgctgcgggacagcggatcatcacgctggaaacgggcgaaagcaaactggaagtgctgttttttgtcccgggtgatctgggaaaacgtatcgagcctggcatgcaggtcagaatttctccaacgacggccccccgcgaggagtatgggatgctgatcggaaaagttgtctccatttctcctcatcccgaagggcaggctgaaatcagcgagcatctaggcaatcctgaactcgcccgcatgatggcaaaggatggaacgccttttgaggtcagggccacgctggagctggctccgtctgaacccgttcctgacgatgatgaggatgaggatgatgtgcggcacaatccttatacctggacatcgacacggggtacgaccatttcactgagcagtggccagatggtggtcgctgatgtcacggttcgtcaggcacctcctatttccctggtgattcctgccttgcgtcgctggaccggcttgtaaaaaggctggaccagatgaacaccgattccagcaatgtgaatgccgaagcagaccaggcaatgccgccccggcttcgtccgacgcgtcatcgtcgcgtgccgaccattctgcagatggaggccgccgaatgcggagcggcttctctggggatgatcctggcctattatggtttatggatacctttggagacgttgagggaagtctgccatgtctccaaggatggcacgtcagcagcttctatattgcgtggtgcgcgccgtctcgggctgaaagcgtcaggatggcgtgtggagccggaggccctggcccagcaccgtctgcctgcgatcgctttctgggagctaaatcacttcgtcgtcgttgaaggggtcaaaaaaaacagcgtcatcatcaacgatccggcctttggacggcgttcgatcgatgctgagagttttgatgccgccttcacgggtgttctgctcacattcgaaccgacggaagcgtttaaacccggtggcatgcgcgtcagcctgttacgggcattgctgccgcgtggcagaagaaccagggcagcactcggttttctggcgatcatcgcggtctgcaatctgctgccaccgatttttctgcccgcggcaggcaagatatttgccgataatgtgctggttcaacatgcgacctcatggttgaggccacttttgctggcgctgctggtgtcggcgctgatgtcttcggtgctgtcatggctgcatgggatggttctgaccaaactccagcggcagatgggcacggaatcggccattcagctcatggggcatctgctgcgtctgccggtcaatttttttgtgcagcgtcatacaggcgatatcgcctgtcgggtggatgcggcacagcatttgtcacacagtgctgtcgtgaccatttcctcagccgttttcagcatcatgggtgccattaccagcgccctgatcatgatgctgtacgatgtgccgatggcactcggatgtttcctgctgtcggctgtcgatcttgtcgcactctatcttgtgacggtgatgcgtgtggatggcgtgcggcgcgcaacacttcagcgcgcacgctatacgactgttgccctggggggtatccagtctatcgaaaccatcaaggcatccgggtccgaaagcgatttttttgcgaaaattgccggtgcacaggctcaacttctcaatatgatgctgagcctcgagcgtctgacggtctatatgacgcttgtgccgcaggtcatcaaaagcctttcttatgccgggctgctcggatggggagccgccaaggttatgggcggcgatatgacgatcgggacgctgattgcgtttctttcggttctgcaagcctttcatacgccggttcagacattggtcggagccattggcggcctgcaggaattgcgtggtgatcttgatcgtgtgcaggataccatgcgtcatgccccggccattgttgaaaaaatcgaaggcaacagtagctggctgagtgaacatggaaggttgtccggccggatcacgctgcatggcatcagcttttcctacagtgccgatcggcctctgatatccgatttcaatctggatatgccatcgggatcatgggttgcgctggtgggcgcatcaggcagcgggaaatcaaccatctccaggattctggccggtcttctgtcgccatccgatggtcgtgtcatgttcgatggggtcgatgccgctgacattccacgacgcgttatcgctggctccgtcagttttgttgaacagaatgtcgttctgtttgaaggcacagtgcgggagaatatcgcattgtgggatccctccctgaatgacgaggcgattgtgggtgctgccaaggatgcctgtatccacgatgatatcggtcggcggaaagggcagtacgaagcggttattgccgaggatggcgcgaatttttcaggtgggcagcgacagcgttttgaactggcacgggcgctggcgaccaatccggctattctgattctggatgaggcgacatctgcgctggataccgcgaccgaattatcggttctggacaatctccgccgcagaggtatcacaatcctgatggtatcacacaggctcagcaccattcgcgactgtgacgagattattgttctggatcatgggcaggttgttcagcgcggcaggcatgaagcgctgatggcggtggatgggccgtatgcagagcttatccgtgtcgaatagcatttcattttaaaccggcagtcccacgatggttcgttttgaagtcaagcagcaggttatttgtgctgaacatcatgcgtacatgatacagggaggggaggccgccctgttctgggaggcttcccatcaggccggaaccagacgctttatcggccggttacaggacggggacgttgtattcggtctttcatcagccgggatacgtttggttatattactggataccggcacatcggctgaaaagaaagcgtcggacattttggccatgcagcccggaatattggcggaggccgtcgatacatggctatatcgccttctgggtggtttaccggatctctcaaatcatgatttcggggatgcggaaccgtggcagccggattccgctggtctgaacgctgatatgcctgccggagagcatcttgttccgttcgggtctgtttttgcgcccccagcggacagggtgctgtggtgccaggtcagggacggtgccattgcaacggcattgcagtctctggagtccccgcataacgcagccttgccgtgtttgagcctgctgccgttcgtgactgaaaaagacagcctgatcgttttcagtaacagtctgacgatggcggtgcacggacatctgcttgcattgctggagatattccatcaggcgctgctggcctgtctgacccggcaggatcaggaaaatcaggatttctttatccgccgcctgtcggtctccgcggatgaggatgccagagtggtttctgaaggattggccgctctgacgcccgggaagcggcccgtaccggtggtagcggagacagatctgccgcttgccgtggctttgaaggccgttgcggaggatatgggtgttgccttgccaccggagttcggccgggtcgtcgagaagataacaggatttgacgaagaaggtatcctgaaggcactggcggcttattgcgggttgagcatacgccgtattcggcttcgtcccgactggtggcgccatcccggcgaaaacatgatcggatattttcaggatggtcagcctgttgcgctgatagcaggcagaaaaaaatggacttccgtgcatgctgatcaggaacagaaaaaatggcagaccgtgacggccgaaatggctgccacggttctttcttatggatacgtggtctataggccctttggtctcaaagataaaaaaccactttatgccatcatccgctttgtcctcagtctggccagacgcgaactgatattggtaggaatcatcagccttctggtcagcctgatgggaatggcttctccgtttttatcgggcatgctggtgcagcaggttatcccggaaggggtaaaaagtgaggttcttcagcttgttctggcaatgctgggggtctcgttggggatggtcagtttcgagcttgtgcgcagccttgccgtgctcagaatggaaacggtgctcagctcgtccatggatatggcattatggaatcatctgctgcggctgcctgcaagctttttccagcgtttcggtgccggtgatctttccatgcgtgcggatgcgatcaatgaaatccaccgcacgatcggtatttccacgattaccattctgatcagtgttattttctcggtttttaatcttgctgttcttttcagctatggcatggcgcctattctgctgacgatcgtgatctgccttgtcgagatagggcttcttttattctcggcgatgttcaatacgaccatgcaacgtcaggctctggcgaacaggggcgccatgcagacgttaacggtgcagatttttcagggcatatcgaaattacgtgtcgccgcggcagaaaaccgttttctggcacgctggatgaagcttttcgcccgggatcaggccattcattatcgggtggatatggtcggcaatgggctggcggcttttggcgtcggctggaacattctggtcatggcggcgctgattgctctggtcggctttggtgccgccaagatgtcatttggtgattatgtcacgtattccggcatttcagggcagtttgtttctgctgtgctgtctctggttggcatcatctcctcgatcatgtcggtggtcccgctatgggaaagaagcttgccgatcctggcagagccgcaggaaaacgccggcgggcgtgtgcagcccggccagttgcacggtgatatcgcactggatcatgtgacctttacctatcccaacgggatggttgcgctgagagatatatcgctcaagatcaaggcggggacttttgttgcgattgtcggcccgtccggctcgggaaaatccactctcatgcgtctgctgctgggtttcgatcagccgggcagcggttccgttctgttcgatgggtatgatctgaaagatctggatacaggcgccgtccggcggcagcttggtgttgtgttgcagcaaagcagaattgaaaccggcagtatttataataatatagccggtgcggtgccgatgagtcatgaagaagcatgggaggccgccagccttgccggactggcagatgatatcgatgccatgccgatgggacttcatacctatgtagatgacagcggccagacattatccggcgggcagaagcagcgtcttctgctggcccgtgccatagcgcgtcatccacggatcatgatgctcgatgaggcaaccagcgcgctggacaatataacccaggcccatgtcatgaacacgctgtccaccctccggatcacacgtgtcgtgattgcgcacaggctgagcacgatcaaggaagcggatgtaatccttgtcttcgcggatggccgtctggttgagcagggcaattaccagtcactgattgcagcgggaggtgttttcgccggactcgcccagcgtcagatggcatgaaacgacgcggccttctgctcagaaatgggtctggccgcgcattctgcccgaacctgtatggctgcatcgctggctccagtcaccagtcgcatcttctataagatgccttgagcagcctgatgtccttgtttttccccttgcaaggcgcgggagcaataggcaacgagggcgcgaacagcatatccatggtgagatcgtgaaatccctgcgccggctccagcatgacctgccggtcgtgaaaactgcgttccgattactctgccttcaggcggacaaacgccacattaccctggcactccagctggaggggttatatccttggcctccctcatctgccacgcggtacggagatcctgttccagttcccgcctagccttttcgctctcctgcgggttgggcaagcgcaaaatgaaggatggatgccaggaaatcaggacggggccgccgtgaagcccctgctccaccatgcctcgtcgccttgtcatggcagcccggttgccggttaatgcaaaagtcgccgaggcgcccagggccagcgtcaaacgcgggcggaccagcgatagctccagatcgagccaccagcggcatgcctctatctcttttcggtccgggctctgatgcagacggtgccgaccacgggggagaaatttgaaatgcttgaccgcattggtcagccagacctccgccgccgccataccgaccttgcccatcaggtcacgcaacacctgcccggccggaccgacaaaaggccgcccctccagatcctcccgatcgcccggctgctcccccacgatcatcaatgaagcaccgacatcgccctcgccccagaccgtccgggtcgctgcctcgcacaaggagcaacgacgacattgcagggccgcctgccgcgcctcatccagagtctcaggcgacacctccgtggcgaccggcatggaggcgcggtaacgggccgaaatcgcggcggcaccgggacgtggcgctgtcgtccccgcctgatgcatgcgctgcacccgcgcctccgcatcggccagcatatccgggatcagccgcgtctccggcaggttgcgccagtatttcttcggcatctccgacctcatcgcagacaatttgatgcgcgctggattaaagatattggcgaaatacgtgtcccacaaagccgccgatgcatcctccggcagattcgggcgaggcatgccggcgccaaaccgcaacgctccctccgtaaaatgcgccgagagatcaggggtggcgatcatccagtccatatccgcaaagcgctggacgaaaaacgggctggcaggctcaagggtatgatgttccggctcgaaccacgccacgaagcggcggcgtgtgtgctctcccgcgatctcccggaaacgcacaaaagcgtgcattttgtgaatgtcacgcttgaccgccgatgccatcagcgtcagcgtacgtcccagcccgtcactcggggacaaggccgcgagatcaccccggctgatcctccataaagcctgatacagcaatccgccgcgatcctgcgcccggtgccagatcaccgtttccgcgaggctgaggaaggcgggcggtacagcaacacggcgcggccccctctccttcggcaggggggtaaggccgaacagggtttccactcctgaccagtcgatatcttccggcggtatatgatggctgattgcaagctgcgccgcttgtcgccatgcagtgaaacacgccgtatcaggcaggtgaaccgtgtaggtcacaacagtttgggctgcttcggagcaggcttgaagcgtgcccgtagcagagcactgtccgtcaagccacgcggattccagccaggcaacacaatgaaaggctgcgcttttttcatcaccgcccccagccgggccacatcctcgaaacgcagccggtgcaggctgcgcgcggcgagaatccgctccaccgtgcgcgcaccgaatcccggtacccgcagcagcatctcccggctggcacgattgacatcgaggggaaaatccgcgcgattccgcagcgcccaggccagcttcgggtccagctccagatcgagatagccgccctgtgtgccggtagcgatttcctctacgctgaacccgtaaaagcgtagcaaccagtccgcctgatacagacgatgctccctcaaaaggggtggtcgcaccagaggcagggccggagacgcatcgggaataggagaaaaggctgaataatacacccgccgcaactgataccccgtgtaaaggcgcgaggaggtagagagaatggccgtatcatcggctccatccgcgcccacaatcatctgggtgctctgccccgccggagcaaaacgcgccgccttccgcccggagagggttttatcctgcgcggcctccccttccagccgcaccagcgccatggcactgcgaatagtctccggccgcttttccggtgccagcgccctgacgctttcatcctgtggaagctcgatattgatcgaaaggcgatccgcccataacccggcctccctgatcaggtccggattggcgtcgggaatggtcttgaggtgaatatacccccgaaatccgtgatccagccgcagggtgcgggcaatccgcaccatctcgaccatcgtatgatcgggggactgaataatgccggaggacagaaacaatccctcgatatagttccggcggaagaattccagcgtcagggtaaccacttcctccaccgagaatcgtgcacgctccacattcgagctgacccggttgatgcagtaggagcagtcgaaaatacagaaattggtcaacaatatcttgagcagggagatacagcgcccatccggggtgtaggcatggcagataccgcgaccaatcgtaggatcagccccttccccgcccgcattgcgccggccgcggccactggatgcgcaggacgcatcatatttcgcggcatccgacaaaatggcgagcttgtcctgcaaggtgatcctggccatggcgatacgctaaatgttcccactttgttcgtcaagtgatcataaaatcgtctaaaacttcaccattactcaacaaaaatggcttatcggggggtggggatagtggcaaacattctatcgatgctaaagaaacgctttaacgcccggagagcagaaaggctgcatcatgtcaggacacgcttgatgaaatatacgcagcccaagcgtgtgggcggacgggccgcatcgacaggatggcatagcgatgcaggcggaccggcctgctcctccctgttatttttccctcatgatgccaggaagtgacggccttgattattttgaccggcggagcaggttttatcggctcaaacatcgcggccgaactgaatgaggcaggccacaccgataccgttatcattgactggctcggcaccgaacgcaaatggcataatatcgccaagcggcgcttcgctgattttgtctttccggaagacgtcgacggctttctggatggtttgaaaggcgccgatgccgttgtgcatatgggggccaattcatcaaccaccgccacagatggtgatgaggtcatccgctccaatttccgcctgtcatgccatctgtggaactggtgcaccgctaccagaacgcccttcatctacgcttcatccgccgcgacctatggcgatggcagtcatggctttgtcgatgacgacagcgatgcggccctcgatgccctgcatccgctcaatctttatggctggtccaaacatgctttcgacaaatgggcgctggaaagggcacgtcgtcatgacgctcccccgcaatgggccggtctgaagtttttcaatgtctacggccccaacgaatatcacaagaaagacatgatgagtctggtggccaaaaatacaccgtccatcctgaatggtcagacgatccgcctgttcaaatcccaccggcccgaattcgcggacggagaacagttgcgtgacttcatctatgtcaaggactgcgcttccgtcgtcagctggctgctccagaaccggcatgtcagcggattgttcaatctgggaaccgggaaagcccgttccttccgggatctgatgatggccgtcggacaggctgccgggaaaacgacatccatcgagttcatcgatatgccagcttccatccgtgatcagtaccagtatttcacagaagcctccatgcacaagcttcgggcggctggttacacacgggatttttatagtctggaagaaggcgtgcgggattatgtgcagacttatctgatcacgcaggatccataccggtaatttcggatattccaagaccgttttttaacgcataaacctgaagatatcagatctatgaccgctgaggccccccaagcaatgaagatcattatcgggctgattgagcacattggtgatattattgcctgtgagcctgtcagccgctatgtccggtttatgtatcctgaagcccatatttcatgggctgtcatcaagccttatcgctcactgattgatcaaaacccgtatattgatgaaaccatcattcttgaatgcctgaccgactggataaaattagcaaaacatcagaattttgatcgcatcatcgatctgcatattaatcacagagtatgcgagcattgccgggttcccctgatcaaggaacatggaaacggttttgttaatacctatgaatggtttgattacggcaacattctggaagctttttccataggcgccgggttgccaaaattatcggctgctcctgtcatttatattgatcaggatgccagagatgccgtcgattcactggctctacccgatgaatactgtgtgattcatcgggattccaatctgccggtcaaagactggtccgcagagaaatgggccgaggtcatgcgctggatacagtccgtcctgggcatgacagtggttgaagtgggtgcccacaagggcgacagaccatctgcatcaccggccagcgtgattgatctgacgaaccggacatccctgctggaaacagccgaaatcatccggcgcgcccgtttcttcgtgggtatcgacagcggtccgtctcatatggcaaatgcctgcggtacacccggtgtcgttttgctgggccatctggggatattcaaacactataatcccttctccggccgctacggaacgaaggtgcgtgatgtcaagcttgtgcggaatctgaatggtcctgtgcaggacattgaagtctctgaagtcaccgaggccattgcctatatcgcgtccatcgatcgcataaccccagttgaaaaatcccccgatccaagcccgtcaagcattagcattcctgtagctgattccactgaacgcgccctgatcctcaaatccggtctgtttgacgctgcctggtacaagctgcattacataccctcagaggcttatgatccgcttgaccattttatcgccattggtggtcataaaggttacaagcccagcccggcttttgactgcgcgcattatctgacggcccatcctgatattggcgcgcatcagaccaacccccttttgcattatctgcactgcggtcaggcagaaggccgcaccatatctgctgatgtgctgcctgagctgaaaacatgggaaaataccgaccacaaggctgaagaagatgctttccgtatcttctcccactctctgccacagatcgcatcatctgaagaagccgttgatatcccccgcctgttcgcattttatctgccgcaatttcatcccatcgctgaaaacaatctcgctcacggtccaggctttactgagtggaccaatgtcatcaaaactgaaccgcttttccgtggccactatcagccacgccagccaggcgaactgggttactatgatcttcgttccgttgatgtcatgcggaagcaggtcgatcttgccctgcaacacggcatttccggattctgtttttattactattattttgccggcaaaaagctgctctacaaaccaattgaaaattatatcaattccgatatctctgctccgtttttctttctctgggccaacgagaactggagcaagcgatgggacggtggcgacaaggaaatcattatcgcgcaggaccattcctctgaagacgatctgatcttcattcgtgaattactgccgcttttccaggatcagcgctacgtcaaggtcagcggcaagccgatcctgatggtctataaagcgcatcttttccctgacatcttccagaccaccgaaatctggcgggaagaggccatcaaacacggctttcccggcctttatctggtcatggttgatgactggaccgatgaagaagttcagccgcgtctgcgcgggtttgatgcaagctatgaaatcccttcgaatgtcgtgccacgcaacgttctgagtgatgaaacagatgagcttggtctaggcgaggatttcgaggggcgaattgttgattatcataaatttgccagctatcacatgggccgccccatgccggaatatcgtcggcatcgcaccgtcatgctgccatgggacaataccccgcgctatggctcccgcgccatggttcatgtcaataccagcaacaatgcctaccggacctggctgacccaggccatgctggatacgcatcgccgccacgttccagaagaacgcattgttttcctgcattcatggaatgaatggtgtgaaggaacttatgtagagccggatggacgttacgggcgtcattatctgaacgaaacacgcgcagccgttcaggatgtacgagatattctctcacttgcttccagcggggaatccgtcaacgcattggctaaattacagcatatcggccacataaaggacgaaggtgcatttcgcgttcttcaagccagccgtatgtatacacactacctttataatgaaattctgcggctgcgtgatcatgcgcacaatcttcagcaagcgctagagcatcatcgtgccatttctcctgatcttgtgcagcaactgaatgaacaggccggcttactggcccatgagctggctctctctcaggaacaatcaacttatctgcaagcagaaattgagagaatgcattcagccctctcctctcagattgaaaatgtcactgctcaactccatactatggtgacatcgacatcctggcgtatcaccgctcccatacgatggatgcggcgcatgctaagacgctgactatgacggagtggtaaaattttcctgcatggtttctggattttgacagcttgcaaaggtactctctgcgcatgaacgagccactggatcataccctgaccgactctgttcaggcgcgttacgggcgactgcattttttcgctcatgacaccggagcattgaaaacatcgcttgagacatatggtgaatgggcggaaaacgaaatccgctttctgaccagctttataagagaaggcgataccgttatcgatgtaggtgcctatatcggcacgcacgtgctggcattttcacacgccacaggcaacaacgggcacgttatcggcattgaagcacaggagcaatcattcaaactgctctgcaacaatgtccttgataataatgtcactcatgtccgtttggaaaatgccattgccggggaggagaaccaggttcgccttatccacgatatagatattgcgcacgatgccagctttggcagcacgtcccttctggaagatttttcagctgccgacaagactgcgccccacatgatagaggcgcgagaaatcaagcttgattcgcttcatttgacaacatgccgactggtcaagatcgatgcagaagggatggagcacattgtactgaagggtgccaccgatcttctgtcacgtctgcggcctgtgatttatgcggagtgcaacgctactgacagcgggcttaaaacacttcatctcctgaaaaaatatggataccagaccttcgcccatgttgtgccggcttttaatcctgagaatttctttggtgtatccaacgatatcttttctggatcatgtgaagttgctctgattggcattcctgacagcctgctcgatacgcttcaagcctatatcctgcatgagaaagagctgatcctgcggattgaaaccgctgatgacctcgctttggccatgctgcataagccacaatatccggttgaaatcctccggtcctgtgcagcagcccatactggcggcactgcatggcttgattattacagtgccctccccgtgcatctggaggctcgcgaacgggatgtcgctttcctttctcaatctttacagaaagaacgcgatgaaaatcaggtcatcgtggctgatgcggcagcgctgcgtctcaaaaatcaggagttagagagagatgtctccctgctgcgggaggccgtcagcgcagaagtagatcagcggaacaaaagtgaggctgatacggcagcactgcgtcttaaaaatcaggaactggagagagatgtctccatccttcgcaaggccgttataaaagagtcagagcaataccaggaagcattactcagagcgcaggaacttgaaagagaaatcccgatcctgcaacaatcggcacggatcgagcgtgaaggacgtcttgctgcggagcggtcagttctgaatcacagtgaagcagcggccaatctacagaccatcgccaatacggaaaggcaattgagacaagaggctgaacacaatctggccaatgccgaagagcaatggagaaaagagcgtgatgctttgtcgggggcacaccaacagctgataaaagagatatccagccttcgttcttcgacatcctggaagatgactgcccccctgagatatgcgatccggcgtctattccggcgtcgataaaacactcaccagaacaggctgttacctgcttccgaacttcgggtggaagcaggttgcccttgaccctgcttaccgaccctcgaccggaaacaaggtccgctccaccaccgcacagagcatatgggccgcggtgatatgaatctgctggataatggccgtctgtggtgatggggccagcagcaggcggtcacacagctcggtcatggcgttacccgcgacgcctgtgaagccgaaggtgatgatccctttctcccgtgcggcatgcaacgcccggatgacgttcggtgagcggcccgaggtgctgattcccagaaacacatcgcccttttgtcccagcccggtgacctgacgctcgaacacatgctcatagccgtaatcattgccgatggcggtcagggctgaactatccgtcgtcaaggccagggcaggcagaggcgcacggtcatacatcaggcgagagacgaactcggcggcaatatgctgtgcatccgcggcactgccaccattgcccgcaatcagcagctttccaccattacgaatggaggtgcagacatcctcccccatgcggatgagggtctcgcgagccgcttcatctgctgcaaaggcatccatggcctcgcaggaggcgtccagaaagcgggtcagaaaatcgcggtgatccaaggcacatacaccttcatgcaggtcaattcgagacccgcaggcgtcatgcagccacgggttggattactctatcaccttgcccgtcacggtgtaagccgtgtgttgccggctgaaacgctccccgccagcaggggcgaaagatgataacaaatttctatctattcatttaagttacaactcatataccgctttgtccattgcggcgcatcatgcggggcagcactttccgcctccgggcagggcatggattccatcttcctctcttgcctcgtccgaaaaaaacagcaggccgatccaaggagccaaagacgtccatgcgctacgcgacgatcaacccctataatggggacgttctgaaacaattctccgaaaccgcggatgcggatgttgcccgggcgatcaccgatgcgcatgcagcctttcagtcctggcgttacgcgccctttacggagcgggccaaggttatgcgcagcgccgccgcaatcttgcggagcgatctggacggctacgcccgcctgctgaccctggaaatggggaagctgttcaccgaagccaagctggaagtcgagttgtcggcgaaaattttcgaatactacgccgacaatgccgaacacctgctgcaaccggagatcctgccggtggctgatccggccgagggcaaggcgatgatcgtgcatgagccgctgggcgtcattctggcgatcgaaccgtggaacttcccctattaccagattgcccgcatcatcgcgccgcagctttcggccgggaacaccgtgctgctgaagcatgcgcagaacgtgccacaatgcgccgaagccttcgaggcgctgatgctgaaggccgggctgccgcgaggagccttcatcaacctgtttgcctcccgcaatcagatcaccaccatcctgaatgatccgcgtgtttgtggcgtggccctcaccgggtccgaacgtgccggcgctgccgtggctgccaccgcaggtgcggcgctgaaaaaatccatgatggagttgggcggtgcggatgccttcatcgtgctggaagatgccgatctgaaaaaaactatcgactgggccgtgttcggtcgccactggaatgccggccaggtctgcgtatcctccaagcgtatgatcgttgtggacaaggtctatgaccagttcatggaaggctatgtgaagggggtagcggccctgcgtgcgggcgatccgtttgatcccgaaaccacgctggcccccctctcctcccaggccgctgccgatggcttgaagcagcagattcgtgatgccgttgcccagggtgccaaagccaccgaagtgggtgctccggttccaaaccagggggctttcgtgcagccgacaatcctgaccgacattgatggagacaatccggcacgccattgggaattcttcggtcccgtctccatgatctttcgggcgaaagatgaggacgatgccgtccgcatcgccaatgataccccgtatggtctgggcggatcggtctttaccgccgatgaggagcgtggcaagcgcgtggcccgccggattgagaccgggatggtattcatcaatcacccgaccatggtgaaggctgaccttccttttggcggcgtcaagaactccggctatggccgcgagttgatcggtctggggatcaaggaattcgtgaaccacaagctgattgatgtcgtcgatatagacgcgccgttctgagaaagaccggcttcctcttcctcctggcaggaggcaaaaaaacaggcgctccggggttacatccggggcgcctgtttcattatctgtgtgcggttcaggctgatcaggcggactgcgcctcaggctccacctcggcagcggaactgacatacggcccagcggcgagaatctggatcgccagcatacccatacccccctgcgaccggcgatccagcttcaacacggcattgcccgcagtccagcggcccgcctcggccccatcccatgcattccagccttcattggccagagtgacgttgattgcctgtgcggaaccggcatcgaacagcacggcctcgccaaccaggacacccagagtgcgacgatcatcgacaaacgggccgaacacatcgcaggggcggctggcgcgcgataggatccgcacggtttcaacgccggccgggatcataaacacgaccctgtcattggtttcccgcaccttacgcaggatctggcctgcgtcgctcaccagatgcagatcagcatctgaggtcagctctggtgccgcagtccgactgcccggcatgattgtctcagcccgtgcggtaagcgcgcggaaaatcggctcgaccacttcccggcttacagccaacggagcggcggcatcatgctgccagctacgtgcattgccttgcccgatagacacgacattgccgtcagccgtgccgaaacggatgcggttaccagtgtcgagatagctttccgtcagggtaccctccgccctgatgacggcatggccatcagtttcgatatgataatattggtaatcagtgatggaccgatcatagataatggagctgccattgaccaacatgcgtaccggtatgaatttcccatccagaaacaggcaatgctccggggtgatcagcagatcacgggaaggcaccccatcagccagcgcatctttcagcacccgcaccggataaccggccatatcatccggcaagccgacacgcgccgccgcactggcatggccagcccaggtcacttcggctgcatgctgcacaccatcccggaaggcaagcacacgatcacccgccctgagttcctccaccgggcgttctccatccggtgtgctgatcatggaaccagccaggaaacagacaccaataaaggtgtttccgcccacataggctatgaccagtggattattgccgctgtttgtatagtacgtaccggcattgagcgtgacacctgctgcgagattggccgtatagtgaccgatctgctgtccgttatcaccgtacaaagtaatagtacgggcggaaccggatgcgctgatcgtataagaattgacatgcgcaatggtattctggaattcgatcgtatcttttaatggattgtaattgttgatggaggtgctggacaaattgatcgctgctccaccagcattgacaatcagggtgccaccgccattcccgaaattgactgtgctgttgttcagcacagacgcaaaggcagtgccgttggaaaatacaccgccattcgtaatgttaacggttgatccgctcagtagacctgccacattgccattcgtcaggcttgccgctccgccatcgacattgagcgtcagaccactcaagcctgaagccagaacgttaatgtttgctgtgccaccaacatagaaagtgttattgttcagcgttgccaggctggcggcaatcgtgattgtgcccgatgcgcccggcaccaccacatagcttgaaccaaacagaacagacgccagactgaaggaaaatccatttccggtcagaacatgatccggggccactgttcccagatgagtggtggtcccgtccggatccgtgatgacgacattgtatcctgtcaggatcccgaaaagcccccgcaccggagtgacggaataaacgacgcctgagttcgttgtgtagtctgtcatgggcttacctatgcatggaacgagggaacgggaaagccagatggcctaacctgctttaaatcacccttgtttcataatgtatatatttatattattcaacgaatactttattatttttgataaactactcatttaatcagaatttttactttcaactttttgttgataaaataaagtttattatatcaccaaaaatcaacgcatggtttcttccagaatggattgcagccgctgctgataggcctcctgggagtgatcctgtagaatacgcgcataggctccgttacggatgctgttccacaaggtctcatcccggtacagcgccagaatgcgatccgcgaaacgttgccgctcatcatcgccgccatccgcaatttccactccatctgaccagccgagctggcggcacagcaaagaactggcgacaaccggaattccgtaagaagcggcctcatgaaccttgtatgggataccggcggcaaatcttgtcggggccacgaaaacacgatgacggttataaaggggtgccagatcatcgaccggccccatgaaattgacgctgggcaggctggcaacgggccctgtatccgtgccgggcgccacatgcccgacaagagtgattttaagatgccgccccatcctgtcctgaacaatcggcatgatcgcatgcaggaaccagagcaggctgtcataattcggtgacattgtcccatgcaacgcgccaacaaacaggagatccctgcgctcctcgtaacccggcgtttcaccacgctgcggcacgtaatgcccgagcgtatcaatggtcgaatatccggccttgcggataatctccgcatcaatatcgttcacggcgatgatccgctgagcgaaacgtgcgcagtccagctccatctccactgtcgggacgtccttgatactctgcccggtcaactggcgatgggcgatttcacggggtgccaccacggcctcggtatccagcacaatcgtactgcctgaaacgctggaggcagcagagtccagaaccggtgccaacaggcgcagattatgtgtacgggcaatccagagaatgtcgtacatccccggtctgctgctcagaaaatctgcaaaccggtcgaaacggcgatcatgcatgacttcgacacggtccggaaaatccgtccgccagtcgagcgccaacgtcgcgtcagggtgcagaggaaacaccgtgacggcatgaccaagctcatccatagcccggataatatcattggtccggacataaccggaccccagataccgcatcggcatccgatcctcgaccagcagaatacgcagttgccgccgtctggcactgcgggcgcgatgaaagcccgtttcgctgaaaccatgatggaatctcagcacatcacgatgctgacggcagaaaatatcccgcgcctgcccgatggagcgcgcagcccatcctgcgctggatgatccgtattcataatggtgaatgacgaccgacggatcgtacagcgtgacatagccgcgttttttcagacgcaggcagagatcggtatcctcataataggccggacgatagaccggatcgaagccacccagcgcctgcacctgctccgtgcgggtcaacagaaaggcagccgagcagaaatccacttcccgcacgaaattggcttccggtgcatcaaccggataatcacgcgcatatccatgggtgcgcccgtcccgccagacaatgcaacccgcctcctgcaacaagccattggtgcggataatctttcctccgacagcaccggcctgcggattggccgccagacgctggaccgcccgctccagcgcgagcggccccaacaccacatcgttgttcagatacagcgtatagaggcccaggacatgctccagcccgacattacaaccggcgatatagccgcgattggtggaaaaatggatcaccttcgcgccatggacatagcgttcaatggctgtggtttcatcgcgcgatcctgaatcaaccaggatcacctccaggtcgactttctgtgccgcgagcgaagccagtgtctgcatggtcagatgaaactgattatgcatcacgatgatcacggagacggtcggcggcacgctctcgtcacgggagaaatcaagcccgtgcggcatcagacaggccagcgtgttgcgcgcctgccgggcgaacaggaaccgcgtctggttttcggtcgggactggctcctcttcctgcacaaagccctcgatctgacgggcaatgtggagcgcaaaagaatcacgaataaggttgctggccgtgttcagggttgactgtgcatctgttgacggaagctgcaagccgtgacgcggagggcgcccctcttgaatgccgaattccagaaaatgcatatatccgttgcggaagcgacctccctgcaggaagccgtccagatccgcattgccggaccgatactcctcctccgagaaaaacggatttggattgaaggcatggggcgtgtcattgcccaggtaatgtgccagcggactgacccatcgtccggcagctatttcctctgcgactgcgggatagttttgcagataccattccgcatcgaaataccaggaggagcgcggataatgcccctgcccggccagatcgaacacatcctcgatcaggctgcggtcttcctttttcggcgggacatgggcgggcctgaacatgttccacagatcaggatccagaaacagcccaggctgccgcccttccgccgccccttcgcgcagatagtgatcaaacccgttgacgaaatcccctctgccaaccggcccgtcaaagcgaaacaggtcaggataggtccgctgataccatgcctcatcaaacaaccagttgggagaacggattttatggccgaccctgaaataatgatcgtagccacaggtgaatacaccctcatctatggcattccgcacatcagggttggcattcacataccattgctcgtcaaacaatgcattggggcagaaacctgactgatgaccttcatcgcgataatggtgccagccatccggcttgccatattttactgtgtaccagtcagcatcgaaaaacagccaggaagggattgttgttttcctcggcacacactgcaatgcggcagaagagtcctgatcaatctcgctatggaaaagctcatgaagcatcagtgttgcgtgcccaaaatcatgggtgctcctgcatagtcacagggaacagccccgttctttacagagttaaaaaatcaactttcaaataaacctatggttgaataagaaattttcaacaaacgcagaagctgatcttctcaaaaatgtctctaaaaaaacactctctttatccagactgtttttatcacttcatattctcagcatagtttattgatctgaaattacaccctcaagggagacagagaaaatggttgtttttgtaaaatgagtatttttatgatgggcattggataaaaaaacgcgccgatcaataccggcgcgtttattgtattctcgtttttcaatcagacgttttatgatcgtttttatccccgtatcagtgtcctcaccagatgcaatgcaagaagcagtgcccccactgacaacgtcaccgacgccaccgcataagaagcggcaagaaacactttgccacgctcataaagcagcaccgtttccagagaaaaagcggagaaggtggtgaacccgccgagaatcccggtggtcagaaacagccgccagtgctgcggcaacccggctttgagagcgaatgtctccaccaccgcaccgatcaggaacgagccgagcatattgatgaacaacgtgccgaacggaaattccgtcagcccccagcgcatcgcggtcagattgaccatatgccgcgccataccgccaatcccggcaccgaaaaagacgatcagatagctcatcactcagccccgcttcatcctgttccgtgactttacacagatcatgacagccggccacgctggcgaccgatccgggcgatcagcgtatagaaagacggggtcagcaacagaccgaaaccggtaacacccagcatgcccgcgaacacggtggtgccgagagactgccgcatctccgcccctgccccggtcgcgacgaccagcggcagcacgcccagaataaaggccagcgaggtcatcagaatgggacgcagacgggtacgggcggcatgctcggcagcagcggcaggggtagccccttcatcctcggcctgacgggcgaattcgacgatcaggatggcgtttttcgcagccagaccaaccagcaccacgaaaccgatctgcgccagaatatcgatggccatgccacgccataacaggccggtcaccgccgccagcagacacatcggcacgatcagcaccaccgccagcggcagcttccagctttcatactgtgccgccagcaccagaaacacgaacagcgccgccgcgccgaataccagcagggtcggcgttcccttcatctgctgctgataggcaagctcggtccattccacgccaaacccatgcggcagaacctgctcggccagccgctccatatgcgccagcgccgtgccggaggaaacaccgggggccgcgccgcccatgatctcggccgagggatacaggttatagcgcggcatccggtaaggcgaggtggtatcggcgaagcgcgccactgtgccgatagggaccatatgaccactggcattacgcgccttcagccgtccgatatcatcggaggtacggcggaactgcccatccgcctgcgccaccacctgataggtgcgacccagatagttgaagtcgttgatataggtcgagccaagataaagctgcatcgctccgaacacgtcacccggcgtcatcccgaccttttccgccttctggcggtccatatcggcgtacaccgagggcgtgcccgtgttgaacagcatgaagatcccggccagagccgggtctttccgggctgcggcaaccagttgctgcgttgcctgctccagctccttcgcactaacgccagtgcggtcctgtaccatcagcttgaaaccgccagcctcgccaatgccctccaccggtggcggggcgacggtcaacacgaaagcatccttcaccacggaaagccgccgctgcatgtctttcaggatcaccggcgccgaaagaccttttttctcacgctcgtcgaaatccctcagggtggagaacaccgtcgcggcgttggaggcattggtgctgctggcaatatccagaccggcgaacggcaccgcatgagagacaccgggcgtctccatgatgattttggtgacctccctgaccgcctgcttggtgcgatccagcgaggctccgggaggaagctggatcagagtgaccagatagcttttatcctgatccgggataaagccggtgggcgcacgggagaattgaaagccggtcagcgcgatcagcccggcataagccagcatgaccagccccaccccccgcaacagcaccctcgtcagccggccatagcgatcggacagccagtcgaagccacggttgaacagcgcgaagccccgcgccaccagacgggataagatggtaccccgcggcgtgtgatgatcatgcggacggaacagcaccgcgcataaagccgggctgagcgtcagcgagacaatcgccgaaatgacggtggacgccgcgatggtcaccgcgaactgccggaagaaagctccggtgatgcctgacaggaatgccgacggcacgaacaccgcgcataaggtcagcgcaatggcgatcaatgcgccgccgacctcatccatcgtgcgatgcgcggcttcggaaggagacatgccggcccggaggttacgctccacattctccaccaccacgatggcgtcatcgaccacgatgcctaccgccagcaccagcccgaacaatgacagattgttcagcgtaatgccgaacagggccagcacggtgaacgtaccgatcagcgagaccggaatggcaatcaccggcaccagagaggcgcgccatgtctgaaggaacaggatcaccaccccgaccaccagaagaatggcgatcaggatcgtatcctccacctcatacactgatttggagatgaattcggtggggtcatactgaatggtgtaggcaacgccgggcggaaaatccttcgacaggattttcatcgcctccttcacctcttcatccacggccagtgaattcgcacccggctgagcgtagatcgccagcggaatggcctcaccgagatcgagataagcggccgagctgtaatcctgcgcgcccacttcggcccggccgatatcgcgaatacgaacgatatggccctgccggtcatttttcacgatgatgtcggcaaattcctcggcggtatgcagccgccccagcgtctgcacgttcagttcatacgcttccgcagaaggggttggctgctggttcagcacaccggccgagacctgaatattctgcgcccgcaaggctgaaacgatttcctccgccgtcacatcatgcgccgccgccttgtcgggatcgagccagatgcgcatcgcataatcccggcccccgaaaagctgtacattgcccacccccggcagacgcgccaacacgtccttcacatgcaaggtggcatagttggacagatacagttgatcccgcgactcatccggcgagaccagatgcaccaccagcaggatgctcggtgtcactttctgcacggtcacgcccagacgctgcacctgatccggcagacgcggcagagcctgcgtcacacggttctgcgtcaacacctgcgccatattcagatcagtgccaaggcggaacgtaaccgtcagactgagcttgccatccccggtggactggctgctcatatacagcatgttctccacaccgttgatctgctgctgcaacggcgtcgcgacggactggtccacgacctccgccgaggcgccgggataggaggtggagatctgcactgtcggcggcacgatgtctggatattgctcgaccggcagcgcgaacagggcgccaaggccgatcaaggtgataaaaatgctgacgaccgaggcaaggatcggccggtcaataaaggtatgggtgaagcgcatgatgtctctgcttccccgatcagtgcgtgctggccggaacgctggaaaccgggcgtatctcacccggtttcgccgagaccttcatgcccggctgagcccgcatgagtccatcgatcaccacgcgatcctgcggagaaagaccggagcggatcacgcgcaaaccctgctccagcgggccgatctccacgggcttggggcgcaccgtgccatccgccgtaacggtcatgacgatatggcgggtctgatcctgcatgaccgcggccgccggcaccagcagcaccggcgcaggcggcgtgactgtcaggcgcagccgcgcaaatgcacccggcaccagaaacagatcggcattcggcacggtagcacgggcatgcatggtgccgctgccacgatccatcgcattgtcgatgaaatcgagcctgccatgccgggagacagcaccctcatcacccagcatgatttccacctgatccagcgaggatgatgggccgggcaaagcagcggcgttacctccgtgctgtctggcacgcgcataggcgaggtaatcggactcgctcatatcgaaatccagatagaccggatcaagcgacaccagcgtggccatcaaggtagaggaggcccctcccccccggctgccgttgaccagactgcccacagagaccagatgcgcgccgatccgcccggtgaagggggcgacgacatgggtgaattccagatcgagtttcgcatcacggatagcggctttcgcctgatccagatccgcgagcgcggcattcacatcggccgtgcgctgatccaccgtctgcgcagtcccgaaatcagtgtggcgcaattgctgggcacgccagagctgcactttcgccagcgtcacacgggcctcggcgctttgatactgtgcgttggcctgcgccagtttgatctcgtaagggcgtggatcaatcacgaacagcagatcacccttatggacgatctggccatcggtaaaatgaatctcctgaagctggccgcccacctgagcccgtaattccaccttgtcccgggcggaaaactggccgaggaaccctgcatatcccgccacattccgttgcagcggcgtgctgacgatgacctccggcgcgggcattgccgcaggatgggacgctttgtccgatgaaaaccgcgccagaagaggcgtcaaagcaccctgtttccaggcatagcctcccccggccagcagcagaatcagaaccgccagattgcgccatgtccgtgcttcccgccgccctgtgccgcctgaacccggcctgctgatcccctgtgcctcacctgttcgctgcatcacgtcttccatccccccgaactcggcagatcatcccgaaaatgatgatagaatatcataccgaacgatactatatcggctggtatggtatccgggaaaccggttttcaaccgcggggaggattgtaaacacagcatgggacgtcatcgcgcctttgatgccgactctgccctgctcgccgcgctgcacgttttctggcgcaacgggttcgaaggtgcgtccctgtccgacctcaccgaggccatggggatcacccggcccagcctgtatgccacatacggtaacaaggaagcgctgtttcacaaggcactggataagtacgaggcgctgtatctctcgtttttcgcccatgcgctggaagcaggctctgctcgggatgtcgtatcgcaggtgctgacaggattcgccgatcttcaggccccgcaggatcatccgcccggctgcatggacaccaattgcgctctggtctgctcggaagccgccgagcctatccggcgggagctgatccgccgccgcaaaatggatgaagaccgcctgtgtgagcggctggaacgggcgcgggcggaaggcgatctgccgtcttccgcctgccctgccacactggcccgtttcgtgatgaccgtggcacaaggaatgtcggtgcaggctgcatcaggcgtggatcatgccggcctacgccagattgttcagacggcgttacaggcttttcctgcccattcctgatgccccatccctgatgattggcaaacagcctatgaatcacgccgcttcccgccgccatgccgggaacggatccggcaggtgcaaccagagggagggcgtgaaaggtccggcctcgctttcgcctaccaggcaagcatcgagcgcagcacggatcgcagcttcgtccatctccgcgccgatgaacaccagttcctgccgccggtcaccgaacacatcgtcccacttcgaatccagcatgcgccgccattcttcatgatccggccagcgtgtccgggggatggcggcccaccataaccccattgcctgatgccgcatcaacgccccggcctgactcatttcgcccacccattccgggcgggtcgccagccagaaatgccccttcgcccgcacgacgcccggccaggacgtgttcagaaacgcatggaacttcgccggatgaaacgggcggcgcacgcggtaggtgaagctgcggataccatattcctcggtctccggtttgtgctccgcatagccgtacagctccttgtaccacagcggatgggtctgggccttctcgtaatcgaagcgtccggtcttcagcacgcgatgaagatcaacacggctcatgctggcctcgaccagatcggcctccggattcagggagcggatgatggtgcgggccgccgccagttgctgcggcgtcgcggcatcgattttattgaggatcactacatccgcgaactcgatctgctggaccagaagatcgaccagcgtgcgctcatcttcatcgccgagcgattcaccacgatcccgcaggaaatcggcagaggcataatcattcagcaaattggcggcgtccaccaccgtgaccatcgtatccagccgggcaatgtcaccgaggctgaccccgttctcatcccggaaatcgaaggtcgcggcaacaggcaaaggctcggaaataccggtggattcaatcagcagatagtcgaaccgcccggcctcggccagccgacggacctcaatcagcagatcatcgcgcaaggtgcagcagatgcagccattgctcatctccaccagcgtttcctgtgtgcgggccaccgcgccgccggttccgtcactcgctgtatcggcccggatcagatcggcgtcgatattcacttcgctcatgtcattaacgatcaccgcaacacgtagcccgtcccggttatgcaggacatggttcatcagcgtcgtctttccggctcccagaaagccggaaaggacggtgacaggcaggcggcggtcctgatcgggggaagctggttgatccattccggtggtccctgaagaggagatggggcatacagttatgttataacataacgtttatgatccactgattcaaggcacggcctcccccttgcatcggagaatactttgagctgatggctgtcttataaacttaaagttgttaatttcctgattttattgcgttgaagtttatttcgtgaaaggatcgaatccgttcgagagccgtatcatcttttttcatccctgcctttttatcagcctctatccaaaggaagctgcctcgcatgagcctcaaaaaagatacaggcctacaggggccttcagggcagggctggaaacccttcacatacagctaccggtatggtgacagcgatccgctctcgagtcaggtaacctatacctatcccaaccaggccctgtatctgaccgaaccaggcgacagtacagccatcagctataccgatatccatcagggccagatcggtgactgctacgtcctttcctccatcggggaactggcgatgtggtatcccggcgccattgagcggatgatcaccaggaatgccgatggtaccgagtccgtcacgctctatatgtcggccagtggcactattccccattatggggagaccagctttgtggcgaccacggtcacagtcaccaatacctttctcaactccggggtcaataacggctccagccagaatgtcgtcaacggtaccaaggaaatctggccgcaggttctggaaaaagccattgccactctggggggtggatattcctcgatcgcttatggcggcaatccgaccacaacactgatgatgctgaccgggcagacggcacaggcctattatccctatatgagcgccgaaatgctgcagggccttctggcgacgaaaagcctggtcgtgatggatacgggcacttcatcgctcagctatgggcttgtggggagccatgcctatatgctgaccggcctctcctatataaatggtgaggcttacgttaatctggccaatccgtggggctataacaatccggcgccgatcccggtgtcacagctcgccaatgccggcattgtcgagattgatgtcggccattacgttcccgcagccatcacgaatattctctccatctccggtacggctggcaatcaggcggtcaatgacaatgcctcgctgaacccgtttgcaaatgtgcagatcgcagatacgggtatcaatgagacggaaacagtcaccatcacccaatccgcgttgaacggacgcctgacatctctgggcagcggcagctatgatgcctcaaccggcgtttataaggtgactggctcggtcgacagtgtaaatgcggcgctgcgtaatctggtgttcatacccaatgcacatcaggtgacacccggcagcactgtcaccaccggattcaagatcgacgtcaccgatcaggatggtgtaagcgccagcgacagcagcacctcggtcattaccaccgctgtcaacaatgcgccgatcattacaggactttccagctccagcctgaaaattctggatgttgggcatgtttccccctttgccggcactgtcatctccgagccggatttcgggcaaaccgaaacagccatcgtcacgctgtccaacgccagcaacggctctctctccaatctgtcgggcggtatctatgatgccgcgaagggcatctatcaggtgaccggaacagcggatcaggtttcacaggctctgaaagggctggtgtttaaccccactccccatcatgcggcagctaatacgcaggaaactacaggattgacactgaccgtcacggattccggtggtgccagcacatccgccacgacctccgtggttgcgaccgaaacagcggctaacaagcccttcaacgacagtgtcaatatccgtgccttctccacgcaggtgatatcccagccgattgatgcagccagcaatggcacattcaagctgaacatgctctccacagcggagtttgcatccacggtcagtggagccatcaagatcgacttcaagggttttgcctcacagctcgtgatcgacaatgcctcgacctttggcaacaatgtcggcacggcatcctatacaggcccgctgctgaaagatttcggccggatggaattcattgatattcatggattgtcagcacgcaacctgaaatcagattactccgcaagcaccggcctgttgcagttgaccgcgcaaaacggcgcaaaggcgacgctggatttcgatcccggttctctggggggccggaatttcgcctttttctcagatgggcatggcggaaccctgatcacacgcttctgatctgacagacacgttcttccggcttgaatacagatggaagggatggaaggcagagtaatctgcccttccatcccttttgttctttatgatgccaatgccgttcaatggagttgcgcggcaccgccattcgctgccccgacagttggatcgcgcgccagcagagtaccgagaccggcctccaccgccgccatggccgcggcgtccgttgtgatgccctgtgcatgcagcatggtcggtctggcacgctggcgcaaatactccacccccgccgacagggccgccgcacgggcagaggggtccgttaccggacgaccactggcaactgccgcggcataggcggccccggcagcctgctggatcgtgccactccattcggcattgatattccagcgccgtgccgcccaggccagcacacccggcaccagaacagtcgtggcaatataggcgccgccttgtgccacggcatcaatcaaaggggaccagttcatggatctgtctccgtttatgataaagggggatatgtcaggtaaaggcggccgttgccgcgaccacgcgcatcaggcgccgcatccagcccttgccgaaacgcgaccaatctgacgtggcgcggtaacgttcagcacgcagcctggcgatttcagcatgcaagtcggcctgatcggcaccgttcagagccgccagcgtcaccgggccgatctcgccatcctgacgaacgtctgcagcctgctgcaccatcagggcagcactggctggcccctgattgacggccgcatcgaagaccagtccgccgaccgggccggacatatggccacagcacaaaggccgccagtagcgctgctcataaatcgcggctgcctgttcgcggctcagcccgatcatgtcggctctggtagcctccctccccagccaggtacccagaaccggagcgctgataccgaactgcgtccctaccaagcgccccgcattgaccctgccacccgtccagttgccagcatcggaggcgaggctggtatagcctccctccacgctccggctcatgaccagagccagagcctgttcaaaactcatgagatttttcctgcgttttgtgcgcgctgtgatcaacgccagctcagatgatcgcggacgtaatcaccgcatagcgtccagaccgtgccgatagcgctcacggcgagactgccgctgatgaccaacccgccaatacggctgcgcagatggcggaactcagccaccggaccttccagcgcctcgacccgccgctccacaccgtaaacccgatcgacaatgcgggaggaaccggcacgcagaacgtgcagctcatcccgcaactgatcgaagcgttcttcactccgctcctgcccgcgctgaacatcctgccgcagatcgcgcagcagttccgacaacatttccggttgatggttcatgaagcaccttccttgattgacgttaccggatgatagagggcctgcccctgatccggctgccattcggtggtagcgtcatgggcgggaggctcgatccatattgcccggttgagcaccgtcccggcgggctgcgtggtcccatcctgcgccacacacggagccgtgcagatctgcacgtacgaagcgggcgccgccgcccccagcagcaatgcgatcactgcgattatggccttgcgcatatcactacacctcccgattgaccgggcgcaccaagcccgtattgccgccctgtgattgtagaaccgcctccacctccgcctgcgccgaagcctgcgcctgcgctgccattgccgccatcggtggaggcattgccgcctgccccgcctgcgccaccgatggattcctgaccgggctgtgtacgaaccggaatcatcccgccattgccaccgggcgcgacgcccccaaaaatattccccatcggatagctgtcggctgtaaggccggaagcgccgccggccttgccggcgccattgccatcgaccccgccaccagcagccgcgcccgccgttgaggccatggtaacgccggctccacccccagccgcccccggcgcgccgctgcctccggatgccccgacaccggggctggtcagattgagagcgctttgaccattggtcatgccgccgatgccaaagggatagccctgaccgggtgtcgcaccactggcggggccgccattgatcagaaaactgccactgccaccgctggccgaggctgcggtggagccaccagccggagcgccgccgcctccggcgcggatattgagcgcaccacccacgatattcgtctcaccaccgccgatcccggcagccccggcaccagacggctggccaccacctgcaccgaccaccacggtgagcgatgacgctcccaaggatgcaactcgaacgcccggcatccgggcgtgatatcccggcgagccaccggccccgccgctggtcgccgtgccggatgcggcaacagtgccgttgccaccggatgaacccccgccccatgcctcaatatccagcgtgactgcccatgctggcaccgtatagatgccacctgccgtcatgaccgtgcacacgctggatcgcatgggcggagacgtgaccgtctgggctgaggcgatgcagggcagaaggcaagatgccatcaaaaaaatgcgacgcatcatgtcaccacctcagcgcattgaaagtaaccgggctggcggcaaaggccgtcacggcaccggtcggcacgaaatcgcagcgtatggacgcccccggcacaacctccaccgaagtagcagcgcgggatgagccagtggctccggcaaaatccacccagagcgacacggtattgccggccgggttctgaacgctgcatccgcgtgtgatcgagcctgccgcaaacacggtttgataagacccggctgtgatcgaggatgatgcagcagcagagcctgttgcagagactgccacccccgcgacaggtaaaggtgatgcagatgacagcgcgacgggacgtccggtcgccgcatcaatcatgcctaccacctgggcaccgatactggcggaacatgatgcgtcggcacaataggagggccgcatgccctgcgcctgcgcttgagacataaaaaaaggcgccagaagcgccagatacagccatttcatcttcattttccttatttggctttggcctcaagggccgtgatgcgggtcagtgcattttgcagggctgcggtcagcatcggcaccagcttgctgtaatccacctgctgatagtccggcacctcacaggatgcgtgccactcagtgccgttccagagatcgggattttgctcttttgcagcctgataagtggtttcagccacattttcccatgccaccgtaccatcacgaatcacgacattgtccacatgacgcgttccatcatgctcccctgttaccgcttcagggatcacagcttgcagctcatgcgcgatcacaccggtcacgatgcgatctggatgggagataaatgcaaaattcttgatgtggatattcaggattttttcagcggcagcactttgatcgagatcggtgatactagttttcagacgataatcggatgtggtgttgtattgtaccgacgatccattgctgccgatgctgccgatccactggacgccgctgctggtgcctgccgaaaacgcaataatctggttattggagccattcgtcccgaacgccgctgccggtccgggagcagagtaagcattgaacccggagggcgtcatcgagcagccattggcgccgttattggccggggtaaaatttccgtccgtaggccccgtgcagacatagttatgcgcgtagacccggttggctgtttctatcttcgagctgcaatagaggcttccggaaaaatatccagcccatgtcgcggcaccgccattatcactggcatagaggctggagttgtttccgctacccttggtgacagagagagtgccgacactggcggatgtggcgacatagagaccgccggatgtagaaaacccgccatccagcgcataaatcgtctgcgcggtgacagcaccattcgctttcatattgttggatacgctcaggtcaccgccattgatggtagcaccaccatcaacctggaattttttactgacataggcggagcctgaaaaatatccggcccatgtggccgcaccgctattatcgtccacatagaggctggcagcatttgtgctccctccgcctacatacatcgtcttcttaaatgatgctccgccattggcggtgatgccaccattggcggtgatgccgccggttaccagaagcgatttatcggcggtcatgtcgccaccgacttccagagtagcggatgccaggatcaggccggcgcttgcaacctgtccttgcgtcccacctgtggcgataatgcgcgcattgtagtcggtattggtgccgtctgtatggaaatcaatgtatggtgtcgtggggaccgactgagacccgatctcaagggggccatagatggtcgcaccaccctggaaagccggatttctgatcggagcgaaccagtttgccaacacccctgcggccttgcctgtttccgtctcgctcggcgtgctgccatcaagcccgatgacagaggaaatctgctggtagagccattttattttccagtctctttcctgaaacagaccgttgaacaattccacgctgggtggaatctgtcccagataggaaaagccctgatccgattgtgtatcactcggcggggatgccgttccttgtgatgcccacagactgttgaaacggccaaaaaacgacatgctttttcctgtcagtgttgaggtttaaaaaaaaccaggaccagagaattcaggatgagggaatgatgttatccagcgcgcgcgccatacaacccgatccgaagcccatataactctgctgttgaaatccgaagggtcttgccggatcgtactgcatctgcaccagaccaacgccagccggttttggaaatccggcgatagaacgtgcgaaagcgagatcagaggccgtgatgaatcgtcccacaaccgcggtcaggcttgcgtcaccgttatcctggagcagcgtgctgtctgcattgaacagaacacagaaagcggccctcagatcctcggttgtgccatgtgcgttgttcagcaggattttgagcttcaacaaccgccgatactgatcatccgtcagcattatcgcactggccggacccaccagccgtgactggccgagaatatcgccgatgccatccagttgatctccgcttgcctgatccagcacgcgattattcatcatcgcctgcaaagccgtatccagcgtcgtgcacgccggataaagcgccttgaccaaagactgaagagaaggactggcggaaaactgggccagcatatgctgccacgccaccacgccatgatcgcgcccgaagaccatgttggtggcatcaggcacctgcccgtttcctggatcggcatcggcaatatagaaaacgcgatccgaaacacgggaagcaaagccgttactggtaggaataaaactgctcacccggtttttttccatctgcggagccgaaaaaaccattgaaacagcattgcttccagccgccccgttcacaaccagagaggctgagaccgtattctgcgccgctggaatctgtagactcaccctgatcctcaccagccggcctgaagcattgccggacggaaacgcctgcgtcacattggcagaaccggatgagagtcgcagcgacacgaccggcacagatgcagaggtgccgatcatcaacccccatgcgctgagccaccatgtttcccccgcctgggccgaaaccggatcacctaaactgatttgtgcggaagctgcactgtcaagcgcaggaaaatcgaattgaaggcaggaaaacccattcttcgtcagccggctggtcacgatggaagcataatttccagaccagcttttttgactgtttgtcagcattgaatcaggcagaaagttggtagacgctccctccgtcagtgcgccgagataacttccatcatcggcataggatggtcttagaacattcggtccggcaataacgagttttccatctgccgtgatatagctggcagcactttcccgctttgtaccgaacgcggtattcaactcattttgagcgatcatatgacaatgcccggagcagtctgaaactgcggacgcgcaaaagccggcatgcatgacacataccggattacgacatccgcagatcaggagaaaagagtagaaaaaacttcggctttttcaaaaaggccgaaagagacattcctgctggatcattcaagaaggaatgtttttatgcatcgactttagcagacaataagaaattatcttccccttgtccacctttttattcggtcctccagcactcaagtagcggagggtgggccggagcgtccggaaccgggttgcacaccggaatgagcatgtgttttgaccgaaataccgttaaagaccgcatcctgatcgccggataccgcgcccttgattgtcaagccgcccggcgcattcagtatgagagaaccggaagatgtgaattccacagaggcagagccgaacgcaatcaccatattgtcgggatgggccggagatgtagcctggctgtgcgccagacccggcacggcgatggcatcggtgatgtgggtctgacggaaattatcgacaatatcactgccggcatctttccagttttcaagcgaacgctggcagaaatgcagcatgacgccatcaccggaatgtaatggccaggtgattccgacagggccgaccgagggaaacacgacaggcacatcgacaacacgcggggcttttataatctccgcatccggtgaggttttggacagggaaagctgcacctcggcgcggcgtgtggcggggtcataggacacaatggtgcccggcatggtcgtgttgatgcgatcgcaatgcgaggcaatcaggtttttcagaatctgcttgatgtcttcagacatggtaggaatcctttgttgatatcaataaaatttgaagccgaaccggtctgtctcttcctgacgctttttctcggccgacagggcatttgtcagagaagaaagactttccttcgtttccttgccgaccgtggcagaaaattgtttgagggagacgagattaatcgttgaggtccatgttcccagctcggaattttcgaccggcatcgtatcgccattatgctcgatcgtatcgacacggaatttttcatacctctttccctgcggaagccatacggggtcgcccggattgatatcgggccgcatcagggaatacacctgcaccccttccacaggtccgatactggagacgaggtctttcagatacgggttatcagcgggattcagatcctgtatgatagcggagcttcgcggccccatgaaggttctgtcgatataacggatcagccctgtttccatgctcagaaggacggaagggcgcgtggtggtttcctcctttctggtaacctgaatcgttttgttctgaacggaatattgcaagccgacagaatggcagatgctttcgagcatatctttggccgatccgtaaaagctgaagccgcttttcagacgtctggcaccaatgccctttgccatgtataatgtcattttggcgttcgtggctgcggcctcaatgacatcccggacaggaattcctttttctcctctataacttatcaatgatcgggataaaagatcagagccatcgaagcctatcactgtcacaatagaatctgcatttctttggcctgtttttatggcgtatggagaacctgagaaggccaacgaaaaagggccagattcatagccacaataaacttgtaaatccacagatcttattatatgtcttaatgattcattatttatattatacaaatcaatttttatactatttccagaattattatacattcttttaatatttatttttgcttttatatttgtgattttttttattccttcatcacttataaaaattatttcgcatttcctattgtttaaagaattcattttactaattctccatctgtattgcaagatttacgatctatttcagataaaaacttacctccaaattcctcgccatataatgcccatcctcgacttgatttgattgcaagctctcttctcggtatatgattttttaatatttcttccgttgccatacagacaaaccaatctccttgttcattaacggtaacataagaatgtatcgtagtaacattcggatttcttctctgaagctcatccccaaatgactggattaagcttgcctcttcttccccccgataaagatgatacggaccgggcggcacatcatatttctggcgcagtttttccagaatttccggcgtcagcttgctttctatagcctcgttatgttttcttcgacgctccatctcctcttgcagcgcctgcgacaatttggccaccagcttcgggtcccagtaatctgcgacagcagacccacaggatagaacattgcctaaaagaactgcggcaataacaagggttttgtatttcatcgtctgatacactccattttatgctttcatctccttcgctatcatacagaaagcgcaccataccggcaggcacaatgcgctttctgtatcatgatcggagcaagccgacagattcgtattttctatcttgcaaataagtcattttactacttctccatctgataggcatgctttatcatgtatttcaaacaaaaatttgcctccaaattcatcgtcatataatgtccatcctcgacttgattttattgaaatctcgtttcttggtatatgattttttaatatttcttccgttagtatgcagacaaaccagtctccttgttcattaacagtcatatgagaatatagcgtagaaacatttggatttcttctctgaagctcatccccaaatgactggattaagcttgcctcttcttcccccctataatgatgatacggaccgggcggcacttcatatttctggcgcagtttttccagaatttcaggtttcagcttgctttctatagcctcgttatgttttcttcgacgctccatctcctcttgcagcgcctgcgacaatttggccaccagcttcgggtcccagtaatccgcaacagcagacccacaggataaaacattgcctaaaagaactccggcaataacaagggttttgtatttcatcgtctgatacactccattttatgctttcgtctccttcgctatcatacagaaagcgcaccataccggcaggcacaatgcgctttctgtatcatgatcggagcaagccgacagattcgtactttctatcttgcaaataagtcattttactacttctccatctgataggcatgctttatcatgtatttcaaacaaaaatttgcctccaaattcatcgtcatataatgtccatcctcgacttgattttattgaaatctcgtttcttggtatatgattttttaatatttcttccgttaccatgcagacgaaccaatctccttgttcattaacagtcatatgagaatctgaccaagaaatatttggatttcttctctgaagcttatccccaaatgactggattaagcttgcctcttcttctccccgataaagatgatacggaccgggcggcacgtcatatttctggcgcagtttttccaaaatttcaggtgtcagcttactttctatagcttcgttatgttttcttcgacgctccttctcctcttccagcgcctgcgacaatttggccattacacccgggtcccagtaatctgcgactgcagacccacaggacaaaacattgcctaaaagaaccgcggcaataacaagtgttttgtatttcatcgtctgatacactccattttatgctttcgtctccttcgctatcatacagaaagcgcaccataccggcaggcacaatgcgctttctgtatcatgatcggagcaagccagaagaatggcagatattttcgagcatatctttggccgatccgtaaaagctgagtatattttttttactccatcatcacccataaaaattattttgtatttcctgttgtttaaataattcattttactacttctccatctgatgcgcatgccttatgttgtatttgcatcaaaaattttcctccaaattcatcattatataatgtccatcctcgacttgatttgattgaaatatctggtctgtgtatgtgattttttaatatttcttcagatgctatgcagacaaaccagtctccttgttcattaacagtcatatgagattctaaccaagtaagattcggatttcttctctgaagctcttcccaaaatggctgggtcaatctttccttttcttcccccctataaagatgatacggaccgggcggcacataatatttctggcgcagtttttccagaatttcaggtgtcagcttccgttctatagcctcgttatgttttcttcgacgctccatctcctcttgcagcgcctgcgacaatttggccaccagcttcgggtcccagtaatccgcaacagcagacccacaggatagaacattgcctaaaagaaccgcggcacctgcgatcttcaaatataaagctctcatagtccccccactcccccgtcgcttgttccacggaggatgcagagtttgcatcctcctgtggcataattatgatcctctgatctttgctatttccaattacgaaacatagatgcgtgcggtatcgaaaatcgcgcgctcgcgggcgccgatggagatgttggcctgtgtgtaggctgtgctcgctggcattgttgcggggtcgctggtaacggcaaagctgagcgcgatggaggcaatgccgctgactgttgcgtaaatcgggccgaggaaacgctgcgcaacaacatcctgagcaatatcgagtgcaacaccggtatcattcagggattgctgcacacgcagcagaccatcggcggggaatgtttcctcgcttaatgtcgtgattttgcagttgatccagacatagcgccgcaccggccgcgtgaagccgatgctgtgccattccgtgccgttatgcgcaccggtgctgatctgcacggtctggctgttgaggccgtatgcggtgataccggccggcttcaccgcctgaatctgcgcagcgacggcggcgtcttctccgccctcgacaatgcattcgacactgtgcggtggccgtccgccgttatcgacggaggctgtatcgttttcgatcaccatcgcggcggtgacaccttgcactttctgaagcaggctggcccggatagagggcaacgtcccggcccccagccgatagacaccgcgcgcatagcgtgcccgcaaggctgaatcggtctcatagggtcgccctggcgtggcatcctgaagattgagaatacgtttaaagccggagatcgtgttgctgatcgtggtgatggagtttgcaggggcggtatacggcccgtaatcacgcgcgataaacaaaccgggcgttcccatctccgtcatgatcagcaaagaagatgtggcaacgctgattgttctgcgtccatcggtaacgatacgaagaactgcactgctgccgcttccctgcacactggcattgtatccagcggaggaaacagcagccacgagctgcgccagaatggccgaggcattggccgatgccgcggtgatgctgaaactgacggagttcagcacaagagaataactttgccccgccacagcgctgctgacgccgatagagacatcggccagagtatcagggctgatttccgtatcagccgcgagcagaaaacgcgtcagcccggcctgctgaggggcggctgttccggcgggcaccaatgtgccggcattgccgtacaacacgcaatatacctgcgagcgcgtggcctgaagccgggtgacgcccgtgaatgaaaccgccttgtccagattgctgccgctggcggtggcgggatacatggcgttatagacgccctccgccatttcccacagcgcggcctctctctcggcaaaggtggcgacgatctggccgaggacggtatccggctgggttgcgatctccgccccgaatgcattttgcagggtggtgatgatctccgcgccgatatcgctcatgcggcgcttgatgaagccggacggggtgatgccatagctggtcatgaaacctgttcctttcaggaaacaaacacaaaaaaagccgcatccggtgaaggaggcagctacgaagaaagacggtggatggttggggtggggagctattcaaccaaagtgatcgttgatgtccatgttccaagttctttattgtctacaggcatattattgccatcgtgttcaattgtactgacatgataacgttttttgacgattccaggatgtttgattacaacaggatcacccgggatcaaatcaggccgcatcaatgaataaaccgttaaaccctctactggctcatctgaagaaacaatttgttttacatatggattatcggtcgggttaatacccttcgtaaaaacagacgcctttggacccttggaagcaacttcgacatagcggatcagaccagtttccattgacagcagaatttccggtttaggaaaaggctgacctttcttgttgacctgtacaacattattctggacagagtattcaagtccctcagccttacaggcatcctcaagcatattcttcgatgagccatagaaactatacccatgtttccagctgcgccttccaagaccatccacaatcttcaggcccaaacctgcatcatgcgcagcagtctcaatgatttccctgaccgttacattctcataccctgtgtaactggatcgagaagctgataaaatatcatttccatcaaatgccgtgatggtaatcgtatagtctgcatctttatgagccgtcttaattagatttggcactcccacaaaagccagaaaaagatgagatccatatccagcatatatttccatttttactgattgttttataaacttaacgctagatccttttaggttaaaaattgtcaaactgatgctatttccagagcttgttatggatctctttatattcaaaatgacccttaaatcattaacatcatataaattattttcctctccaaaaaaacgaatccgaatttttctttctgataaattcattccactatttctccatcactattacacgcgttaaacaaataagaccaaaaatttcctgctacttcattagaataaaaaacccatccattgcttgattttatcacttctatataaacaaatactccattttttagaattttttctaacccaatacaagaaaaccaatctccattatcattaattgttacatatcctccagcacgaaaatctggatgttttttcttaatttcatcccaaaattgatctattattatatctgcattttttcctcttaattcgtgatatgggccaggaggtaaggagtattttcttttcatttctttaataaatttaggtgtttgttttctttctatttcttttttctcttctctctctttcaatctttgcacaagcaaatcatgccttaattgttccaatacttttggatcccagacatctgccgacgcgggtattgaggctagcgatgtgcaaaatatcaggaatgcactgcataaatgttttagatttatcattcttgaaacctctttttatcgttcgactactatgccgttttaattagatttggcacgcccacaaaagccagaaaaagatgagatccatatccagcatatatttccatttttactgattgttttataaacttaacgctagatccttttaggttaaaaattgtcaaactgatgctatttccagagcttgttatggatctctttatattcaaaatgacccttaaatcattaacatcatataaattattttcctctccaaaaaaacgaatccgaatttttctttctgataaattcattccactatttctccatcactattacacgcgttaaacaaataagaccaaaaatttcctgctacttcattagagtaaaaaatccattccttgctagattttattgcagaaaaatgaataaaaactccattttttagaattttttctaacccaatacaagaaaaccagtctccattatcattaattgttacatatgccaaaatggtatgaaaatctggatgttttttctgaatttcatcccaaaattgatctattattatatctgcattttttcctcttaattcgtgatatgggccaggaggaactacatattttcttttcatttcctcaataaactcaggtgtttgttttctttctatttcttttgccttttctctctctttcaatctttgcacaagcaaatcatgccttaattgttccaatacttttggatcccagacatctgccgatgcgggcattgaggctagtgatataaaaaatatcagcaatgcactgcataaatgttttagatttatcattcttgaaacctctttttatcgttcgactactataccgattatagacctgacttatagcaggattataatccgggatcgagacaaacacaggcataaaaaaagccgcatccggtgaaggatacggcttacaaaaatcctgatataatcagtgagaaacctatgcggcaggtgtccctgatcgtccggagccgggctgtacaccggtatgagtatgcgtgctggttgaaatattgttgaacaccgcatcctgatcaccggtgaccttccccttgatggtcaatccaccagggagattcagcaccatgccgccggagggggtcatttccatggaggccgagccgaacgcgatcaccatattctccgcatgcgccggctctgtcgcagcgccatgattcaaacccggcacggcaatagcgtcagagatgttgctttgccggaagtcgtcaacaacatcatcgccatgatccagccagttttccaaagatcgctgacagaaatgcagcataactccattccccggatgcaacggccaggtgatcgcaacaccgcccccggtcggaaacaccaccggtacagacaccacgcgcggtgctttcaggacgatcccctccggcgaggttttggacagggaaagctgcaccaccgcccgccgcgttgccggattataggaaacaatcgtccccggcattgtcgtgttgatccgatcgcaatgcgatgcaatcaggtttttaagaatctgcttgatatcaacagtcataatcaaaactccttacaacgatgtttgacaggtgacattcactgccaaatcacttcgccatctgactggcaggcttgtttgtatatttcctcataaaagccatctcccaccacatagctatcaagcaaccaaccggcgttggacataatccaatcatgcttctgaacggctccattattcataattttctgaccagagtaacatataaaccagtttccgctatcgttgactgtaatatttgaagataattccattatatctttgcctattataggtttatttaatttctcataaaagtactcatataaatttttacactctttgcttctgcattcatgatatggacctggcagaacgctgtacttctttcttaattcttccagaagctctggtgtctgattttctgcaatcatctcctgcactttaaggtcctgccggtattgcttctgttgaatcaggttcttcttcttccaaagcgcatattgatgcagcctctctgctttttcctgtttcgttgcaggaacagagatacagcgatgatcgatatcgcaatattccttccgctcgacacattttccgtttcgatcacaaaacatatgccatacaacgtgtgaatcatcatctctgtcgaaagccagagcggaaccacacatcatggccacgcataggaccaccaccagaccggcaagattttgacgtttcattctcatgaccttttcactggaatcccggatcgagccacatggacgcgtcttgcatcccgacacatccatggcagggatagggaggggggatggctgtactttcctccccctccatccgcccgctcatgccccaccgatgccgaacgggatgctgtccgacaccaccccgaaccgggtgcgggcagagaacacgatggacagggtccggctggggcggtccagagtcgtggtcaggctttcgaccgcctccacatccggaaccgacgcaatcgccgctgcaaaaatggactgcaaaacgacccgttgcggctccttgaccagtacattttgcaagtaaggtattccaaaatcgaggtctaaaaaccactctccacgccatgcccggagggtgattccgatctcctgacgcactctggccaacccatcggagagaatcaggtctccattggtcaaaaatacgtcccgagtcgcgtccgcaagaatgatgtcgtagcccatgctaaaacctttcatatgttacgttaaaactctctcccggcttatctcccggtgcccttcccaccggccgaaaccggaggcgaaacagcggtcccggcaggggctgaaaccggggaagaagggggatgaattgcgttttccggggagcagacatgtgtccatgtccacccaaaatcggggtgttgttcgctttccagcagcaacgcgcccgaggatgccatcacgaatcggtccgagtcggacccgctcatcccggccatcccacccttcaatcgggtggtcgaaccgcacatataccactgcgattctccccctttcccgtcccgaaatcgagtcgcatgcccctctgaaatgctgattccacggcccagcctcgcttccagagcagcctcagcctcctgtctcatcgctgccgactcgctgtccggtacgtgctgaacgggttgctgactcacgcgaatcgggggcgcctcagccgtggagagtgctccatgggcgcgggcatgcagctccgcccgctgtacagcccccatattggccaaggcagaggcaggatgaggggccgtatccaggggctgggccatggcacggctcagcatcaaaaccggcatggccagcgcaatgccgcgccggaaaacatcgcggaaacgcaataaactcactctggaagcagggcagaagggacatgctttcggcatagggaacggaccgctggatacagggaaaaacagagatgaggcggagaccgggggaggcagagcggcctgtcggttcctgcctccatcagctgctgttctgcgggcggaaataaggccgaacaaaagcaaaacagtggcgtcaccacggggctttgcgctggatcagccagtgccggagcctctgacacgggtggtgacacgggtggtgacaagggccggaacgcagaaaggggggaggcagccttgcgctccctccccccttctctgtaggctgcattggttggtgcaggccctttctaatattttccggcgctgtttgccaaggatttatggcgacccgtcagtccgcccctgcaagggaggcagccatttcagcggcggagacataaaccagcgatgccccgccttcacccggcagatcgctgcgcccgatgcgttcctgcccattttccagcgcggtatcgggcgggatggcgatgagttctccttgcggcatggcctcggtacggtaacggccgatcaggggggtgttgcccagcacgggcagcccctccaacagggtggtgcgggtggcatcctgaagcccgatggtccagaacccggcctcgctgttccaggacagatgcaggaagaagggctggccatccagcgcggcctccatcacgctgtcattcagatcgggcacggaaatcagctgcatatccggtttcctttacggtcaggccgacaggccgagcgcggttgcaacccgcgtgatcaggctcgggggtggggtggcggattgcgcttttccagcgggaatggcggaggatccggtcttgccgctgacctcggcggcggcattgccgctgaccgccacatcggcctgcacgatgcgtatctgaaggaaatcgagcttgatcttcagggtgcggctttgggattcgccatctttcgtgatcccgcgattgatctcgcaaccggtcatggccatgttcggatagacatgcagcccggtcaccactgtgacaggaagatgggcggtatgcagctcctccagcagcttgacggtatcctccagccgcgaaatcccgcgcaggccgagattccatggccgaaacagcgtggcattggccgaggacacggcccccgtgattgtcagccgcgccgattgcgggatgatgccgtcggaaatcggcatgccctgttccaccggatattgcgtggcgagggagggcagctgatagctctccatactcagcagatccagatgcagcgcccccttggtggcggggacgggagcgggtctggtttggcccgtattggcagcccctcccccgcctttatcaatgggcgcaagagcaatgtgccggggagtcgcctgatattccagataggtctggccggaggcgccaaaaatcagatccagcgtgttcagcatgggggaagccttatgggaaaaatgatcctccgccctgctcccgcaggaaacagggagagggagagatcagggcggagggatcgtactcaggtggcgttgatcagccgggcgcctcctccggtaaggaagaacgagcctcggcaaccggttgacgcagcgcatcgctcagcacggtggccataccggccagcagaccgccatcacgacggatatcgccatgacgcagcaggtcgtgcagcaggaaagccagcacatggctcggcccttccggctcggcccgcagcgtggccagcaatgcctgaccataggccgcccccagcccgcaatcggtcagataatcgccgcttggctccggcgcccaaaagcgcgtgccactgccatcgccggccacccgcacaaagggcagggtgtgcagaccctgcgcaacggcctgatcggccgcagacgcccccagcgccatgcagggcggcgtccatgcagtaaaaggcggctttggctgctggcatggcatcgtgctgttctctgtttcgcctcctgcctcggcagaaagcgatgacggttgttttttcctgtcagtctttatggccatgaacggccccttcttgatcgctgctccggacggttgtggggccgttcgatgcagccagttgcagcatgtcggtcggtgtcatcacccatggcgtgaaaatggccatcggttttttcactttagcgttattttatgaaaataaagcgtatgttttctttttctctttttttatacaatttagccttccgatcttttgtctccgctattggcttgccgggcgaagccgtcagcgctgccttccagactgtcggacacaccctgtgcggcgagggctgcgatggtgtcggcatccccggacggagcagtgatggaaatggagggcgcacccaccgacacattggtgacgtagctgaccgcccctgcggcgcggccaatgctgtcgggttctgccgcaccatgcagtggatcacgcagcaggctgactggcggcagcatgtcacccagcacctgccgcagggcggacagaccgggcaaaggcgcgggtgaaagtgcgagagatgcgacaggagaagccgttggtacagcgggagcctccatggagaagactccttccctgcctgcgttttcccggccgggatcgaggagttctgacgcgcccctttccgcatttccccctcctgcagcacggttttcgacagaagaagaaagcggggacggcagcagtgccgcacgccacgcggtcagaccggacagcaaggaggacgcctcccctgccagggcggcgacaggcccgtgcctgccctgcgcctcggctgagaggccctcatcacctgtcgtggaggatgggaccgccctgtcccgatgctccatgacaggcagcagagaggtcagaagaagcggcaaggacggagcagcggcagctccgtccgagttggtatcagcctcttgcggagaagctttcagcgccatcaccaaattttgaagaatgtcaagtcctgactgcgctgtgttgcctggcccgatgccttcagacatgggggaaagggaggcatcctccggcctcgcggtccatgctcgtatggcgccttgcagcgcgccggtcaggtcgatcgcgcgctctgtccccgcaggctgcgtgggctgcccgtctggcaacaggctcctgaaaaggctgaaggaggcgccggtcgccgaggcttgcgcctcctgcatctcctgccgcagggaagcgcggaaagcagaagccggatcatcgttccccccctgctgtatggagggttgcccggccatcagctccggcgtggcagaaacgggcggaagttgcggcaacaacagagcttccgcctgccgcatgatccgccgggtcagggaagtctcctgtaccgtttcttgcgaagaagacgccggctcaagcgccgacagcatcctgtgcagggggggcctctccatctcggcagaaggaaggctggaaggcgtggcaaactgccccatcatcgccagcgaggcagctggcacaagctgcatcaacgcaccccgcattgtctgcgccatggcaggcagggagagggcctccccacccgcaaccatgctccccgccgctgcggcagggccctgcgcagcggccgggctctgcgcccatgtcagcatggcttgcgacatggactgccccgccgactggatcgccgacagggcaggcatcagcataccggacatcgcatcggcctggctgccggcagcattggatggctgaacacccgaaccgcccagtttcgcagccatggcagcggtgcgttccatttcctcgcgcagacgcgtcgtttcggcacgcgcctcatcgatcccgctgcggtcgaactgaaaccggatcagcgtgaccagttcacgcagaatggccattgccctaactccttcttgccgttccgtctgtccggttacgcgccagctgatcccgcttggccgccgcatgctgctgcgcacgcatgtccagcaatgcgttcagcttcagcaggtcatccagcgtcaccaccccgccgcgcagctcgcccagcgagacatgcccggccagaaggggacgccagatcagtagttccgacctcagttcttcagagagctgtccgccgttcccattgccgttcccattgccgctttgcggttcgtcccattcggcagaacctgtccaatgagggttctgccgcgctcgaaaaaacccgcgtagttgatcctcaccacctccatgcacagctcgatggcctccgatacgtcggagaacaccgaaccggccatggcatgactcagacgacgcgccgtggcggggtcatcccccaccgcgatgcaatcggggtcgagcagaagacgcgcaagtttttccagcgcctctccatccagcccgcgcgagagatcgcgcaggccctgcatgatggcttcctcaccacgcgccgtgtccatcagcgcggcgaagggcgccagcaacacaccctgcaacgagccgagaatacgcagcgcacgaaacggatcgaaccgcttgatgtgataaacctgcgcaccgatcgtgacgctctcgcgtccttcctgaattgatccgccttgcaacatggttttcatgaccttcaggatttacggaaagcggtagcgagctgcggggacaccgccgtaatgctccaggcccgcgttgtgcccttcgcgctgcgctcatgaccggcccggccattgatccagcaggtgccggcggaaaacagcaggccgccccccagatcctcgatcaggatcggcaccggaatgctgccattcgacagacgatccgccgtatacagcgcatcgagatgctcgttgctcgggctgctttgcagcagggtcaatgtgatcttgacccgtggatcaacactgaaactgcgcatgacttccccatccgcaccaacgctggaatcgaagcccgcgctctgttcatcgaccgtaatgaacttgtcactggaaaaaccgctgatcgccacaccaccgatcacgacgtacacattggacggagagtaattatagacattgccagccatgatcatcattcctcaaaaaatggaaatttccgcgctcagattgtgtaggacaacgtgccgttgatctggaccagatgcaccgcaccggccagacgcgcccggaaactgatgtcacgcagcacacggctggctttggtgttggcggagatattggcggatagcggaaccgaaatcgtgtaggaaggaatcgggttgttgttaccatccagctccggcggcgcgatcccgccccggcgcacacccagatcgagtgccgcctggaccttgcttttcaccatcagaatgccctgatcggtatagggaatacggttatcgaccatcatctggaacacgctggtcttgatctcttcctgcaaccagtcgcggaagcggatgacatcgatccactcgccacctgtggtttttccgccctgggtgatggtgacattgcggaagctttcgaacgtattaccgttcttgccacgtacggcgctgctctgtccttcccccagcgtatcggcgctgacaccgggcagcgtgcagttggcccagctttcctgacccggatagagggtgaacatcttcgacatcaccgccgcatccgggaaatcggtggccgctgcggcgtgataaaaacagaaggtgcggaagtaatttccagctttcagccgcgacagcgtatcggtggtcttggtggaatccagcgcatcggtttccgcaatcgctgtgccgaagagtttaccgttggcttcggcccatgcggctgcatccagaatattggccggcgtccggtccggcaggatcaggccgtaccagctattatcgctggtcttcatggccgagagggcggccgtcagtgtttcattctggccgctgccatcccagaagccgatatagatctgtgagatatgcggtgtcacgctgaacgcatccgcggcggcaagataggccggatgcgtggccgtcagaccgtacggagcagccagcagatcactggcagccgtgataatacccgtgcgcggcagagcggtggtgcttttcagcacgatcagcatatcgctgaaactctgcgtattcacggaagcagattgcagcttgatatccaccgtgacgaggcgatcgagattagccatgcggcgtctccatttcgatgttcagggaaagggggactggcgcaccgccccccggtaatgttccggtggcctgaaccttttcgatcaggccgaccacatccgcgccacgcatgacatggccgagcgtcagctccatggctgcccgctcctcccatatcgtttccagcaaagcggagatattgaggacggggccgcaggacagcacggcgatgccatgcagaaaggcattgtcctgcgtggtggagaaacccagtctctgacgcagcgtatccagaatattcagtgcagacgggccgaaaacctgaatttccagcgtgtcctgcatgggtgtttccaccaccatcagcccatccgcattgacggcgccataccatggtcgtgcgatgggtctgcttccttcctcactgcgcagccagcgcagggtggcgtatggaaaagccgggcggggtgcattctgctccgcccagatcagcgcgcagtcgagcatcggctgcacgaaaccgtgcaccgtgccatcatccagcatgatggaactcccttacggttcgagtgaggcgaggtaacggtgatgatccacccgcatcccggcatcccaggattgccgcgcgataatgcgataacggcgcggagcggtgtctccggcagtggtatacagcacgcaatctccgcgctgaccggatgcattcccgatacccagcacggcatcggtataaatccggatcagcgcagtaatcgcctgaccacccggcaagggttgtatctgctccgcatcactgacggaggcaggctgcaccgtggcagagatggtctgtgtcaccggagaggccgggacgaaacggccggcaacatagctgcccgttccttccctcaacaccgtcaaagactggcggaaactggttttcatgcctaatcccccatgctgacgggaaaccggccatcaaccatggtcgagatctgatccagcaaccattcctccggctcaccaccctccagggcgagggcggcggcctccgcacaggcatcggcgatgctgccggcccgtgcatcggtgaaggcgcgcagataagggcgcgcggccgtggcaccggaaccgaactccgccgccacggctgcggcgacctctccggtttgattatcctcacgctctcccacatgctctctggggccgatgcgcaggctcagcccctccagacgggataaagccgtaccgagcgtatccattattccggctccccggtcagaaccgcaccggtcgataaaggacgcagcagcgcctcataccgcgcccggtaattgcctgccgcctcggcttcggcgcccgtcagggcacgcgggagatattcgatctccagctcgccttcccgttcccgccgcagcgcctgccccgccccggcggtcccgctaccggacagggaagaagcacgcaggctcagcagccatgccgcatacagcgccatggcctcctgcctgcgaccgggggagagtgtggcggggcaatgtgtcgccgccacgcccagcgcatccgtcaccgcctgcgccggggcattggcgaattccggtgccagaatagccagcagcaccggagccggataaggcgctgatgcgtcactcatcgcctacaccccatccagatagcggatcgcacccggcttgcggatatcgaccccgccgagacggaaaatccccggtacctcgaaccgcatcggcccgctctgccagggggcgaggaactgaagcggcatcgggatatgcagcttcatcacatccggcgcccggcgatagacgatcatgcggccgacaccggaggctccggcgctttccagaccgggaataccgcgcacagtcagcggcaggccggtggtcagcgtgtagatattggtgcgggcgaggaagctcagcgcggtctcgctggtggcgggaatgcgcgtctgggaaagcttcagccagcgatccaccggcagcagcacggtatcggccatctccacccgcagcgatgcagtctggataccggtcaacgccgcattcacatcgtcgatgatctcatcaacggttttatgcgcccagtccggattgccggaggctccattcgccaccgtgcccgccgtgaccgccggatgggacagcaaaccgctgaacccgcgcgccgcatcgccacgcagcacgatgtcatcgacgaattcttcataggcacggcgtgcggcctcggctttttccgggccgagatcaatgccgtactggcgtgcatgttccagctcggccagatcatagccatagccgattgcagccatggagacggtgacgcgcagcctgtcgcgcacgatatcggcacgcggcacatcctgcgcctgaccgttgaaccattgggcgcggcccaccgtgtcggcggaaacatattccaccacctggatccattccggcgcggtggtatccaccgggatcagggacggatacagaatatcggcatattgaatgcgatagatttcggcttccagcgcggcggcctgactgaccagaaagctcagtccggtctgcgcatcgaaccgggtatgctgaagggagctgttcattcttccagaactttcttgtaaggatcaggacagacgcagacgggccagaccgcccgcaggggcgctggtgtcgaaggtcgcattcggaatggcggtgttattggaggacgccgccgtgatcgccccggcgggggtcagataggcggctgcaccggcgctgacgctggcagcgacacgcacccagatcacacccttgttgagcacggagagcggcgatccggcgggataggtatccaccgcctgccccggcagcgcaggcacggtatgcacggcgagcgcgatccccagaaaccgcgcagccgtcgcggagggcagacgcacgctctgatctttcacgccctgaacaacgggctttccaaaagcgatgtcggtgtcggcaatgcgggtcaggatggtgaccggctcggcattggcctgcatgccctcatacgcatcgggatgacgggcggcgtagctggtttgcagcggcggcatgatcagtgttctcctgcatgggaaggccgcgtggaacgccacgcagcggaaagggtcgccttgtaggtttcgtaggcactcagcggaattttctgacgggatgccgcttcatcccggcgctgtgcgacgctgtactgcgcctgcaccgcgcccgcctgcatccgggcctctgccacacagagatcgaatgcggcttgcagataggcggaggattgtccctccagcaccagcgcatcgccccgcacggcgcggatcacagcaatacgaagctcatcatcggaagcatcatcatggagcgtgacaccaagaccggcagcatcctgttccagatttcgacgggcctgcctgattttttcctgctcaagccgtgctgcatcggcacgggcggcatcacgctccgccgtgaccaccgccagcgccgcatgaagcggacaatccggcgtgcaagcgggcgctgtatcggcacgatccagattcagccgtgcattccctgcgcgcccacgcgggacaatggccacgtgattgacacggataccgcgttgcacggcatcataggcttcgccatccacctcccccggcgtttcatccagatcgaggcgatagccaaccgacaaatcacgcagaccttcatcgacggcagaggtatcgtgaatcactatgtcggcaacaaggttatctccatcctgccgcccctcgctcataaccgcgccaaccaccgtgccggcagcattggcggctgtgatgaggccggatgtcggcggcggatgacccaccgtgatcggacgcccgcggaaactggcgagactgtccgcatggaatacttcttccggcggacgatattcgcgccgctgcgcgcccgtcaccggatcggtgtaagtgaaaatgccggtgcgcgtcagtaccggcgtatcggtgatgaacccgtcatcatcacgatgcgcgcgcggcagcggcaccatgtcatggcgctcggtaatcatgcttgctcctgactataaaattgcgactcagagagtctgtgaagcggtgccggacaaggtttccgcctgcacctgcgcctgcaccctggccaaagcggcctgcgcgtttttcagcgcagcatcggcctgttccgtttcactgggaatccattgcggcgggaaaaataattgccaacctgagggtgcagaggcccgcaatcctctctgctgccatagcaaggacaccagacgttccagtgccgggaccagcacacgccgctgcatcgcctgcaccagcgcgatatacacttcccgatccccttccccggtcgcgttctgaccggcggcggaacgcccgaacagatgcgtcaccggaataccggtgcaggcagcaatggaaatctcgaatgcctcgatctggtcgctgacaccggaaagattgagatcgtgaacctgccactggtccccggcatcaatgaccacggtgttcaacacgttgcgcgccagatcgacccggcgcacacgctcccgcacgctttccagcaagggtgagttcgcggcatcatctgcctccatcgccgcctgacgcagcaggtcgccgaggccggccatcccgaacaccgcctgttgcttgcgttccagcatgccgcgcgacagccgcagcgcatcctgataacgctgaacctcctccagacacccgctcagcaccgagcgtccgcgccagggcagaccgttgctcatgccatgtggcagcggcgcacccggcaggggcagtaaccgcgtttcatgcaccgtgaacatcgtgccgccaccgcgcggtgtcacgcgatacaccatcggctgaccacagcgtgcatcggcgggatcatcgtaaagctgatccaccgtgatttcctcggcgtcgaacacacgtagttcagcaatgccggacagggaagagaggcgcaaaggacgctgtggatcggcctcatcatccgcgaacagcatcacggcggctccgccgaacagacgtgcccagcgcaatgcctccgtcatccgcgccggaacatgcagccgggcgatctccgccgccatggcctgttccgcagccgcgtcaccatcgcacagaacagtaacaccccgtgacagtgcatcttccgccggagcatcgacaatccgtgccgccaatcctccctgaagataggccgataaaaccgtaccagccgcgcgcgtgtcgccaggcatcatcagcgttcccggctgcacagcaccgagcacaccggacagataatcatcgagccgtgtgcccatgattgcatccttgcagaaaataaaaccgatttttaaagataggcgaggaacgatgcgcgcgtgtcccgcccctgcgtcagcgccagaaaagcgcgggacagcgcatccacctggtcgtcatgtctggcggagggaaaccccgccaactcatccagcaatgccgcctgccaggcacccggcagcatatcgacattgcccgcattcacctgcgccgcgaacggcatggcgcgggtggatttatcgccgctctccggcgaggtctcgacgacataaccgccgagcatccgcgccagataagccgcctgtgccttgcctgcctgaccggggtcacgcgggatggaaatccgcaccgacgcaccatcccggctggccgtggcggcgatgatgcgcgtcacatcctccggcccgccacgcagacgcacgatatcgccaatgacaaaacgccccgcggcatcacgacccagccgcgcccccaccgtccagtcgggatcaccggtaccggtctgtcgcgtcgccgccagatcccaggcccgcacccattgcacagaagccggtgccgcaagaatgcaggacagagcagccgttttgaacaacgcaccctctgcagggcgcggctgctgctgatacagcgccgcccagtcccgcatcgcgccaccgcgttcatactccgccttcacgcgctgcaattcaccggcatagccgtaggaatcatctccccacaaccattctcccggtaagcggcccagcggatcattgtcctcggcctgcgccggcagattgacgcgacgccatgacgatccctgacgcagcaacaggcggccgcccagatcatcctcatgccaccgtgtcatgatcaccacgatgcggccacccggtttcatacgggtgcgcagatcagccccgaaccagttccacacacgctcccggcaggcacggctatcggcatcggcccttgatttgacaggatcgtcgatgattgccacatccgcacgccgtccggcaatcgggccgccaataccaacggccttataggccgatccgttctccgcctcccaatcccttgcattttcacgccgcaatccggtaccgagaatggaagcgtaatcacgcagacaggattgcacaccacggctgacatgatcagccagatcggcggtatgggaggcgccgatcacccggatgccagattgcagcgccatcagccatgcaggaaaaatacggctggcataagtcgacttcgccgatcccggcggcatggtgatcaacagacgatcgactgttccatgcgccaccgcctgcaattctttcaacagcagatgatgatgcgcagccggataaagattctgttccgccatgaccaggcgtgcaaactccggaaggctctcccttgctgccagatcgcgcaggcggcgacgcagcgccagttcccgtctgagcgcagtatccgccgcctgcatcgacatatgagataaatcctaggtttttttctgatgggcgcggagggaatccagttccgcctcgatctccgcacggctcatggcctgcgccggatcgcgggagggcgtttccctgaataatcccagcgcccgaccaagctcgaccagagcagcgcgtttatcggcaagcttcacccgcaggccacgtggcgtttcaaccacttcctcgatcgcaaaagcggtatcgtcatcgagtgaggacgatgccttgacccgcaacccgtcctccgaccattccagcacgtcgcgcgcatcataaaatgccagacgcgccagagccgcgactatgttttcctttgtcacaggctggatcattttctttttatctgcttccgtctcctgctgcgcctcatgcgccagagcggcacggatggcagcactgttgagacaacgccttgcccccgcggcaatctgcgccggcgagagatcaggaccatagctgacagcataagcctgctcggcattgccgttcagcgcggcataggccaccacgaatttctgctgccgatctgtaagagaaaagcgtgtcacgccctgatccttcgggtctttccgtccgagcgtgcatacaaaaaaccccgtgttttcacacagggtttgcaaagaccggatttgagggaaaatcttccgaaccggacaaaattccgatttgatataaaaaccctactttatcatcccggtgatcgtcaagctttttttccttttcatcctgaatgaatcacaatatcgcctctttataacgggtttataatcctgccatgtagtcgataatggcctcgatcatctcatccggcagggttttcgcgctaaaccccggcatctgccggcccggccagtcccgcaccgaggccggatcacgaatatagcgatgcagggctggccgctgaaaataggctgtcggattcatgggttttccaagatcaggcccaaccgagccatcccccgcgccattcagccgatggcagggcaaacagaaagcgataaaagctttctgcccctgcttgatccgtgccggtgcatccggtgacaatgccagttgaggccagcgttccagaggtgccgttctgatggccaaatgggtgatgcgatacggccagtattcgctggagacacgctccgcgcctgcaccactccagatgatgtaaaatggcccggcactggctttcttacccggcaaaggcggccatggatattgaggatcctccaccgccagccatggctgcggctgagacgcatcctgtgacgccgctctgatcatctgtaatggcagatcggcgctgaacccgtccgaggctgtggcggtcagcacgccgctatcatccgtcactttccccagcaacgccgcgaggctgacggcacgataacgccgtgtcccgccataactgccatcctgcactgtgacccattgtgcatcagaccgtgccagcaaggcggcagcggacagcgactgtttccggccattggaagaaccgatcaccagcgtctccgccggcgtctctgccgtccgggccgtcatgacgggacacactgccagcatgatgaccatacccgccttccagagcctgcgtctcatccgacctgatcctgtcctcatcgcataaaaaaaccgctccatcccggcggaaaaccggcatggagcgggcaaaacagtaagggaagaaacctgaaaaaactatcagatcaaggctgaggccgcgatcagaaattcacgatcatatccaggttgaaccacagcatgtcattcgtgccgttattcacgacagggaaatagccattggccgcgctgggaactgcggattcattgaacgggttggtgccgttcagcgaacggtcatagcggatttccgggcgcacggtgaacttgccgccccagaacatatgacggttcacgaaatccgggcgataggtcacacccagcgtcaattcgccataggtggtcggcggcgcaagatagtacgggtaaggcttgttgctgatggcacgggtgaaggaggtaaagctggcatattcagcgataatcaggccggtattgtcgcggaacacttcaccacgggcgttgaaggtcaggttcggattgatatcataggccagataggtggtcacgccatacgcatcggcccgcagcagatcgtcatgcagataggtggcatcgaccgtcacggtcgttttctcgttcaccttatagctggcgaggaaatcggcattatactgcatctcgtcattggcacgggggccgacaccggcactggtccacagcccgtcgggtgaagtcaccggatagctgttgtttccctgcgggccgaaatgaccgatcaggtgcatattcagcttgttgtccatcaggttgttccactgaacgccgatggtgcccttgggacggttgttattacccgcattgccgaagctggtggaattacccgcatccacgccgaggatgaaatccatcttgtcggtcagatgtgtcgtcgtcattaccccgatcatttcgaaggggacgatgtaatcagaggcataattgaacgtatagaaaggccgcagcaaggccggcgtgccttccgatcccagcagaccgtacatctggccgacctggatatccacgccgcccttggtaaaccacggcaggtggaaatcaatatgcgcctgcgtcggcacccattgatacagcccggtcagcacgccatccgccataccgatggtgggatcgaagcgggcgtcagagccgtacatcatctcgaacacaaagcccacaccatagcctttgccgacatcctgaatgggatgcgacagattacccatgatctggttcatcgtgaccgtattggcacggtcggcatagaactggccgaaattgcggcccgatttggtccacggattacccgtaatgccggcctgaatggtcagatgcgcctccgtattatcccagtaggaggctttggatttcggcttctgtgcagctgagatcgcctgctgctgctcggccggcatttcgctgatggtggggcgcatttcatcccctttcggttcctccggcacctgggcgcggccttgacccgccagtccgaacagaacggttccgaaacagagtgcagtcgttgcccgccagatcattttcccgttcacggatacaacctttttattgtctatattttcagattttcttccgcctctgtgtccatttgcgaataatcactgacgtttgtcagcaagctgcatcaggatgacagtggcgttaccaaagtttcatggagccaaagcccggttattgaacaaagccgacacaaacttttatttcagcttcgaacagacttattttgacctgttgagaccaattcatcacgtttccggactgttccatacgtgccggaacctgttttaccatcttcatcatgatcccccgctctgcttccttgcctccccccatggacacccgttcaaggggccacgccacggcgaagcatatgtctgccaactacaaagcaactggcatgccataattcctgtcaggtaattttttttcctgatatccgcgtaaacagggccatttcctttcagcaagcgttcacccaggcgaatggcgtgccgtcaggaaatggctatttttttatcatgatgaacaaaggatgacttttattttaagattggcaggcaaaaccgttttggaattgaatcttttcaggccgatgcaggaaagcgtccctctcccttatcgacacccgttaccaaccccattcagtcatatttttttacattccagacagactgtttaagaaatcgacccttatattgaggataacgataaagatacgggagaataaaaatgccagtctttaccagcccagtactttccaacaacaagggcaaaacccatatccgcggcatgataactcatgctgttcttgctaccttcgtgcttctgggtgctgcggcttgcgccggcacgagcaatgacggcttgaacggacagaccgtgatggaagaaaccatggatacgcatgaggccggtttctgtcaggacaagctgatgtggggcccgcagaaacgcccacaaatcaggcatgtctgcgaaaaataaaggatcttctcctcaccggccccgataaaggatgagtgcagcagacagacagagagagaggcgtggtgaagctgatgaagcctcaccgcgcctcctcgggttttgagggggaagcaggttgccgacccgcataatgatcggccagcgcgtccaatgcctcgatcaaccacggccgggcacgtccattgcgcatgtgatgtgcctgttcgtatgctcccagcgttttccaatccaccacgacccaggcgaagaccgcccgcgaccgctccggcaccgcggacaaagcggcacggcagcggcggagtgccagaagctgccgctcagccgggccatgccccggacctgccgaattcgtcacacgtcccagcgccagagaagtcatccggcatccggcggaaataccctgcgcccgcgcatactcatcgcggaaccgctcggcagcgcagaacagggcctgcggcagatcgccacgtgcatgcatcagttgcagcccatcccggcggcgacgcagccggatcgaaggggactgactggcttctcccttctcatccggggtattttcctgttgcagggacagcatcaccgtttccctcaggatacgcggggaaaggtcggacggggcggagagatagctcatgatgtaggtttcctgcgtgataaaggcgttctgaaaggggaagccggatcttcgacccgcgccgcgcgctcctgacgccatgcgttcagcagggtgctgacggcggcgatttcctcgggcgatggcggcttgcgctccgggatcggaggagacgaaaattttccggacgggggcaaagcgcgggagggcggacgatgggcccgccaccatgccgacaacccgttgcgcacatcatcaaagcccggcatctgcatccgccgcggcgcacaggcgacatgttccagactggcttcggtaaaggccgcatccggcatgctcctcagtaaaggagcgtaggcgcggaacgcccgcaaagcctccgccggatcggtcgggtaagtcagctgcgccagcgccgtaaaccagtcgcgccgctccatcaggcgctgatgcgacggcaggggatcagaccgtggaggaaggggcattatgcttcctcccccatggtgcaggccgcatggccgggctgccatgccgcatgctccctcagtaaagcgtcctgacggctgatggctcttttgccgcgccccctgtgggaagggttgtgggaagaggaggaggccgaccgctccgcatcgccacggcaccagatgcgccatgtcgccggccaatcccgccgcagaccggcagaccccgaccgggcctgccagtaatcccggaaccggggcaacacctcctccaccctcaaccccagagaggttgcaaagcgctgctcttcctctcccggttgccaatccggtggcagacggcatccttccggccccctctgatgaggatccacctgatgagggagagagtgatttttttctctctctgtctctatccctgtcccttgcatctgcgcctgcatatccgggggcaaagcgggcggagcatgtttctcccaccgggcacgggcgcggctgcgctgggcaaggcgcatcgcccaggcctgacaggctttttccgccaccaccgcatgatacagccgcccatccgcacaacgctgccagccatgcagcgccatggtccgcagcctcggccagcgattgcccgccccgctcagccgggccagcacacggtcatcatccggcaggctgcccgccgggcgctgggtccagcttttcaggatcagcagcagggcggccttgaactcatccccgctggacagcgccaccatatcgctatccgccagccgctccacatccagcggcatgaaaggcaggccgcggagatcgctttccggcggggtcagggggaggggcaaagctgaggaaagggcttcatgactcatgcgcctaatcctccatcacccggtgttcagggcagcggaaaatgaaccgatcctccgccgatcgtgggaacaacacgccgcaatacaggcatcggcgcggtggcagacccgccttcccctccgcatcggcggacagggaagcaagtgatgaagcgggaggggattgtgactcgaccatgcgcggcattaaaaacttaaggggttaaccccgtcaacaccgaaataactgaaaggggtagttttcaacccctttacgctgtgctacagagacacgtatgagccatccatccgatgcccgatccccgctttccttccccatagagatgacagtgggcgagcggatgcggcatgccagaatccagcgcggatggtctcaggacgcattggcgaaggaggcgggaacctcccagaccacgatcgacaagatcgagcgtaatctgacccagcgctcccgcgccctgccccgtctggcgcaatgcctgggtgtggatctgctgacgctggacccggattacctcggcgattaccaaccgggcacagaggcggaagcgccccctcagtcaccccggaaattgcagggccaggttcgcataccggctcagccgatcccaccgccgatcacggggctttctgtgcgcagcgtaccggttttcggcacggcacagggcggcgcgctgggggcaacgggtctgccggacagtgcgcaggcgctggactgggcgcggcttcccggccccctgaccggcattcccggcctgttcgcgctgtatgtcgagggcgacagtatggagccatgggtggagcatggccatctgatctacatccaccccacccgccccgccgccccgcgagaccacgtcgtcgtggtggtgcaggacggagaatacgatgagccgcgcgcgctggtgaaacgtctggtgcgccgcacggccgggcggctggtgctgcaccagtacaaccccgccggagagatcgagatcgacgcccggaccgtcatgcgcatctaccgggtcatcccctggaacgaggttgccggggtttaaccccgaaacgtcattttaacaccatttggtgttgacgaaacggggttaaaagggttaaacggcgcggcctgttccgctccgtttgaccgaggtttcacgatgcccagctaccccaccagtgtggaggcagaatttcactggttcgatcatcagggtgatcctcagatcacgccgctggagatccatggccgtctcgatcccggcgcatggctcgacgaaaatggtcagtcctgcgcgccgattttcgtcgccacccacatcaccgatgtccacaccggccagcccctgcccatgaccggccccctcgcccgtttcgccgatacgctcactgaagactggagcgatccacggatggatcgcatgctgcggccgtttgaaccaagggaaaagagggtgatggcgtggcggtaggcaggaacaattggagcgtggcgacattcctttcaaatacgttggtcgccatcggcgtatcaaagcggaagatgtttccaagtaccaacgcatacgcgatgaaaaacgcagacaggcattggaggaactggctgaaatggatgcagggctgatttaagatatgtttgccaaccgctttaccgcccggctggatgcctgtactctgaccggcgcgttaaagcgaaatcttctcttgtctctggcagaagagggattttttcgtccctgctggtcacaggatattctcgatgaaacaaagcgcgccattgccggaattattgcaggccatgcccccgaattgaccacgacagaagccgaggatcgtacgcaaagagcatgtaattccataatccatgcttttccagaagccatggtgatggaatacggtcatcttgcaccgcataatcaccaactccctgatccggctgatgcgcatgctattgcggccgccagcataacgccgtcaaccagcatcatatgcaatgtttgaactcacccgcacccacaaatgcacaggcgctgaagaagcctgcaccatgaccggacggccatgatgctggttcaaacctcgtatcggcattcggccggtgtcagaccgagttctttccgagcctgccatctggcttcatcgcaatacaggatggtgtagtctggaagttctgctttcaaggcccgagcgatttccagaccggcttctgtaaagccttccagatcgaacggtgcgcgttcctcgggcggcagaaaatcctcgaaatcgtcggcccaatcctcccacgcctgcaaacgggttgtcaggtcttgggaaatgggcaggtcggcaaggaggatcatctctcccttgctgctccacaggcaatgcgtcagatcaccgcccatgacgatgtatttgtccggcggcagcaccggtgcatccttcatatcctgcggcctcgcttcatggctggcagtattgatcaagaaccatcttggcatggcattacgcggcgtcagactgatcctgcagagagcatgggtcaatccgggtggccaaaacctcttgccggttctcgcaggcatccccacctcaggaatgaaagcacattcatcaatccacttttctggaattctcttccatgccctctatcgccctgcttggtgccaccgggaatgccgggtcgcatattctgaaggaattgtcagatcgcggccatcgcgtgacggcgattgcgcgtaacatctctgcgatccctcccctgcctggcgtcaccgccgtgaccggagacgcagccgataccgcaaccatcgtccctgttctgcatgggcatgatgcggtaatcagcgccctgccattccccaccattgatcccgccctgttgttgcgtgcggtgcgggaggcaggcgtcaaacgctatctggtggtcggcggcgcgggcagtctggaggcagagccgggcgtcaagctgatcgatcaccccgatttcccagccgaatataaattcgaagcctcacacggggtcgcgtttctcgatctgctccgcagttccgccagtgatctggaatggagtttcatctccccctccatcctgttcggcccgggtgggcgcaccggcgtattccgcctcggcggagatcaggtgctgcggcatgaagggggttcctccatctcctatgaggattatgccatcgcattggtggatgagctggaacacccggcccatctccggcagcgctttacggtgggatactgatttcctcacattttcgtgatgccaccgaggcaaagcgggctgcgttgcttctgtcgtgcacatgcctcgccgtggcgggccgatccggctcgtctcctcccctgaacggcaaggtgcggaacacgttgagagatacaggagatcgcgtccatggcccctcccacccgcccctcccgcccggcttcctcttctgcttcggtgcctccgccgccctccggtgggggctgcccgtttctgcacgggctgggcggggagctgcatcagctcgccggagagaacaatccggttttgacgacgcagcagggcattccggtcggcgatgatcagaacacgctgcgtcttgatgcgcgcgggccggcgttgctggaagatttccacttccgcgagaagatgttccatttcgaccatgagcgtatcccggagcgcgtggtgcatgcccgcggctatggcgctcatggcttcttcgagctgaccgaaagcctgagcgatattaccaaagccgatatcttccagcgcaagggcgagaaaacacctcttttcgtgcgcttctccaccgtggcgggtaataaaggatcgcccgatctggcgcgtgatgtgcgtggtttcgcgatcaaattctacacaaaggagggcaactgggatctggtcggcaacaatattccggttttcttcattcaggatgcgatcaagttccccgatctgatccatgccgccaaagaagcccccgatcgcgcctttccgcaggcccagaccgcgcatgacaatttctgggacttcatatccctgatgccggaagcggtgcacatggcgctgtggatcatgtcggatcgcaccattccacgctccttgcgctttatggaggggtttggcgtgcatacgttccgctttgtgaatgcggagggtcattcaacctacgtcaaattccatctgaagccgaagctgggcctgcaatccgtggcgtggaacgaggccgtgaagatcaacggcgccgatccggatttccaccgtcgcgatttatggagcgccctgaacagcggtgatttcccggaatgggaggtgggcgttcagcttttcgatgatgccttcgccgatgccttcccgttcgacgtgctggatgccaccaagctgatcccggaagaagatgtgccggtgcgcatcgtcggccgtctggtgctgacccgtccagtggacaatttcttcgccgagaccgaacaggtcgcattctgcacccagaatgtcgtgccggggatcgacttcacgaatgatcctttgttgcaggggcgtaatttctcctatctggatacgcagttgaagcggctgggtggaccgaacttcacgcatattccgatcaatgcgccccatgtgccggtgcagaatttccagcaggacggccacatggcgatgcgcaaccccaaaggccgcgccaattacgagccgaacagctggggagcggagggagggcctcgcgaagaccctcaacgcggccataccagcttccccgcgcaggaaagcggcgaaaagcgccgtgccaggccggagaaattcgccgatcattacagtcaggcacgccagttctatctcagccagaccccgatcgagcaacggcatatcgcggatgccttcacctttgaactcagcaaggtggagacgccggcaatccgcgagcggatggtcgggcatctgcggctggtggatgaggctctggccgatgcggtggcaggcgggctggggctgaaggctttaccggatgctccgaaaccggcccgggcgccgatcaatgatctgcctccttctgcggcactgagcatcgtggccaatggaccccagcgcttcgagggccgcaaactcggtctcctcgtcagcgacggggcggatgccgcgttgttgtcggcgctgattgaggcggtcgacaaggaaggggcgcaactggaactcattgccccgaccgtcagcggcatcaccgacagcaaaggcgtctcccacaaggcgcaacagcgtgtggagggtggtccctcggttctgtatgacgcggtggctgttcttctttctgccgacggtgcggcgctgctgtcgcaaaaaccggaagcacgggatttcgtcagcgatgcctttgcgcatgcgaagttcatcgctttcacaaaggaagccgaacctttgctggaggccgccgggatcaagcccgctttgcaggataacgggttcgtcagactggaaaaagcggacgatgccgcccgtttcctcaaaacatgcggcgccctgcggttctgggagcgggaagcaaagaagcccgcttgagacagggacgttaaaaaggtgaacaggaagcggctccgggaggggccgcttctttgattgagtatggaaagaaacgttattcttcagtcactttattttggaagcaatcattgttgatctgtaacggaatatttttgatgtagccttctaaactccgttttgtcactctttcccgcagcgaacgacaaccagcagaatgctgtcatcctagacctgataaacaagtcggtcatcgtctgcgagacgccctctcacccttgtcatcgctccaccggtttggtctgttgcacgcagagaagtcattgggaaccataccgaccatgcatgccagcacacgccgctatcgctatcatccgctcctgctgactgtctgcggcatgatggcagcctttaccatggcccggcctgctctggttcgggcggcttcaccaccttcctacacgcctccgcccttgccgtcccctccgccagccgacaccccgaaaacggcacagcagccgaccgattatctcggcctgcccggcccgatcctgctggggaaaaagctttaccatctggtgtggagcgcgcatcccacggccgcttatgtcaagcaggaatacattccggcggacgaaaccatcgctcattacgacagcatgctcctgatcgagcgcatcagcggcccgatgacggtcgagcaatccgtcaatctgatggcccttcagcttcagagccgtaaaacccgcgatccgctcacccggctgacggtggtgaacaatcaggagaccggcaacaccatgctggatttcctcatcagcggagaaaccagggaaggccccatcgtcgagtggaatgcctaccgttatgcgccgctgaccaaggatggcggcgtcgtgctgttcgggctgagccgccgcgcctacggtcaggacgggttggccgcgttcatgagcaaactgtccgacaccagacaggaggggctggatctgctcaccaccaccccgatgccacaaccgcatgaaccgccgcctccgccgccagccccggccaaggggaaagagaaaaaaggctgagcctgccctcctctatgactttcctattccggacaggcgggcatggcatggaaagcctatgcccgcctgaataccgtcgggaaggcgcaggacgcatccgtccccgcgcatgatccatgatggggagccaacacgcatgaccgaacattccttccagaatatccttccttcttcttcctcaccggcagaggttgcgtggttttaagctctcatccgtacaggaaaaggaccagccttagcatgggcagtatcagtcacagcgacaccagacagttcatcgtgggccacgacattcagggacaatgggtcgtgtgcgatcaaagcggagccgtcggaggcattttcaaaaaccgtgactccgcgctcagcttcgccagaagcgaaacgggccatcatcctcacgcggtcttctgcgccccggatcatctggtgatggatttcttcagcacgatcagccacacggccttacgcccgcaaagctgacctcaacgcaccgcctttttccgggaggccgcagaggcaggcagcagaggcaggcagccgcccgggaaatggaacggagacggacgcacttccgcaattgagggaaactgtgcgggcttcggacgccaaagctcgtatcacaacagagcacgccgttgtggaaccaatttttcacaggttcctgcctgtaaagcctcatgtccacaaaggctgaagaaacaacaggcagcatggttatcctgtatcagccaaaatcgcttcggaacaaaaacggtaccccttgcagcgtgatccgagtattgtccgacagagtaaaatgcacattaccggcggtgtccggtcgcatcgtaaagtaggcggcatccacctgctgttcagaaaatccgttgaagaccaggcgatccacccctttctgaaaaccgctgatcgtatcggaaccaccgccacgcccattggtaaaagcaaaaatatcgacagctttcatgctcacactgccagccatcagggcattgccggttcctgcaaacataactgtacctggcgcccaatatccgctgagggttgtattccctgaacctgcctgcagaacattgccttccccatgggatctcaggatatctccatcaccaccgccgaatacagtgctgtttctggtgacatcaatgacgttcgatcctgcactgccggcaaagaaagtgccgttcgtggcaccctcaaccgtgatattaccacttccaccctggatcgtatccctgctgccatttccgccgtagtaagtcagcgtggcaccgctctgaccaaaagccagcatagtaccggcatcacctccatacagctctcccttgctgccggaaccaagcagcaccaagccactgccagagccaccgccggtataaatgaggctgccggccgtaccgaacatggtggaagctccatctgcaccgataatggtattgcttcctcccataccgataaatatcggtgatgattggccgtttgcgaccagaaaccgtgcaccttctccggatccgatcaccgtattgacacctgcatatgcgacaacagtatcggaaccattgctccagagggtattttcctgccctttcatattgacagttgagccgccaaggccggtcatcagaagattatgattggcagacgccacaatcgaatcatgaccttttcctccgaaaatagtggtatagccttcaccatcttcaaagaaagtggcacctctgccgccgatcaggatatctccctgaccgctggcatacagatatccgccaccagaaccactggccagcgtatccgcacctgcgccaccggtaatcgtgttctttccagcaccacccgccagatattgcgataaactcgtattcaattttacataaacgggtgccgtttcgtttttcagcaccacactgattgatgatggggccgtaccgccggcggtaggaagaaacgccagattggtcagtgccgaagacacatcttcaggccgtccagacacaatataggttttgccgtcagcactcagatctccagtgccgagattggcataggttccgccaaaagatgaattcaggctgaactgggccgtcacctgcgtcgcggtagaataaccgtacagcgtgatgtcatttgtaaaaggatgaataccgctggctgtataaacctgcgtaccgccggccccgtcattctgggccagcaatacctgtcctgcaaggctatcactgctaaatttcaaataggcagagcttgttccggcaacaatttttacgacaccggctcggctggtctgtatgacggatgcgctgttcacgtaacgcatgctggcgagatcaatcgcatcatccgccttgaacccgctgatgaccgtgtttgacacgtccacagtctgatcgagaacagccagggttccgctgccgtttcctgtgaatgtcaggctgcctctcagccatcccgcacttcccaacgatatttttccagtaccgctgataacggcattggcgccgatactgttctgcctgatcaccatctgaccaccagcagtcaggactgtgccactggctacaccaccgctatcaacaatctgctgtgccgtatcacccgcaacaacagtgttggtggccaagccatacatgtattgtctgccaccggagttgatctgcgttccgtcagcaagacccgagtacaagatcgtttgcgtacccgcatcaccaatgaccgtgccactgacgcggccaccccaattgacgacctgtgcgccgccattgatcactgtcaggtctgcaataccacccgatgcgactgtcatggcacccgaactgttcagagaggtgctggtaacggctccattcacaatagctgtatcgtactgaatggcagagaggctcccgctctgaccaatcacaagacctgacgaactcacacccgatgagatgctgataagagccatttttattctcttactaagttttatgtagataagcagtcacaggaaccgggttcttatccgaactggctccggctgagtgcggagacgccgacgagcgtgatctgtgtattatccgtcagcgtgaagtgcatattgccggacccgtccacgctctgtgtcgcataggacgcatcagcctgcgcaccggagaacccgttcagcaccagatgatcaacacctgccgtgaaaccgctgatcgtgtcggagcctccaccttgactattggcaaaggcaaaaatatcaaccgcactcccattcgtgctgccgatcatcatatcattgccagtcccagcgaacatcacagtgccatcagcgccgccaccattcagcgtcgtgttgccgcctgccgcctgcaacacattccccgtccccgtcgcggtcagaacgtccccattccctccgccaaacacaaggctgtgtccggcaacagagatctggttcgaacccgcagttccaccaaaatacgtgccgttgatcccgttattaaccatgatgctgccattgccgccctggatcgtgtcggcgccgccaccacccgtgtagaacagtgtcgctccgctctgaccgaaggccagaaggccgccagccgcactcccgaacagattggccgtgctgccggcgcccgtcacgataaaacccccgccagtcccggccgcataggtcaggttgccagccgtgccgaacagcgtcgaggcgccatcaccacccagaatggtgctgacaccacccgcgccaatgaacatcacacccgaagacccgccagagatcgtcgcgttcgagccacccgcaccaatcaccgtgttcgcaccggcagagaccgaaacgtcatccgcgccataactccacagagagttaccgcgcgccttcagatagacggtggaaccaccagtccccgtcatcaccagattgccacctgccgcagcgttgatcgtatcgtgaccacgccccccgaagatcgtcgccgcaccggcaccatcattgaataatgtcgagcctctgcctccaatcagcagatcgcccttgccaaccgcctgcagcacaccaccaccagaaccgctggccagagtatcattgccggaaccgccgataatcgtatccgctgccgcaccaccggccagatactggttcagcgccgtgttcagcttcagcacgaccggagccgtttcgtttttaaggatcaccctcacggaagatggagcagaaccggtggatgcaggctgaaacacaagagtctgcaacgctgacaatatatccgatgccgttccggacacgctgtaactgctgccatccgcgctgaccgtgccactgccgagattcgagaagctacccgcatagccagacccaaatccgaacacagttgacagggttccaccggatgatgtgccggtcaggctgacctgcttcatcaattgggcataccctgtcggtgccggctctggtgtcggtgtcggggtaggttgagcatccgatacataaaggatcgtgctgttatcagtatcctgtcttatctggattgtctggctgctggcaaaattgagcgtgtatgaagaagcatacggattttcaatcagcacccttgccccggattgtttgacgctggtatttttgctgtaaagcagccatgccagatcaatcttgtcatcgcttttaaatccactgatcaccacaccggaaagagaggtacggtcatccataatcttcaaagtaccgctgccgacatcactgaatgtcagagatccgctcagtgtaccgccactgaaaacggtgacggttccttgatcagcaatcaggtcattgaccgctattccttcaacaaactgcataccgcctgagctgatggtcgtattactgaccacactccccgacgaaacaaactgatagccggcagaatgaagagtgacaccggtcgcataaccaccggatgaaacaaactggataccggaatcgttgactatcgtgcctatggcagagccaccggatgaaacaacctgataaccagaagaattaatggttgtcttttctgcaataccaccggcagaaatgtactgcagagcagcggacatcagtatcgtgccggttgcgtatcctcccgacagaacagtctgcagaccgtattgattgactgtcgtcccactggcactgccagaagcggaaacaatctgcgttccaccctggcttatggtggcactggcagcgatccctcccgacatgaccacctgtgttccaccacccagaattgttgtcaggctggcaatgccggaagcagaaatactctgtgttgcactgcgataaatcgtggcactgattgcagtcccgcctgtgagaatggtctcctgaccaccagagttgatgaatgagccgcttgcaacaccaccggaagaaacaatctgcatgccatagacttcatcgctgccggcaacaccaccggagagtacagtctgcgtaccgccagacataatccatgtcgcgttaaggacaccgccatcggcaacagtctgactggcgccagaactgacatagacctgaaatgtactgccaccgccgacaacagtctgaaggccaccggcgctgatattcacgctataggcgacaccaccgccgagcacatcctgacggccgccggacaaaatagaagcaccgtaataatagccccagcccccggaactgccggacgtggtggaaacagcgacctgacgtccatcatgaccaccggataaaacagtctgaaggccaccggccccaatcgtcgtggaagctgtctcacctccggcagagagtatctgctcaccaccggaattgatcattgcactgacagcataacccgcagcaaagacaatctgcgtgccacccgatgaaatcagagctgcgactgctgtgccacccgatgaaaccgcctggctgccaccggccagaatcgtcgtaccacccccgccagacgtcttccccaccaggccagcgacttcatcaatactccgccatccaccatcactaccgccagccagaatgatctgggtaccgccagagctgatggttgcaccatacgcattgccaccgttcacaacctggctgccaccggccagaatcatcgcgccactcagtggattattgccattggaagacacgttggtatcccaccggataccatcccagcctccgttccagacaatctcggttcctccggaactgatgatcgtgccaagcgcactgccaaatgtattggacaggctgatggctgaagaaaccagtccagacacctccagagcaccgccggcgctgatcgttgtgccggtgacacgaccactgaaaaccagctgtgagccaccggaattcaccagcgtcgcggaagccgacgcaccatccagcacaaactgcatgccaccgtttgccagcacagtgcctgttgcggtcgccccggatgagagcaactgggacgccgaaacctgcaaagaaaaatcatgagcggctaccccgctccccagaatctgatacccgccgctgccgaacactgtatcgctgatgattgcgccggaagaaacaaactgccttcctcccgcactcaccaccgtaccggatgccgtgcctcctgaaaacacaacctgtgtgccactggaaaccaggattgtgtctgttgccgtggtgccgacagagacagcctgaaaggccagcgtatcaatcaaaataccgcttgtctgtgccccgctgaccagaatctggataccgtcagtgccgaaaaccgtgtcactgacaaccgcgccagacactaatatctgcttagcgcctgcactcagcgtcgtacgcttggcaacaccgccaaaaccaaccacctgcgtagcatttgcacccgccagcatagtgtcctgtgcggttccgccgctatagacgacttgcgtgcccccaccgctgacaagcgtatcactggcaaggcctccattttcaatgttctgcgttcccccactattgacaagagttccgctggcagtgccaccgctcagcacctccatgactcccggcaggttcagcgtggtgctgatggcggtaccgctgacattcatcaggtcgccttgactgccccctgaagacgttccgatcgtcaagccgcttgaaatcgttccgggaaaaacattgatggtgtcattaattgttacacttaatatttctgttgctcaaggaacgagtagggcagtcgaacggtacggattttttccctaataaacttttttgtgcaatgattttgttgctttctcgttttgattaaaagttttaatatcaaaacgttattccaatattgaaacagaacacaaaaaaagagagctgaccttcatcagctctctttccttgtggtccagcgatttcactcagatcttcatccgaactggctccggctgagtgcggagacaccgacgagcgtgatctgcgtgttatcagtcagcgtaaagtgcatgttgccggccccgtccacgctctgtgtcgcataagacgcatccgcctgcgcaccggagaacccgttcaggatcagacgatcaacccccgccgtaaatccgctgatcgtgtcagagccgccagcctggccattggcaaacgcaaatgcatccacgacagaactgttcgtgctgccgatcatcagcgcattgccagtccccgcaaacatctctgtaccgtttccagcagcaccggtcagcgtctggttcccggttccagccaccagaacgttgccgctccccgtcgaggacagaacatccccattgccaccacccagaaccgtcgcgtctcccgtggccaggatcatgttcgaaccggcagtgccgccaacataaataccgttactgccggagctgacagaaacgcttcctgtgccgccgataatcgtatccgaagaaccatgccctgtataatccagcacagcgccactcgcaccaaacgccagcagaccgggaccagtggtcgaaccaaacaggttgaccgtgccaccagtgccggcaacgaccagatccctgccaccattggctgtatagtcaaccgtgccacccgtaccaaacaccgtcgcgacaccattaccaccgacaacagtgctggcacccgttttctggatgaaagttgtgacattattactgctgatcgtggcataagtcgcgccgccagcaccaacaatcgtgttcgcgcctgccatcactgacaccgtatccgcgcctttactccatgcaacattgccggcagcagacagattgacctgactgccagcactccccgtcacgattgtatctctgccagcagacgcattgatcgtatcacggccctgaccgccccggatcgtcgccgcaccatcaccgtcattgaacagcgtggccccgctgccgcctatcagaagatccccactgcctcttgccttcagaacaccgccgccagacccgctctgaagcgtgtcggcacccgtcccgcccatgatcgtgtcagcctgcgagccacccaccagatactggttcagcgtcgtattcagctgcaacatcagcggcgctgcctcgtttgacagcaccagctttaccgtcgtcgcagaaccgctaccgcccggctggaagacaaggttgtgcaacgccgttgatacttcggtggatgtacccgtcacgctgtaagtcttgccatccgtgctgacttcaccagcaccaagattcgtatagctcccgctgtaagcagcatcaaagccaaaatctgccgtcatgctggaggccgtgccaacaagagacacgctctgtgccggcagaataccgcccgttgcatatagaacagtggaaccattcgtaccctgctttgcaaggaagacacgattgcccggcccgtcattcgcaaagttcaggctgtagctgccattccccgtcacaacgctgatattgttgctgccctgtgtcacatagccctggctgtcatagcccagactgctcagatcaacctgatcgtcactctggaaaccgctgatcacaacaccagagacgacagcgccgttgtcaccgatgacaagcgttccgctgccaacgcccgagaaagtcagggaaccactgagcacaccaccactactgacagtgattgtcccgctaccggcaatcacgtcattcaccgcaacaccgccagcctggatcaactgcccgccaccggaggtcacaaccgtcccgctggcaacgccgccggactggatgctttgcaacgcaccgctaccggtcacgtgtgcattatatgccaggccgctcaaggtctgaagtgttcccagcaacgaggtaccactcgccacaccgcccgcatccacgaactggctgccggagctgaccacagttccaatcgcgataccgcccgaatacacactctcgcttccacccgacactaccgtcccggaggcgataccgccgctgctgatcaattcattgccgccgatcagcaccgtgccgcttgccgtgccgccgctcagatacaaatcaccattggtagtcatccgggtgcccgataccgatgcaccagcctgcacaagcatcctgccattgttcagcagcgtgccaagcgcagagccaccggaagaaacgatcaggtcgctggcctgattctcgatatcgacaccggatacgctggcgccggaagaaacagtcaggttaccacccgacaaaacggcagactgcaccacaccgccgctcagcaggaccatattaccgcccagactgaccaccgtgccgctcgcggcacccccagacgaaaccgtctgcataccaccggaattgatcacagtggtgctggcaataccaccggcggaaataacttgcgtcccaccgcctgataaaacaattcccgtcgttatggccccggaagaaagcgtttgagagccagacccctgcacagaaatgccgctcacaaccacgccgctcagcagaacctgattgccgccagcgctgaaaatggtgttactgatgatggcgccagaagacacaagctgcatgccaccagagctcaatatcgtgcccgaagccgtagcaccggagaaaacagtctgcgtgccaccagacaggaggagtgccgaaaatgcggaaccgccagcctgaacaaactggttcccaccactgctgacaacggtgccactcgcaataccgctatcgaaaacagtctgctcaccggctgagctgatctgcgcactgaccgcactgccggcaacagactggctgccagcactgatcaccgtattacttgcaacgccatccagcagaatgatctggaaaccacccaaaaccgttccactgatgtccagaccggcagactgaataaactggctgccaccagcactcaccatggtgccccttgctacaccgccagaagaaacaaactgccggccaccagataccagaaccgtacccgttgctgttgcacccgaagacagggtttgagtggccacaacctgtatggatgcaccgctgatcgaggcaccgcttagcaaaatctgctggccgcctgtactgaatattgtgccgctgacaaaggcaccactattcacatactgaagaccaccagatgatagcgttgtagaaaaggcggagcctcctcccataatattctgcgaaccacctgcactgacctgtccgccgctgtccagcccaccagaaaaaataaactgtcttcctccagagcttatctgcgtattgctcgccaccccaccagcataaactgcctgtcccgctcccccactgatctgcgtattaagtgtggcgcctcctgaagatacatactggccggcatctgcgttgagatgagtatcctgtgctacccccccagaataaatatactgcccgccagatgtataggcctgggtatcaatagcagtaccacccgaagaaacgatttgagtaccacgagaagcaacctgagttctgctggccacaccgcttgaaagcagatattggtacccaccactgctgatcgtagcagagacagaatatccaccggaaccaacgctttcctgacctcccgaattgatcactgtaccgctggctgttccacctccagataccaccactaaaccgctattattaacagtggtgtcagtaataatcccctgaacagaggcactatcatactgaccagcctgaccgatgatcaaaccggtgcttgttacaccagaagaaaccacaacgttagacattaatttccctttaattgatatttgttgttaagcttactacttcttatagatcaaaaagtcagaaagataactttttaacataagactaaaattctaacagggcattcaatatgacaaatgaagttctaaaaaaaacgctgtagccagaaacggctacagcgtctgatagatcaagcatcaatgatgcttccctgcagtaaagttcagagtcaagtcagatcttcatccgaactggctccgactgagtgcggagacgccgacgagcgtgatctgcgtgttatccgtcagcgtgaagtgcatattgccggacccgtccacgctctgcgtcgcgtaggaagcatccgcctgagcaccggagaaaccgttcagcaccagatgatcaacacctgccgtgaaaccgctgatcgtgtccgagcctccgccttgaccattggcaaaggcaaaaatatcaaccgcactcccattcgtgctgccgatcatcatatcattgccggtccccgtgaacatcacagtaccatcagcaccgccaccattcagcgtcgtgttgccgcctgccgcctgcaacacattccccgtccccgtcgcggtcagaacgtccccattccctccgccaaacacaaggctgtgtccggcaacagagatctggttcgaacccgcagttccaccaaaatacgtgccgttgatcccgttattcaccacgatgctgccattgccgccctggatcgtgtcggcgccgccgccgcccgtgtagaacagtgtcgctccgctctgaccaaaagccagaaggccgccagccgcacccccgaacagattggccgtgctgccggcgcccgtcacgataaagccgccgccagttccggccgcgtaggtcagattgccagccgtgccgaacagcgtcgaggcgccatcaccacccagaatggtgctggcaccaccagcgccaatgaacatcatacccgaagacccgccagagatcgtcgcgttcgagccacccgcaccaatcaccgtgttcgcaccggcaacaaccgcaacattatccgcgccatagctccaaagcgcgttaccctgactgcccagatctacggtggaaccgccagtcccggttacaatcaggttgctgcccgccgcagcgttgatcgtatcgtgaccacgccccccgaagatcgtcgccgcaccggcaccatcattgaataatgtcgagcctctgcctccaatcagcagatcgcccttgccaaccgcctgcagcacaccaccgccagaaccactgaccagagtatccgcaccagaagaaccgccaataatcgtgtccgccgccgcaccacccgccagatactggttcagcgtcgtgttcacctgcaatacaaccggcgctgtttcgcttttcaggatcacctgaacaaaagacggcgcagaactggaagatgaaggctggaacacaagattttgaaaagatctgaatacgtcctgtgtggtgccggtgatcgtgtatgtgctgccatccgcgctgaccgtgccactgccgagattcgagtaagttcctgtataggccgtattgaatccgaatgaagccgtcatggttccactggcggaagcaccactcacactgacctgcttcggcagttgactgtagtcggccacatacagaagggtactgccatccgcatccgccttcgccaaaattgccgccgcattgtcaaaggtcagggcatagtggccatagctgttggccacagtcaccgtattaccggactgcgtaaccgtggtgttgttgctgtactgaagccagtccagatcaatctggtcatcactctggaacccgctgatgactgctccggaaataaccgaacggaaatctgtaatcagcaatgttccactgccggcactgctgaaggtcagtgagccgctcaagctccctcccctcagaataaccgccgaaccatttccggcaatgacatcatccaccgcaacgccggccacagtttgaataccacctgtactgatggttgtgccgctggcaaccccgcccgcgctgatgatttgggtggcatcagaactgactattgtacctgttgcagtgccgcctgaagaaagggtctggattcctgaagcagccagcatcgtgctgacgacagagccacccgacagaacagcctgcaaagcaccagaactgatcaccgtcagacttgcaatgcctccacctgacacaaactgggttccaccatctgcaaccgtcgtgctgacgacagttccaccggacagaactgtctgtagtccgttcgcactaacctgtgtcaggttggcatttccaccagaggaaacaaactgtgttccaccactgaaaattgtcgcgctggtcacggaccctgcagacaggatggtctgggtacctccgctgatgattgcgcttaaagcgcttcctccagacaggacgttctggtttgcattataattgaccgcagcccctacaagcaccgcgccatcatagatgttctggctgccgccatacgtaatcaacacattgctgacaatgccgccggaataaacattctgaatgccattgacggaagcactcatagaactgccgcctgcatagacattctgggtgccggccaccagaatgttggaagcactaccaccggaagaaatattctggatactgccgctgatcagtcccatattgctggtattgccgccagaaaaaatattctggataccactaacagttccgctaactgccattccacccgacgaaatattctggatggcaccactgtcgacagcaacaccatcatcaaggccgccatcataaatcgtctggattccaccgcttgcgatttccgtgctgctggtttctccaccagatgacacgaactgtgttgccccccggctgaccgttacgttaacggcgctgccggctgcatagacagtttgaacaccgccggatttcagcgccgtatcactgaccgtacccccggatgagataatctgggtaccgccattgctgactgtcgccccactatccgttccacctgcatagacagtctcggtaccaccggttctgatgactgtagaagtggccgtacccccattactgattgtcaaggcaccgcctgtgctgatcacagtgccgctcgcattcccaccgttcgagaccacgatgagaccagcactcttgacgatgctgctgataacggtgccctccaccgtagcagaatcatattgtccgccagggatgcccagaacgagatttgtcgatgttatgccagaagcaatatcgataacggacatttatttaccccgcccaagatattaatattaaattaataaaaataataatttcatattaactaacatagatgtttttactataacattcaagtcatgtattaagaaagaaaatatacatatatacatttgaaattaataaactctaaaccagtgctttccacaggtttagggtatgagccaggatcgctcccataaaaaaaggggaaacggacttcttccgttttccctctgctacccactaatcgtttcaggctagccttatccgaactggctccggctgagtgcggtcacgcccgtcagcgtgatctgcgtgttatccgtcagcgtgaaatgcatgttgccggacccatccacgctctgcgtcgcgtaggaagcatccgcctgagcaccggagaacccgttcaggatcaggcgatcaacacccgccgtaaacccgctgatcgtgtcggagcctccaccttgaccattggcaaaggcaaaaatatcaaccgcactcccattcgtgctgccgatcatcatatcattgccggtcccagcgaacatcacagtgccatcagcaccgcccccattcagcgtcgtgttgccgccgccggcctgcaacacattccccgtcccagtcgcggtcagaacgtctccattcccaccaccgaacacaaggctgtgtccggcaacagagatctggttcgaacccgcagttccaccaaaatacgtgccgttgatcccgttattcaccacgatgctgccattaccgccctggatcgtgtcggcaccgccgccacccgtgtagaacagcgtcgcacccttctggccgaaagcctgaagaccaccagccgcactcccgaacagattggccgtgctgccggcgcccgtcacgataaacccgccgccagttccggccgcgtaggtcaggttgccagccgtgccgaacagcgtcgaggcaccatcgccacccagaatggtgctgacaccgccagcgccaatgaacatcacacccgaagacccgccagagatcgtcgcgttcgaaccacccgcaccaatcaccgtgttcgcaccggcaaagaccgcgacattatcagccccatagctccaaagagaattgccctgaccgctcagtgtaacggtcgaacctccctggcctgtcaggatcaggtcatgaccggcagtcgcatggatcgtatcatgaccacggccaccgaagatcgtcgtggaaccagcaccatcatagaacgtcgtcgagcctttgccaccgatcagcagatcaccgctgccaacagcctgcagcacaccaccgccggaaccgctggccagagtatcatgcccagcaccgccaatgatcgtatccgccttcgagccaccagcaagatactggttcagcgtcgtgttcagctgcaatacaaccggagccgcctcgtttgaaagcaccagcttgaccgttgtcggagaactgccaccgctcggctggaagacaaggttgtgcaacgccgtcgatacgtcggtggatgtacccgtcacgctgtaggtcttgccatccgtgctgacttcaccagcaccaagattcgtatagctcccgctgtaaccggcatcaaagccgaaagcagccgtcatgctggaggccgtgccaacaagagacacgctctgtgccggcagaataccgcccgttgcataaagcacagtggaaccattcgcaccctgcttcgcaaggaatatccgattggacggcccgtcattcgcaaaattcaggctgtagctgccattccccgtcacaacgctgatattgttgctgccctgtgtcacatagccctggctgtcatagcccagactgctcagatcaacctgatcgtcactctggaaaccgctgatcacaacaccagagacgacagcgccgttgtcaccgatgacaagcgttccgctgccaacgcccgagaaagtcagggaaccactgagcacaccaccactactgacagtgattgtcccgctaccggcaatcacgtcattcaccgcaacaccgccagcctggatcaactgcccgccaccggaggtcacaaccgtcccgctggcaacgccgccggactggatgctttgcaacgcaccgctaccggtcacgtgtgcattatatgccaggccgctcaaggtctgaagtgttcccagcaacgaggtaccactcgccacaccgcccgcatccacgaactggctgccggagctgaccacagttccaatcgcgataccgcccgaatacacactctcgcttccacccgacactaccgtcccggaggcgataccgccgctgctgatcaattcattgccgccgatcagcaccgtgccgcttgccgtgccgccgctcagatacaaatcaccattggtagtcatccgggtgcccgataccgatgcaccagcctgcacaagcatcctgccattgttcagcagcgtgccaagcgcagagccaccggaagaaacgatcaggtcgctggcctgattctcgatatcgacaccggatacgctggcgccggaagaaacagtcaggttaccacccgacaaaacggcagactgcaccacaccgccgctcagcaggaccatattaccgcccagactgaccaccgtgccgctcgcggcacccccagacgaaacggtctgaacaccgccggaactgacaacagtgctgatcgcggtgccgccagacaacacaagctgcgtgccatcagaggtgaggattgttccagtcgctgtcgcgccaaaggaaacagtctgcgacgcagccacctgaatggaagttccggtcgtggacgcaccgctcagaagaacctgttgaccaccagcactgaacacagtcccgctgacgataccacctgccgacacaaactgcgtgccgccagagacgagcgtcacatttgttgcgctgccaccggacaaaacattctgcttaccgccagaactgaccaccgtgccgctcgcaacaccgctagattcaacaacctgcacaccaccagaactgaccatcgtgccgctcgccacaccaccggacacaacagcctgctgaccaccagaactgaccaccgtgccgctcgcgacaccaccggacacagcatactgccaaccgccagagctgagcagcgtgccgctcgcggcagcgccagacgacacaagctgcgtgccgccagaactgaccaccgtgctgatcgcagtgccgccagacgatacaaactgctcaccgccagaagcgaggatcgttcccgtcgctgtcgcgccagacgaaacagtctgcgatgcagcaacctgaatggatgtcccggtcgtggacgcaccactcagcagaacctgttgaccaccagcactgaacacagtcccgctgacgatgccgccgcccgatacaaactgcgtgccgccagaaaggagcgtcgcattggtcgcgctgccaccggacaaaatattctgcttaccgccggaactgacaatcgcgctgatcgcactaccgctagcgtaaataaccgcagagccgccagcactgacaacagtgccgctcgcgataccgccagaagatacaagctgctgaccaccagaactgacaatcgcgctgatcgcactgccagacataatatactgctgaccgccagaaccaaccgtcgtgcctcttgcgataccaccgtaaactacttctatccccgcgctaagaacggttccagtcgcataccgccagagataatcagctgcctagtgaaatttggtcccggagtcagtgtcgtcgatacagcagaaccaccactggaaattatgatatcgactctgccattctgtccatgagccgaagtattactgatagtccccagaacatccaccgtcgcactgccagggtctccgttcacattcagcccggtggaagtaacacccgcagcaacagtaatgtcagccattggaaatccttgatttagaataaaaaccgtcgacacagactgaagtctttggaaactttattgactcatgtgatccccaaaatgttacgtattttgtaacatttttaatgttatggaacgcgcgaatctcaaaactgctatctcactctaggaaaatagacacaatggttgatttcggccagtttttttcaatttcagataatttataacaaaaaaacattaatttatatctgaaatgaactgtccttcagatcggttggctcacaattacgctcttcatgtctcgattatgggggagaacatgcgcaaggtgacagtttctatcccgggcagagccacggacgcaggcctcggtaacccgtcaaaacaataaaaccctgccgaaaaccggcagggttttatcttaagtcagccaaggaggctgggtatttccaacgcccctttctgtattggcgattgctccggtcaacacctcatccaaactggcttcggctgagcaggatattcggtcaggagacgtttacatcatgcccaaaggctctccgcgcacatgttccccgtacgggcgcaccatctgcacggtaatatggcgcgtcggaaggcggcaggggcgcacggccgcgaatacggtcggcgattttttccgccatcatgatcgtcggagcattcagattgccggtcgtgatcagcggcatgatcgaagcatcaaccacgcgcagcccctccagcccatgcacgcggccctccgcatccaccaccgccgcatcatccgtgcccattttgcaggaacaggacggatgatacgccgtctccgcatggctgcgcacgaaggcgtccagatcggcatcgctcgtcaactccacacccgggctgagttcgcggccacgatattgatccagcgcaggctgggccatgatctcccgcgtgatgcggatggcagcgcggaattcgcgccagtcctgctcatgcgacatgtagttgaacaggatgctcggatagacttccggatcgcgcgatacgatctgcacacggccgcggctgggcgagcgcattgagccgacatgagcctgaaacccgtgcatctgcaccgcattggtgccgttatagctgatcgcgaccggcagaaagtgatactggatgttcggccacgcgaaatcatcatgcgagcggatgaagccgcctgcctcgaaatgattgcttgcgccgaggcccttgccgagaaacatccactccgcgccgatcttcggctgattccaccacagcagcgcaggatagagtgagacaggctccagacactcatactgcatgtacatctccagatgatcctgaagattgctgccgacaccttccataatctgcaccggtgcaatatcgagcgccttcagcacggaagccggaccaacacccgagcgttgcaaaatcgccggagacgcaatcgcgccgccacacagcagaacctcctgccttgcataagcgattttgctttctccgccatgcaggaacgctaccccgatggcgcgcttgcctgcgaacaggatgcggtcggtcaacgcatgggtcaggatggtcagattcttccgcttccgcgcctgatccagataaccccgcgccgtggaggcacggcggccctgtttcgtgaccgtgcgatccatcggtccgaaaccttcctgctgatagccgttcagatcatcagtgcgcggatagcccgcctgcacgccggcttccaccattgcctcgaacagcgggtttgctccgccgcccggtctgccgagcttcgatgtgatgacggataccgggccatcgccgccatgatagtcattggggccgatatcccgcgtctcggccttgcggaaatagggcaggcaatgagcgtagctccattcctccagcccgtcccgttccgcccagccatcgtaatccatcgcgttgccgcgaatatagcacatgccgttgatcagtgaggaaccacccagtcccttgccacgcccgcattccatgcggcggttattcatgaacggctccggctccgtctcgaacgcccagttatagcggcgcccctgcagcggataggccagcgccgccggcatctgggtacggaagtcgaagcggtaatccgggccgcctgcctccagcagcagaacgcgcgttccggcatcctcggtcaggcgggtggccagcacattgcccgccgagcctgcgccgatcacgatgtaatcgtattcctgcaaattgctcatcgcgctgtcctgcccttttcaaaaaacagactggaaaccgccgagttcaaccagcaccgatttgatgcgggtataatggcccagcgtcatcagcccgttctcccgcccgacgccggattgtttataaccgccgaccggcatctcggccggggagccgccccatgtgttgatccagcagatgcccgcctccagccggtgaatgacgcgatgcgcccggctgagcgattccgtcaccacaccggccgccagaccgtattcggtggcgttggcgcgggtaatcacctcctcctcatcgcggaaagacagcaggctcagcaccgggccgaaaatctcctcccgcacgatggacatgtcgtcccggcaatctccgaacacggtgggcaacacgtaggccccgcgggagaattccgcctcctgcggggctcctccccccgccagcagggttgcgccttccgctacaccacgcgcaatgcaggacagcaccttgtcacgatgcgggaagctcgccagcgggccgaacaccgttgccgggtcttccggatggccaggacggatctttgcgacgcgtgccagcaacttctcccggaaggcggccaacacgctctcctgcacgaaaacgcgggtgccgttggtgcagacctgaccggaagaatagaaattcgccatcaccgcaatatcggcggcccggtccagatcggcatcctcgaacaccagcagcggggatttgccgcccagctccatcgtcacttccttgagcgaagacgatccggccagcgccatgaccttctttccagtctccaccccgccagtgaaggagattttctcgatcaccggatgcgccgtcagcatcgccccgacatcaccgcggccctgcaccacgttgaacacgccatccggcagcccggcctcggtatagattttcgccagttcgatcaccgtcaacggcgtgacctcgctgggcttgaagatcatcgcattgcccgccgccagggccggagccgatttccacagcgcgatctgcaccgggtagttccatgctccgatcccggccaccacgcccagcggctcccgccttgtgtaagcaaattgggtcgcgttgagcggtatctgctcaccctcgatcgcctgtgccagcccggcgtaatattccagcacatccgcaccggtcatgatgtccacggtgctggtttcgctgaatggcttgccggtatctttcgtttccagcaatgcgagcacgtcgtttcgcgcacgcagaatatcgaccgcccggcgcaggatgcgcccgcgctcgattcccgtcatcgccgcccagatgcgctgtccttcctgcgcactggccacggcgcgggcaatgtctgcttcacgcgcggcggcgatgtgggccagaatgctgccatctgccggattgaccgagctaaaaacctcccccgtaccagcctcaacctggccatgaatatacaatcccggcgtcagggaatcgggaacatgagcttcctgtaacgcaaccggagatagggaaggagagggagtggtcatgatcgggatatccttgcacgcgtctcagccgaggttgaagctttgattctacaagactatttactttaatttgaacgtccattcaataaaaatgcgctctttttcccgatcccaaatcaaaagtaggtttgatttattggttatgaaattttaagttgacatagaggcttcctccatgaaaaaaacagtcatctgatcaagaattaaatagaactacagttaagatcggatggctgaatttgatcctatacgtctattactagtacgcctaataatgactctgggttaatcacagtcaaaatactattgctatgttaatgactacaatgacgtatggtgtgtcggcatctgaaggctgcccaggcatccggttagatgttaagctcaagattatgggcgtgacacaccatactctgtttatctggcaccatcctattctggcattccatacacattttgtcacaaacgggtggtaagtttttgatctatataatcaaaagccacatgaatattttcctcattaactttcccggcaagagtggcccgcagccataatccgtcaatcagcgccgccagtcccagtgcggaatgatgcgcctgctccatcgtctgcacgcgcaggaactgggtccgcaacacacgatggagataccatgcattgatctgctgcaaccgccgcagatgcggctgatgcatggaggatgaccagaaagccagccatgccttggccgcggcggtactggtctgtgtgccgtcaaaattaccctcgacaatggcacggagaagggtacgcggcgtatcatccacagccgcttttcgtctggcccgcatggctgcgaacagatccgccagaatctggcgcatcgccgcctccagcaaggcttccttgtcctgaaaataatgggcgatgatgccggtcgaaacccctgcgatccgggctatcctggccacggtcgtatcactcagacccacctcatcaattgattgcagcgtggcgcggatcagctgggcgcgacggattggttgcatgcccactttaggcattatgtccctctcctgctgctcccgcgcatgggaaccatcccatcactgcgggcccatcactgcgggcggtgccgctgggccatcagagcctgcatgccgttgcgcatcaatcctttctgacccagcttgctgaactgcttcatcatctgactcatatcatcgaactgcttcagcagacggttaacatcctgtacctgcacgccagccccggccgcaatgcgctttttgcggctggctttgatgatgtcagggctgcgacgctccttcaccgtcatggagctgatgatcgctgcctgacgcttcaggatggacgtatcaatattggcgttctcaatctgctgcttgaatttccccagacccggcaacatccccataatggaggaaaggctgcccatccgggaaatctgtttcagctgtttggcgtaatcttccagcgtgaagcgccccttgagcatcttcatcgccatttcctcggcctcggcctcgtcgatggtctcggcggccttttcgaccagtccggcgacgtcgcccaggcccagaatacggcccgccacacgctccggatggaaatcctccagcgcatccagcttctcgccagagccggtcagcttgatcggtgcgccggttaccgcccgcatggacagggcggcaccgccacgcgcatcgccatccatccgcgtcatgacgataccggtcacgcccaccgcctcattgaaggcacgggccgtgttgaccgcgtcctgaccggtcatggcatcgaccaccagcagggtttccgacgggttggtctcggcgcggatcgccttgacctcctccatcagctcctcgtcgatggcgaggcggccggcggtgtcgaggatcacgatgtcatagacctcgcgccgtcctgtctccatggcgcggcgggcgatctccaccggggtctggccctggatgatcggcagggaggcaaccccggcctgctccgcaagctgctgcaactgaagctgggctgccggacgctgggtatccaggctggccagcaacacgcgccgccgttcctttttcgccagacgcagcgccagcttgccgctggtggtggtcttgccagagccttgcaaaccaaccatcagcaccggcacgggcgccacagcattcaggttcagcggcactgccccggcaccacccagctgttcgatcagcgcatcatgtacgatcttcatcacctgctgaccaggtgccacgctgtcgatgacttccgcgcctgccgcacgctccctgaccgaggcgatgaagtctttcaccaccggcagtgcgacgtcggcatccagcatggccagccgcacttcgcgcagtgcctccgccacatcggcttcgttcagcgcgccacgaccacgcagcttgtcgaaaacgccggtgagcttgcccgaaagtgtgtcgaacataacgcaaacccttgatccatcagaaggatggggtgtgcggcccgggaaggcagaatgtcaagcacgttcaccccccggcgaggatacaggctgaaccacaagacaaacgcaacatcacctttaaaaaaatttcccctatttaaataaacacatcagttatatataattaatcaatagcttaaatgttgacaaagtcaaaatattccataaaattaactatcattttaattttgaaatttctaatagacagccattcatttttaaaagtttaaaattatgctggcatggatcggatcggatctgtccaataataactggaacacaggcaaaaactggcaaggaggcagccctccctgctcttatcaaagtgctgcatttcagaatggagccaccgtttttctctcgaataaccataatatcgaaggtcttttgatctccgggactgttatgatgacttctgacgggcatactctttacaatgacaatgcccggctgacattggaaggcggatcagttctggtgctggataacgtccatctggtcacacagacgacaaccatttcctccggtcaggccaccatccggcttcagggtgcccaactggaaattgagtgtggcagctatatgccggccacgctggattttcaggatcgccataatgcggatggcagcgtttccggcagtacggtgatgatcagttacgacggcgcgaaagcgaatatgttcgcgtcgatcaccaacctgaccacccgtgatgccatcatgttgaccaacgcgtccacacacggctcccggatctatcttcaagccaacggggatggaagctactccctgatagagcaagtgccggaatggggtggacagacctccatcctgtgcaggcacgtgacactcgccgcagggctgaccgccagtgatttcacctctctcaaccagaacgggatactggcgctggtctgcttcctgggcggcagcatgatcagcacaccggaaggcgaaaaaccggtcgaaaccatctgcccgggccacaccattctcgctttcgaaaacagccagtctgttgcacggaaagtcatctggtcaggcgttgcaaccgcacatgtgaatcaggatctgcccgctgaccaggccggatatccggtgcggatcagaaaagacgctgtcagcgatcatgtgccgtataaggatatgctgatcacacccgatcactgcctgtatctggacggttatttcatcccggcccgcctgctggtgaacggacgtacgattttttatgatcgttcttttacatcctatcaatgttatcatatcgaaacagaaaaacatgcgatcatcaccgcagacggggttctgacagaaacctatctggataccggcaatcgcagacagttcagccccctcagcacagagcagaccagcgggaacgtcaccttgttcggaggccggaaatcgaactgggccgaggatgccgctgcaaaactggccgtgacacccgatctcgtggagccggtgttccgccgtattgaggcccgcgccaacgaatttgctccgccggcccgcccctctacgaccacagagcggcagttgcagatcaagacacaagatggccagatgctccgccaggtaagggaaatcaatggcagggtgctgtttatggttcctgccggggtgaatgccgtgcgtattctctccaacgcctcccgtccctgtgacgtaacggggccatttctggatgatcgccgcaacctgggtgtgttgatcggcgaagcagtcctgtatgattcagggatgacccacaccctgaacgcccatctggagcacgaagggctggagggatggcataatccccctccctatgaggcctctaccggggcatgctccggccaacgctggaccaacggcaatgcgctgctgccgcttgggaaacgtcaggatggggcgattggtctgttatcattacaggtgctggccggaggcccctatatcatcgcaacaccggctgatgaagacaggctaatcaatattaccggaacagcctgaccacgcagagatcaggacggtcaggaagcgaccatacgcgctactggccatgtgatactggccatgtgaaatccggaatcgcctgaggggcggccagcagatgctcggccgcccgtgcggccctttcgtattctatctcctcggctgatcgcgtgtcataccaggcccattgcgccatgcgataacgggccgcctccgccagttcggcatcctcatgactgcgccagagctgcatcagtcggtctgcttcctgatggttgccaccggcacgggcgatctcccccgccacgacatcctgcgcgaaggcatcgtccggagccagtgctctggcccgatcgagcgcggccgaggccgctttcagccagcatttcgtacaaagaccacgcgccagttccagccagaaaaccggacttttccgccgcccctgccggaaagcccgacgaaaagccgcacggtcaaatcggcccagcacgagattcatcgccagcatcggcagcaccctcgcctgctgaagcgcgcggaacatgtgatgcccgcagaaccgcaatggcagcggggtcaggtcatgatacatcaggatggcccgcacatgcggccggtcctcgctatccgggtcgtaaataatagtaccgcgctgcaaccgaccgatcagccgcatccggtcctgacgaaaagcaatcccttccgcctcccgccgccaacgccagtcctgcggcatcagcgccggatcaatggagaattggggggccaccgccaccagatcatccagcgccagactttccgcgaaattgatggccgcatagccgcccatgctgccgccatatccgacccggcgtcgccccttcgtttctgccagcacggcgtcgatcagttcagtcatctcatcctgctgataccagtcattggcagccggtttaatggcgatgacatccagcccgcgatgcgtaaagaaagtctctccggtgacgggggcctccatatccggctgtggcaaccaggtttcgaaaaacacaacgaccggcccatccggtaccagcgcctccgcatcggcagacagaaaacgggccagataatgcgcaccgcggaaaatctcccgggcactccgatccaatgaggaagcagaagaaggctgtgtcatacggcgatcattgccaaagccccgatccggcgcaaggcatggcgcaaaggatagacacaagttatcccctcaacgcagaacgcccccggaagaaaatcttccaggggcgttacgcatccatcacatcacgtcgaaccggatggctcagcgcggcgcgagcaccataaccatctgccggttttccattttcggcatctgctcgaccttggtttccgcgtccagctcctcacggatacgctggagcacgcgggcaccgagttcctgatgcgccatttcgcgaccgcggaaccgaagcgtcaccttcaccttgtcgccttccgagataaagctgcgcatcgcccgcatcttcacctggtagtcgttttcatcgatgttgggacggaccttgatttccttgatctcgatgactttctggcgcttgcgggcctcgtttttctttttctgctgttcatatttgaacttgccgtagtcgaggatcttgacgaccggcggctcggcgttcggactgatttccagcagatcgagaccaacagcataggcgcggatcagcgcgtcacgcgcgctcatcacaccttgcatctctccatcctgatcgatgaggcggacctgcggaacgcggatttcctcatttacacggggcccgtcgcgattaggcggtgcgggcaagggcggcctggctatggatctctcctgtatctgttatcacgaatgccccgccgccatggctgcctggaaagcgaccgaaagcagacgggattttgcaatggctctatttgcccctcaacccgccgatgatcaagggcaaagacgggaatgactgcccagcccctgcatcaggacgacgatactgcttccctgacctggtcttactgccgcagatcgggcggcgtcgcctccgtagcgagggctgagattgcctcgtccagcgccatcacctgctgctcctgagaaccgagacgacgcagcgccacctgacgctgttcggcttcacgccgtcccaccaccagaatcaccggcacatgggccaggctgtgttcacgaatcttggcattgatcttctcgttgcgcagatcggcctcggcccaggtgacgccggcgcgtttcagggccgtcaccacctccatcgcatacgcgttcgcgtcggagacgatcggtgccaccaccaccggcaccggtgccagccaaagagggaagcggcccgcatattgctcgatcagaatgccgatgaaacgctcgaaactgcccagaatggcccggtgcagcatcacggggcggcggcgggcgccatcctcggccacatattccgcgttcagacgctccggcagcacgtaatccacctgcaacgtgccgcactgccagtcccgcccgatggcatcgcgcagtacgaattccagcttcgggccatagaacgccccctcgcccgggttcagttcgtattccaccccggccagacggcaggcttcacgcaactcgtgctcggcacgatcccagtcttcatccttaccggcgcggctctcgggacgatcggcgaacttcacgcggaaactgtcgaagccgaggtcacggtacaccgaggccagcatcgccacgaaatccgcggtttccttggcaatctgctccggcatgcagaaaatatgcgcgtcgtcctgtgtgaaggaacgcacccgcatgatcccgtgcagcgcaccggacggttcgtaacgatggcaggccccgaattccgccatccgcaatggcagttccttatagctgcgcagaccgtgacggaaaatctgcacatggcacgggcagttcatcggcttcagggcgagggtcttttcctcatcctctacggtggcgatgaacatatgctcccggtatttgtcccagtggcccgagtcttcccacaggctgcgatcaaccagttgcggcgtgcggacttcctcataccccgcctcgatctgacggcggcgcatatagttttccagcgcccgataaagccgccagcctttcttgtgccagaagatggagccgacggcctcttcctggatatggaacagatccatctccttacccagccggcgatggtcgcgacgttcggcttcctccagttgatgcagataggcatccagctccttctgatcgcgccatgcggtgccgtagatgcggctgagcatcgcgttgcggtgatcgccacgccagtacgcacccgccaccttcatcagacggaaagccggaccgatatccccggtgctgcgcatatgcgggccacgacacagatccagccactcgccctgacgatacaccgtgatcgtctcggtatccggcagatcctgaatcaattgggccttgtatttttcacccttgtcctgaaagaaacggatcgcatcctgacggtcccacacctcgcgttcaaacggagcgttgcgggcgatgatctcccgcattttcgcttcgatcgcaggcaggtcttccggcgtgaacggctcgttgcgggcgaaatcgtagtagaaaccgttctcgatcgacgggccgatggttacctgcgtgccggggaacagctcctgcaccgcctccgccagcacatgggcggcatcgtggcggatcatctccagcgcggcctcgtccttacgagtgacgaacaccacctgcgcatcagccgcgatggcgcgggacaggtccatcatccggccgtccaccttcattgccagagccgcgcgcgccagaccgggaccgatatcggccgcgatcgtagtgcccgtcaccggcgcatcatagtggcgcacggagccgtcgggcagggtgatcgctggcatgatatacggtatcctgatgataaaaagtgaaggcgctgcacctaaacgcagccgaaccgattgtccaccgccatggggtcagacctgccctccttctccccctcccctcatcttttcctttgacagcaatgcgggagaaagggagcaagacagcaccgggaaagcatgattatcctcagcctgtgagggtcgtatctgctgccttttctttccctcagccgccccgaaaacacccggatcaaccgggataccatccatcataagggtttcctcccccatgtcgtaccctgtgtctcaccatcatactcgaccgccttatatccgggctgccgctgccgggctgttgcttgcggctgctttctccctgtcttccaccggccccgccatagcggaggatggagcctccacgccggagcagatcgtgaatgtcatgaataccatgtggggcaagcagacccccggccaacgggccaatcatgccaagggcctgctggcggaaggcacgttcacccccagccctgatgcgaaaaagctcagccgggcaggcattttcgccggcaagaccattcccgtcaccgtacgcttctcagacgccaccggcctgcctcatatcgccgacgtctcgccgaatgccaatccgcacggcatggccatccgatttcacgacaagggtcatacagatgtcgatgtgatcaccaattccctgccctttttcccggtccgcacgccggaagaatttcttcaattgctgaccgcgatttcgaagagcaaggatgcacctcatccgaccccggccgagcagttcatcgccacccaccccaccgtggccggagcagtcggcgccctcaaaaccccgtccagctttgcgagggaaacatacaacggtatcaacaccttcattttcaccgatagcgatggcaagaaacatccattccgattcaaaatctccccgatcagcggcgcccatcatctgacgcagcaggaagccgagaaacagaagccggattttctggtggatgagctgccgacgcgactgaaaaaaggccctgtcaaattcgccctctatgccgttctggctgaaaaagacgacgcgatcgacgatgggtcaaagcccttccccgcagatcgccgccaggtccagctcggcacgatctccatcaaaaacatccccgaggatgctgacaaacaggcggcctccatcctgttcctgcccggcaatctggaaaccgggatcgaagcctccgcggatccgctgatcgacgcgcggaatgccgcctatgcggtgtccttctcacgtcggcagtaagcaatacatcaggagaagcagtgcacgaaaaccacagcgtgcactgcttctcagccaaaaaccattctttcatcatactgccattgaagaataaagcgaaataatacaaatataattatataatttttcttttttaagcctaaggttaatcaatgcctttttccggcctgccgaatgatccgctgtttcagtatcaatggtatctgcaaaataccggacaggcagggggcacacccgggatcgatattgatgtcacgccgctatggtccctctacactggcaaaggggttcgtgtcggtgtcatcgatgtcggaacccagctcgatcatcccgatctggtccaaaatatcgacccgaccgctacgtgggatgccgcacaggacaaaccgggcggtggcccgaccattgccgcggaaaatcatggcactgccgtcgccggtctgattgccgccgccgcaaataacgggattggcggagtgggagttgcccccgatgccacgctcggcatctatcacgaggcagagggaacagttccctatccggtcaatccgcaggaattctcgattgccttcacgcatgcgctgaacgaccggatggatgtggtcaatgccagctggggggtcggaaccccgttcgcgcccttcatgtccgggcttcagacactggcacagcagggccgcaacggacttggcaccgtgatcgtgatgtccagcggcgacagccgcggcagaggctccaacgccatcatgaacgccaccaagaattcccaatacgtgatcgcggtcggtgccatcgacaataccggcgtcgtcgccagatatagcacgcctggcgccagcctgctgatcaccgcgccgggcggctctgccaccaatccctctgcctctacacccggttcagacatcgtctccaccgatcgcaccggttctgatgggtataacacccttgccggtgctgccggagattatgtctataatttcaacggtacctctgcctccgcgccgattgtatcaggcatcgtggccctgatgcttcaggccaatcccaacctgaattatcgtgatgtacagcagattcttgcccaatccgcacgcatcaccgatgcaggctccgtcaaatggttccagacgcattcggcagactggaatggaggaggccgtttctacaacgccgattacggatttggtctggtcgatgcccgcgccgctgtgcatctggcagaaagctatcggggccgcagcgtcaccggaaccgagcagacactgaccgctgcctatcagcctgcaagcccggtcgatattgcactcgatccatcgggtacagcaccgacacggatcagctttaccatcaataacgccatttctgttgagcatatcagcctgaatctgaacatgaatgtgccggattcaggcaatctccgcctcggtctgacctcgccagccggcaccaccgcgtttctgttggtgaacattgccgatatgcagaatgttccttggaaacaaggcggtttcacgctgacctcgcccatattccagggagagcatgcgcaaggcacctggacaatgagcatctgggacaatgcccatttctcaacccccacgacgcccgatacgctgaccagtgcgacactgagtgtaacaggatcgcagcctgccagccatgacattgtctacacgaatgactttccgactttggccagccagagtgcaacccggctgaccttatccagcacgcagccaaacccggttttcaacgcctctgctgtaagcctgccggtcagcatcagcattcccgtgcagcgcttttccattggggggacttcggcctccatcgcgcctgcgaccaccttgtcggcactttatactggcgatggcaatgatacgctggtcggtggcagcagcgccatgaccttcaatcccggctatggcgataatacggttctgctcggcaatgccaacaacatcgtcaactcggagggcaacgacaccatcaccgcaacacagggtgcggcaactgtgcgggcctccggtaatgctatggtattcaacaatgccgcccagctgaatttcgtcagttctgccggagccagcaccgtcatcggtggcagcggagccatgaacgtcaatggtggagccggcaagctcaccgtgttcggcggcaccggcgccgataccatcatcggcagcagtacaggtggtaatcagttgatcgccaatggcgcaggcagcgctgtgttcgccaacgggaatggcaacatactgcttggcagccaaacgggtgccgtgacgctcgcaacgcagggggccaataacaccgtgttcgggggcattggcggcggcaccatcctcagcaacggcaccaatgatctggtggtaatggatcagggcgccaccaccctgttcggtggacagaatgccgccatcttcaccaacagcgccaatgccaatatcgtcggcgaaacaggttcctatgccgtcggcttcggcagcggcaccagcaacgcatgggccagcgcctccaccgatctgttcctcttcgccaacggacaggccgggggcaatgtcaccatcagcaatttccagggcgggaaagatttcatccaattgcagggatatggcgataacgtggtgcagaccgtcctcgccggtgcccagcagaccgcatccggcctgtccctgacgctcagtgataatacccacatcaccctgctcggtgtcaccagcctcaatcaatacagctttatgacctgaaaaacttaccctcgcggaataaccaacaggcggtgcaccagccgggcaccgccttttttgtcattaaaaatatattttatgctttttaggctttttgcagggaacccatcccggcagcgcattggacatcagacaagaatttaactaatcctcattctcaacttctaccctcctccggtctggatcggggcggaaggatcccatggccaccgtgccaaggagctgacccatgcgcctgacccagctgtcggttgccagccacagtgtcatcgaccatatcgagccgctcggaccggatgacgtcatcgcccggcgtctgggtgagcttggcttcgtcccgggtgaaccggtgcggatgatcgcgcatggccctctgggtggcgatccggtggcggtggagatcggctttacccgctttgccctgcgtcaggccgaggctgatcgagtcatcctgcgcagtgatccgggagaacgtctggcggcggagtaatgatctcctcccgccttcaccttgcggatgcgtccgttatttcagtttcccgattgtaacgactggatccgatgtcaacgacaacacacccgctgcgcattgcgctcgtcggcaatccaaactgtggcaagacggcgctgttcaaccggctgaccggcagccgccagaaagtcgccaactatgccggtgtgaccatcgagcggaaatcaggccgcgtgaccacgccaagcgggcgctccgtgcaggtgctggatctgcccggcacctacagcctgcatgctgccagtcccgatgaggccgtgacacgcgatgtctgtctcggccggtatcggggggaagatccgcccgatctgctgctctgtgtcattgccgccaccaatctgcgcctgcatctgcgcttcctgctggaagtgaggcaactgggccgtccggtggtggccgtcatcaacatgatggatgcggtcgagaaacagggccttcatattgatattccccatctgtcagaggcgttgggaatcccggtcgtcaccgccatcggcacacagcgcaatggagcggacaacctgctgcgcctgctggatacgctgccgccggatctgccgccccctcccccgaccaacaccaatgctgatctgcatgccgaggttcgcgccatgctggatcgctgtatcacccgcatcgcgccggaacgtccgacactggaggaaaggctggatcgctgggtgctgcatcctgtctgggggatgctgctgctgaccctgctgatgttcgcgatgtttcaggccgtgttttcctgggccaagccgatcatggatttcctgcaggataccatggaccatcttggcgacgtggcggggactgccctgccggaaggcccgttgcgcggcctgatttccgatggcgtgatcgccggggccggcaccgtgatcgtgttcctgccacaaattctggtgctgttcctgtggattctgacgctggaggcatccggctatctgccccgcgccgcattcctgctggaccgtttcatggcgacagccgggctgagcgggcgttccttcattccgctgctgtccagtttcgcctgtgcggtgccggggatcatggcggcccgcaccattcagaacccgcgggaccggatgctgaccatcctgatcgcgccgctgatgacctgctccgcaagactgccggtctatgccttgctgatcggcgccttcatcccggcccatacgattctgggcctgttcaatctgcagggactggttctgttcgcactgtatctggcaggtatcctcagcgctttgctggtcgcccgcgtgctgaaacgtggcacggtagaggaacaacccctgttgctggagttgcccccctatcgtctgcccagcctgcgtagtctggccatcgaactgtggcagcgcgcctatattttcctgcgtcgtgtgggcaccatcatcgtctccgtcagcatattgctatgggccttgtcgagcttcccctctccaccacccggcgcaaccggcccggcaatcaactacagcctcgccgggcagattggtcaggccatgctgctggtgttcgagccgatcggattcacctggcagatctgcatcgccctgattcccggcctcgccgcacgggaagtcgcggtcagtgcgctcgccaccgtctattcgattacggccgacaaggatcatgccgctgagaagctgatgccgctgctctcctcgcaatggagcatggcgacggcgttctctctgatggcgtggtatgtttatgcgccgcagtgcttttccacgctggcggtcatccgacgggaaacggggggctggaagatggtctggatcagcgccggatatctgttcggactggcttatctgctgtctttcctgacctatcgtataacgcgcctgttcaccggttgaagccagccaggaggccaccatgctccagtccatcatcgccgggatcgccgtcctgatctgcgctctgttctggatgcagaagcttgccccccgtgccatggccccgctctggtcggctgtatcggctctgctgcggcggatgcaggtgatgcctgcgttggccgagcgtctttctccagccgcctccccctcctctaccggatgcaagggatgcgacggctgcggtggaagcaaggggggatgccactgactgatatgaagggcagacacctgcctgtccgggaaaaatatccctgaaaccggccatccggcagagtatttgtcggctcggcatggtcaaaaatctgtgccttgtcttacgccggtattccatcccaaaagcacagtgcaaactgccttcgcacaagaggcaggcttgggatgcccatcgggatacccattgggatgacaagacaaaccgccggttcaggacgccccatggataagccagccagaatgccgccttgttatggcctgctcgcagcaagggatctgacggcgcgcacgctgcttaccgcgcccgagatcgaggccattttctccaccggcgtgccggcaaaaccgatctggctgcatctggatctgctggatacccgcgtgaccgaattcatccgcgccttgcccgggctgccggaacaggcttgcgcgctgctgtgcgatcgcaatgaatcctctcatctcgatacagaggatgacgccctctggggcaccattccggattttgcgcatgaggtcagtgaagaaccggacccggcctatatgggtgtgctgcatctggtgatgacgccgaccatgctgatcacggcgcgtcggcacccgctgcgggcgccttcggtgatcggctatggtcaggcctcactggataccactgccgcgcaatgggatcatctgatgcgggccatcatggaaggcatcagccgcgccgccaaggtgctggccctgaaactggacaatatggaggacaggctgctccagggatatgaggtcacacgcgacgagctggccgggctgcgccgctccgtgctgctgctgtatcgccgggtggagcccaccgtagaactgtatggtgaaatcgccgagatcgccccggaatggatcggggaagccggacacgatatgagccgcgtcacctcccgccttgaaagcctgaagcgcaacgtcatgtcgttgcaggaacggggccgtatcgcgcaggatcagcttgccgcccgcaatgcggaggagaccaatcacagcctgatgatcctgtccgtgctgaccgccatcctgctgccgcccacgctggtgaccggtattttcggcatgaacaccacgggtttgccggggacctccggccccggcggcacctatatcgcgttcatggcgatcctcggctccgtcgcgggagcctgcctgctgctcaacaggctggggctgctgcggttcaggtcggagaaaaaacgacgctgatccggcttcaatccggaacaaggcaaaaccgtcgcaaatgcttcacgggacgaggcagacagatttttctacatcctgcctgaattgtgctgcccaaagcccgtgaggataccgctatgaacgacctttccagccctatcgaaaaatcctggctggcgcttgagcttgaggacgatttcgatgaagaactggaacaggaaatcgacgatagccgccttcctgccgccttgcgcgcattgcagaaccagcaccgcaaaagcaccattgatcgcggactgtatttccgtgaactgctgcgcctgcaatcggagctggtaaagcttcaggactgggtggtccataacgggctgaaagtcgtggtgctgttcgagggtcgcgacagcgcgggcaagggcggcgtcatcaaacggattactcagcgcatcaacccgcgcgtagcgcgtgtggtggcgctgcccgccccctctgaccgcgaacgcacgcaatggtattttcagcgctacatcgcccatctgccggctgccggtgagatcgtgctgttcgatcgcagctggtataatcgcgccggcgtggagcgcgtgatgggcttcgccagcgaatcacaggtggaggatttcttccgcgacgtgcctgagttcgagcgtatgctggtccgctccggcatcattgtggtgaaatactggttctcgatcaccgatcaggaacaacagctgcgcttcatgatgcgtattcacgatccgctgaagcagtggaaactgtccccgatggatctgcaatcccgcgtgcgctgggaacactataccaaggccaaggaagagatgttcgaacgcacaaacatccccgaagccccctggtatatcgtcgagggcaacgacaagaaacgggcgcggctgaactgtatctcgcaccttctgtccctgatcccctatggcgatgtgccacatgaaccagtggcattgccggaaagggtattcgatccgcattatgaacgccgtaccttgccggcagaactttacgtgccggaaaactactgatcagagcatgcattttcccggtctcatggccgggaagcctgtgcctatccataggctctgagaaagctgccgataatcgagaccagcatcagcgtcatgaaaacggtccgcaacagacgggcgcttttgtggatcaccacactgccaccgatctgtgctcccagaaaagaacctgcccccatgatcagggcgcgccggtaatcaaccgcgctgctgctgatcaaaatcgacaacgccgcgatgttgcctgccatgttcagaggatttgcatacatcgtggccgcattgatgcgcagttgataggtccggctgagggccacggtccagatcgatccagtgccgggaccgaaaaaaccgttatagaacccgatcacgacacccagaggttgcaatttgcagggatgaggcggcaatcgggcctctcccgccacatccttgcgatcggatgacaacacgtaatacagaaatacaccgagcaacatccacggcaccaaacgcttcagaaaaacctctgaaacaatttgcagcaacatggctccggccagcgctcccaccaccgtgcagagcaaaccacgccggagaggggaaaaatccattcctccctgacgccggaatttcagggtggcagaaagctgtcccaacacagattgcagcttgttggtgccgaagacggccactgtccccatacccgtcaggccgagtgccggaacgcagatcaatccaccaccccctgccactgtatcgaccactccggcacaaaaagccgccgcgaacagaaatacatccagcgcccaggaaaggtgcattttattgtgacggctttcaaagcagcagggtaggaaaacggtctttatctgccgctatcatgcccatgtgcacaatattttttatactatgattcgcaccttccgtttgatgaaacaaaaaacggcgcgggatttatgcccgcgccgcctttcatgaacccggataaatcagaccgttatgcgtcgcgacgcaccacgtggttatgatggatcacggcttccgcctccggtgcacccgcaccgccaccgaaccaggctgcaaccgcccccagtagcagaccaatgacaccgaagattgcgccacgggctgcggctttacgagtggcttctgccgccgcgatggcttgctgcttcgcctcatcgacggtcttctgatactgctgctccagcgcatccagacgggtcttggcttcatcagggctgatattggccgctttggccaaaccattgacggcctgttcacgggcgcgatcagcttcctgctggttcccgttcagctttgccttcacataggcaacggcggcattctgcaccgtctgcgcgtcggacggattgaccaggctgcgcacctgggcttccagactgttataagcctgttttgcatcatcgggattgcgcgctgccgccgttccggccgcattgcccatcccgcctaccatcgagccgatcccgctcgcagtaccgccaatcgcatgacccacgccgctacccaccgtgctgatcgcgccaccgaccatgccgccaaccgcggtggtcaggatgtagaacagaacgaaagtcgtggccgcccatgagaccaggccatgccaccgcgcagtattcagctttgcagtgccggataaacgacccgccacatggccaccgaaaaaggccgcgataatgcccgagagggtccaccagcccgccgccgccatggacagcgtatcggcatcgggattaccggagctgttggcagcatcaacagaactcagcccgataccgatcccgagcagattcaacagggcctgcaccaccagagccagaacaacgcctgccagcacagcgccccaggaaatccggttggacagtcgaatacgacgctcatccagcgccagatactcatcttggctgctccaacccgtgtcgccataagggccgggcggcaccggatgtgttgtatgtgacatgcgtattcctcgattatgttgtcttgcggatagttgccgttcggaccgggcggcgatgttcccgcatcgcgcctcaggacggcaatccttcactcaagacgttaccagggcgagaaagttgcgatagcagcctgtataactatgttcacaaccatgtgaggcagcaaaaaaaagccttgcagtgagggaaccgcaaggctttttcaaaatacatgtcttaaaggatcgtgtttaagcgctttcaaccaaggttattattccttcaattcgaaagctccggcaatcctcagcttcacttcatcacccacgaccggcagatacttggtgatgccaaattcaccacgatggatttccgtataagcctcaaacccgatcgtctgctttttatccatcgggttgatgcctgtgccaaccagccgaacccttagcacgacatgtttcgtaaccccgtgcagcgtcagattgccgggcaccatcgcatggtccttgcccgcaagcgtcaccttggtcgccacgaacgttgcttgcggaaatttcgcactgtccagccagtcggccgatttcaattcttcagtgagtttctgactggtcgtcaccaccgatgcgatcggaatactgatacggagcctcgtcttttccggagcggcgggatcgatggccagctccccctgcgcatcggaaaacaggccattgtaatgcgtgaatccgaaatgcgagaccgagaatgcgacctgtgaatgagccggatcagccacatatgtgccggccttgattgatgccggatcagtagatgcgatcttctgcgacgctgtttcagcgtgcgctgtgccaccctcaaaacccagcgcaaggacacccgcgagaaaggcccccgcgagaaagggagtgcccattgcgaccgatttccacgttccagtcatccgcattatttttatccttttccgaaacacaccgcttttaaaagcgctttccttcaacagtgttgcaagatcacgctgcatcggaaaccacctgaatcgaaatcctgcatcgccattatttgactggtctcagcgagccgagtgccagaggggttgcatcgccctcgcagacaccgcatgagaaacagggtgtgcaacttattttttaccagcatgaacggaccttgtttccgtgatgaatgaaacagtttccggtgtctcccctcatcgtcccctgcggctgctggtcacaggcggggcgggctatgtcggcagccatacggtctgggcactgcatgaccggggcgacgaagtcaccgtctatgattccctgtttcaggggcaccgtcaggctctgccacccggcgtgcggctcgtagtcgccgatctggcggacgaaaccacgcttcatgccaccctcgccgagggacaatgggatggcgtgatgcatttcgccgcgcgttctcttgtgggggagagcatggtcgatccgatgctttacatgaaccagaatgcggcactgggcttcaaactgatcgcggcctgcgtgcagcataaagtgccgcgcttcctcctgtcctccaccgccgcattgttcggccatcacgacgacacgccgatcgacgagaacgccgccatccagcccggctccccctatggcgagagtaagttgatgatcgagcgtgccctgtcatgggcggaccggattcacgggctgcgctatgcctgcctgcgctatttcaacgctgcgggggccgatccgcaggggcggagtggcgaagatcatgatccggagacccacctgatcccgctggtgatcgacgcggcgctgggattacggccggagataaaggtgttcggccatgattacccgacacgggacggcacctgcatccgcgactacatccatgtcagcgatctggcgcaagcgcatctggcggctctgacgcggatcgatcagggcagcacagtgtataatctcggtaatggcgcaggctattcggtgatggaagtcatccacagtgtcgagcgtgtcagcggcctgactgtaccgatgcgcatcgaggccaggcggcctggcgatcccgccgttctggtcgccagtgcagagaaaatccgtcgtgaaaccggctggaccccccgtttccctgcgctggatgatattgttgccactgcccttgcatggcggcgcgcacatccgcagggcttcgacgcggcctgagcctgttacggatcatcaaacgatcatctattcggccgttcttccggatgggcagccgcttggcggacggctacggtccggcagtatcctgccgtttgcatcctcccgaatgatggaaatccccatgcgcagccgcatcagacatcgtgaaacccatgccacggaacggctcggatggcttcgtgccaccgtactgggggccaatgacggtattctgtccaccgccagcctgatggtcggcgtggccagcgcaaccagccccggcagcgggcgtggcgccattctgctggcgggcttgtcggctctgatcgcgggggccatgtcgatggcggcgggcgaatacgtttccgtcagctcccagtccgattcagaacgtgccgatctggcgcgggagaaaaaggaactggatgccgactggcacggagagctggacgagttgaccgagatctatcgcctccgcggtctggatgctcccctcgcacgacaggttgcagagcaattgatgcgccgcgatcctctctccgcccatgccagggatgagttgggcatgaccgaggacggagcggcccgtccggtgcaggcggctttggcctcggcggcctccttcgcctgtggtgcggccctgccatggctggcagcggcactggcccctgatccctacgatgcggcagggcagagcacgggacagacaagcgtgatctggaccgtctcggccgtgtcgctgctggcattgctgctgctgggtctggcgggagcatgggccggcaatgcgccgaagctgcgggcggcgatgcgggtgttgctgtggggtgtgctcgccatggccgccaccgcgatcaccggccatctgttcggtggtgtggtgggttaaagctccagcgtctggctgcgcaccagccgggcgtacagcccgtcctgctccatcagggccgtatgggtgccctgctccgccacccgtccatcggccatggccaccaccagatcggcatcgcgcacggtggacagacggtgcgcgatcaccagcgtggtgcgcccctgacgcaatctggtcagagcctgctgtacagcggcctcgctttccgcatccagcgcgctggtcgcttcatcgagcagcagaatgcgcggattgcgcaacagtgcgcgcgccagcaccacacgttgcctctgcccaccggacaggcgctggccgccggggccgactatcgtctcgaacccctccggcagatcgcggatgaagcctccggcagcggcttcggcggcctgctcgatctccgcccgctccgcgccctcacgcccgatgccgatattggcggcgatggtgtcgtcgaacagcaatgcatcctgccccacataggcaatggcatcccgcagggaggcaagcgtgacctccctgacatccgcgccatcaaccagcacccggccggacgtcgcatcccgcaagcgcggcaacagggccagcgcggtggattttccggctcccgaaggcccgaccagcgccaccgtcatgcccggctgagcagcgaagctcagcccgtccagcccggtacggccatcggcatagacgaagcccacattctcgaacgccacatgcccttgcccttgcggcagaggaaccgcatcgggtgcgtccctgatggcggcaggctcgtcgataacggcaaacacccggaccagcccggccaccccctcctgcaccgccgcgttcagcgagccgagcgcacgcagcgggcgggaggcgatcagcagtgcggcgataaaaccggcgaaatcgcccaggctgctctgtccgtttgcggcgcgccagccggtgaagccgatcaccaccgcgaccgcgctgccgcccagcacctccagcaccggatcgacccgcgcgcgggaccgcgtcatgcgcaacaacgcgctgtagaggtgctgaaaagcctctccggcgcgcctgatctcgaaatcctccagccggtaggcgcggatggtgcgggcctgcgcgaaactctcgttcagcagagcggcggtttcccccattcgctcctgcatgccgccggaggcacggcggatgcgcttgccgattttctggatcggcagcgccgccagcggatacatcgccgccgcgatcaggctcagcacccaatccagatacaccatggaggagaccagccccaccaccgtcaccacatcgcccaccccgttgacggcacggaccagcgcctccctgatggtggcggcgtcggtggtgaaacgcgcggcaagctgcgccggagcctcccgctccacccgatccagatcggcatgggcgaggtggctgaacatacgctcctgcaactccctgatgacgatcagcaccagttgctgcatggagaccgtctgcccatacatcgccgcgcccttgatggcggtgacgatcagcaccagcaccggaatctggtacaaaatccgccggtcacgggcattgaacaggtcgatcgcatgctggatcaccaccggatacagcgccgtgctgcccgccatcagcgccgtcagcaggatcaccaccagcatacgaacacggtgatgcgcgatatgctcccgccacagccgccccatcatggcgagggcggtcggctccaactccacgttgatcttccgcgcccctttacctctccgctttggcggagcgtgtgggggtggcgactgatccgttacctgatcgagcgggcgtgcatccatgcacccgggtgtatcaggccggggggcggtttgcacacccccggcgggagagtagcgatccattatgatgagtgaggtctatctccgcgcacgcggaggaaccccgctttccggcggtgcatttcaacggcacggaggtctatctccgcgcacgcggaggaacccacccctccccttcctcgcgggcgcgccttaggggtctatctccgcgcacgcggaggaacctgggaccgatatcgccgtcctgcatgacaccaaggtctatctccgcgcacgcggaggaaccgccgacagtgcggcaacccctagtgagggggcaggtctatctccgcgcacgcggaggaacctcattcctgattgatggctcgcagtcctatacaggtctatctccgcgcacgcggaggaaccatcttgagacagacgaaacctatcagagattcgggtctatctccgcgcacgcggaggaaccgccagcgcgcgcggatggtgccgaccgcgcgagggtctatctccgcgcacgcggaggaaccaatgcgtgcccaacctctcccggcgaccagtcgggtctatctccgcgcacgcggaggaaccccgcaaatcagcggccccgcttttcagatatcgggtctatctccgcgcacgcggaggaacctgctggcgcagtcgatggcgaacggcacggggaggtctatctccgcgcacgcggaggaacctgtagccgaccatcttcatctctgcgaacaatgggtctatctccgcgcacgcggaggaacccagttgatcggccctgatcggctcccagtacagggtctatctccgcgcacgcggaggaaccatttaggcgaaagttattcttttgatcccgtggggtctatctccgcgcacgcggaggaacctcgtccaccatttttgcattcgggacgacattgggtctatctccgcgcacgcggaggaacctcaggcgcatccggcaccgtctgcatgagaccgggtctatctccgcgcacgcggaggaacccgtagatcacgacaaggcgggtcggatcgatgaggtctatctccgcgcacgcggaggaacctcccggggtgggagtggagtgcgcaagacgaagggtctatctccgcgcacgcggaggaacccccgggctatttttgctcgaaaagcgtgggtggggtctatctccgcgcacgcggaggaaccgctctgtatcgctggtagtctcacgcgctacggggtctatctccgcgcacgcggaggaaccaggatggcggggtcgatcagcaggtcgtgccgaggtctatctccgcgcacgcggaggaaccgggctgaccatggatgctagcatagctgcccacggtctatctccgcgcacgcggaggaaccggatgatgcacccggcccatccggcgatatcggggtctatctccgcgcacgcggaggaacccatcttctccttgggctccgcagcccggatcgcggtctatctccgcgcacgcggaggaacctacgatctgtgccgcgccatggtgaccgcgcagggtctatctccgcgcacgcggaggaaccacgagtggattcaggctggcgttcaccaccgcgggtctatctccgcgcacgcggaggaacctctgtcgtccgaacgccagggcagctcggcccgggtctatctccgcgcacgcggaggaaccgctcaccactgccttggctgcccggtttgccagggtctatctccgcgcacgcggaggaaccgattaggcccccgtctattttattcatcaatcaggtctatctccgcgcacgcggaggaaccgttcggccaattccgccgtgttggacgcacacaggtctatctccgcgcacgcggaggaacctggaacggtgcgtacgtatcggagctatcgtcgggtctatctccgcgcacgcggaggaaccgcgtttctgtctgagtgcccgttacgccagcagggtctatctccgcgcacgcggaggaaccagcagaaaaaaagccaagggacgtggggcacaaggtctatctccgcgcacgcggaggaacccgctgccttgggcgctcggaaacggtcggtcaaaggtctatctccgcgcacgcggaggaaccctgtattggagcgcaacgtcgcaatacaggtcgggtctatctccgcgcacgcggaggaaccccgatcgcacgatactcggccggaccggccggaggtctatctccgcgcacgcggaggaaccctgcatatggaacgggaaatcaactatcatgacggtctatctccgcgcacgcggaggaacccactcctaagtgcgcggcaggtcagaaagctcgggtctatctccgcgcacgcggaggaacccggatgaagcccctaatgcggaggtgacggagcggtctatctccgcgcacgcggaggaaccttcccgcaaaactgcgccatgtctttgccgctgggtctatctccgcgcacgcggaggaacccggcagacaaatcgtgcgcgtcagctagaaacgggtctatctccgcgcacgcggaggaacccggaaaaatacctgacggacgtagagggtgtcgggtctatctccgcgcacgcggaggaacccccaacggtcgttggttcactacgatcacagggggtctatctccgcgcacgcggaggaaccacgtggggcacaatcgtccaacgcccgctggcgggtctatctccgcgcacgcggaggaaccgcattcggtgggggcagcgcgaaaccaatcgaaggtctatctccgcgcacgcggaggaacccgacgcaaataaataacgccctaggaacgacggggtctatctccgcgcacgcggaggaacccatgtcacgccgcagcgcacggatgcccagcgaggtctatctccgcgcacgcggaggaacctcttgcctacaacacattgatacttattgacaatctcaaagaacacaatgtttcagaaattaacttctctgaagcagcagtactccaccggcatcgataatgtccttcggagcatcacaatcagaacagaatcaggttaggagctataccaaccctgctcctctcccacttcctcatgcagaattaaagacgcgtctgatcgtcttctgcaacgggtgcaggattaaaaaggggcatgagaagattggctctctatacgctcacccgttggcggaacatccagaacatgcttggcaatcattgatggaacaaagcccggacgaactgcatgaagcgcaggctgcgcaaggatatattaaataatctgctccaccctcctgacatcaaaatcgattttgtgcggaaagacctttccactttcattaccgagagcacccagatggcttgaaagccggaccgaaaagggatttttcttcaaacatcaggccggacgcagcaattcttatgtctgtgtcagacgaagagtagaatttaaattcctcccgccttcacgccatccttcacccacgccagcaacgccgccttttcctcctccccctcccgacagccgcgccggagccattccgtgcggagggtgtcgagcaaatggccgagcgccgggccgggcacggcgagaccggccgccagcagatcgcggcccgccaatgggaaattcgggcggctcaaaggcgtcagaaggcgtgtcagatgcgccgcccgctcatcgcgcaacatgacccaggcgcgatcaatcagagcctgcgccggatcatcagccagcagacggcgcaggctcaccatatccgcagcaccatcccacaccggcacagaaccatccaggcaggtggtcaaccggcctgcctcctgaccggacagacgcaggcgctcggccaaggcgcggggaggctcctttgcccccaccagcaaagcgaggcgcgggattgcttcctccgccaggccttcgccgggcatgccgtttgcaaccgcctcgaccaacggtgcgggatcgtatccggcgggaaacagcaccggcagcacaccggtctgctccatcgccgccagtatcgccgccagatgcgggccggtgaggatacggcgcaactcgctccacacacgctccgccgacagctgcgtcaactctccggccatggcggtaatggcctgcatcgccgccgcatccggctccgtcccctgttcccaccggccatagcgggcctgaaagcggaaaaaacgcagcgcccgcagccggtcctctgccacccgccgccccgcctgccctacgaagcggacccggccagcgcgcagatcgtccagaccgccgaaataatcatgcagcgtgccatccggcgacagggacatggcgttgatggtaaaatcccgccgcgccgcatcctcctgccagtcatcggtgaaggacacctcggcatggcggccatccgtcgccagatcccggcgcaggctggtgatctcgaaatgctggcccctgctcaccgctgtcaccgtaccgtgggaaagcccggtgggaatactgtgcaggccagcctgttccagacgttgcaacgtctgctccggcggcatcggcacggcaagatcgatatccgccaccggccgccctgccagcgcatcccgcacgcatccccccaccggacgcgcctgcggcaaaaccgccagcacatcctgcagggccggatcatccagccatgatggatacagaaatggtttttcttccgtcaaaagccgggctccgacgccagatgagcctccgcctgccgcaaccgcaaggatagctccatcaggatcgtggcagtcgcgccccagatcacatgctgctcatgcggccagacccagctttgatgacgcatgcctcttacctccagccagtcctgccggggcgcgtcaggatccagcagcacacgtaatttcagttcgaacaccgccgccacttccgcgggcgcaatgctcaccacccagtccgggcgcaccagccccaccaccggcgtcaccacaaagccggttccggtcaggaccggatcgagccgtccgagaatatgcacatcctccgccagcaagccgacttcctcccgcgcttcccgcaaggcggcatgctccggggaggcatcgccgggatcaatccggccgcccggaaaggaaacctgaccggcatgatgacttaagcccgcggcacggagcgtcaggatgatgcccggttcctcggcctcggtgattcccaccagcaccgcagcagcccgcatcatggagacagtgtccgccagcatctccgggcggcgcagcaggacgcgatcaggccccggcagggccagagccgtgcgcagatatctgccgacagaggctataccgcatggcgggacagtctcttccacctccatgcctcatccctgttccgcatggggcggcatttcgccgagtgcgaaaaacgtgccgcagctccagacacccagcatccggcggcagcaaacatcatgcggttccgccagcgcgaccagctcgtaatacaccgcccggctgatccgcgcctcaacagggggagcgccgtcttctccatccctgacatgcagatagggggtaggctcgcaggtcaggatatcatgcgccacgcggatcggatggtcctttccggcagtgatgagctgatcgacattggtgcggaaagtcagcgtctgatggcggccacagccggtccagtccagctccaccgcgacaaagggcgcatcctcgacctcgatccggccttcctcgaccggggtgcgcagtttgtaaccatcccgatcccgtcgcagcacggaagcaaacaggcagaccagctccttacgggcgatggggctgccgcgatacagccatgtgccgtcgcgccggatcagaaacggcagcacaccgcaacatgcgctgccgtcatgcgcggcaccgcccatgacggcatcaggggtaaaaccctgcttctcatcgcaggaaaggctgttcaatgtgctgttatcgaccacgttccatcccaggtttgatccgatgacgccggaaagaccgcctgaaaggcatcgcgcggaggaaagccccccacagcaatatcgccttgagagcgatataggaagtctctctctgctgatcaaacgggacgatcgcagattagccgtggctctgcatcagagcctgacaggctcggagggatgctcgggcgcggcaaaggggaccgccatgaagcgttgctccgtctttgtctgccgcagccttgtggcacggctgaaaaacgcgttcagcagcacggcggagacagccgtcagcacgatcggatcagccacgaccggcctccatgcggcagggagcatccggaaaaaatccggggccaccagcggaatgacgcccagcccgaccgaaagcgccaccaccagcatggcattatgctccgtcctgtaatcgacggtggcaaggatcttgatgccggtggccgccaccataccaaacatgatgaaagccgccccgcccagcacgctgtagggaatggtggcgacgataaaggccagtttcggcaccagacccagcgccagcatgatgcccccgctggcaacgcagacataccggctgaacacccccgtaatcccgaccatgccgacattctgggagtaggaaacatagggaaaggtattgaacaccgcgccgatcacggtccccagaccatcggcccgcagcccgcgcctgatatcctcatccgagaccggcttgcccaccacgctgcccagcgccatgaacatgcccgtcgcctcgataaaggtgatggtgaccagcaggcacatggtcaggcagggaatcaggtgaaagctgggcatgccgaattgcaggggcgtaaccaccctcatccacggctcagcggcgaggccggagaaatcgacatccccccgcaggatggtcagcatatatcccatcagcagcccggccataaccgcgacatgggacagaaacccgcgcgcgaaacgcaccagcagcaggatggtcaggagtaccacgaccgccgccgagatatggtggaaggatccgtaatcagccgctccaatcccgccggcagcccagttgatgccgatccgcatcaatgaaataccgatcatcatgatgatggagccagtcacgagagcagggaaaaagcgcagcatccgcccgatcagcggcacgatggccagcccgaacagcccgccgaccagagcggccccgtaaataccctgcaagcctactcccggcgtcgcggccatggccagcatgggcgggatgcataaccccgtgactcccataatcacgggcaggcgaataccgaacggaccgaaaccgatggtctggatcagtgtggcaatgccgcaggcaaacagatcggcattgatcagcatggcgatatgggcctgatccagatgcatcgccgcaccgagaatcaacggtgccgccaccgcattggcatacatcaccaggacatgctgcaccccgagcgtcagcaatctgggccatggcagcatctgatccacaggatgtcgttttttgaccgcactcccggatacggaacccgtcatcattcattccttctccgcccgaacatgcgcaggctcacatgccgcgccgcggcaggctacgaatcatacccgttgcctgccagtgcccttttcttgacaaggtgttgcgaaaatctgaacaccttcttccgatggcatggtgacaacacaagtgatcgacagcctatgcgacatctgcggattctgacccatatcgtcgatgtggcccgcagcggctccatccgtcgctcggccgagcggatgaacatcaccgcctccgccctcacccgccagattcaggatttcgaggaggagctgggcacaccggttttcgagcgcaccgcacagggcatgcggctgaatgccgccggggagctgatcgtgcagcatgcgctgaccagggcggccgatctggatcagatacgctcccgcatcgccgatcttcagggggtgcggcgcgggcatgtgacggtggtgtgcagtcaggcttttgccaggctcgacctgccgcgtgaaatcgaggcatgccgcaggctgcatccgctggtttccttcagcataagggtgctggatcacagccgcgcgctggaagcgctgcgccgttatgaggccgatctggcgctggtccttcaacctctgccggacagggaaattcaacccctgttgcactataccctgccgctctgcgcggtgatggcgtgggatcatccgctggccaggcgggacggcgcaccggtacggctgcgggcgtgtctggagcatcgtctggcgctgccggagcgtggcatggccacccggcaggctctggatgcggcgctgttacggctggggcagacagaccccgaggatatcgccgtggactcggattcgatggagctgctgaccgaatatgtgcgccgcgccggagccgtgacctttcaggccgccagcccgttgcagggggaggaggccggtgatctgtgcctccgtccgctcgacccgcgtgatgcggagccggtttcctgcgtgctgggccatctgcggggccgggtgctgtctgtcgcagcggccaaattcgccgatcagctcgcccgcagcctgcatgcacgctacgggcactgatctcccgctttgcgatcatgcgacaacgtgtcaccatttgcgttgatcttgtgacacgcggccagtttccaccatcgccagaggatatgtgcatcattatgccggtcagcatgtttcaaaacgccgacacacactcacttgaaaccagtctcgcggccctggaagccaccggcgcgaaaatagcggcggtgcgcaccgaaatcggcaaggcgattttcgggcagcgcgcggtgatcgaacagactctggtaacgctgctcagcggcggccatctgctgctggtcggggtgccggggctgggtaaaagccgtctggtggaaacgctcggcacggtgctggggctgcatgccgggcgggtgcagttcacgcccgatctgatgcctgccgatattctcggcagcgaagtgctggaggaagcggagcatggccgacgcgccttccgcttcatccccggcccgattttctgccagcttctgatggccgacgagatcaaccgcgccagcccgcgcacacaatcggcgctgcttcaggcgatgcaggagggtaaggtcgcagtcggcggcgtggagcatgccctgccgcgcccgttccatgtgctggcgacgcagaacccggtggagcaggaaggtacctatccactgccggaagcacagctggaccggtttctgcttcaggtcaccctgacctacccggaggccgccgatgagcgcgccatgctgctggccaccaccggcgcggaggaagcccgtccgcaacaggccctgacggccgaggatctgcttcaggcacagcgtctggtacggcagatgccggttggcgacagcgtggtggatgcgattctggcactggtgcgtggcgcccgcccggaaaccacggaggatacggaattgcgccgttatctggcctgggggccggggcctcgggcggcgcaggcgctgatgctggcgacccgcgcccgtgccctgctggatgggcggctggcccccagcctcgatgacgtggcagccctggctccgccggtgctgcggcatcgcatggcgctgggtttcgccgcccgcgccgagggcattcagctcgatcagttgatcgagcgcctgatcgagcggatcgggtgagtccagcccatatggcggcttcttctcatcagcagaccctgctgcgggcacaggcggaggccgagcgattgccgcctttgctggcggcggcggagcgggtggcgtcctccgtcgcacagggcgtgcatggccgccgccgcaccggcagcggcgagagtttctggcagttccgcccattctcccccggtgatacgccccgccgcatcgactggcggcaatccgcacgctccgggcaggatgccccgcggggatggttcatccgggagacggagtgggaagcggcacagacggtttttctgtggaccgaccgctctgcctccatgcagttccgctcggcggcagcgacggtctccaagctggaacgggccgatctgctgttgctggcgctggcctccctgctgctgcgcggcggggagcgtgtgcggctgctgggggcggaaacacgcttcagcggcggacaggccgcgctggaggcgctggctatggcgctggacacgctggtgccgggtgaggtgccgcctctctccgcgccggtgcctcctttttcccatgcggtgctgatcggcgatttcctcgggccgctggaggaaatccgcgcctcactggcccggctggcggcgctgccggtgcggggatgcgtgcttcagattctcgatccggccgaagtgctgctgccctatgaaggtcgcgtgcgcttcaccgggatggaagccgatggggaggtgctactcccccgcgtcaacgcggtgcgggaggaatatgccagacggctggccgcccagcaggaaggattggccgcgctctgtgccgggatgggcttcaccttctccatccatcgcaccgatcgggggccggaactgcctctgctggcactgcatcaggcgctggcagacagtcgggccagcacctgatgggagacaacccatgatgtttctgtctccatggctgttgctggcactcggcctgctgccgatcctgtggtggctgctgcgggctacgcctcccgccccacggcaggagaaatttcccagcctccgtctgctgcgtgatctggcgatgcgggaggaaacaccagcccgcacgccatggtggctgctggccctgcggatcgctgccgccacgctggtggtcatagggctggccgggccggtctccaccccgctggaggcgttgcccggcgctgctggttcctcccactcaccccttctgctcgtgctggatgatggctgggcctctgccccgcgctggccgggcatcctgcgcgcggcagagcagagtctggatcgcgccgccatggatggacggcaggcggcatttctgaccactgcccccggcggagacggcacccagcccaccaccagcccggtcatggaccccgctctgctgcgcgcccgcatcggtgcgttgcagcctcagccatgggccaccgatcaccgtgccgccgctgccatgctgaaccggctgccggccaagggatggggcgtggtggcaattccggatggtctcgcccaaccgggtgacgatgtgttcgccgcggcattgaatcacctcggcccggtgatgaaggtcgagaccgaaggcagcgcacccttgctgctgcgcccgcccgtgatccagcccgaccggctgatcctgcgcgtatcccataccggacgcagcgcagggaccgatcatgccgatgtgctggcccagaccgccgatggacgcagcctgtcccgcacccgcattgtcctgcccgctacaccgggtaccgccgaagccccgctgaccctgccgccggagatccgcaaccagcttgcaaggctggtgctggacggaccacaaggtgcaggcggcatcgtgctgctggatgaacagtcgcgccgacgtccggtcgggctggtggcggcggatcgcaccgccgccgacacgccgctgctcggcccgctctattacctgcgtcgcgctctggaaccctatgcggaggttcgggagggcaatttgaacaccctgctctcccgcgatctgtccgtgctgatcctcgccgaccggccggtggaaaatgaggaagagcgcgccgccatcctgcgcttcgtcaacaagggcggggagctgatccgctttgccgggccgcatctggccgcgcatccggatgatctgctgccggtccggctgctggatggcgaccgccagctcggcggggcaatgtcatggggacatccggcgcatctggccccgtttccgcccggccccttcgccggactgcccccgctcgggatggcgtcccctgacataagacggggtgacacaagatccggcgatcagaaagcagaggataaaaccggggccgatatacgggtctcgcggcaggtcatggcggaaccctccaccgatctcgccacgcatagctgggcggtgctggaggatggaacgcctctggtcaccgagcgcagtcagggggcggggcgcatcgtgctgtttcatgtcaccgccaatacagactggtccaccctgccgctctccgggctgttcgtggaaatgctgaagcggctggtcgggctggcggcaggcgtggcctccattccgcccgacaccatgctttcccccgccgagacgctggacgggttcggtcagcccggcagcccaccgcaggccgcaacgccgttgcgcgccggagattttgcctccaccccgacctctccccatcatccaccggggctatacggaccggaacagggacggcaggcgctgaatatcggcactgccgcccctgcccttctccccgctgcacctattccgggagcgcgcaacgtcaccgccgccctgctgggacggcagcatgcgttcggaccgggactgattgccaccgcgctggctctgctggcactggatatgcttctgtcactctggctgcgcggcatgctgaaacggggcggaggggatggcggcggcgccctcacaacgcccgcatcgaaacccgcctttttcgcccggcggcgtagaatgctgagcctgctcatcggcggcgccgtcaccatggccgcgctgcgcccgcgctccgcaccggctgcttcaggcggaatcgccgggaatccggacagccattatccctcgctcgccatccatctcgcttatgtcgtgaccggcaatgcggagcaggatgccatctcccgcatggggctgaccgggctggccgatttcgtctccggccggaccgccgcgacgatcgcgccgcccatcggtgtggtgccggggcgggatgatctcagcttctaccccctgctctactggccgctgaccagcgaccagaacccggatgccttgccggaaaccatgctcgcggcgctgaacgattatatggcgcatgggggcatcatcctgatcgacacgcgcgatgccggggccggggccggcatgaatggcggacatgaacgcctgttgcaggccatcgggcgctccctgaatgtgccgccgctgaccccgctgacgccggagcatgtgctggcgcgcagtttctatctgctgcacgatttccccggccgttacgccggtggcgaggtctgggtccagcgcgatgaggaccgtgccaatgacagtgtcagcccggtgattattggcggcaatgactgggcctcggcctgggcggtggatgatcaagggggccatccctatgccaccattcccggcggcgcgcggcagaggctgctggcctaccgcttcggcaccaatctggtgatgtatgcgctgaccggaaactataagggcgatcaggtgcatgtgccctccattctcgaccggctcgggcagtaggacggggatttgatgcagaccgatcatatctccgcctctgatcatatctccgcctctctggggtttcagccgcttctgccgctctggctgctgggaacactgggggttctgtgtctgctggcgctgctgcccgcgctgctgcgccgggcgcggggctggccatggcggctggccgccttcgccgcgctgctgatctggctcggcggtccgatgctggtgcgggaaacgcggcaggggctggccgatatcgccctgctggtgatcgaccagagcgggtccatggcgctgaaggaccgcaccaagctggccgaacaggcccgcagcattctgacgcggaccattccccagcccggtcgtgctggtgaacctccgctggaactgcgcaccgtcaccgtaccggagcatggccgtgacggtacgaaactttttgccgccatcgcgcaggggctggccgatattccacgcgaccggctggctggaatcgtcgccgtcaccgacgggcaggtgcatgacgtgccgccctccattgccaaaggcacgcctccggctttcaacgcgccgctgcatgtgctgctgaccgggcggggcgaggaaaccgatcgccgcctgcgcatgatcgaggccccgacctacggcattgtcggcaagaccgtctccctgcgcgtggcggtggaggatctgggcgtcgccaaccctgccaatggggcctcccctggggcctccccgggggcggagttgaccctccgccgtgatggagaggctccggtgacgtacaccgtgccgatcgggcaggaataccccattaccctgcctgtgacccatgaggggccgagcgtcatcgacatgacggcggcaacgctgccgggagaagtctcgaccatcaacaaccacgctgtcgtcaccctcaacggggtgcgggaccggctgcgcgtgctgctggtctccggcgagccgcatcagggcgaacgagcatggcggcggctgctgaaagccgatccctcggtcgatctggtgcacttcaccattctgcggccaccggaaaaagacgataatacacccctcaacgaactctcgctgatcgcctttccggtgcgggagttgtttcagcagaaaatccgtgatttcgatctcatcattctcgaccggttccagaaccgggggattctgccgcaaatctacctgcgcaacatcgccgattatgtgcggcagggcggcgccctgctgatgactgccgggccggaatatgccagcccggtgagcctcgccaattctccgctgggggaggtgctgcccgccatgccgcatgggcaggagtccgacgatccgctttctgccgtgatagaaggcgggttccgcccgcaggtgaccccactcggcacccaccatccggtgacggagaaactgcccggcgcaccgggagggggaaaagataccgcttcggaatggggatcgtggtaccgctatatcgccacggacagcccggataatccggggcatgaccaaacggggcatggccaaactgtgctcgccaccccggatggcgcgccgctgctgattctggaccatgtgggcaaagggcgggtggcgctgctgctatccgaccagatctggctatggtcacgcggacatcaggggggtggtcctcaggcggagctgctgcgtcgcgtcgcacactgggccatgaagcagcctgagcttgaggaacgcgccctgacggcacagatcacgcaggggcgtctgacagccctgttgcgcagcccggaggatattgcccccggcacggtgaccgtgaccgatcctgacggcaaggacaccagcgttcccctgcatatcaccgggccggggcgggcggaggccagtctacccgccgccacacccggtgtctggcgcgtgcgttatcgtccgccgctgtctgctgaacccgcttctcaggaaggggacaaggctgcatcctctgaactgactgctttcgtggcggcatccccgcctgatccggtggaggtcgccgatctccgcgccacggcgaccgtgctgaatggcgcagcccggctcagcggtggcagtgtgcaatggctgtcgcccgcaggggtacccgctatccgccgcgtctccatggacgcgcacgccgctggaaatggctggattggcctgcgccgcaatgatgcccatctggtgaccggaattgatgcgctgccgcttttacccggctggatcgctctgccgctgatcctgttgctgatcctggcagcgtggcggcgtgagggacgataattgggacacatgggggaagactgttcagcctgatgcatccgcaatttttccactgcgtcacaagcaggacgacacaagaaacacgacagggaaacagaaatggccagacagcccgattttcatgagaataatcaggatgccgcgtctgcgcgctggtctccgacagtggcgctggcgggatttatcgctttctgcctgctggtggcagccgttgatggtgtctttacgcagggcggcgtgcgcgactggtatccatcactcaccaaaccgcccggaacaccgccgaactgggtctttccggtcgtctggaccacgctatatatcatgatcggtgtagcaggctggctgctatggcgccgcagggcatggagcacgctacgcctgtggggctggcagattctgatcaacgcgctgtggaacccgatttttttcggcctccaccagatcgggatcgcgctgattgtgattatggcgctgctggccctgatttttcgttgcatccagcgctttaaagcgattgatgctctggcggcgtggctgtttgtgccatatgccgtatgggtctgctatgctacctatctgaatgtcggcttctggtggctgaactgaaccgcatgcacccgcctctgccatcgggcaccgggcggaagggagtattcattctgatggcgtatcgcctgacttcttctttgtcgtttcgcacacgctgtggcggtattctggcggttctggtgaccaccctctgcattgttccggagcatactgcgcaggcgcagggcatgggtatgcacaacaacccgcacgcctcagaacccaaggtgcagcaggctcctcccccctctctgcccggctccaaacctgccagccatacgccggtgccgccgcccgacaaatcgctggccgatatgcagccgaatgacgccctgttcgatgccatcaaccgcggcgatgtccctgccgcccgcgacgccctgtcacgcggcgcgcagctggaggcacgcaatgtgctgggcatgacccctctggagctgtcggtggatctggggaggaacgagatttccttcctgctgctctccatgcgtccgcccccggacagcgccgccgtcatcagcggtccagcccctaaaccggttgctacagccggcaaggggaccaggagcaagggcagcaaatcccatcatgaggatagcgccgcaatctccgccacacagccgaaacaggccagcgccaatgaaacaggctttctaggctttaatcgctagctcttatgcgtccggtcggccgggaaacagtccgaccggaaaagactgtgcggaaagcggattgcagaacaccgccagttatgtctaaaacccctcccactcaccagcgggccgggttagcacagtggtagtgcagcggttttgtaaaccgaaggtcgggggttcaaatccctcacccggcaccagtttggatggttgggtgtgctcagcttttccagacaatctgatcgcccctttgcatcgcctgcacggcagagcgcacctgtccatgtgctgccgtcatcataacaagcgggagattgtttccacggctttccagatgcgcctgaagctgccccccattaaaccaggcattgatccacatcatccgtggctgcgcccgtgcaatgtggctgatggaggatggcaggcgacagcgggttatgccgggcctccagacagcgtgtgaaagattgcctggttttccggatgacatgcgcgaccggctggatgaagggccaggcaatgccatcatcctgcccatgagccgtagcgacatcgccgattatccgggcctgacgattgaaaccatctctgccgcaccttgacagcgttacggcgggaaggactggtcaacatctgtaaatcccaaattttgctcctttcccgtcctttcctcaagctgaacgatgccccccatatcgcgcaggtgcactgacacgatatggggggagaagcctcagatcaggctgttaccgccatatccatgccgaccgtcttatcaaccggataaggccctccagccctgatctgaatcgccagcagcgcgatactgtcaggggcacgctccccaagtggcagaacggcattgccgttggtccagcggcaaggcacggcctccatcgcaccccaccccggcaggtcgctttgtcttagatgacactcgatatgacgagtggacgcggcctcgaacagaagaacctcgccaaccagcaccccgagttgccgacgatcatcgacgaacgggccgatcatatcgcagggacggctgctgcgggaggcgatgcgcacatccctgacatctcccgacaccatgaacatgacacgatcctcggtcttgcggacaggacggaggatctgcccaccatcggtcaccagatgcagcgccgcatcatccgtcaaacgggctgtgaccgtgcggtcaggaagaccggcctgttccgcgcgggcctcgatctgacggaacagcggctcgacaaaatcccgcgatacacagagaggcgccgcggcagcgttccaatccagattgcgccgaccattgatcgccacaacgcggcctttgctctggaaggcataacggttaccggtatcgagatagctttccgtcagaacaccatccgctttgatcaccgaatgggtctcggtttcgatatgatagcaatcataaaccatgaaggttttatcatagaggatagaacgcccattcacgagcattctcaccggaacgaaggctccgtcgaggaacaggcaatgttcacccgtgatcagcatatccttgcacgggacatctggagcaatagcatctttcagcacgcgcaccggatagccggcaagatcatcaggaacggaaggctggacccgcatctgtgatttcccaacccatgtcaccttgcggacagagactgttccaccatgataggtgacgatctcatccccaacctcaatgtcctgtacaggaacatctccccgcgccagcgtgatcatgctgtcaggcaggaagcagggcgccgatccatcgataccggcataggtcaccagcctgccgccacccgccacggtcgtcggctctgtaacggtggcaccggcagagaccgtcatggtgaaagcacccgccgaggcattacccagataaggggacgtgaccgtagcaccggacatgactgtcacattggcggcactatccgcatcggggccgctattgatataggtgtcgttgatggaactgcccccggcggaaatcctgaccacattcgaattataggtatttcccgacaccaccccgccattggcaacgaccagatagccgttcacttccaaagaatccgtcatcgtaccgccattgagcacggagaccgtcggaacaccgccggcaatcgtcgccccggacacgaccgcgccgctggaaatggtcagcgtgttgatgcgggacatcaacacagggccggtgacggattgcgtaccgctctggtaataggtcacgccgctgatattgaccgcagaccagttgccgccgctcagaaaggtgaaacctgaaagcgggggctcggtattcggggttccactgccatatgtggccgccatggaaacgacagagccagaggtcgccgtcagcgcagatacatgtgcgccggaggatacaacggcagtcgcgcccgcccccactgtcagcccggacacattcgcaccggagccgacgacgacacgcaagccattcactgttccactgttgaaagtcgccccattcaacgtcccgcctgacgtcaccgaaacggtcgcagcgccatccgcagcggggccatcattgacaaaggtatcattgatggaactgccgccagcggcaatcgtcaccacattcgaattataggtattccccgatacaaccccgccattggcaacgatcagatagccgtttacctcgacagactccgtcatgatgccaccgctgagaacagacacggtgggaacgcctccatccagaatggcactggaaacaaccgcgccgctggagatagtcagcgtgttgatgtggcccagcaccaccggtccggtcaccgaagtcgcgccgctttgataataagtcgtgccgttgctattgacggcggaccaattgccgccactgagatatgtaaggctcattgaggtctggctccatcgctgttgagtgctgccattgaaggaattgtcttgatggttgaaataaccgcttcaggcgtaatcaaacgtgagcattcaaactgcctgtccgtgttttcatggcgcggacaccagaaaatattattgtgatcaaacatgattctgggatcattccagcaggaattacaggcattccagttgatgacccggtatggcgtataaaattcgttggtcgggtgggtaaaacccgaaatcaacacgacatcaatcccgactgcccaggccagccaggaaagtcctgagctggtaccaataaaaaattcggcatgggtcagccagcgtacacgctcttccaaaggacgattaccggtctgatcctcgcagccatgtggaagatggttccagacccagtttttgccatgtaccgatttctgatcgatacagatcacccgcaatccctgatctttcaggaatttgatgacctctctccatccatcgggattgttccaatatttgcactgcgatgatgcctgcgcggcaatgcagacatagcgctcctcgatgggtctggagtcatcacggacagcgattgcaggcctgacctcacccggatcgacacccagtatataggccgccgtcttgtggaggccgacatgccggaagtcgctgggctgccagttattttcggtatccgtaaagaacaaaccaatccggtaggttgcataggctcgttcctgcagatcggacttggccagaacttccttcgtggtgaattcgatgttcggatactgatccttgaacaaggcaataaatttatcagcaacgacacaaatcgttctggcgcctgttttctcctgaaagcgcggcacataggagaaccagccaatcgcatctcccagcgtgccaaccgggatctggatcaggatgatcttgtcggccggatcgaactgatgatggaaaacatccctgatactgccatcatcggatacaaaaaaaaccctgatctcatagcgcagaaaatatcgcttcgccgattgcagacgaccatttttcagatcgccgtggtacaggattacgccagatgccttatcacgcagtgtcacccgccagacaccatcctcccgctctggaaaatggactctggcaccgtcgttgaaatcaaaacgaatatcctcaaccccttcctgcgtcgggacggacggagcgggaagatatgcccctccatggaggcaggcagactctgcaaccaaaacaggaaaccccttatttgcgctgattttcaatcaagaaaataggacaactatctttttcaaagacaacaaagctttattttgcaatgtaattgataacccagccacgctaacacaatattatttatatagtttcaagaattattattaaataattctttatttgtgattgaatattgatttgttatttttctactgctggtaatatttttatccagccatcagagactgccggcagccacctgaacgcagaaaggcgtgcaggataatggcacgcagctggtttttatctgaacaggctggctggggcgggaggattcgaacctccgcatggcggaatcaaaatccgctgccttaccgcttggctacgccccaacatgccgtaacgcggaggatcaaccggacaggcaatcctgcgcaccgccgcttgataagcggaaccggcgcgcaggtccatccccctgatcaggatttagtgccggaaatggcgcataccggtgaacaccatggccagaccggccgcatccgccgcggcgatcacctcatcatcccgcaccgagccacccggctggatcacggccgtggcaccagcggcagaggcggcctccagaccgtcggcgaagggaaagaacgcatccgacgccaccacgctgcctgcgatcagcgcgccgcctttctgggcggcaatgcgggcgctgtcgacgcggctcatctgcccggcaccaatgccggtggtggccagatccttcgcatagatgatggcgtttgacttcacatgcttgcagacgcggaaggcgaacagaagatcgcgccattccgcatcggttggtacccgcttcgtcaccacgcgcagatcctggcgctggatgcggccattatcgcgtgtctgcaccagcaggccgcccgccacgctccgcaccgccatgccctgctcagccgggtccggcatgccacccgtcagcagcagacgcagcgccttcttgcgtgccacgatctccagcgcggccttatccgcatcgggggcgacgatcacctcgctgaaaatgctggtgatgcgctcggccgcttctgcgtccaacgtgcggttgagggccacgatcccgccgaaagccgaaaccggatcgcaacgcagcgccagatcccacgcttccgccagactggccgccgaggcgacgccacagggattggcgtgcttgacgatgacgacactcggctgctcgaactccgccacgcattcaaaagcggcatcggtgtcgttgatattgttatagctcagctccttaccctgaagctgacgcgcagtggcaacgccgggacgcgcgcccagcgcatagaaggcggcgctctgatgcggattctcgccatagcgcagaccctgcctcaagctgccgccgatggagaaatgacgcggaaattcctcctgaaccgtcccctgggtcgcaaaccaggttgcaatggcgctgtcataggccgccgtgcgggaaaaagccgccgccgccagccgacggcgcagcgtggcatccgtgccgccatgcgcggtgaactgctccagtactgcatcatactgcgccggatcggtgacgatggtgacgtggtcgtggtttttagccgccgcacgggtcagggcggggccgccaatatcaatgttttcgacacaggtttcgaaatccgcgccggaggcaacggtggcttcgaacgggtaaagattgacgcagaccagatcaatcggagcaatgtcgtgctcattcatctgcgcgacatgctccggcagatcacgacgaccgagaataccgccatggatctgcggcaccagcgttttcacccgcccatcgagaatctcggggaaaccggtatgcgctgagacatccttgaccgccactcccacctcccgcagcgccgcggcggaaccgccggtggagagaatctccaccccgccaactgcaagcgccttggcaaaggggattaacccggtcttgtcagagacggaaatcagggcacgacgaataggggcggtagcggtcatgatgggtgcgaactccggcttgaagactgccagcgtgtctcccaagccgtgcgcggcgacaagagccttcgccgcatgcccgcccctctgctgtcttatgggcctcctgcctttgggaagtcagcgggcggcgtgaagctccggccgcactggcaggttctgggcttcgcgcaccgccacccaggctttcgtcacagcgtcggagaacatcatcccgggtgccttctgacagacgcgatagacggtgcgggcgcgttcgatcttgtgcggggtgctgtccggcagctctgccgtcggcagtcccttcgcggcggcgttgctttccagagtgcggaaagcatcatcgattgtctcgaaccagccgatcttgcgggaggaaatatggttgcgcaccaccatcgcttcgatccggcgactgttgaccacctcccccaccgcagcgctgtaatcggcgcagcgcgggcgatagttgtccgtggcggcctgagcctgtttgacgggcagaaagccactgactgcaacagccacagcggcaagccgggcaaacggatgaagcatcttcctggaaaggtgcatgatgggtgatctccggcacgtcggttcgacagacccggcggtaatgccggatatgtctcatttagacatgtcgaacggcggatgcacccatcttcgcacctgcacaatactatgtcacaatccggcagatgttctgcaatataaggccgtttcaaggcaacgcagagagagcgtgagaaggaatgcctctcttttgtctcggtgctattctttctcgatcgtgcattgcaggggatgctggttatggcgggccagatccatcacctgcgttaccttggtctcggcgacctcataggtgaagacaccgcagacccctaccccgcgccgatgcacatgcagcatgatctgggtcgcttcttcgcgggttttctgaaaaaaccgctccagcacatgcacgacgaactccatcggcgtgtaatcgtcgttcagcatcaagaccttatacaaggacggcttgcgtgttgccgggcgcgttttcgcaatcagtccggtgctggtgccatccccggcatgaccctgcccgtgctcatcgctgccatggatatcgatcatggtattcttcccgtcatgaagccgtaccatgcgccgcttgggcgcggcgcgttccagcctaccatatcggatcagggctggcgggggaaagagggagcaggcagggaaaagcacctgatgcattctgcaggcacaagcacaccggaagcgggatcgctcaccccatccgatcgacggcagcagagacacgctcggtcagaggggccagcgcctgctccgccacccgcatggaagcatcagccaaccggctggtatccaccacggctttttccatcacatcgcgggcaaagctgttctggacctcaatcatatcctgcacggagcgggtttccgccatacggcgcatggcattggtggccgtttccagaccatcctgagcactggcaagccattgacgggacagttcctgaaacccgctggcccagacctgactgcactgaagcaaggcgtcaaaattgtcgcgatggaaggccatcagatcgtcagggcctggaatcatgctgtatcattcccgttcatcccgcgccgggagggagcggaggagacgttcagactatacggcctggtctgtccggcatgggcaggcgtcattaattaccatgcccggaccgtcatcaaacatgagccgtcatgttgcattgcaacacgaggtgtcaggtagccctccctcccgttaaagtcaatgacggcaaggcttcctcatcgccgccagccttgccggatggctcaatgatgacagttccgcaacaccggggggttatccgccacggccaagaaccgctctgcaaatcatctgttaacataccggaaatattgcttttcccggcaaacgacgctggacagcagccgtgctcgcctattaggtttaataatgcatggggggatggaccgtggggcgtataaaagctgacagagcgcaggcaagccgggccattgcagcagaggagacacccgtcatgatggtgtcccctctccgccgcagctggcgcgcccggcttacccccgccctgttcggcaagatcgtcctgcgcagcaccatcatcggcgggctgcatgtgtctgcaggagccgcgttcctcaccaccgcagcaaccggtttttccactacggcctacgcccagatcggttccgagcgctacagctccatcgtcgtcgatgccaataccggggctgttctttccgcctccagccccgatgaactgcgtcaccccgccagcctgaccaagatgatgacgctgtatatgctgttcgaggcattgcgggatcgccgggtctcccttgatgatctggttccggtctccggtcatgccgcctccatgtcgccctccaagctcgggctggtccccggcacaaggctgacggtcgaggaagccattctcggcctggtgaccaaatccgccaatgatgccgccgccgctgtcggtgagatgctgggcggtagcgaggagcagttcgcgcagatgatgaccatccgcgcccgtgcgctcggcatgacccgcaccgtgttccgcaacgcatccggcctgccggacccggaccagatcagcaccgcccatgatatggctgtgctggcccgtcatctgattctcgatttcccatctgaatatcgttacttcagcacgcccagcttcgtgtttcaccgccatgtgatcccgaaccatgatcgcatgctctccatctacccgggtgcggacgggctgaagaccggttataccaatgcatccgggctgaatctggtcacatccgccctgcggagcgacgtcaggctgatcggcgtggtgttcggcgcctccaacaaatatgagcgcgacagccatatggcagcgctgctcaatgccggattcaggcaggaaggcgtgcagtctgacggtatggctgtggcacaggcacgggcaccgtccttcatctcctccgcccatgcgtcggccatgccggtttccgcacggatgcgggtggcccgccatcaggcgcgcgttcctgccgcacgggaggtcgaggtggccgaggcccccgtcatgccgcgcagcagactgcaccgctccgtctccgtggtgcaggtcggtgctttcagcacccgtgccgccgcccagcgggctgcgaccggagccgcccatcaggatggcggcaaggtgcaggtgacacccgttatggtgaagggacagaagctgtggcgggcacaggtccagaaaatctcatctctcgtcaaaccatccaaggcacgccacacacaggtggcggcccgttaagccctcctgattttttcggctgacggccttatatctgttccagctacccgccagggcggcttcccggaaggggcgaaatgtttttccatttcgccccattgcttgtgcacatttgctgacagggcctgcacagcctgccccctgtcgatttctgtcgatcaaaaatcgtgaggatacagaattccatgaatcaggcgcatcggatcgtggtcgtgggcggtggagccggtggacttgaactcgtcaccgctctgggcaacacgctggggaaacatggcaaggcccatgtgacactgatcgaccgcgcacgggcgcatgtctggaagcctctgctgcacatcattgccgccggcagcatggatcccggcgaacatcaggtgaactatctggcgcaggcaaaatggaaccatttcgacttccgacttggggagatgatcgggctggaccggcaggcacagctggttcatctgggcgaaatgcgggatgaggaagggcggcagatcacggctccccgctccatcccttatgacacgctggtcatctgcctcggcagcgtgaccaatgattttggcacgccgggcgcggctcagtatgctgtgccgctggataccccgaccgaggccgtccgcttcaaccgtcgcctgttgaatgcttgtatccgcgcgcaatctcaggatggtccgcggcaccccggtcagctgcatgtcgcgattatcggcgcgggggccaccggcagcgaactggccgccgagctgcatcgtaccgcccgtcagatggtggcctatggcctcgaccggatcgacccgcaacgggacatgcgcatcatgctgatagaagcggcgtcacgcattctccctgccctgccggagcgtatgtcggtcgcgaccgaagaattgctgaaagagctgggggttgaggtcatgacgaactgccgcgtggctgaagtacgggaagacggggtgcaactttcctccggtacattcctgccggccgagctggtcgtgtggtcagccggagtcaaagccccggattttctgcgcgacattgacgggttggaaaccaatcgcgccaatcagctggtggtcgaacagacgcttcagaccacccgtgatccgaacatcttcgccttcggcgactgtgccgcctgcccgctggatgagaccgggcgtctggtccccccgcgcgcccaggcggctcatcagcaggccagtcacatggtcgggcagatcaaacgccgcatggccggagaggcgctcaaaccctatcattaccgggatttcggttctctggtttcgctgggacgctacagcacggtcggtaatttgatggggtctctggtcggcaagaatatgtttattgagggctattttgcccgactgatgtatcgttcgctctacaagatgcatgaggtggccgtgtcaggctggtggcgtaccatggtggatacactggcacgcagcctgtcctcccgcgtggaaccgaccgtgaaactgcattgacgtcagggcagggtgtttctattgccccgggttcaggcggcatattgccgcgcgctggtatagtgggtcagagtggcggaatatccgcattgaggccggggagtggattgaatggacggtgagtccgactcaaagcgtatcatcctgcatcggccggaggatttcgtcggcatgcgcgcagccggacggctggcggcagagacgctggatttcatcactccccatgtccgccccggcatcacgaccgaaaaactgaaccagctgtgccatgatttcattgtcgatcatggcgccattcccgcgccgttgaactatcgcggcttcccgaaatcgatctgcgtctccatcaaccacgtcgtctgtcacggcattcccggtgagagaaagctggaggatggcgatatcctcaatattgatgtcaccgtcattctggatggctggcacggcgacagcagccgcatgtatgcggccggcaccccggccaccaaagcccgcgtgctgatggatgtgacctatcaaagcctgatgcgtggcatcgaagcggcaaagcccggcgcaacactgggcgatatcggtcatgcgatccagagctttgtggaaagcaagcgcatgtcggttgtacgggatttctgcggtcatggaattggccgtacctttcacgccgcccccaatgtgctgcattacggtcgccccggcagcggtagcgtgctgaaaccgggcatgttcttcaccatagagccaatggtgaatgcgggccgtccggacgtaaaggttctggacgatgaatggaccgcagtcacacgggatcgcagcctgtccgcacaatatgaacatatgattggcatcacagagacaggcgctgaaattttcaccctctcccctgccggatacaatgcgtggccctatccagtctgacgatacgcgaaagaaaataggaaaccggcggaatggctaaaggcgtcggagaagcttctggcccgctgggcagacatatcctgcgccaggaaacatcggtttccgaaaccctctcccccgcgcgctctgtcgaggatgttgctgccaactctgccctggtgacatccgttcctcccggcaaaggaaccgaggggcatcgtgccaggatgcgccaacggctgctgacgcatgggccggaggcgctggcggattacgaaatgctggagatgctgctgtttctggcgcttccccgccgcgataccaagccgctggcaaaagacctgctgaaccatttcggcagttttgcagccgtcatcagtgcatcccccagagaactgaccaccatcaagggagtgggagaagcaggtgccgcggcgctggctctggtgcgggcggcatcgctgcgtttgctacgcgccgatgccgtggcacagccggtattgaacaactgggaaaggctgatcgcctatctcaacgcttctctggcgagggaaaagaacgagcagttccgggtgctgtttctcgacaaccgcaaccagctgatcgcggatgaaatactcgcacatggcacggtcaatcacgcacctgtctatccacgggaagtcgtgaaacgtgccctggaactgcatgcgaccgccctgatcgtggtccacaaccatcccagcggagatcccaccccatccgccgaggatatccgtatgaccagagaattacgggaagccgggcgtcttctctcgcttgatctgcatgaccatgtcatcatcgggcggcatggctggagcagttttcgcaagcagggcctgctgtgaccatatccacgcttattgccttcaaatataatgcgccttttaattgccgcttcggcaagactattcttaatgacgaaggacggtagccatgggaaataacatgacacgcgtactggtcatagaagacgatgaagaagtcggtccgtcccttcagtcaaatctgcttgcccgtaactacgatacccagctggcgatcacaggtacgcaagggctggaggcagcaaccaaatccggcttcgatgttatgattgttgatcggatgctgcctgaactggatgggttaagtctgatcggacgattgcgggagcagaatattcagacacctgcccttgtcctgagcgcgcttggggcagtggatgatcgtatcgaaggactacgtgcgggcggggatgattatctcgtcaaacctttttcgctggaagaactcgtagcacgaatcgaggcgctggtccggcgcccggtcagtcaggccagcctgcaactgcgcgctggcccgctgcggctggatctgctgaaccgcacgctttcctgcgaggacaaaacggtcgatctgctggccatggaactgaagctgctggaatacatgatgcggcgtcctgatcaggtggtgacccgggcgatgctgctggaagacatctggcgttatcgtttcctgccggaaaccaatctggtcgatgtgcatatgggcaaactgcgtcgcaagctggccgaggctggcggtgacgggctgatccataccgtccgcggtgccggtttcatgctgcgcattcccgccgagaccagccacctgccctccgcctgacatccggcaggacacgctcttttgtcatccagccatgcgccgccgaacacatccagtcccgcctccctccctgccgtgatcagggaaatcttccacaccaccaccttccggctggcaatggcactgggaggatcattcctgctggccattctgtgtctgttttcattcatttatgtacagacatccattctggaaaccgaacgtgtagacagaacgctggcgcatgatgccagagaactggtcgcggatcgtatggaggatacgctccgcgccgttgatctgaatgtcgtgaatgatctgcaccgggtgacactggttggtgttttcgaggccgatggcacgcgcattgtcggcaatctgctgcatctgcctacgtatctgccggtagatggggttgcgcatggcatcaaactgctgcgtctggctggcgaacatagcgtgcgcgaaaaaatgcgtgccgtcgctctgcgtattcatgacggacggattctgattctggcccgcaatatcgaacaactggatgaattgcggcatgtggtgctgggtgccctgctgatgggggtcgtgcctgccgttatcctggcgctgatcgtggcggtatggatcagcgcaaagacactggatcgtgtgcgcgatttccatacctccattgcccggatcatgaatggcgacctcagcgaacgactgtccctgcggggcggagacggagatttcgaccggctctctaacagcatcaacggtatgctggaccgtatcgaggatctgatccgcgatctgaaaagcgcgggcgacaatatcgcgcatgatctgcgcacaccgctgacacgggtacggatgcggctggaacaggcccgctcagcacaggatcttgattcggcccatgccgccattgatcttgccctgaatgggacggatcgcacgctgagtattattacggccctgctgcgcatcgcggaaatagagacgggtcagcggcgctcccatttcagtgcggtcaacctgccggacctgctgtccgaccttgaagcactgtatggcagcatcgcagaagatgccgggctgacacttgggattaccaccccgcccccgcctgttccggccatctatgccgatgccgatctgctgatggaggcgctggccaatctggtcggtaatgccatcaagtttacgcccgcaccgggggatatcatggtggaagcgtatctggcacatgatggcgccatgctgatcagcgtcagcgatacaggccccggcatctcggctttcgagcgcgagctggttacccagcgcttctatcgatccgatcgcagccgccatgtggagggaacagggctgggactcagtctggtcgcagccgtagcctccctgcacggcttcagcttcacactggcggatctcaatgatatggcccatcacaggcgcaaacatggcatgccggtcggctgcattgccacactacgctgcccgcgggaatccgtactttaccatgcctcctccaaccgggaggaagaaccgcgcggaaacccatcagcctttccgcgctctcaagagacactcccgatacagcccccgaccacaccgccataagcctgccccacggtcgggaaatccacctcatcctgccaccagctgatgcaaccggccgatgccgtgacgcagccacatcggtacccagcctggtacgccggcctcggtatcgctgaattcctgcacaccatcccagatcattttcagcgcgacatacagcaccactgccagcccgacccacgcgatccagcgataacgggacagcagattcgccagcgcattggccactacccccatcagcaccaccgacagcaccaaacccgccatcaagatataagggtgcccctctgccgcaccagccacggccagaacattatcgaggctcatggaaagatcggcgagcacaatctgcgtcatcgcctgtcgcatggttttggtcggaggggatagttcgagatgcggttcctgacggcgcaattccctatacatgcgccagcaaacccagagcagcagcaagccaccagcaagcgtcaagccgatgatttccagaagctgcaacgccagcaaacccgccgcgacacggatacctgttgcaatggcaatgccccagaacaccgctttacgccgctgctcggccggcagtcctgccacagccagccccaccagcagcgcattatcacccgccagggccacatcaatgaacacgacctgaaaaaatttgatcaccgcagggctgaaaaccagtccgtccggaaagagagagtccattatcttttccatcctctaccgggttaaaggcccggcctgttcccccgcccacacgacaggggttgccaaaacggtgcaggcgggtttctaccttcctctccgcccgctttggaagacgagatcccgatcatggttccccgctatacccgccccatcatggccgccatctgggcgccggaaaaccgttaccgcatctggttcgagatcgaggcactggccgccgaggccatggcacaaaccggtatgatcccggaagaggctgcccgcaccatccgcgagcgcggcaacgtcaaggtcgccaccatcacccaggccgatctggaccggatcgacgcgatcgaggccgaaacccggcatgacgtgatcgccttcctcacctggctggccgaagggatcggtcccgatagccgcttcgtacatcaaggcatgacctccagcgacgttctggacacctgcctgtctgtacagatgacacaggccgccgacatcctgctggctgatctggacgaggttctggcggcgctgaaagcgcgggcgatcgagttcaaatacacccccactatcggtcgcagccacggcattcatgcggagccgaccagcttcggcctgaaactcgccgggcattatgccgaattcgcccgcaaccggaagcggctggagcaggcccgcgcggaaatcgccacctgcgcaatcagcggcgcggtcggcacctacgcgcatctcgacccccgtatcgaggcctatgtagccgagaagctgggattgagcgtggaaccggtctccacccaggtcatcccccgtgaccgccatgccgcgttcttctgcacgctggcagtgatcgccagcgggatcgagcgactggcgatcgaggtccgccaccttcagcgcagtgaggtgcgggaggctgaggaattcttccatgccggccagaaaggctcctccgcgatgccgcataagcgcaatccggtgctgagcgagaacctgaccggcctcgcccgcgtggtgcgggccgccgcggttccggcgctggaaaacgtggcgctgtggcatgagcgggatatcagccactcatccgtggagcgcgccatcggccccgatgcgacggtcacgcttgatttcgcgctggcccgtctcgcgggcatgatggcaaagctgaccgtctaccccgatcagatgagcagcaatctggagagtctcggcggtgtggtgcacagcggggaggttctattggccctcacccgtgccggcatcctgcgcgaagatgcgtatcgtattgtccagcgcaatgcgatggcgacatggaccaagctcggcctgccagatgcgcgaggcttccgcgacaacctgctggccgatcctgaagtagcaggtcgcatcaccgccgagcagatcgacgcggccatggacccatcgatgcatctgaaacatgttgataccgtgttcgcccgcctgttcggctgaacctgaggtataaaaggggcggctgaaggaggccgggcatgtgcactctggtccttctccaccgtcccggtacggactggccgctgttgatcgccgccaaccgggatgaacgactggcgcgtccctggctgcctcctgcccggcattggccggatatggcggtcacaggtggactggataccgtggcgggcgggacatggatggctatcaacgatcagggcgtggtggccgccgtgctcaatcgcaccggcacgctcggccctgttgctggcaaacgaagccggggagatcttcccattctcgctctgcactatcgcagtgcagaggaagccgtgcaggcaatcgcccaactggatgcaggtgcgtggcgcggctttcatctggtggtggccgatcggagccatgccttctgcctgatcggcaaaagtttgcccgggaaaccagaagttatcccactaaaagcgggaatcaacatgttcaccgctcatgatccgcatcatactcccagcccccgcgcagcacgcttcctaccgattttccagacaattgctgctccctctctgcccgactggggtgcatggcccgcaatcatggccaaccaggacgccccccacgaaagccgcatttgcctacctgaaaaaaatggatatggcactgtctgcagttctttgctgggtgtttcctccaacaacgatctcatctggcaatttgctccgggtaatccgcatacaaccaaatacaggcctgtaaagatacgctgataaaatagtcgtagcctgccccaaattcagaaacttgctgtgcacgcttaaaaccatccgcatccgccgcaagcgtgctggaatcagcgccattacgccgatctttctcaagcttctcagaggccgcctgaacatcacgatcggctttgtcgcgataagatttcgcaacctcgccgctgaccatcatgccgagttgggtaaagccgtaaggcagcggatttcgtgacgttctcgctgctgagccgcgtgtattgtgcgcaaattataatagggtattctcgatcgagagcaggatgatatgctgcccgtatttagttcaactccgcgcgcccgggcggcattattttatttctttattttaacatatacaactttgcccatcccacaaatgatggggaaaggggcctctttagcccccctatattaaaaccctttattaattctttaccatatgcagtagagtataattgatagccataccaggctgcaattctatcattatctttatcagtacctctatcacgatctttatcggtattctttatattctctatagcctgccatatagatatttctgttccagtatcaatatctgctatgccagttttacaagaggcttcgacaaaaccaatcaccctatccttccatgtcgattcgcctgtaatctgatcatacaattctatttcaggaagaatactataagtagccatctccgtaatgctcaacatataaatatcatcttggtaagcttggagaattttttgatcacacatcattctactcacgaggaaattttaactttagaatcctatttgaatttaatccctttaccacaggatcattgatctcaacagtggctgtcgtcgacagtgtatcccgccctgcttgcccagctcgacgaaaggttacagcactgccatcactgaattccgcaacccatgcccccggcttacccggaattggcttaaaacttgtcggtattctaccgttgaatgcattgaacgcaaactgctcagccgtttgatcagggttcgcactggcaggcatttcacgtggactgccggccccaccactaggtgtaccgacaaaatcaccattcagtctgaataaattcgataaaccaccactccgattagagagtgtttccaacaatgcttttctggcatccaaagtcgcctgatcggcagcagaaaggttttccgtaccaacggaagcattcttgatcagctcctgcaaaccatccgctgttgtattgagggacttaatgttccttgcctctgccagcgcctgctgcatccgcaccacatcttcacgggtcggcacataattctgtggtatcagcattttcagcgcagggttctcaggatcaatcttcgcaagttctctggcagcaaagttgaagttatgcgtgtcgaggatttcctcttccgtcagaggctcaccattcggaccaacagggcgattgacctcttcatcaagaggctcctcctgattgtagagtgtagagctggctgctgcggaaccacccaggaccgcaccgatccctgcaccgcccatgcctgcgccggtcagcgcccctataccagatccaatagccgcactcgccatgaggatgacgacatggccagccgggctatcaggacggatcgcaccaccttgcagataatcctgccacaaatagcgctgtaattgcgccgaggaatacgttccagccgctgcgccaagcccgccagccagaatactgcctgcactgccgcttcctgcgatggcaccctgcgcggcaccgatcacagcatgcagcgccaaggcttccgcactgtcttccttccatcccgcattgcggatttgggcaccggcagcttcattggcgacctgaccaaaaagcgttgctaatccctgattgaaagcgaggtcattacgcgtctgctgcggatcgaacttgttctgcaacccgttcgtggtttgcagcgccgtgccgccattcaccgcgataccgccagtgactgtgccgagtgacgtgttcgccgtcagctgatccggacgcagcagattcgatggaacagagccgttccgcaccgtcacaccgacattgctggtgatcgcggacagggttgtgctgtgtgcactatcgctggtttgggcgacaccgccgccactgcccgttccgctgcttgacgcgctggcagtcatcgagacggcagagttatcccggtgattatccagattgctgaccgtcagcgtgccggtgttcagaacattaccgtaccatcagtaagcactttatcccggctgcctaaagaaaaataaggagacaatgcaaactttgggctccaaaaaaatgtggaaataaaattttccttcaaagtaagctattttgctcagacaattttaaattcagaccacagcattaaacaacacccataaacgttcacgaatctgatcaagcttggcgtttgctgcaaaacggccatcttcatcattatcccagatgaaatactccgagaatccccggccaccagcgatcatggttaggtagatcgatcgcgcattctcaaacccctctgaatctgctctcccctctttcttctgcaattcagctattgcagcctgaattccacgcaaccagtttcgttcgtttttagcattgagaatgctctctagctcctcaagcaacacaagaaccgtagcggcacgtttatctacaatttctttcattttatcggagtcgatccaagaacttggacgccttctatattccatggtgtttgaataaagatctgatctttgttatatcctcctaaatatactccaccttgattaccgaccggcccctcataaattgtcgttcccttgggaatttttacagcgtagacagtattgatattggatacgcccgtaagaacgccagttttaggatcaatccactgcggcttcacagccgaatcaatcctgacttgaggtaccgatgaggggggctccctcgtaaaccattgaccaagaggtgcgccagcatctcctgcacgatataatacgatgtcatccgtcaatacggtagaattatattttccactcatgaagtttgcggctggattgcctggcaggcttgctaacggtccaggattctccacagtattgtaggtaaacggaccggttacacttccataccccttcacctgcacacccggctgcccgacgacggtcatctcgccgtctttcacgatcacggttccgggtatctgccgtgctgagccggcagcagaagccgcggctcctccggccatgccatacagaagctccgcggcccccggagacatcccaaagacagaaaccagagcctgtgcgccgaaagtccccgtcggatgaccgctgatcgtcatcaggccagccgctacctgatcagcagcccaaccactcagaacaatgccaccggcagcaaccatacagccactgccaaagcttgccgcgcagctggtgataccgctgatcgtcagcgcacgacccgtcaccgcagccgtatatccaccggcgacctgcaaggtagccatccctttcgtgagaacctggccgtgaccggaatcaaacgcactcaacgcgtcaattgcagcatcagacgcggaataaccaaaaagtgcctgttccgcagaaggactatgcccaggggcactccctccctgaaaaaatgcagtctgcgaactcaactgattgcgcagatccgcataaccggaagaggcaccaacatccgcaatgcttttccagaatatgtattcctgactgccctcagcatactccgcgtagcatttcaccaaagcacaggccgcagccgtcagagccgcctcccgctcaggatcaccgttcgcaagctgcctgatccggtccagttcaaccggatgcagttgccggttgaactgatccgcgctcatcgccgcaccggcaccactgagcgtgccaccgctaccgccaaccgcgctgccggcaatcccaccggcgacaccgctcacggttgatgtcacgatgttcgtcgcgatcggacgcagccaggcagggagatcagccgttacctgaccggtaaagccggagagagcgccagaggccgcatcacccgccgcactgcccgccatcgcccccgcgacgttcccgccgcccagcgcggcaccagtgcctgccaccaccatatgcatcaggccggagccgtagccggaccagaaatcagccgtagcctgcttgttcttcagatcagactcatccgccgcaagcgtgctggaatcagcgccattacgccggtctttctcaagcttctcagaggccgcctgaacatcacgatcggctttgtcgcgataagatttcgcaacctcgccgcttaccatcatgccgagttgggtaaagccgttctgaaccgtgagatcattacgcgtctgctgcggatcgaacttgttctgcaacccgttcgtggtttgcagcgccgtgccgccattcaccgcgataccgccagtgactgtgccgagtgacgtgttcgccgtcagctgatccggacgcagcagattcgatggaacagagccgttccgcaccgtcacaccgacattgctggtgatcgcggacagggttgtgctgtgtgcactatcgctggtttgggcgacaccgccgccactgcccgttccgctgcttgacgcgctggcagtcatcgagacggcagagttatcccggtgattatccagattgctgaccgtcagcgtgccggtgttcagagtgttatcattcgcaggcgcaaggctggagatcaccgcaccggtcagcgatgtattgccgccaacggttacgttcagaccacccttcccagcaaaaagccccgtctgggaaacaacagaagcgtagtcattgttgatattcgaagccgccacagaggccaaaaattgaataaattatttaagaataaataatgtttatttttggaagatttaggcacaaaacatctatccaatcatcttgcgtaagtatcattacatgaaatattgtatcttttatatataaatttaaagattcattatgaaaccattctaaaaaatcagaattttctacaataacaattggactatcaggataatcatatacatcagcaatagcttctaaagataaatattttccttcatccatacatctatgagccaataccattgcaccaaaattaattacaaatatttcagatttttctttagaaaaatctgaaatatgaacacgaaatccttcattgtcataatacaaaccaacaaaatcaatagatttttcaatttttattgaagatggaaagcgtctatgaatacgttttttaggcatattaatatctcaactttatatagttatttttatactgaacctctaaagtcgggcggctaacatgcccttctattcgatcagaactatatggtcgaacaataacatttgtaccatcacttaattgaccaacatacactgcacttacatcacccttatgtatgacccttacattttttaatcctaaagaaagaaaatcagcaagtgcctgatcaaagccacctgatttatcatactgcgtcgtttttccgccagtatttcgtgtaggcttcaagcctcctatcaattcatcaattgttttcacttgattattttgattgccaatttccggcaaagcctctgcggcaaccttattctcggcattgaaatttgcctgatcggccgcagaaaggttttccgtaccaacgggcgcattcttgatcagctcctgcaaaccatccgctgttgtattgagggacttaatgttccttgcctctgccagcgcctgctgcatccgcaccacatcttcacgggtcggcacataattctgtggtatcagcattttcagcgcagggttctcaggatcaatcttcgcaagttctctggcagcaaagttgaagttatgtgcgtcgaggatttcctcttccgtcagaggctcaccattcggaccaacagggcgattgacctcttcatcaagaggctcctcctgattgtagagtgtagagctggctgctgcggaaccacccaggaccgcaccgatccctgcaccgcccatgcctgcgccggtcagcgcccctataccagatccaatagccgcactcgccatgaggatgacgacatggccagccgggctatcaggacggatcgcaccaccttgcagataatcctgccacaaatagcgctgtaattgcgccgaggaatacgttccagccgctgcgccaagcccgccagccagaatactgcctgcactgccgcttcctgcgatggcaccctgcgcagcaccgatcacagcatgcagcgccaaggcttccgcactgtcttccttccatcccgcattgcggatttgggcaccggcagcttcattggcgacctgaccaaaaagcgttgctaatccctgattgaaagcgagatcattacgcgtctgctgcggatcgaacttgttctgcaacccgttcgtggtttgcagcgccgtgccgccattcaccgcgataccgccagtgactgtgccgagtgacgtgttcgccgtcagctgatccggacgcagcagattcgatggaacagagccgttccgcaccgtcacaccgacattgctggtgatcgcggacagggttgtgctgtgtgcactatcgctggtttgggcgacaccgccgccactgcccgttccgctgcttgacgcgctcgcagtcatcgagacggcagagttatcccggtgattatccagattgctgaccgtcagcgtgccggtgttcagagtgttatcattcgcaggcgcaaggctggagatcaccgcaccggtcagcgatgtattgccgccaacggtcacgttcagaccacccttccccgcaaaaagccccgtctgggaaacaacagaagcgtagccattgttgatattcgaagccgcaacagaagcagagccgccgctggtgcccgttatcccgatctgcacatttaccgagccgccggcctggctgctgttgccgctcgcggtggcctgcatgcttttcaggatcagatcaccgccgatgctcgcaacgattttgttcccagaagcatcagccccttccagttttgtgtcttttccgctgaccagcacaagcgtgttcccagccgccaccaccgtgttcacaggcgtcgtgctgctggcaacagtgccaccctgagaccagctcgcgctgccctcaacaccatagcccgtgctttgcgtgccgatccccgcatacacaccgacagcagcggatttcgagacattgtcgttgctgtattgcgtgctgttctcccctgactgaaaaatgatgtttccggtcgagacaaacgccgcgttcccgcccgccttcatggtcgcgccacgcgccgtgatgtcgccatcggtcgacacaacggacagattgccaccggcaaccgcgacacttccctgtgccgtgctgctgaaataacgatcattggctttactgcctgagccgccgaccatgacatcgacctgcaacagctgaccgttactgcccgaagacgtggctgcatcaaccgccttatacgcctgatagctggcatacccggcctgcccggcttccagagcctgcagacgcgcatccgacggacggtccgacgcagcaaccgccgcagcggtgtaggcgttcccgaccacgccgctcaacgatgccgtcaaaccggagaaattggacttctgtgtttgtgtctgcgtcgttgtgtcatgcgatacatcaaacgtgacactcttgccgatgatcgccatgtcaccgccggatgacagatgcgcatcctgcaacgtcaccgcgccaccggaatgaaccgtcagatcaccggacagagaaccgaccgtgctcgcgacattcgtcacctgctttatcgtcgtcgtgttgctgttctgctgaagaccgacgccgacacccacaggcagcatgctgttacccatgctgaaaacaccggctttcttctcgttctgattatccgtgatgctcagcgtctgctctgcgctccggatcgagatatcgcctacagcaccaagcgtgacattccccgtgccgacaacgcccgaacccacaattgtcagatttttccccgactggatcgaaaccgtatcgccggacaccgtgctgccgacagacagaaccgcctccgtccgcgtcgacaccgtgttatggtgataatccatcccggagctaccaaacgaaaccccgctctcactatacgaggcaaagctgtcatgacgctccgatgcggaaagcagagagatatcgccgttctttgtctgaaggctgacaggcccatgatcgctcagaaggttcgcccccgtcccggtgatcgagccaacagccagaagagaaagaccgctgccgcccgaaagcgtgctgccctgaacatgctcgtcatacgagccgaccgtttgcgaacggccatcgatcaggcccgtatggctgcttgatgcctctcgcgtctcgctgctcgtcaccgcgttcagcgtgatgctgcccgtcgtgattgcatccagtgcaccgcctgccttagcactgctgccattcagcgtaatcccgccatcacccgcagcaagggtcatattgccgcccgcattgatcgacgagccgatctgcaatgttacatcatgcagaccactgaaaccgctgctgttaccaaaaccgctttcgctgcccgagatcgtgctcgacaacgtattcgtcgaggcgccgagagaaagcgattgacctccaatcagggtcacatctccgccagatgacagcttgacacctgtcagactcagagaatttttggccaaaatgatggagtttttacctgcgctgagagtagtgccgagattttccgtcagattgaattgacggtttacgccaccaaaggaagagtcatccttggtcgacaatgccaggcttcccaaagcaacattgcgacccgctgaaagttcaagagaaccaccggccccgaacacacttcctgccgaaacaatatcctgcccggctttcatcgtcagattgccaccggaaacaatggaggcaacacggttcagggattcaatagagccacccatcgtctgccagctttgtgtcgtgctggtgctgagtatcgtgccacccgcctgaagcagaatgtcattccccgctttcagcgtgccgccattattgatgatgtcgccggttacagaaattaaaagattgttcgatgccgagaccgtgccggagttataaagacctgccgctttcagtgtaacatctttaccggccagcaccgcaccatcagtaagcaccttatcccggctggcggaagcaagataaagctgaggaaccagaactatttttccattcacagtccgcggaacataccagacaatatcatcatccagtgccgcgacctgctccggtgtcaaatcaacaccgaattgcaatccaagtgagtgagactggctggccgcattgttcagcagtgcaaccatttgtgcctgctgcgtgctatatgccgcactcagcgtcgcacggcctgtggcatccgatacctgctgggcaatataacgcgtgtcaaaatacgcatctcccagaaaaggaggcgttgtctgtgagtttacgcccaagcggtcaagcagatactgggaaccgtagaaacccttgaatgtcgaatagttcggattcgtttcaatcagatattgtgcctgtggagaaggattggggataaacaaagcgttaccccccgccacagaggcaatgatctgcgccgtgctcgggccgtcaacactgctgaacgaagactgcgtcgcagaagaagaggacgcagtatttttcgtggagacaggctggaattgaggcgttgtagccgaagacgacgcaccttgcttgataacgactgcattgccattacttccccagctccctgcgccctgatttatgcctggcaagtaagaagctgtgcctccgacagatccggccccctgcatggacagattaccagcagaaacaccgccccctccctgtgtaggcgtcaacgaattcgaggcacccggcaccgtataggaaactgttccgctcggcaggcctccagtcgtggaagacagaccgcccggcaaagtcgccatcgaccccagccctccattgccattagagatgaagctcccggcaccattagagccagccggtgctgctgccgtcgatggcaatggtattgacccgccaaatcccagcatctgcgatggcatggcctgagcaatttttgtctcgttggtaattgtcccggtgaaatcgccgctgatattcccaccagcaataatggagccggtgacgctctgtcctgcagcattaaaccagtctgccgctacaacgggatgacccgcaccaataacccacccaggcatcggaatatttgagggtaacggatcaacaagcggtaaggccgaacgacagctgtcattacccgtacaggtcgtcgtatatttaacacttccctgatagccaatattattcaggctgcctcccgtcaggttgatatctccacccgccgaaagatggctggcatcatttgtgataccgttgctggaattgattgtcaggtttccacctgcactgatcaaagccgctgcagcattccgtacgtagctcgcaccagttccttcaacaagtatcccggattgtgcactttgatcataaagcgcaaaccagacaccacctgccccaataggattgggcacgtacacgtgtttaacatttgtccaatattgactgatatcagatgatgatttgaaattactgagatctaccgccggtggcgtttgattggctgcgtaaagtttttgaaaaataatccctgatgtctgcgtcacaccaccagccacatcattcgtaatgctctgagcatcaatagtcacattaccatttgaagaggctgcctgaataagtccagagtgattcaataaggcgcttgcagaacttccagcattcctgccaccaatcgtcagattgccattttctgcgataagggcaccctgattattagacagggtaccatccaggccaatattcagccccgtagaaccatatatcaatccagtattggaaatatcacctttaatcaacagattcatgtctgttgtgccaaaaaggccacctgcattgatcaaggaatttgcagatatggaaagttgtgcgttcgcaccaatgctttgaccggaagagatgctcagcgcaccatcaacatcaagagatatatccttgccagatgcaacccctgcaaagtcttctgccttgaaatcaccttttaaattcaagaacagattatttgcagcactgatctttcccaaccccgattgagcagcggcattgattatcagatcaccatcacctgcctgaatactgccatttgcattgctaaggagcccgattgaaaaattgagcaaacctttgatcgtaagagagccagcaagagcaataatactacctcctgcattgctcaatgtaccatcaatctgcactgtagcaccggttttgccaaccatcatcccggaattagacagatcttcagaaagggttgcattgagtacaccccctgctcccatagaaccattattaacaagtgatcccgcgctgatagtgagatcgctctgcaccgcaaccagatttgcctctttagaattattcagcttgccagagacttgtacagaaccacctgaagaagaaataatggatccattattgttcaatgatgctgcttccagcatcatttttgatgtcccttcgctttgaatatttttgttattgacgaccgccccctttgccgtcacgctgacgctgccatctttcgccccgatcaatccaccattcaccacactgtcgccggctgtgatcagcaaattctgaccgccgacaagtgcaccatctgcaccgatagagacagatttttcagtgagcagcgcaaccgactggctactccttacctggccaaggccttcgtcataatacgagcctgtattaatagtgatattaccggcattagcctggatattgcctgcagagttgatgaggcctcccattgcagcatttccaatgccggccaaccaaatatcacctgtcgtagtaccaattattcccttgttttcaacaattcccgcaacattcatgaccaatccagtcttacccagaatggttcctgtattggttacattgtcagaatcagttatgaatagccctgtacctgatgataaggcgccagagttattaaaaattccagcatgcaccgtgactgtatcattgactgagccaattgttccgggagcgttatttgaaaacagaccgccaatatccagattaagaattccacttgctgttatagaactgttattatttaaactacctgaagccacaagattcaagctgccattctgtgcaacaagactaccttgattatctagatccctggctatcaaacttaccagtccagatttggacccaatcgtagcacccgtcataatagtcaacaggccggatgtattcagattcaaaccattcgaaccaccagccaacggaccagctgtaacaacgggaccatcagcattcatactcaatgctgtcccagcgctgatttgaccagcagaatccgcagaataactgcctgttatgatagaaacagctccagcattcgcctgtatactaccaccattattcgtaatggctgccatggtggtattacctgcaagcccccgcaaggtaatgtcgcctttgtctgaggccacaatccctccatcattgtgaagagttcctcctgccccaaacaataccccgctctgtccataaaacagacccgagttggtagcatcacctttcaccatggaagacaatataccaagagctgccaaaccggttggcatttccttcactatgccagctgtattattaaatgtcccggcagatattgtaagatttccacctttggcggaaatcaatccactcccagtattactaagcatattagacacggccagcacttgctgaccacttgcaacaatctgtcctttattcgccaaggctgtggcctgcaaagtgatatcacccgctgccgcctgcaccaatccatcgttcgttatattacctgcccagatggtaaccggcccctgcaaagcccccaccatgccgctattgattatctctccggcagaaagggcaaaggtcccaccactgacattaccctgcacagaaaccaggccagacaccgagaaatccaatgtatgcttggcactaacgatactactcgcattatcactatacgaggcagccgcaatattgatatcaccgtcagaggcttgtatttgtcccccgttgttgagtatggcagccgtgacggaacctgtcaggcccttcaaaattatattgccggtctgggcagttacagaaccattgctgttatctagagtaccaccaatagacagagttactccggacactccataaatcattccggtattgctgatatttccagagattttcccgataatgagacccgtactcagcagaccagtactgtttcctgttgccgtattggaaagagaggctgcattaaactgaaggtttcctcccaatgctgcaatctgaccagaaccagcattttcaattttatcagccacacttatatcagctgctttaccagcagcgatctgaccactattgagcagagactgcgcattcaacgacacatcattggagacggcaatcatgatacctttattcatgattgcccctgatttcaggtcaaactttcctgattgtgttcctatcgttccatgattgatgagagacgctgctgaaacgatcaagttgccgctggcagcctcaatagtgccctcatttttcaatataccaccggtctgcagtgtcagaggtcccgctgcaatctggccagcattggtaatatctccactgacaaacagcaccatgtcctgcgctgaaaacaacgccccatttccaacaaatgtaccggtattaagggttagagttccctggcgtgcagcaatgacaccccctgtcggaataccttcaactatgccaacaccattattgataatctgcgctgttgcacttcctgaatgcattccgccgattaaaatattcccgtgctctgcaatgacaagaccattcgtattatcaagcacaccggcgatctggaatatatcgccctgtgcaccagataattttccactgttcctcaatgcatctgcggtcagtcctaataatcccgtttcggctatgactgaacctgtattggtaacagttttaccaatagaaaaagatacattgccagcacgtgctccgatcatgccattattattcagcgcgccgccagccgtcagctgcaaacctgtaccaccggttatctcaccctttgctccaacggaaaatccagcgaccgcatccagcgatacctggccagatccactgagcagaccccccccaacatctgtataggaagaagcatgaacgctgacgtttccagacttcgcctcaagcttgccgcctgtattattgaaatcacctccactgttcagggccacaccagtctgaccacccaacgttccccctgcattattgaaggttccagacgtatacagcgtcaataaagagtttggagcaattacttgtcccgcgttgttcacagagccagctgatacagacaaagcttccttctgtgacctgatcagaccagatgattcattgttcagtaggccggacagcatcaatgtttggccatcagatgattcaacctgaccactatttaccaaagacaacgctgtaagagaaatagtgcctgcagcagaagcaatttggccgttgttaacgcttgccccggcaataatctttaccgatccactatgagaaccgatcacaccattattacttagcgcgccgccagccgtcagctgcagacctgtatcaccggttatctcaccctttactccaacggaaaatccagcgaccgtatccagcgatacctggccagacccagtgatcagaccactcccaccatctgtataggaagaagcatgaacgctgacgtctccagacttcgcctcaagcttgccgcctgtattattgaaatcacctccacttttcagggtcacaccagtctgaccattcagaccgccgcctgcattattgaaggtgccagccgtatacagtgtcaataaagaattcggagcagtcacttgtcctgcattgttcacagaaccagctgatacagacaaagcttccttctgtgacctgatcagaccagatgatttattgctcaggaggccggacagcatcaatgtttggccatcagacgattcaatctggccactatttgccagagacaacgctgtaagagaaatagcgcctgcatccgccttaatgataccgttgctattattcaacagaccagccacattcaagagcagtctgtcggatactgccacaatctgtccatttgtgttatcgaacgtatcgctgctcatcagcgaaacaccggcttgtcctcgcaatatcccgccagcattactagatgaagaagaggattttatatttaaaaaaccattattactaataatcgatccattactggccaatgcatttgcagcaatatgtaaatcagatccagattcaatatagccgctattattcagagcaccttttacgtccacaatagtggtgccggctgcactgatcttaccagcattaccaagcgaactcgctgctatggccagcttatcagaggcagcatcaatcttgcctgtgttcattatatcaccggacttgatggtcacagagccggcctgtgcacccaacataccggcattgagcaacggaccacctgcgctcaatactaaaccggagccgccaataacctgtccctgaattgacaccgcttctgttgaaagcagcgccatccatcctgacgcagtcgctatacctttgcctgcatcagcataggattgcgtctccaacctgatatccccattccgtgcctgaatgaggccatttgtattaacgactgccgttaggggaagattgtttgaacctccatccagtatcactgcaccagatgcagaagcaagctgaccacctgtattgtcgagcactccgttaatatgacctgtcaatcccgtatcagctgccagaactccaccattgttggatacatcccctgttgactggacctgcaatgagcctgaaccagatacaattgttcctgcattactgagactaccaaccgagaaaaccagatcaccggcatttgtaattatttttccaccagaaacattactggctttctgtgcaacctgaaaattcgcctttttatatgactgcactgtaccgttgttattaaaagaagttgcctcgattgaaacagactctttcgttgaagcgataagacctgcattattcaacaacccattctggttcagttgaacattaccacctgattggatgctggcggcaggcgatgcatcaataccttgtgtagagattgcaatattacccgctgcggacaaagatccttttaaaacaagctgaccgtttgccgtcaggatcagatcgcttgcattggcagccattttgccgtcaattcgaacccctgctcctgcctctgtaacagtcatcagaatccgattggcatacattcctcccatcgccgctgtatcaattgcaaattgcggcgcaagagaaccatccgaggctgctgttgccgttcctgaaggataggcatagttgacttgaccagccgtcagcaaaatagcctgcccgtggacaggaccgttgaccgttacacgcctgctgacgatatcaagaactgggacctctgtaaaattaccacctttaccgacaaaagctattgtcccttctcttaccgacagatctttcagagatccatctgctccaagagaaggagtgcctgtagaaagtgtcacacggggtgtatttataaaaccgcagcctgagcaggtaataccattaggatttgccagtaccacagcagctgaagcgcccgcgacttcggtaaatccattcagttgggaagcggcattccctgtgacttcatttaaaataatctttgcagaacggccctgtaaattcgaattaccgtatacaatccctcccaactgggttgacgtggctgttgttgcattattcaggatcaaacctgaaggtgccacaccaaactcagtgaaatggttatgagacaatcctgctgcattaggtgttgcgacattcaactgcgcaacaccattggcagttgtatccagtgtcggcaacgcgccaccagcaccggcatcaaccacgatgcgctgagcatccgccataaccggttcaagtacaagcacaatactaagacagaatgcgataaaacgccgaccaatcccggctacatgcgaagaaaattctgtcaaaattgacaacagcacaaaaatagaaaaattcattttatcgcctgtttttctgatgtgtcggttattcatcagaattttactccagcctgaaacgcgcagacccatccatcatgaccaagaggcccttctgcaagcgcatgctgtgccgaaacatcccaaaatactggaccactcagacttcgaaagccgaatgccgccccagccactccaccacggacaagcgactggttagtctgtgacaatgcagcatttgactctgcccaacccgcatcaagccctatataggcttctatttttccgcttagtatatcaacgttttttaaacctgtacgcggcaggttccatgtaatgtcgttacgtacataagaaccatgatcaccgatcaggctgacattgacgaagcctctgactgtataaatgccaccaatctgtaaagcttgttgagaatatagatgcgcatttgcataatctgcatgtataaaactgtgcaggcgggcacgtaatggaagcggctggtaaatgtcgatatcaatgcttggcctgatatagacagcatgtggatcggtatcagttggatttttaatttccagagatgtccccagacctggaagacctccctgcaaacctattgtcagaaaatattgcccaccccacatccgctggctgtaactgagtctggctgagagggcagccaagtcttcactggcagtaaataactgaacatcatttatactggacttgacctgcttaagctcataggaaaattccagggtcgttttgctgatttgtccccgtgtcaatacacggctcaagcctgccttccaggtaagtgtatcaccagccagcttgaaagtgtcactatgcgctaccaaaggataggtatagctggcgtaacgccaatcaagaaaagctgtccagtatccatagggaatggaaacatcaaacgctgcgtaactactgttacgcgaatgctgaagtggaaatacggaatgatcatactccacagaccagatatcaagcataccgaaaggatcatcagcacgtaacaacagatgaccagtattccgcccagtccactgctgtccataattatcgacccacgcggcaccatgcagccagccattatgaggggtttctatcaccacaatgctggtaccggtttttttaccaggctcaatatgcatccgggcatcccagctgggcagacggttcatctgctccagaccctgctccagatctctcaaattaaggatgtttccagaaagatcttgaaacgctcccttttcgtgccacgaagatttttgtcctttaaaaataaagctgttaacttggccttccacagccacgatcctgacagtaccggatgataaatcctgttgtggtaaataagctctggacgttacaaatccggaatcaatgtaagctttgttaaacgcattgatcagcttatcaagctcaaccaaagatagacatttttgtgtaaaaggggcagccagcgcctgctgctgccatggcggaagatgatcagccccttttacttcaatccggctgacctgtatgcaatttccccccgatggaacggcagccgatggaacacgcagttctacgtccccatccggcggcgcgatacgctgcaactcccgttcacgatcctgcgctctccctctctgctgctggtcgagcgtattgctgataagctgagaagatccattttgaacaatttgtgcctgcgtgttggtcgagtacactgacaagaagctcatggccagaaatacggccagcctctggtaacaaggcgccatgatacagcaacccttttcaagcacagttcaagaaaagcaggaatttcaagtcttatggtttggtaacctgcgcagaagatgctgcggcagtattggcagatgaatcagcagaaacaggcaccggcgccttcccactctcaaaggctgccaatgcttccgccaccccgttcatgacaaaattcagcgtcacaccacgtccattgctcatgacaatgtggatatgcccctgcttgccatgcttcaactgcgacaaaaacgatggagacatcatagatcgtgcaaaacaaccccggctatcacagaactgataatcaagggcagttgtatgtcctccatcaactgacaaagtcagggcagattttaactgcacacccaatggtgcaaccacggtcgcagtataaggctttcctggcgcttctgccattaaggcaagtgtcatgatgggaaccagcttttctccctgcttgagcaacatctgctgagcaatctcgcaaacaggatgctgatttttgtttgctgtatccgccggggcctgacaacgatagatccagtcaccaaaaatctgggccaccacatggggtagggcagaagaaggcgatggcgcagcaggcgatgcaggagccacagaatcagagggagattttatctgattagattgggccagaagggataatggcaaaagcattccccataaagccaatatcgcaatgaatctaattttctgtatcatttcacttctcaaacattttgttttgcgaattatgatatgataagaaaataatcaagttttgtattttaaattaaatttatttactttctattactatttatattgctcataatctgtctaaaaataacaagaaaaatcttataatttagattcgaccgcatttcgctccgcgagaaacatacaagccgctatgccatcattgccaaaactgagcctatagctgccgccgttcgcggtgatgatcctcatcacaccatgatgactggcctgatcgacataagtgtcactgcataaagcatgcctgccaaatcgaccgtatcgtcactttagaagctgctcatcactgcaccgaagcacctattaaacctacaataggtccaggccgggcacatgacctgtcagcatgatttgtgctaaacggagcaggatcagactatccaccggacatgaaataccctgaccttgccttaccaccggcctgaccatcatgagcaagaacaaatcataggcagatgaacaaccgcaccatcccccgccgcccgaaccgcaggaagccatgatacgcatggcgatgacacaggaacagggcgttacagatgtttcccgatgccctgcatgctgctatacccggcgcgcgtcgcccggttcggggggcgtggttcgtcacaccgtcgctgaaagtcatgccatggcacgccgacgccagctctatgagggcaaggccaaaatcctgttcgaggggcccgaaccgggcacgctcgtgcaatatttcaaggacgatgccaccgccgggaatggagccaaaaaaggcatcattaccgggaaaggcgtgctgaataaccggatcagcgaatatctgatgcagcgtctgggtgagatcggcatcccgacccatttcgtccgccgcctcaacatgcgggagcagttgatccgcgaggtcgagatcatcccgctggaagtcgtcgtgcgcaatgtcgccgccggcagcatctccagccgcctcgggatcccggaaggcactcgcctgccgcgctctatcctggaatattattacaaaaacgatgcgctgaacgaccccatggtcgccgaagagcatatcaccgcgttcggctgggccagtaccaccgatatggatgatatcgtctccctgaccctgcgcgtgaacgattttctctccggcctgtttctgggcgtcgggattctgctggtcgatttcaagctggaattcggccgcctgtgggaaaatgaggaaatgcgcatcgtgctggccgatgagatcagccccgataattgccgcctctgggatgccaagaccaacgagaaaatggacaaggaccgtttccgccgcgatctgggcggggtcgaggaagcctatcaggaagtggccaagcgcctgggtatcctgccggaagccggcagccgggacatgaagggtccggagaccatgcagtaacaatgagcgatacagcaatgagccatcccaccaaggccgtggtcaccgtcaccctgaagaacggcgtgctggacccacagggcaaggccgtcggccatgctcttcagacgctgggtttctccggcgtcggcgaagtccgcatcgggcgcgtgatcgaacttgaactggccgagaccgatcccgaacgcgcccgtcagaccgcggaggatatggcccgcaagctgctggccaacaccgtgatcgaaagctttcgcgtggagatcaagtcatgagccgttttccggctattttgttcggtggcattcttgcctgcacggccgtcacgatcggcctgtcgggcttttcaaccccggcgcacgccgattttctgaagcggaaagtcttgctggactcctgcctcagcgcaaaaaacgagcgcgactgcaccggctatatcgccggaatcgccgacgccgccagcgatgcgaaacaagtgtgcatccctgccgaagcccatctgccgcaggtcaaggcccgcgtgctggactggttgaaagcccataaggaaaaccccaccgaagccgccgccccgtgggtgaaacaggccctgacggaaagcttcccctgcaagtgagccaatgcgcatgaaagccggcatcgtcattttccccggcacgaatcgcgaccgcgatatggcgatcgcgctggaacgtgtcaccggccatgcgccggcgcggctgtggcaccgcgatacctccctgcccgccgggctcgatttggtcgtgctgccgggcgggttcagccatggtgactatctgcgtagcggggccatggccgccctctcccccatcatggccgaaatccgcgcctttgccgagcgtggaggccatgtgctgggggtctgcaatggtttccagatcctcactgaagcgcacatgctgcccggcgcgctgctgcgtaacgcttccctgcgcttcctgtcgatggactgccatttgcgggtggagcgggccgcaacgccctttacctcacgctggcagaagggagacatcttccgctcccccatggcgcatggcgacggcaatttcttcgccgatgacgatacgctcgaccggctggaaggcgaaggacgtgtcgcgttccgctatgtcgatgcaacgggggaagcaaccccggacgccaatctcaatggcagtgcccgctccatcgccggtatctacagcgagaatttgcgcgtgctcggcctgatgccccacccggaaaacctggtggacccgctgatgggcggcgtggacggcaaaccactgttcgacagtatcgccgcatcgctcgcggcatgagggggcggagcggctcccttccggtgggccatccactccgatattttcctaccatccgcgcgcgccgcttcccgcaggccagcgcgcccggcaccgaggctgctgcatgacccgagacgtcaccctgtccctggcccaggaattcggcctcgacgccgccgaataccagcgcgtgctggacatcatgggccgcaccccgagctttaccgagctcggcattttcagcgtgatgtggtcggagcactgctcctacaaatcctcccgccactggctgaagcaattgccgaccaaggccccctgggtcattcacggccccggcgagaatgccggcgtggtcgatatcggcgacgggctggccgccatcttcaagatggaaagccataatcatcccagctttatcgagccttatcagggcgcggcgacgggtgtgggcggcattctgcgtgatgtgttcaccatgggcgcacgtccggtggccaacctgaacgcgctgcgcttcggcagcccggatcatccggccacgaaacggatcatcgacggcgtggtgcgcggcattggcggctatggcaactgtgtcggcgtgccgaccgtggggggagaggtcaatttccacccctcctataacggcaatccgctggtcaatgccatgaccgtgggcattgcgccgaaggatcgcatcttcctctccgccgcggcgggtgtcggcaatccggtgatctatgtcggctccaagaccgggcgcgacggcatccatggcgcaaccatggccagcacggagttcggcgcggattccgaggaaaaacgtcccaccgtgcaggtcggcgatccattcaccgaaaagctgctgatcgaagcctgtctggagctgatggccaccgacgccatcatcgccattcaggatatgggcgcggctggcctgacctcctcctccgtcgaaatggcgggcaagggcggggtcggcatcgaactcgacctcgatgccgtgccgcagcgcgaggaaggcatgaacgcctatgaaatgatgctctccgaaagtcaggaacgcatgctgatgatcctgcgccccgaccggcaggatgtggcccgtgccattttcgaaaaatgggagctggatttcgccgtcatcggccacctgaccgataccgggcacatcgtcgtgaagcatcagggcgtggtggaagccgatattccgctcgatccgctggcggaacaggcccccctctatcagcgtccgaccgtggaaacaccgaagcgtgcgccgctgggcgaggtcgccgatccggtcgggatcgcatcagccctgctgacgctgatcggctcgcctgacatcgcctcccgccgctggatctgggatcagtacgacagcaccgtcggcggccagaccgtgcgccgtccgggcgctgccgatgccgccgtggtgcggctggatggcacggagcgcgccctggcgctgaccaccgattgcacgccgcgctactgctttgccgatcctgaagtggggggtgcgcaagccgtggcggaaacatggcgcaacctgaccgcggtgggtgcgcatccgctggccattaccgacaacatgaatttcggcaacccgcaaaagcccgaaattatgggccagttcgccgccgccatccgtggcatgcgcgaagcctgtctgacgctggatttcccggtcgtcagcggcaatgtcagcctctacaacgagactgaaggcaccggtattctgccgaccccggccattggcggccttggggtgctggataatgctgaaaccgccaccggcctttccctgcgtccgggccttgacctggtgctgatcggcacgggcggtaccacgctcggccagagtctgtggctgcgcgaaatcgcgggccgtgaggacggaccgccccccgccgtcgatctggcagcggagcgtcgccatggcgatctggtccgcagcctgatccatcagggcaaggtcgctgcctgccacgatctgtcggatggcggtttgctggtggccatcgccgaaatggccatcgccggccataccggtgccgtgctgagcggggaaggcgatcatgtcttctggtatggtgaggatcaggcccgctatatcatcgccaccacctatagcgcggccgtgttggatgcggcgaaagcagccaatgtgccagccagcctgatcggacgtgccgaagggacggatttgcaagtgccgggttgtacccccatatccgttgctaccctgcgcgaacgtcatgaggcgttcctgcctgcgctgatggcgcagcgctgaacgtcctgccattcaagccccgcgaaggagagaattgctatggccatgtcggttggagaaatcgaggccctgatcaaggcggcgctgccggatgcacaggtcacgatcgaggatctggccggggatggcgatcattacgccgccacggtcatcagcgagacattccggggtaaaagccgggtgcagcagcatcagatcgtctatcaggccctgcaaggccgaatgggaggcgtgctgcatgctctggcgcttcagactagcgcgcccgcctgaaaacccctttttatttcctcttgacgagccaactaaggacgagccgatgagcgatacagccagccgcattcaggcggatatcaatgagaacccggtcatgctctacatgaagggcacggcgatgtttccgcaatgcggcttctccgcccgggtgacgcagattctgaaccatcttgaagtgccctataaaaccgccaatgtgctggaagatcaggcgctgcgcgaaggcatcaaggccttctccaactggccgaccattccgcagctctacatcaagggagagttcatcggtggctgcgacatcgtaatggaaatgttccaaagcggcgaattgcaggccctgctcagtgaaaagggcattccccataaggctgccgcctgaacttacccggacggggtcaggatacgatatgaaagccggagcctgtactccggcttttttcgtgaagtatcatgctacatgacccgcagattaaaggctgcatgggctatgcttttatctctcaccacatcagagagagtgtagcggtcaaggaccgccagaaacgcttttgttgcctcggccagtatagaaggggcctgacagcccggacgcgcggcacaatcggcacactccacaagatgaaagccatcctcagtacggcgcaccagctcacccaccgtgatctgatctgccggtcgaccaaggagtaagcctccgctacgcccccgcaccgaagatactaacccggccgagaccagaccctgtactaccttcatcagatggttgtgggaaatatcataaacgcgtgcaatttctgcgatctgtacaacacgatcctgattgacgctcagataaatcattacgcgaatagcataatccgtatatcttgtaaatttcataaagttgaattttcacaaatatagtaaaaatagaagatgcggtttttatatccattttttatggacttaaagatgcattttatatacctttaaaaaactgttgttcagaatacactaaaaaggaacaggcaccatgccctccccactcggtgatgccaccaccgccctgatcaaggctacgattcctgctctcgctgaatatggcattgctattacccgggccatgtatgcgcggctgttccagaacagggagattgccgccctgttcaatcaatccaatcaatccaatggtatgcagccggaggctctcgcgggcgcaatccttgcctatgcccggaatatcgacactcttgaggtgcttggcccagccgtggagcgtattgccgaaaaacatgtcggtgcgcatatcctgcccgaacactatcactttgttgccgaagccctgcttggagcaatcagcgatgtgctcggtgatgccgcaacgccggagatcctggacgcgtggggggaggcttactggtttcttgccaacgtcctgatcgagcgggaaaaagacctgagggaggctgccgcgagggccgagggcggatggaccggctggagacctttcatcattgccgacaagatcagagaaagcgaattcattacttcctttatccttcgcccgaccgatggcggcccggtgctgcggcatcggcccggtcagtatctgacggtcacgctgtcccctgcgggggcccctccgctgaagcgcaactacaccatttcctgtgctcccaatggcaaatactatcgcctttccgtcaaacgtgaggcgtccggcggtggagcatccgcttttctgcacgatcagatgaaggtcggcgataccctgcttgccaccccgccggcaggtgatttcgtgttgccggaaaaccagacacggcccgtgattctggtctcggccggggtcgggctgacgcccatggtcagcatggctgaaagccttgccgcacgtcactgcccggtgccggtgcatttcattcattgcacccagaacagcaagacccacgccatggggaccgcgttgaatgcgctggcagagaaacataaggaccgcatgacggtcacgaccttctattcccgcccgcttgcaaccgatgagcagggcgtggcctatgatcaaaaaggcaggatgactgcccagtggctgatggcatggctttcaacccatatgcctctgatggatgccgatctctatgtgtgtggcccgcgtcagttcctgcatgacatgctgaccgggctggatgcagccggtgtgcctgcggagagagtacatcatgagttgttcggccctactatcagccttcaggccgcataacatctgcgtgtgccggtcatattcatgcgggggaatctgcaaccagcgagacggtaagggcgctgtcagtccgggtttttatgaaccggagccacagacatgtctctttttgactcgatcgtcgacaagattgttcactatgctggcaaccttgtctcgggagccaaagccgagcccgcatcggcccagcctgcaccgggtgaggcttctaccgcctcacccggtgccatttccggcacggattcttccctgcaatcggtcgatatcggggctacgctctcccgattggcagaacagaatggccagggcctgaactggcaaagctcaatcgtcgatttgctgaagcttctggggctggattccagcctgcaagcccgccagacgctggccggggaactcaacgtccatgccggagaaaccggcagtgcagaacagaatatcgccctccatcaggcggtggtgcagaagctggctgctcatggcgggaaatggcccggctgagacgcaagatctttctcttcaaacagcatcagggcgctggccagcgcccttttcctgccgggacgaaacggaggaagcgttttactgacgctgaagatcaaaacgatcgagcgtcatcaccttgttccaggcagcaacgaagtcacgcacgaatttttctttcgcatcgtcggaagcatacacttccgccacggcgcgcagctcggaattcgaaccaaagatcaaatccaccgtgctgcctttccagcgcaaggcatcggtcttgcgatcatgcccttcatacacgccagccgtatccgcagcttttgaccatttcgtggacatatcgagcagattgacaaagaaatcattgctcaacacacccggatgatcggtcaacacaccgagttgtgagtggccttcattggcatccagcacccgcatccccccaaccagaaccgtcatttccggcacggtcagattgagcatgctggcccgcgtcaccagcatctccgccggagaaagctggttggacgacgcatagtaattgcggaatccatctgcggtcggctccagcacggcaaaagatttcacatcggtctgcgcctgcaccgcatcgacccggcccggcgcgaagggtaccgtcaccggatagcccgctttcttcgcggcttcctcaaccccgacattgccgcccagcacgatcagatcagcgagagatatttttttgccatcatgattgccatcgttgaaagcagtctgaatgctttcaagcttgtcgagaactttcttcagttcctgcggatcattgaccggccagtctttttcaggagccagacggatacgggcaccattggcacccccgcgcttgtccgtgccgcggaacgatgccgccgatccccatgccgtgcgcaccagttccggaaccgtgaggccggaggccagaattttctgcttcagatcggtaatatcggcttcatcgaccgccttgtaggtgatcgccggcaacggatcctgccacagcagatcttcctttggcacttcaggaccgaaatagcgcgaacgcggtcccatatcgcggtgcaccagcttgaaccaggcacgggcaaaggcggccttgaatttctcaggatctttctgaaaactgagcgcaatcttgcgataggatggatcggttttcaacgcgatgtcggtcgtgaacatcatcggcggatgacgcttggaggcatcaaaggcgtcaggaaccagctgatccgccgaagcatctttcggcttccactggacggcgccgccggggcttttcgtcagcacccagtcaaaaccgaacagattatcgagatattgtgatgtgaaattcaccggatcagccgaccatgcgccttccaggccactggtgatcgcatcagggcctttgccggtgccacatttatttttccagcctagcccctgctcctcgatccccgctgctgccggtgcaggaccaacgcatttgctgggtgaggccgcaccatgggcctttccgaatgtgtggccccccgcgatcagggcgacggtttcctcatcatccatcgccataccgccgaatgcctcacgaatatcccgcgcggcggcaaccggatcgggaacaccgttcggcccctccgggttgacgtagatcagccccatctgggtcgccgccagcggcttttccagcttgccgttcttgtcacgattgttggacatgaactttgcaccggaaccccagtagatcaggtcaggctcccagtcatcagtacgaccacctgcaaagccataagtcttgaagcccatggtttccagcgcgacattgcccgtcagcaccatcagatcaccccatgagagcttctcgccgtatttcttcttgatcggccagagcaggcggcgggctttatccagattggcgttgtccggccagctgttcagcggctcgaaacgctgctgggcaccactggcaccgccacgaccgtcataggtgcgataggtgcccgcaccatgccatgccatgcggatgaagaaaggtccgtaattaccataatccgccggccaccaatcctgcggcgttttcagcagaacggcgatatcctttttgaccgcaccaagatcaagggtctgaaacgccttgatataattgaagttggctcccagcggatcagactctgccgcatgctggcgcaggggagacagatcgagatgatccggccaccagaactggatggaacgcggctcaccatcactccaggctggaaccatgggtatggtggcagagagaacgactgtcagaacggcagcaacgcttctgattgtccggtgcatgcagcttgatccttcctgatataaatggggacttctgaacggcgtccctttcacgtgtcaggaagatgcagaacccggtggcgcagggataatagattcttgctaccgtcaggatcggctgagcctatcaaagcaatacacgcccggaattatcaattatatcaaacggatcgcagagtgtttattcagaccttgcaataaaaaagcctcctatttcccggaaaatggcagttattgcaggttgctacccacaaaaaagccgcctcccgcaggagacggcttttagccatccagcactgccagcaggaaacgctcagagtgcctcatccagcgcggcaaggatattatcacccattgtccgggtgctgaccgaagccataccggaaccggcaatatcggcggtccgcacgttgcggtttaagaccgtgctgcaagcctgctcgatcagatcggcctctgcatgcagatcgaaggaataacgcagcaacatggagaagctgagaatctgccccaatggattggcaatgccttttccggcgatatcgggtgcactgccatggatcggctcatacagcgccgggcgacgaccatccgcatcccgtgcaccgagcgtcgcggagggcaacatgccgaggctgccggtcagcatggaagcgaggtccgagagaatatctccgaacagattgccggtcaggatcacatcgaactgacgcggattgcgcgccagctgcatggcacagttatcggccagcatgtgcgacagggtaacatcagcatattcggcggcatgcaactccgtcaccacctgacgccagagcaggccgctttccatcacgttgcatttttcgacactggtgacgcggttgtcgcgcgcacgggccagatcgaacgccacacgggcgacgcgctggatttccatggtcgaataggtctcggtgttgaagccgcgcttcgtgccgtccggcagggtctcgatgcctcgcggctcaccgaagtaaacgccgcccgtgctttcacggacaatcatgatgtccagaccgcgcaccacatccgccttcagcgtgctggcatccaccagtgcgtcgaataccttggccggacgcagattagcgaacaggcccagctccgaccgtaaacgcagaatagcaatctccgggcgcatgtcgaagccgagcttgtcccattgcggaccaccgacggagccgaacagaaccgcatcagccgctttcgcggccgccagtgtttcatcagccagaggcgtaccctgcgcgtcaatcgcagcgccgccaaccagaccttcggacagatcgaagcggatgccgcgcttcgcttccagccagtcgatgatacgccttacctgctgcatcacttccgggccgacaccgtcaccgggcagcagcagcaacttacgggcagtcgtcatgtgatccgtccttcgcaaaagcgcccgctttcgaaaaagcggggcgccatcagcagcaaactcgtatgaagccgccggcactcagttggcaggcagcgtaatccggggaaaccagggctgggttacggtccggttttcctcaaaccggtcgatcgcctcgcggcgttgcagggtctggccgatatcgtccagaccgttcagcaacagatgacggcggaaaggatcaatctcgaacgggatttcctcaccgttcggacgcaccaccacctgacgctccagatcgacggtcaggcgggaattggcaccatttccggcatcatccatcaggcgatcacagatatcgcgtggcagacggatcggcaaaatgccgttcttgaagctgttattatagaaaatatctgcaaaatccggcgcaatcacacagcgtatgccgaaatccagcaaagcccatggggcatgctcgcgggaggagccgcagccgaaattctcatgcgtgaccaggatctgcgcctgacggtaaggctcccggttcagcacgaaatcagggttttcctgaccatcaatgtagcgcatcgcatcgaacagatgcgtgccaaggccagtgcgcttgatggttttcagaaagcgggccgggatgatcttgtcggtatcgacattggcgaccggcagcggtgcagcaatggccgtcaggacggtgaacttatccatcagacggtctcctcgacattcagggtgcgcacatcagtcagcttgccggtaacggcggcagcagcggccatggcgggagacagaagatgtgtgcgtccacccggcccctgccgcccctcgaaattacggttggaggtgctggcgcaacgctggccgggcgtcagcttgtccgggttcatgcccaggcacatggagcagcccggctcccgccattcgaaaccggcctccaggaaaatccggtccagcccttcctgctcggcctgctgccgcacaatgccggaaccggggacgaccagggcacgtacgccgtccgcaacatgccggccacgggcgatggcagcggcggaacgcaaatcttcgatccggctgttggtacagctgccgataaacacgacatcgaccggcagatcagcaatagacgcaccgggcttcagatccatgtagtcgagcatacggcgcatctgggtacggcgcgcttcatcggtcgcacggtcagggtcaggcacagtgccgtcaatgcgcaccacgtcttccgggctggtgccccatgtcaccatcggcacgatctcggaggcttccagcactacgacgcgatcgtaatgcgcgccttcatcgctggccagagagcgccagtattccaccgcacgatcgaaatcctcgccctggggtgcaaaggggcggccacgcagccattcaaaggtcacatcatcaggtgccaccagacccgcacgggcaccggcctcgatcgacatgttgcagatggtcatgcggcccgccatatccagcgcccgcaccgcctccccggcatattcaatcacatggccattgccacccgccgtgccgatcttgccgatgatcgccagaatcatgtccttcgccgtggtgccgggcggcatcttgccccgcacctcgaccagcatattcttcgcaggcttctgtaacagggtctgggtggccagcacatgctccacctcgctggtgccgatgccgaaagccagtgcgcccagcgcgccatgggtggaggtgtggctgtcaccgcaaacgatggtgaagcccggcagggaaatcccctgctccggtcctaccacatggacgataccctgccgcacatccagcagatcgaaatagggcacgccaaactcggccacgttcttctgaagcgtttcaacctgcaaacggctttccggctcctgaataccggcacggcggtcgctggtgggaacgttgtgatcgaccacggcaatagtggcatccggacggcgcaccaggcggccagccatacgaaggccctcaaacgcctgaggcgacgtcacttcatgcacaaggtgacggtcgatatagaggatgcaagtgccatcctccagacgatccaccacatgggcatcccagatcttgtcgaacagcgtccgcttcatgcgagcctccggtcagggtggccgaaccacgatccggcacatcccgaataagcacatcaccctgttgcagcgaaaaagatccgccaacagggcacttcatcaacagcgcctgcataaaaggggacacggctcgtgcggtgcaaccgccgaatcgtgtcccctcttcagcgtttccggcatgacagcacggaataatgcagcgtaagaatgccgcagcgacatggtaaggcccccgccttgccatgttcgccccctgccttgcgcggcctcattccagccccccatccagacagtccccgcatcccgcctccatcacccggcaaaaccggggatggaagcaggagcgccgattaattactcggcggctgcggtttcggtcgtggtggagcgcgccttttcggcgatacgggcggacttgccggagcgtccacgcaggtaatacagctttgcacgacgcacatcgccgcgacgcaccacctgaatttccgcaatggtgggggagtacagcgggaacacgcgttccacaccctcgccatagctgatcttgcggatggtgaagttgctgttcacgccacggttcgaacgggcgatgcacacgccttcaaacgcctgggtacgggtacgctcaccttcgacgaccttcacgagcacgcgcagcgtgtcgccgggcacgaattcgggaacgggacgttcgctgacgagacgggcaatctgttccgcctcgaaggtctggatgatgttcatgacttggatccttctctggatgcggtgattagggcgagccgccaccgcgcgcaacattatcttcaggataagaggcatgtggcgatgcggcatcgcccagccggtaagccgtccataaatccgggcgccgttccctggtcacggtttccgcctgacgctgccgccaggcggcaacctcggcatggtggccggaaagcaggacatcaggcacgcgccggccctgccattcggcgggtctggtgtaatgcggatattccagcaatccggcggagaagctttcctcctccgcactgctggcggcccccatcacaccgggcaacagacggatgcaggcatcaagcagcaccagcgccgcaggctcaccgcccgacagcacatagtcgccgatactgacctcctctgccgcatgggcatcaaggacgcgctggtcgatcccctcataacggccgcaaagcaggatgcatcccggcccggaggccagagtgcgcacccgcgcctgcgtcagggggcgtccacgcggggtcatgcacagaaaggggcgcgtatccccctccatcctgaccgccgagagcgcggcatccagcacatccggccgcatgaccatgccagcaccaccgccaaaaggcgtatcgtccaccgtccgatgccggtctgacgcatgggcgcggatatcctccgcctgcagcgcccacactccgtcccgcaatgcccgcccggccagagacaggccgagagagccgggaaacatctccggaaacagcgtcagcacgctggcacgccagggagaggaaggaagggcctcatgatgagaggaaactgcgctcatgccgcctctcccccatcatcgtgacccagctcattccggccgaattccggagcgttttcttcctgcggcgggtcgatcagcacccggccggcggcaatatccaccaccggcacagcggcccgcgtgaacggcaccagcagggaggcaccgccggagcgggtgatctccaggcttgcgcccgcgccgtaatcatgcacctgcgcaacttgacccaacagcgtctcatccgccaccagccgggcctccagaccgatgagatcgacgaggtaaaaatcatcctcgtcctccaccggcggcaaggcgtcccggttgatgaaaagacgcgtattggtcagacgctccgccgcggaacggtcctgcaccggcacaccgtcaatggtgatgccggccaacccgtccgcgcgccagtccagcatgatctgccgcccggcctcgtcatgcagcaagccatacgcggtcagatcgtcgggatcggccgtgtagctgacgacatgcaccaggccgcgcaccccgtgggggcgaccgatcacgcccagcaggatgagatcgcgcgacattcggacaaaccggatttaaaaggacggacgaaccggatcaggaagcggcggcagccgcagcggccttcgcacgttcctgcgccttcttcttcggcgctgcctgcttcggctgctcattccaggtcggcatcttggtcagaccggccttccccaggaagcgggcgacgcggtcggtggcgatggcaccctcggtcagccaatgcatgatgcggtcctcgaacaggcggacgcgctcggcatgctcggcggggagcatcgggttatagctgcccagcttctcgatgaagcggccatcgcgcggggcgcggctgtcggcaacgacgatatgatagtacggacgcttcttggcgccggcacgggcaaggcgaatcttgaggcccatcgggtcactcccacgtggctctgaactgcatccaaacgaaaacgcgccgctgcgcgaaccctcgcggagcggcggtgcccaattcggacaatcggtggtctctctagcggaaccgatcgacacaggtcaagtaaagcgacctgcctcgccccgcgcttcatgcaaggcggtcatgaacctccaccctgcatgtataaggaccacccattcctatacgggcggttcacctgagcagcctcatcagaagacaaaaggcaaaaaataattaacgatacgcaacaatatcaacctttctataaattcatttcatcctaaatattacaattacgtaatatgattctcttccttttaatattgcgactcactatcattatcgtatatgcccccggctgttttataactaccgcacagggcacggggtaataatgttccggcactttctttacgctatcataataattttatttttaggcatgttatcaaaagcccaagcgggggaaggccttttctcacgcgtgtatctgaccgatacaatgccgaaaggaacattcgaggttgaggaaacggtcagaaatcgttccggtcgtgcattcgggcagtataacggcactgattttcgtaccgaactggaatatggcatcaccgacaaacttcaggtcgcaggatatttcaataccctgctgatgaacgccaaaggcgcgccggatgatgacgatccagacggagaaacaggttttacacggcacaattttactgtgcaaagtattgcagccgaattcatctatcgcttatttagcccttacgaaaccaaacatggatggggaatggcgctctattttgaaccagaattgatgtttcatgatctgcataatggtctgacctatgacagcacagccgaaatcgagaccagactgattatacagaagaactttctcgatgatcgtttgatcatcggctataatctcgttcttgaattcgagacaattaaatttgcaaacgatccggagcgcaacagcgaactggactggaataacgaaatcggcgtgacttaccgttttgctccaagctggtttgccggaatagaggggcgcaatcacaacgaatatggtaatttccagaaacatgaacataccgttttttggatcgggcctgtccttcattatggtggccaacatgtatgggccaatctcgggtggatgcatcaggtcgcaggcaatccgggttacaacgacaacggaacaccgatcggcgaaagcctgtttttgcgcagccatgaacgggatgaagtgactttgaagctgggccttcctttctgagccaccttttgtctgacagacgttatccgggataaatcgacctatgaaaaatcgtttttttcttctggcttctgtaccggctgcaatcatcggatgcgcagcctatgcagaaacatattttaccgttgcccaggtgcaggcgctgatgtttcccggtcagacactgaccgaagatttccggaaaatgaccgatgctcagaagcaggaaatcgagaacagaagcaacaccaacgtggagcatcataaagtcaaactctggcgggcacctgatggtggcgcgctgatggttgaccaggtcaccggcaagcatgaatacattacctatgctgtcgcgattgataaaaacggtgctgtgcgtgacatcgaaatcatggattaccgcgagacttatggtggccagatcaaggatgcatcttggcggcagcaatttgtcggcaagacactcgattccccgctgacactggagaaagatatccgcaacatctccggcggcaccttgtccgcacgccatatcaccgatggcgtcaggcggcttctgacaacctatgctgttctctacaataatggccggcaatgaacgcagacgcgcccgcccgctgctcggcaccatcgtccggatcacggcaacaggcatgaccgatcccgatgctgccatcagcgatgccttcgcggaaatagccatgatccatgcgctgatgagttttcaaagcagcagcagcgatcttggccgcattgccgcagccaaacagggcgagcacattgtcattgatacacgcacacgcgactgtctgcgtgttgccctggattgggcagcgcgcagtgaaggagtgttcgatcccgttgcagcatgctgccaggatgcatgctggaagcatatagaccttgatcgtgatggtgtacagatactgcgcccattgcgggtcgatctatcgggcattgccaaaggatacgcggtcgatcgtgccactgccgtgctggccgctcgcggggccagcagtgcagtcgtcgaggcgggtggcgatcttcgtgtctccggtctgcgggaggaaaccgtggctcttcggcctggctgggcagctcaagccgcctgcatcaccctctctgacggtgccctggcttccagtgacccggcactgacaaaagaacaaaccggaaaacccgagcatctgcacgggcagaccagacagccagcccccgacctgttcgtcagtgttgcagcgccgtcctgcatggatgccgatgccctgaccaaaattgtccttgccgatatgaaaatagccccgccgctgctgaaagcctgcggcgctaccgcttacctccatgatgggtcatgctggagcagcatcccctcatcatgacaaaacgcccctcactcccaacccggcgccgatatgcggtctacatatccgggcttggcctctggctgagcggtgtggcgtggctgatccttcatgatgtcatttcaccggacgctacaacgccttttatacccgccacgatcacgcccctctgcctgagcatccatggcgcctgcgcaatggccgcgctgtgggtaggaggattgctgtggggcacccatatcgctccacgctggcgcggccgccacaacagagtcagcggagcaatcatcaccgcggcttttctgctgctggcgataacgggatactgcctttactatatgggtgatgaaacggtgcgggcatgggcttcgatcctgcactggggaattggacttctgttgctgccagcattcctgatccatcgtcacaagcaacgagcatcctgattttaccacgcagtaaagggtctgtcgcatgggctggctgcttttactgatcgcgccctttatcggcagttttctcggggtgctgatcaggcgctggcctgatggtcatggtattgttttcggtcgctcccgctgtgaacactgcggccatcctctgtcacccgcccagatgatcccgctgctgagcttcctctggctacgtggacgatgtcggcagtgtggcagtcctatcgatccgtttcatccgatgatcgagtgtgccgccctcgcagtggccgtctgcgcctgcgtcgcacgcggcatcaataatccctttctggcaggggactgcatactcggctgggcgctgctggcgctggcctgcattgatttgcggcactggcggcttccggatgtgctgaccctcccgctcattctcctcgggatgggggaagcaatatggcttgatcctgccaccttgctctggccacgcgtaacagggatcgcgatggcatatggtaccctgacggcactcggcgtgctgtatcgcctgctgcgcggacgggaggggttgggggccggagatgccaaacttttcgccgccggggcagcatggaccggactgaccgccctgcccggtatcttgttgctggctgcgctgggcgggttgatccatgccgccatccgagcctcacgaggcagttcattcagcccacatgctgccatcccctttggccccgctctggccgccgcgatctggatcgtccgcctgttgatgtttcaggacatggaatagcccggacagcctctacaaagaccgcttttccattatcaaccgcgccgcaaaaccaatcatcaccgtgcccgtgatgccatccagcacgcgggatgtcgctggatgcgtcaacaaacgctgcaacggaacggtcgccaccgctacggcagagaaaaacaccagccccatgaaggcgtgaataccggatagcagcgcgccgaacgaaacagccggaagctctggcggcagaaactgcggcagaaactgcggcagaaaactgacatagaaaacaccgaccttgggattgagcagattggtcatcatcccgcgcagaaaccagttgggatttgccgccaagcgcccctgccctgccggcagcataatcgggaacccaccgcccgcaaacacccggcgcagcatggtcacgccaagccaggccagataaaacgcaccggccatctgtaccacacgataagcattttcagacgccgccagcagtgcaccaagtccaagcgccgtgatcaccccccagctcaacacccctgccgaaatgcctgcaccggccagaacagcctgacgtggcccctcgacagttccagtccgcacaaccagagccgtatccagccccggtgtgaccgtcagcagagccgccgccgcagaaaaacgtatgatggccgaaaatgcatccatgatccgtctgctccatcggactgccgggaaagcagctttcctatcagaaagaatttcagccgatccatgtcttcataacaaagcagctcagtcgggaaaaaatctttctgactaaggataatctgcataaccgtcagtcacgaggatttgattcgtttcttttcctccccctccgttgccacatgacacaaccagcccaataatgatccggtactgtatcattttgctatctggctttggcatcatcacagggcccgctcatgccgattgcgcttcccccttttccttgggccaaatttgcggaaccggattgctggttacccctgatcacgcatctcggggatgtcggcgactgttttgaggccctgctcaatctgccgctctatcgtgctcgcctggccaccatcatcgaaaaggagccggatcgcgtcaccatacagcgtctatgcgcgctggcttttttacacgatattggaaaactcagcagtggttttcaggggaaaatcctgacaaaagccagaaaaggccatctgctggaaggctatcatgtactctggagaaaagaagcggggctacaagatgcgctcggtttgcgggaagatctgagccaatggggcgaagccatgcgcagcctgtttctggcggcactggcacatcatggcaggccgatcatggtcgtgggtcaggagccggtgcaagcagactgggcagcccggacagggtacaatccgaccgaggccgcaagggcaatcgggcaagcctgccgtacccggtaccctgatgcttttggtcccggccctcacctgccgcatcataccgagcttcagcatttttttgccggcctggtagcactggccgatcagattggatcacgcgaatgtgattttccccttgatcgcacgatacgcaccgccacaaaggcggcagatgtcctgcgcaatatcaacatggacgtgtcacgactgcgtcaggcgctgaaaccggttgagccatggcagcttttcggctgggcggaagggacgaaactgcgcccgatgcaacaggctttgctggagctgtctctggacatacgccttgccgcactggaatccgaaaccggctccggcaagaccgaggccgcttttctgcgcttcctgcgcctgttcagggcagggttggtggatgggctgtattttgccgtaccaacgcgcgcagccgcagcacaacttcatcgacggatcaatcatgccgtacaggcagccttcggaggcgaatgctttctggccctgcccggatacatgaaggccgggacttctgaaggctgggccctgcccggctatcgcgtggaatgggccgacaatccggacgaagcacagaagcaggcacgatgggctgccgaaacctcacgccgttttctggccgcaccagttgccgtgggtacggttgatcaggtcatgctggcgggcttgcaggtgaaatggtcgcattttcgcagtgccgccctcgcccgcagctatctggtcatcgacgaagtgcatgcttcggatagctatatgagcgcggtcatggaccggatcgtgcagaatcatgtggcccatggcggccacgcattactgatgtcagcaacgcttggctcggctacacgcgccagcctgctgggcgccaggaaaaagagaaaaacagattcgcacagcccagtacatgcgccttatccatccctgagctgggctgaaggagaagaaagacgaaaacaggaaattcatctcggcattgacctgacagaatatcagaaggcggtttccgttaacgcggctcccctgattgcagacccacacgccattgcaggcatggcgctggaagcggcacgacaaggcgcgcgcgtgctggtaatccgtaatacagtcgatcaggtgattgcgacacagcgggcgattgaggcgctggatgcccatgcccccacgttatcggtcaacgggatacgctgtccccaccacagccgatttgccgccgaggaccgccttctgctggatcatgcggttgagcaagcgatgggcaagcactccgttcccggcggccggatcgtctgcggcagccagacagtagaacaaagccttgatatcgatgccgactttatgatcaccgatctgtgtccgatcgacgtattgctgcaacgtatcgggcggttgcatcgtcatgccggtcgtcatgaccggcccgatgcgttcagaaacgcccgatgcgttgtgctgataccggaaatattatctccagagattaatctgctccgcttcggtctggggatcagccgcgatggaggcggcgtttacaccgacatcaccgggctggaatcggtgcgacgcatgatcaatgatggaatggtctggacaattccacaggacaatcgacgactggtagaaacaggcaccgatccgcaaacccttacagcactggctcaacaactgggtccagcctggactcaagcgcgtaacgctgtcgtaggaggacgcagcgcacagggtacaatcgggcgcatgaacctggtcgactgtacacgcgccttcgatggcagcattgatgactgtttcccgaatgatacgaatattgtcacccgccttggtgctgaccgtaccgcactgctttttgcgccggatacaaggggaccattcggagaaaaagtatcgcagatcttcgtacccggacattgggttgacgccagtgttgcaactgcaaccggagccgaatggatacagccatcatcggaacagcttgtgttcgaatctgccggattaagctacagcaggtttgggctgacacggtcttatagcacctaaaaagaagccaaaatgacagtgttctatattgacaaaattttaattcacagttgtattcgcaatgataaattcgtttaaaaaaaataagctttcccattgttaaatggcttgtctttcagtcgttttggctaacctcatatcctcctcattcaggttgaatgaatgtattgtcttctatctcatcctgtttttcgtgttgttaccagaactgaaactcatgttctgaccctgccgggtgctctggccgcattgatgctggacaaagtggacaattttactggcctgcgtccgcatcagcaacatgcatggcatatgttcctggcagcgcttggggccattgcgctgcatcatgccgatcaaagcgccattcccgaaacagagggagaatggaaagacctgctccttgacctgaccaatcaggccgaggaaccatggtcattgattgttgaggatctctcaaagcctgcctttcttcagcccccggttcctgaggggaagcgcgaagtactgaagaacacagtttatacaccggatgcgctggatattctgatcaccgcaaaaaattttgatctgaaggctgaagtcgctgttgaagccgggcttgatgaatgggtttttgctctggtcagcctgcaaacaatgcagggttatagcggggccacaaaatatggaattgcccgcatgaatggcgggttctctgctcgcccctttctcggcctggcacctccaaaaggaggaattggcgctcaccttcgccgcgatatacgcgccatgttggccggacggggcaagctgctcgacatgtatcgggattatgatgatgagggccttgcgctcctttggttggaaccctgggatggcaagaccagtctatcactcgatcaactcgatccatggtttatcgaaatctgccgccgggttcgtctgattaaaggggctgatcagcccattgtcgcgcttgctgttggctcctcggtcgcgcgtatcgaggccaaggcctgcaatggaatcactggagatttctgggcaccagtatatgacagcgaaggaaaatctttttctctggatgcacgaggtttttcttaccgggtattatgcagacttttgttcggggaaaagaagcaacgggctgcacgactgccccaatcgatgcagttgctacccgatgaaacagacatgatacttgtggctcgtggtatggtacgcggccaaggcaaaacagagggttttcacgagcgcatcattccaacacaccgacatatcgtcgatgccatgaatgatgaaaccaaacggcttcaattggcggaaatcgctgataaacaggagaaagagattgcttatatcgcatccgctttgaggcagggctgcgctatcgtatctattggcggcgcgaataaaaaaccgtcaaaagatgattatggttgtgcggccccttatacagatcgtctggaagccgaggccgacgcctatttctttacgacaatccagcaacgtttcgaagaaggtgagaacactaagataccttatctgcgacacttgatccgctatgcagaacgcctgcttattgacgcatcggagtctatcgcctgccccgttcaaaaccgctggcgagcgcgtgttcgcgcgccccgtgcatttcatggtatgctgtggactcagaaaagcccttttgtaaacgaccgcacctcgatttttcctccgaaagaagcggctgatgtcagacagtaaaaaccagaccgagcaggatagtgatccgcttatctccaaactttcccttgcattggccagattgcctcccggcaatctggcgtccctccggcgagcgattccgggccatggatgtccagagttctggagaattttttatagccagaaacttgatcaagatcgcaagtataatgatcaagcctgggaatgggtgatgattgccattgcacggctgacaccaaccgggcagccacttatacgctcaggaaacaaggaagacttcaaattaagcgcccataatagtgacatctcactgggacaagccctttctgatgctaacgtttctgaaaaacggtttactggtcttctaaacgccccgttcgtacaaaggcgggagatggtcatgaggttggttcacgtactgtcagccgcgcgcgcacgtttcaacatgaacgatatcgcacagttacttgtgcaagagcatcatgatccacgtgccaccaataatccactgcgcaaactggctaaagattattatcacgcttccgacgtaaaagagaaagagaaggccaatgcctgagccacgtttccttcagattcacagtctgcatagctacacggcttctctgctgaaccgcgatgatagcgggctggccaagcgccttccctatggcagtgctgtgcgaacccgcatttcctcacaatgtctgaaacggcactggaggatggatgaaggtactttttctctccatcggattgaaggcgcggaagaagctgttcgctcgcgcgatctggtgacgaagcggctgcgtgagccccttcaaggaaccgttgacgtcaacattctgaatgcgatcgaacctgcttttcaagctgctgtctatgggaagaaaggcgccgatgacaaaagtagccgccagcctcttctgtttggcgcacccgaactacgttatctggccgagcagtttacccgtattgcgacctctgccaccgatccaaaatctgccaaagccgctgcagaagatttcacaaaagacaaattatttcaaaatacaatgaaggctatgcgggattccgtatctcttcccggtggcctgacgtctgctttgttcgggcgtatggtgacctccgatcccgaagcgaacatcgatgcgccagtgcatgtggcccatgctttcaccacacatgctgaacagacggaaagcgactatttcgccgtcgtcgatgatctggcaggcgtcgaggataccggggccgaccatatcggttcgaccgaactgacctccggcctgttttacggttatgtcgtgatagatgttccgaccctggtctccaacctgaccggtgttgctgcaagcaactggcttgctgctgatcgcaagatggcggctgaagtgacagcctgtctgatcggccagatcgctacggtctcgcccggtgcgaaactcggctccaccgcaccctatggctatgccaccaccatgctggtggaggctggggaccgtcagccgcgttctctggccgaagcattccgtgatccggccgagccaaccgttaaagatgcagaagataaactccatcaaaagctcaaagcctttgatgaagcctaccaaaccggggaagacagacgtcttctgtcattgagcaacgatccgggcatcaaaaatgtcagccgcacgtctctgccggagctgatgcaatgggtgcgcgataccatcctgaaagccgcatgatgcgctggctggtgttgcaatggcgcgcaccgcttgcaagcttcggcgggacgaccatcgattcacgcggtgtaacacgcgattttccggctttgtcggcagtcaccgggctgctggccaatgcgctcggccttgatcgtaccgacaccacgcagctcgaccggttgcaggaacggatcgtgttcggggccagacgcgaacaggaaccactgctcgggcggatgacggattttcagaccgccctgctcggcagcaatgatcgcggctggacgacacgcggtcgtgtcgaaggacgcgacggtgcctcgaacgcagaagccagcacccatatccgccagcgcgattatcacgcggatatgcaaatgactgttgtgctgcatcttacccatgctgaagaagctccgacgctggatgatattgccaaagcgctgctgaaaccggcccgcccgctgtttttcgggcgcaagccgtgtctgccggcagattatgtgctcgctgcccaggaagaaaacagatgggtagaagccgaagatgccagagcagcactgatcgcaatccccggcgagggtctgttgcgtgcgcaatggtctgctgcccccggcaagggaaagagtctcgccgaccgacgtaactggcgcagcgggctgcatggcggcacgcgacgcgttgaggaggaacggattacccccgttacacgacgctgatgctacatctgatccatctgccgattgaggctcgctcctttgcgcgttgggccagggatcgtggcttcggtccgaaaggcactcaggataacgatgcggtgctgcatcatctgctgacgcaattatttggcagacagatgcttcaaccctttcgtgtgtttacgccggaacaggccaactggtccctttacgcctacgccaatcaggacgcgacgacactggtggaacaggcgcgtttctcgatcacgccggacatgacggaagttatctctctggagcgtctgcgcagcaaggccatgccagacgcaaaaccggggcagcggatcggcttcgatgtcagaataaggccggtccgtcgctctgccaaacagcacgaccaggaaagcgaaaaaatgcaggaacgtgacgctttccttgcagaggcgctgcataatcacgctgacgacaaaaccggtatgaaaagcgccaatcgcacccgcgagatggtttatcgcgaatggctggcggagcgtatgccatgggccacgctggaaacggcacgactggcgcatttccagcgtcggcgcgtactgcgcaacgggaacggtatcgaggggcctgatgcaacgattcacggcacgatgattattggtgatcccgcgcaattttctgaagcccttcgaaaaggcattggcagacacagcgcttatgggtatggcatgatgatgctgcgcccaccggatgctcttccgccggatcgctgatcgatgctgaagggaaggctgggacttcactcctcccgtattcctcacgcggaccgtgccggcctgctgtatctggcgcgagggcagttggtggcacgagatggcactctcgccttcctgcgcgggccggaggaagacgagaccttgcccagcggcgaatacggtattcccgtgcagagtatctcgatgatcctgctcggtcccggctcgaccgtcagccatgatgcgctccgtcttctcgcgcgtgccgatactgctctggcagcggtgggagaggatggggtgaggctttatacagcgcctccactggggcctgatcgctcggctgtggcacggcgacaggcaatcctgtgggcggaccccaaaaaacgggtagatgtcgcccggcgcatgtatgcatggcgccttggcgaagtgttgccccatcgggatatcaccgtgctgcgtggaatcgaaggtgcccggatgaaggagatttaccgcctcgctgcgcaacgtgccggtattgtatggcatggccgacgctatgatcgtgccaatccgactgccgccgatctgcccaatcaagccctgaaccacgccgccacagcaatggaagccgcagctgccattgcatgcgcggcagtgggggccattcctcagctgggctttatccatgaagaccctggccagtctctggtgcttgatatttccgatctgtttcgggacaccgtaaccatcccaaccgctttcgctgcagcgaagttggccgaacggggtcatgaaaatatcgaacgtctcacccgacgccagactggacgcgttctggcagaacgctccgtcattccaaaaatgatcgagcgactcaaacaacttttcgaaaaagaaacggaggccatcccatttctcgaggatgatgaatgatgccagccactctggtcattacaagagatgtggaagcacgctatcgcggctatctgacctcgatcatgctggagctttctgctggcgtttatctgtctccccaactatcctcggcggtgcgtgagcgcacctgggcggtgctgtcggaatggcattccgaactgcgccgtggtgctatcgtgctggcatggcccgatgccaaatcccccggaggcatggcaatccgcacccttggcgacgctcccaaggagattgtcgatgccgacggggtgctgctcgttcggaaaagttaattttagaaacatatcgttctttaatattgtcaataagtatcaatgtgttataggtaagaggttcctccgcgtgcgcggagatagaccctttccaccaggccgccagagggcgttacccccggttcctccgcgtgcgcggagatagacccattgctccggcatcctgttccgcggtaattgcggttcctccgcgtgcgcggagatagaccttgtctgctaatttggcggatgagtttattaagggttcctccgcgtgcgcggagatagaccctgcgcatatctattaaatcctgctgctgattaggttcctccgcgtgcgcggagatagaccccccgccgggttttccgacagcagtccacgggaggttcctccgcgtgcgcggagatagaccctgtgaacgtttttagattttctgcctcggccaggttcctccgcgtgcgcggagatagacccgagaccgtgccgcgacgacacgccacaatgccggttcctccgcgtgcgcggagatagacccgcggctggccgtctctatcgcctggtggtcaaggttcctccgcgtgcgcggagatagaccgagtttcatcggcttcagcggcccgcatttcgcggttcctccgcgtgcgcggagatagaccgtggctgccacttcggctgaccgcacattgagcggttcctccgcgtgcgcggagatagaccccccacacgttcgcgcccgccacgccgtagacaggttcctccgcgtgcgcggagatagacctcgctgcgctcatagtgagcgacagcgcctgttggttcctccgcgtgcgcggagatagacccgtccgaacagacgctgcgtcaaacgccagtgtggttcctccgcgtgcgcggagatagaccctggatatcctcggccgagatcgcatgctcttcggttcctccgcgtgcgcggagatagaccattcccgctgtggtggacgccgttgtttctctgggttcctccgcgtgcgcggagatagaccgatcgccattcaatggccgccagaaataggcccggttcctccgcgtgcgcggagatagaccccatgcagaatgatgcacctatggaggccctcgggttcctccgcgtgcgcggagatagaccttaccgcccctgttccagtactgttctgtatcgggttcctccgcgtgcgcggagatagacctttatcaaaatcggtgcggagcttcggaagcgcggttcctccgcgtgcgcggagatagaccccggttcccccggatttttgccatttttgcatgggttcctccgcgtgcgcggagatagaccgccagagaaaaatctctgtctttaaaaagagcaggttcctccgcgtgcgcggagatagacctggtcttcagctggctggggcagtgctacgatcggttcctccgcgtgcgcggagatagacctttttcaatcgcgcccgacctgcccctgtaaagggttcctccgcgtgcgcggagatagaccctgcgtctgctcactctgcgcgttctggcccaaggttcctccgcgtgcgcggagatagacccaccacgcgcgttttgccgcccttgccgaacacggttcctccgcgtgcgcggagatagacccgacccgaatatagttctcactcagttacatcaggttcctccgcgtgcgcggagatagaccctgatcgctggaaagtcagcgccgcaccgtcgaggttcctccgcgtgcgcggagatagattctcggcaatgtctgcgagatggcggagagggtgggattcgaacccacggtaccctttaggggcacaacggttttcgagaccgtcaccttcggccactcggtcacctctccgttcggggtctcttagagcaggcgaaagcccgcgccaagaggctgtagcagaaagatgcccccttaccttccggcccggttccatccagcccgagcccgaatcgaagccacggcaagcgagaagcccctatacccgctgagcaaacacctccttcgggctgccggcacggcagatatttcatgaaaatgggagccatgccgcaaggaatgtttgacttgtggcgtatgaccggtataacccgcgcctctcggccgccgtgcctcccgcttgtcggggtgttcggaggccgctcggcgttgacgggatggctccgtcgtcgcggagccagcatttgggaccagaagcgatgttcgcagttatccgcactggcggaaagcaataccgtgttaccccgaacgccgtgctgaaggtggaaaagcttgaggccgagccgggcagcaccatcaccttcacggacgtgctcgcagtgggcggggaaggcaatctgacgatcggtgcgcccgttgtggccggcgccagcgtcacggcgacagtgatcgcccaggatcgccttgataaaattgtggtgttcaagaagcgccgccggcagaacagccgccgcaagaatggccatcgccagcacgtcactgtgctgcgcgtcggcgatatcgtcgcggcctgaggaggtttgatccatggcacataaaaaggcaggcggttcatcccgcaacgggcgcgatacggaaggtcgtcgcctgggtgtcaagaaattcggtggcgaaagcgtcgtggccggtaacatcatcgtccgccagcgcggcacgaaggttcaggccggcccgaatgtcggcgttggtcgtgaccacaccctgttcgcgctgaccgacgggcatgtgaagttcctgcgccgcgccgaaggccgcgtgcaggttgcggtgactccgctggcgatcgctgccgagtaaagcgccgccctccctccacggccatccggtcagggggaagcagatcaaaggggccggcgcaagctggcccctttttgcgtcgcctcgtatggcccttcaggcactatgcgtggcagccccctaccttcccctttggccccctttggcagacgagccgcacaccgatgaaatttctcgatcaggccaaaatctacgtcaaatcaggcgatggcggtgacggcgtcattgccttccggcgcgagaaatatatcgagttcgggggccctgacggcggcaatggtggccgtggcggcgacattattgtcgaggccgtggccaatctgaatacgctgatcgattttcgctacacccagcatttccgcgcaccgaaaggcggcaacggagctggttccgaccggaccggtgccgccgccccggatgtgctgatcaaggtgccggtcggaacccagattctggaagatgacagggaaacgctgattgccgatctggacgtgccgggcaagcgcatcaccctgtgccgtggcggggatggagggcatggcaatgcccatttcaaatcctccaccaaccgcgcccctcgtcgcgccgataaaggctggccgggcgaggaacgctgggtctggctgcggctgaaactgatcgccgatgccgggctggtcggactgcccaatgccggcaaatccaccttcctgtctgttgtctccgccgccagaccgaaaatcgccgattatccgttcaccaccctgcatcctcagcttggcgtggtgcggctgtcgcttcaggaagaatttgtgctggccgatattcccggtctgatcgagggcgcccatgaaggagccgggctgggcgaccgctttctgggccatgtggagcgctgcgccgtgctgatccatctgatcgatggcgctgctggggatgtggtcaaggcgtggcgtaccgtgcgggaggaaatggaaggctatggtggtggcctgaccgaaaagccggaaatcatcgtcctgaataaatgcgacggcatgaccccgcgcgaagcctctgcccgccgctccgcccttgccaaagccagcggacagaccgtaaccgttatctccggcgtgacaggggaaggcgtacaacctctgctgcgacaggttatgacctatgttgcacagtcgcgggaagagcgcaggaaagccatgtccggcacctccgcatgagcggtagcggtcatgagcaggatgaagccctgccccggctgaccactgcgcgccgtctagtcatcaagctgggcagtgctctggtggtggatagcaaggccgccactccccgcatcgagtggctgcggggggtcgctgcggatattgccatgctgcgccgtcagggtgtgcaggtgatcgtggtctcatccggggccatagcgctggcacgacaggcactgaaactcactcagccccggctgcgtctggaggaaaaacaggcggctgcttcggtcggccagatccgtctggcacaggcatggagcgaggcgctctccgcggagggcatgaccgccgcccagcttctgctgacgctcggcgataccgaggatcgccgccgttacctcaatgcccgcgccacgctatcggccctgctgggcatggggtgtgtgccggtcatcaacgagaatgacagcgtggccacagcggaaatccgctttggcgacaatgaccgtctggccgcccgcgtggccgaaatggtgcaggccgatcaattggtcctgctgtcggacatagacgggctttatacggctgatccacggcgtgatccagaagccagccatctgccggtggtccgggccatcacgccggagatcgaggccatgggcggagagcctccccccggttattccagcggcggcatgcggaccaagctgaccgcggcccgcattgcaaccggggccggatgcgccatggcgattgcgctggggcataccgatcatccgctccgtgcactggcggagggggcgcgctgcacatggttcctgccgctgccagaggggcgcacggcccgcaaacgctggattgccggcagcctgcaaccgatgggcacactgacagttgatgacggtgcccgccgcgcactcctgcggggtggctccctgctgccagccggagtcgtctctgtcgatggccgatttgagcgcggtgaccccgtgctggtacaaggacttgatggcactgtgctggcaaggggcctgtccgcctatgccagcagggacgcctcccgaattgtcggacgacgctcggaggatatcgaatccatcctcggctggcgtggccgggacgaactggtccatcgggatgatcttgttctgatatgatcagatcaattatcagtgatattccatgatctccttcgattccacgacacattcctccttcaacgccatcaaggccgcctgtatcagctctcgtgtcaaaggcacgggaagaaatgcaagcagcttttcgacattgcggagggtatagagtgccgtttcataaacatgctcttcatccagactttttgtatgcatggccatcagcgcctccgtttgtcaggcttgtgcgcagtatcatgaacgatagggcgtcagcctgtgtcttctggtcagacagcatggttgctttccggcccgagcgctaattaaatcctcgcattgttttgctgtgcattcttgcaaccgaacaaaaaaatgagctgaatataaccagtcgttgcataacggaacttgaagcaatgcttgatggcgtatcggaaacagcacagcaatggatcgcacaagcaggccgctctgcacgcatggcttcttccgtgctggcccgggtgccacatgaggcaaggcagaatgctcttcgtcaggcggcatcggctctgcgtgatgaggaagccgccatactggctgccaatgccattgaccttgaacgctccaatgccagcgctgcgttccgtgaccgtttaaccctgaccagatcgcgcgttgccgctatggctgacgggctggaacagattgccgatcttcctgacccgctctcccgcgtgttgtcggaatgggaacgcccgaacggactgcggatccgtcgtattgcggcgccgatcggcgtgatcggtatgatttacgaaagccgcccgaatgtcggggcggacgcggcaggcatcgccattaaatcaggcaatgctgtgctgctgcgcggcgggtccgaaagtcagcatagcgcacgcgccattcataaggccatgcaggccggcctgcgcaaggcgggattaccggaagaggccgtgcagattgctcccgacaccgaccgtgcttatgtcgcggcgatgctggcaggcaatcaggtactggacctcattattccacgcggcggcaaatcgctggtcgagcgtgtgcagaaagaggccagagttcccgttctggcgcatgcggaagggctgtgtcacacctatatccataaggcagccgatcgtgaaaaagcccgttccatactggcgaatgcaaaaatgcgacgcaccggaatctgtggtgcgaccgaaacccttttgattgatgcggctattgcgggatctctactgccggttctggtcgaggatctgtcggccctcggctgcactttccgcgcggatgacgctgcgcgtgcgattatgccgggtttacctgctgccagtgatgcggatttcgatacggaatggctggatgccattctgtccatcaaggtcgtggatggaattgacgcagccctggctcacatcgcccgccatggcagcgaacatactgaggccatcatcaccgaagatgaggcggcagcagagtattttctgtcccatgtgcaatcggcggttgccatgtggaatgcctccacccagttctgcgatggtggagaattcgggtttggagccgaaatcgggattgccaccggacgtatccatgcacgcggcccggtcgggccggagcagctgaccacctaccgatatctggtgcttggtaacggccagatcagaccctgatccttgccgcatttttcttccacacccgtgaccgatccattaccaagattcggggatcgtcggcgcatacggatcgggttgctcggtggatcgttcaatccagcccatgccggacatgcgttgattgcccggcatttccggcagaagctacgactgcatcaggtgtggctgatggtctcccccggcaatccgctcaaatccggggaggatatggcaccgctggcggcccggcttgcttctgcccgggccattgctgatggacgccatatcattgccacaaccatcgaaagccgtctcggcacacgctacaccgccgatacacttgccagattgcgcaccctgtttccatgcgcccgctttgtctggctgatgggcgcagataatctgaccgggttcccgcgctggcgggactggcgtgggattgccgccgactggcctttcgccgttcaccctcgcccaggctacaccgcacgcgccttgtccggacaagcggccagcgtcctgcgccgctatcggcgtccggagcgggaggcacctttgctggccgatctgccgcccccggcctggatgatgctgcgtctcccgcaaagtccgctctccgccacccagatccgggcgggcttcaaccacaccctgaccggcctaccctcgacagcgcgggcggaaagtggcccggcggaaagcagataggccccattcgagtgcgtcaatggccgaggccatgcagttctggtagagaccatccggtaaacagcgtcaccagcctggagtccaagaccatcgcccgcaagccaatcacggatggtaccgaatcatccaagagccgccgcaccagcccccgcacggtgacggccccgaacatggcggtcagccccggttccccccgcaaaaaagctgctgccgccggcccccgtgccgctgccgcgaaagcgccggaagcaaaggatcaggccgttgcggccagggaaagactggacgccatccaggccgtgatcatcgaaagtctggaggacgacaaggccgaggacattatgaccctcgaccttgccggacgcgccgccttcacggatcgtatgatcatcgccaccgggctggcggatcgtcagatttccgccatggccatgcatctgcaacagaagctgcgcgatgccggagtcgggcgcgtaccggtcgaaggtgcgggcggctccgactgggtgctgatcgacgccggcgacatcgtggtccatctgttcaaaccggaggcgcgtgcgctgtacaggcttgaaaaaatgtggagcgcggaactggatgatgcagagagcgatgcctgatccggcatcctcccatccctgaccagcggctcctggtgccatgacagcgccctggcggatcattgcggtcggacgcatgcgcggcagtgaggaagaagcgctgttccagcgctacgccgcacgattgcgcccagccctgacggtaacggaaatcgcggaagcgcgcggcagcaccgctgaaatccgccggcgggaaacatccgccctgctggcagccctcccccccgcctgcattgtggtcgccatggatctgggcggccgcgcccatgacagtgaggctttggccacgctcgcccggcgctggcgggaacaaccattgcctgtctgcttcatgatcggcggggcggaaggtctggagcagccggtgctggatcgggccgatcatgtgctgtcactcgggccgatgacctggcctcatctgctggtgcggcctctgctggcggaacagctctaccgggcgcaggccatcgccaccaatcacccctaccatcgcacagggcggccatccggataatgacgatgccccactgatcaacacgcccgatattgataactggctgcccttgaagcgacagcctgcctccgctacccctcctgcagagccggagaccgaaccgatgtcagcatcgccgccgcccagacctgtcatgctcgttattctcgacgggtggggctggcgtgaagagcggaatgacaatgcgatccggcttgcccgtactcccgcgtttgatcggctgtggaacagtgcaccgaccacgttcctgcgtacatccggccttgatgtcggtctgccggatgggcagatgggcaattccgaagtcgggcacatgaatatcggcgcaggccgggtggtcatgcaggaactgccgaggattgatgccgcgctgcaggatggcagcgtcaacgatctgcccgccctgcgcgatttcatcacggccctgcgtcaatcagggggcacctgccatctgtttggcctcgtctccgatggtggtgtgcacgcgcatcaggatcacggcgccgctctggcgcagattctgacgcgggccggcattcgcgtggcggtgcatgcctttaccgatgggcgcgacacgccacccgcctcggcccgacgcttcctgaccaaatttctgcccgccctgccggaaggcgccacactggccacgctgtgcggacgattttacgccatggatcgcgacaatcgctgggaccgggtcgaaaaagcctatcgcatgatggtcgacgccgaaggcgagcgctacagcgatccgtgtgacgccattaccgacgcctatgcccgcgaattctccgatgaattcatccggccggccgtattcggtgactatgccggaatgaaagacggcgatggcttgctctgcttcaattttcgttccgaccgggtacgggaattgctgaccgcgctgctcgaccctgcgtttcagggctttgagcgtccccgcttcctgcatttctccggcgcgctgggcatgacacgctacagcaccgagcttgaatccctgatgcagacgctgtttccatttcaggaaatgaccaatctgctgggtcatgtcgtctcggcggcgggcaagcggcaactacgcatggcggagaccgagaaatacccgcatgtcacctacttcctcaatggcggcgaggaagaagtactggagaacgaggatcggatcatggtcccctcccccaaagttgcgacctatgatctgaagccggaaatgtcggcgccggagctgactgaaaaagccgtcaccgccatcggcagcgggcagtacgatctgatcgtgctgaatttcgccaatcctgatatggtcggccacaccggcagtctggaagccgcgatccgcgctgtggaaacggtggataccggacttggccgaatcgtggacgccatcacggcggtcggaggcgccttgttcgtgaccgccgatcatggcaattgcgaattgatgcgcgaccctgatacaggcggcccgcacacggcgcacaccaccaatcttgtgcccgctttgctgtatgattcctcggcacccatcggtacgcgacgcctgaccagcggcaagcttgccgatattgcgcccaccctgctggacctgatgcaactgccacagccgcccgagatgacgggccagtctcttctggcttgacgcaggaccggaaagagtcagcctctgccctcgcctcctgccgggcggggtggtaccagaaatggtctggtatactgcccgccctggtgacggcctgcataatcgccatgatgccgtatgggccggctctggcggtaaaacggcgctcccctgcccatacggccccaccctctggcacccccgctggcacctccccggccagcccggaacaggctcaggcagcgctcaaccgtgccgagcatgagcgcgccaggcaggaggccgcccgcaaacgggccgagcaggaagccgccatcgccgcgcagcaggaggccaaaatcgcggaggcccgcgccgctgccgccatacacctccgtgaggccgacgaagccgtcgccgccattgcggatcgcatggccgatctggcccggcaacgacaggcagcagaaaaaacccttgccgcccgcgccgccgatctcgccccgatgctgccgctgatcgaacggttgtcgctttatccggcggagaccttgctggcagtgccggagccgcccgaacgcgccctgcgtggtctgttggtgttgcaggggctgagccgccagctggaagaaagcgctcaggctttgcgtgccgaacgggccaaagtggatgcactcgccgcttccatccggaaagaagcgtccaccctggccgaggctcaggcgcggcagaaaaccgaggcccacactctggatgaaaaactggcctctatccgctctgaaatccgctccgcccgcaatgccgccgccgaggccgcacagcaggcggcagcctcggcacagaaagccgattcgctgcgggatgtcattgcccggctggaagaagcccgccggcaggaggaagcaaaagcagccgccgaagcaagacgcgccgaaaaggccagacagcagcaggccgccgatcaggcccgtcaaaaagaggccgaaatcgccgcaccagcaggaccaggcttgagcgaacagactgcctcccctcctccttccggtcgatcaggtaccggcggcatgccggtggcgggtacgctggtgcgtaccttcggtgccccgtcagaagctggcggcagcgcttccggcatgacattcagtaccgcaccgcaagcccgggtgctggccccctgtgaggggcgggtcgtctttgccggtccattccgcagctatggccagctggtcattctggattgcgggcggcgctatcatttcgtgttggcaggcatggaaaaactggatgccagcgtggggcggcatgtagcaccgggggagccgatcgggcagatggcaggatgggatccggcagcctccgcagccgcccggccccaactttatgtggagttgagacatgaaggttcggcaatagaccctcgcccatggttgcgagggcgctgatgacgcggcaagctgtcacacagagactgactgaatcacggctgaccctgcgcaggggtggcccagaggaaacacggacatgaaattccgcaccggcctgatgatcggcgctgccttccttgctggcgtcggtgcagggcctgcatcgacactcattgcccggcatgccggaatcgcatccgccttcgcggaagaaagcgacagcagtgacacctatcgcctgctgaccctgttcggcgatgtgttcgagcgcatccgggccgagtatgtggagccggtcaaggataaggatctgatcgaaaatgccatcaacggcatgctgaccggcctcgatccgcacagctcctacatgaatgccaaggcattccgtgacatgcaggtccagacgcatggagaattcggcgggcttgggctggaagtgacgcaggataacggcttcgtcaaagtcatcagcccgatcgacgatacccccgccagccgcgccggaatcaaggcaggcgatctgatcctgaccattgacggccattcagtacagggcctgaccctgaacgaggcagtcgataaaatgcgtggtgctccgggcagcagcatcaagctgaccatcaagcgcgccaatgtcgacaaacccatcaacgtgaccctgacgcgggaagtcatccatattcaggtggtgaaagaccgtctggaggcaggcaacatcgcctatattcggctgacccagttcaatgagcagagcgacccagcgctgcgtgccgccttcaccaagctccagaagcaggcaggcggcaaactgcgcggcgtcatcctcgatctgcgcaacaatccgggcggtctgctggatcaggcggtcgcggtctccgacgatttcctgaaccatggcgagatcgtttccacccgcgcccgtcatacggaagacagtaatcgctggaatgccaaggaaggcgacattactggcggtctgccggtggtggtgctgacaaatggggggtccgcctctgccagcgagatcgtcagcggcgcgttgcaggaccatcaccgcgccatcatcctcggtacccgtaccttcggcaaaggctccgtgcagactgtgattccgctgccgggcaacggcgcgatgcgcctgaccaccgcgcgttactacacaccttccgggcgctccattcagggtctgggtatccagccagacgtgccggtcgctttcacccggaccgaggagccgcatttcctgcccgaccgtgaggccgatctgaaccatgccatcaccaatagcggcggcaccaccgacaaggccgcgccacgcaccgatatgcccgcgatggtgcataatgtgccgaccctgccgccggaaaactggccgaaattcgatcccgccaagccggataccgatttccagctgcatgaagccattgaggtggtaaaggcgatggcccaacagaaagctggccagagcagcgattccaatgcgggcgacgccaaatccggtaaggcgaactgaaggagtctgtgccggtcatgacgaaaacctcgccggaagcactctccgccttgcgggagaggcttccctatcgccccaatgtcggcgcggccctgttcgcgccggacgggcgcgtgctggtcgcacgacgcgccgatctggcccatgtctcggaaacagtgtggcagatgccgcagggtggcattgatcccggtgaggatccacacaccgccgtgctacgggaattgaaagaagaaatcggcaccgatcacgctgaaatcatcggcgagcatccggactggatcgcgtatgatctgcccgatcatttgcttggccgtgcgctgggcgggcggtttcgtgggcagcgacaacgctggtacgcgctgcgtttcctcggcacggaggctgatattcgtctggatgccgacccgcatatcgaattcgacgcctggcgctgggcaaagctggaagagcttcctgcccttgcgcccgaattcaagcgcccggtctatgccacgctggcggcatcctttgcacggtttgggcagggatgggcctgacctccatgacgggaatagcccggattctggtcaccggttccggggggtttgtcgggtcgcatctgctgccgatattacggcagtctttcccgcaggccgtgttcgatgctccgcgtctgtctgacggcttcgacatcaccgataccgtcgcgctggaggcacgcatcgccgctttccagccggatgcctgcatccatctcgctgccattgccgcacctgtgatcgtccgtcagaacccggatgccgcatggaaggtcaatctccatggctcactgggtctggccaatgcgatcctgaagcatgtgccgggctgcgtgctgctgtatgtctcgacggcggatctgtatggagcctcgttccgcagcggtattccgctcgatgaaaacgccccccctgcgccgatgaacctgtatggcgcgaccaaggccgctgccgatctggcactgggggcgctggccggcgaagggctgcgggtcatccgtgcccgccctttcaaccataccggccccggtcagagcgaggatttcgtcctgccggcctttgccgcccagattgcagccatcgaggccggacggcgccctccgctcatctccgtcggcaatctggatagctggcgcgattttctggatgtgcgcgatgtctgcgcggcctatgtcaacatgctgacccatgccgaccggctggttccccccggcagcaaacaggcgccgattttcaatatcgcttccggtacctcccaccggattggtgatctgctggaccggctgctgagccggagccgggcttccatccgcaccgaaacagacccgtccagactccgccccgccgatattccccatgcggaaggcaatgccacgctggcgcgctctgtgctgggttgggtgcctcgtattgcgttggaacagacgctgggcgatctgttggacgattaccggcatcaccacattccagacaacgggtgatcatgagcctcgccagcgtccgtgcttttctggctgctcacgctcccgacatccagattctggaaatgccggacagcaccgcaactgttgcacaagccgccgcagccttcggtgtagagccaggccagatcgccaaaacattggcattccttgtgggaggacagacccttattctcgtcgcacgcggcgatgcgcggctggataaccgcaagatacgcacccgctttggcggcaagccgcgtatgctgccgttggaagacgtggagccggtgactggtcatccgatcggcggtgtctgcccttttggactgagtcagtctctgccggtgtattgtgaccgctctcttcttggctttgcagaggttctgcctgcggcgggttcccccaacagcgcagtacggatcgctccggaacggctggccatcctgaccaatgcggaatgggtcgatgtctgcgcggaaacacccaacgtcgattgatcaggacagggcgggtgatcaggacagggcgggttattcgctatcctcgtccgtcccttgcggatcgcacgccagccttgccccatccagcagggcctgacgacgcgcttcctgctgcgcatcccgggccttttccgcgaccgggcgtccgaacagaacacggcggcgcgctgcctccccggctttctgctccttcatcatccgtttgcggacagtccgtaaattgatgatctcagccatatcaggccccatttttcccacaggccccaaatttctgaccgatttcatggccgatgacacttcagccacgcaacgaaaatggcggcattacgttgaggcatgacggatccccgtcacaacatccggtcgtcattacgatccaacaggctgcaaaaggaagaacatacgcgccatgagcaccattctcctcatcatcctgatcctgcttctcgtcggtgcgctgccgacatggggctacagctccggctggggttacttcccttccggaggactggggttggtgctgctggttgtcattatcctgctgctgatgggccggatctgacggcttgactgattgccgcattggcactgcgcccgttcatcttccgaacagcgcggtgccatcggcatcatagatgggctgccatgaacacgccctgcctccgacatgtttttgccgtaagggcatacatactggcgaaatgaaacgaaggcacaacacatcgtttcgttttcaacaggatgacccatgcgtatatcgtcacgcagtctcgcggcatttgcagccgcagcattttcatcgctccccatcctgccgggcatagcgcgggcagaggacaccgtcagccatagtgatctggcatctgtccagcggagcgttgatgatctgtcccatcagacatctgagtccatttccaatctgaggagagaggtgtcttccaattacgacagtctgcataatgaaatttccagcctttctcaccaaatggaaacattgaacagtgagcaccggagtatgagtcaggacatggttgatcctcgatccgccatgaactcggaggtctcgcattttgcagccagcatcaaggaagacatcctgaagagcgtgaatgcgcaaaatgcacggcggaatgcagctgctcccgatcaggccactatcaacaagatggtgaaaaaagctctgaccgataatccggccctgcttcgtgctgctctggcttccctgaaacagggtggcaatgacgaaacaggaagcacccccagaaccccacctgccagcaagtaattttcatacaaaaaaggccgggcatacaccccggccttttccagttttccgaacagtctccggctcaggcagcgcggagcatgcgacccgcgacggcatccagctttgccatcagggcgggatcccgatgatcttccggtgtggtgatcgcgaaatccagcgcacggtcacatccggcttcacacggcccacgctcctgccccagcaccggcaccaccgcctgcaccagcgcacgcgccttttcggcattgccgcgcagaacacggatcaccgcatcgaccgtgacatgatcatgatcctcatgccagcaatcataatcggtcaccatcgcgacagtggcgtaacacatctccgcctcacgggcgagtttggcttccggcatgttggtcatgccgatcacgctgcatccccaggaccggtacagctcgctctctgcccgcgtagagaattgcggcccttccatgaccagataggtgccgccacgcgcataaggcagcgaaaggcgctttgccgcctgctccaccacatcgccgatacgcgggcagaccggatcagccacagagacatgggccacacagccatcaccgaaaaagcttttttcacgggcaaagctgcgatcaatgaattgatcgacgatcacaaaatgtccgggcggcagcttctttttcaggctcccgaccgcggacagagacagaatatcggtacaaccggcgcgcttcatcgcatctatattggcacggtagttcagatggctcggcgagaggcgatgcccgcggccatgacggggcaggaacacgcattgcacgccatccagagtgccgaacagaagatcatccgaaggcagcccccagggggtctccacccggcgccattccttgttctccagaccgtcaatgtcatacagcccggagccgccgatgatgccgataaccggctgaatacgctctgccataataatgccccccgtcccgcaggatgtaataccgggcgtatccgccacggtgcgcctcgtgttagggggcaaaggccgctggaatcaaccgcacacggcaaaaattctcttctgtcgacaggggggcagacaatgggtggtggctcagaatctgggcagagttcctcctgcgtaggtgattctaccgtcttgccgccggctctccgccatgcgacccctttgggagcaagaaggccggatgcctattatccagagcatatgaggacgctgccagcatgaccgataccgttacagcccccccccacgaacatctgaaatcggcggcaaggctctggttcgaatccctgcgtgaccggatctgtgccgcgtttgaagccatcgaggatgatctgccccccgccgccccgttcggcgatctgccgccgggccggttcgagcggcagccctgggaccgccctacctctgatgggagccccggcgggggtggggtgatgagtgtcatgcgcggccgcgtgttcgagaaagtcggtgtgaacgtctctaccgtctggggagagttcagtgaggatttccgacgccagattccgggcgcggagcatgatccgcgtttctgggccagcgggatcagtctggtggcgcatatgcgcagcccgcatgtgccggcagtgcacatgaacacccgcatgctggtaacgaccaaaggctggttcggcggtggcggcgatctgacgccgatgtttctggacacaccggaaacggcggaagaccgggaaagcttccacgcttcctatcgcgctgcctgcgatgcgcatgacccggcgctgtatccgaaattcaagcaatggtgcgacgaatatttcttcctgccgcaccggggggagccacgtggtgtaggcggtattttcttcgatcaccacaacaccggcaatgccgaggaagacttccactttacccgcgatgtcggggaggcgtttctgaatgtctatcccgccatcgtgcgccgccggatggagcgcccatggaccgaggccgagcgccatcaccagctggtcagacgcggccgctatgtggagttcaacctgctgcatgatcgcggcacgctgttcggcctgcgcaccggtggaaataccgaggcgatcctgatgagcatgccgccggaagtccgctggccctgatcaaatgaaaaaggcggaggatcatcccccgcctttttctttcccgcttcagtgtcccggcataccaccaccgcccttggtggaggaaaagaggaaacacaccggaatggtcgcaaaggacaggatcgcggtcataccgaaaatatccatatacgccagaatcgccgcctgctgctgaagagtctggtaagcaataccggcggcctgctgcattgcctcccccgcattggtgccgagattcaccagcccctgctgcacatgctgaagatagtcgacataaggctgctccagcggtgtcatatgcggctgaagatgcgccatccgcacctggctacgctcggtcaccagcgccgttgcggcagaaataccgatcgagcctgcgagattgcggaacatggtgaacaatgcggcgccatccgcattctgctctttcggcagggtgatataggttacagtactgatcggtacgaacaggaaagccagaccgactgtctgggctgcccgcatcatcatcagcgtccggaaatcgatgtccggcgcgatatggtgcgaataaaccaacgccagacccagcagggcaaagcccagcatgatgacgaagcgcgtctgcacatatttcatgatccgcccgacaaacgggatcaggataggcaccaccagcgccccaggcatcagcatcagaccggcccatgtggcggtataaccaagcctggtctgcaccagttgcggcagcagcacggcactggaatacagcaccatcgccatcaggaagatggtcagacagccgatcgcgaaattccggtccgccatcacccggatattcaccaccgggttcttggcatgcagcagccagaacaccgtccccaccagcccgagaaaagccagcaaggagaaaagccggatgaacccggatccgaaccagtcgagatcctctccacgatccatcaccacctgcaagcagccgaagccgatcgtgatgagcgacagaccgatataatcgacgctgcgttctcctttctgttcacgctccagccagggaggatcttcaaccagcgccgcaacagcgaagaaggtaaaaatgccgaccggcacgttaatcaggaaaatccattgccaggagaaattatccgtcaaccacccgccaacggtcggccccatgacaggggccagaactgttgcaatggccaccacaccgaatgccgctccgcgtttggcaggctcaaacgtgtcgagcacgatggattgctgactgggctgaaggccaccgccaaaaaatccctgaatcagccggaacaggatcaactgccacagagagccggcaataccgcataaaaaactcgccaacgtgaacatggcaatgcagatcaggaaatatcgtttgcgcccgatgatgcgcgcaaaccaccctgaaatcggcaacacgatgctgttcgccacgaggtaggaggtcagcgtccacgtgctttcatcgttggaggccgacatcgccccggcaatatgcggcagggcgacattgacgatggtggtatccagcacctccatgaacgctgccaaagtcacggcgatagcaatcagccacggattggcacgcggtttccagcctgcggcctgatccgctacagccgccccgctcatggtgcttccggcaccttgacgggggccgtcaccggagcagcattgcccggcgggatatgaccgaccggacgggctttctcgggcaagggcgggctgttctccggcgtgctggacagatccaccaccggctctaccgacagacccagcggaattggcaaggatgggtcaatcccgcggtcaatgcggatcttgaccggcacgcgctgcacgattttcacgaaattgccggtcgcgttctccgccgggaaggccgtgaagcgggagcctgatccctgctggatgctgtcgacatggcctttcagattcagccatggataggcatcaatgctgatatggactttctggccgggccgcatacgggtgagctgcgtttccttgaaattggccacaacccagatttccggtgagaccagcgacatgatctgtgtgccagtctggaggaaattgcctttctcgacattccgcttcgtcacccatccatcctgcggtgcaacgatggtggcgtattcaagattcagctttgcctgttccagttgcccttcagcctgcctgatctgacctgccagctgatccactctctgcccggtttcattgatattggcctcaaccggcatggcctgctcgatcgccgcctgagccgaggcaagctgggcctgcgccgcacgcagcgacgcggtggaggcatcaatcgcctcctgtgtcgtcgcagcgcgggccacgctgtgctgacgccggtaatcggtctgcgcccgaaaaagctgagcctcggcctgctgcttctgcgccttcgcggcatccagctgggccgggaagtttttcttcgcaatctccaactgataatgcgtggccgcatgctgggcgcgaaccatggccaactgaccttccgccacttcgaccgccgcccgatagggccggggatcgagcctgaccagcacctcacccttatgaacgaactggttatcgcgaacattcagatcgaccacataaccggccacctgcggcgagatcatcaccgcccggcctgatgtgtaagcatcatccgtgctttcgagatcgcgatgggtgtaccagtaatacacaccgcccgcgacaatccccagcaatgccagaatcagaatcaccctcaccaggggagagcgctttttcgtggcgcggccctgcggctggctgccctggggttggctcccctggggttgcgcattggaaccaccctgccgggccgggctgtctgacgccgtgttcacgtcatcgggcatggattgccatcctcacgcacttgatcgaacaaaactgcgtcagacatagaactgaacggttcggtcagcaagcaaggaagccggaagtctcctcccggcctttcgcacgactgcaatgcgattatgcagcgaccgttgcaggcgtgcctgctgcgtggcgttcgatcaggatgcggatctccgcccggcaggaaccgcaattggtacccgcctgaagcgcctgaccaacggagtccaccgtgtggcatccgccggcgatcgccgtcttgatctgtgtggcacccacaccaaagcaggagcagacgatagcgccacgatccacactgcctttgccgggcctgcctgcaatgacgatgaagcggcgcaggggatcggtaaaatctgcctccaactgctccgccgcccagcctcgcgctacacccacaggctgctgatccacatagagcgcaccggtcaggcgtgccccgttaaacgcggcatagcgggcctgaccggttctggcatcgacataggacaggttttctccgtcttcatgcgctctgccgataagagaagcggcaaagcctgccatatctgccggagcctcggtaaaggcacattccagcctccatccacccgtacagcggctgatggcccagtaatcaggcgcatgtccgatctgttcccagtccggaggctgctgaagcactgcgaaaccataacaggccggcgcataaggctcgatccgcgccgcaacattcttggaggcaggctggccggagaccggatcaatcaggtccggcaccagagcatccacgcgggcgcatgaagcgaactggtcggtccagtgcatcggcacgaacagcattccctttctttgccgtggcgacagtaaggccctcaccacgatacggcccagtgcggtccggacagagaccagatcagccgccgcgataccgagcggagccgcatcgtcaggatggatttcgacgaacggctcggccagatgctgagagaggcgcgggcttttgccggtacgtgtcatggtgtgccactgatcgcggatacggccggtattcagcaccagtggccacgcggcatccgtttgcaccggaagagagggcgtgacggcgatgaagcgggccttgcgatcctcggtaaagaaacggccatcggcgaagaagcgaccatcctgccccactgttctgaaggaagagttttccttcaaagcaggccataagaccggtttcagcgcctcaaaatccgcattgccgatagtggccaacgcaccgatatcgaaatcccgccgcccctcattccccagtgccgacagggcggcatgctcggcgaaaatttcggcggcattgctgtaggaaaaagcctctgcaaaccccatccgtgccgccacatcacacaggatgcgccaatctgcccgcgcttcggccggggctggcaggaaagcacgctggcgggagatgcggcgctcggaattggtgacggtgccgtccttctccccccatgccagcgcaggcagcgctacatgagcgtggcgcatcgtatccgtgctcgccagcacgtcggagacaacgacgaagggacaggccgcaatggctttctgcaccgcatccgcatccggcatggaatccaccgggttggtggccatgatccacagggccttgatgcggccatccgccacggcgtggaacagatcgaccgctttcagccctgctttctccggcatgcggggggcattccagaacagcccgaccagagcgcgatgctcgggattctcgatctccatatgcgcggccagcatgttggccaggccgccaacctcccgcccgcccatcgcattgggctggccggtgacagagaacggacccatgccgggacggccaatacgccctgtcgccagatgacaattgatgatggcactcactttgtcagtgccgcaggaggactggttgacgccctggctatacaccgtcaccgttttcccggtcgtggtgaacagggtgtagaatgcctccctctccgcggcctccagccccgtcatctgatccagcatatcgcgatccagtgcggaggccgctgccagcgcctcggcaaagccggaggtatggcgcgtgacatagctctcattcacctgccctgccgcggccagccaggccagcagaccggcaaacagcgccgtatcgccatcaggacggatcggcagatgcagatcggcaatatccgccgtcatggtacggcgcggatcaatcagcaccacgcgcatctccggccgtgccgcctttgccgccgccagacgctggtaaagcaccgggtgacaccaggccaggttggagccggtcagcaccaccagatccgcgcattccagatcctcatacagtccaggcacagtatccgtcccgaaggcacggcgatgcccggccacggaagacgccatgcacagacgagaattggtgtcgatattcgccgaaccgatgaaacccttcatcagcttgttggcgacatagtaatcttccgtcagaaactggccggaaacataaaacgccacgctgtccggaccatgctcggcaatggcgcgggagaaaccttgcgccacatggtccagcgcctcattccagcccacctgctgcccgttgatcatgggatgcagcaaacgtccgtccagatccaccgtctccatcagggcagacccctttgagcagagacggccgaaattcgccggatgcttcggatcgccccgcacgctgcgtgtgccatcctccgcctgctccacgatcacgccgcatccaaccccgcaataagggcaggtcgtggcaacagaattccgtgataaggatgcctccccctgctgcgcaatggtcatgcggctttactcgcctgcatggccagcgcatctgccgacagaaacaggcgaccttcgtgttcacgcagcttgtaaaccggcacgctgccttcatccgcaccctgtgcctgcccggtctccagagaaaaaacccagttgtgcaaaggacaggtgatcgaatgatcatgtacgatcccttcactcagcgggccgttgcgatgcggacaggtgtcgccaatagcgaacacccggttattcatggtgcggacaatggcgatttttccaaccggcgtctgcacacagcgcgcaccccgcagcggaacgtcctcgatcccgccgatttcgatccattcaggtgaggtcatgaccgcttactccgccgcgttcattatgccgatggaggccatcggtttgaattcatgcttgtccttgccggacacacgctccgaccatggatcgacctgggcgaatttctgggagaacacgaaacgctcgaaataatgacgacgccgttccttgtcttccagaacctgcttgcggatttcaggaatcccgacgcgcctggtccatttgtagatgcgctccagataacgcgcctgttcccggtacatctgcaccagtgcgacaatgacttccaacgcctcgtcttcatccggtaccagaccaagcacttccgtgccacggatatcgaggccggcggctccggcaaagtggatttcatatccggaatccacacagatgacaccgacatccttgcaggtcgcctcggcacagttacgcgggcaaccggagaccgccatcttcactttggcaggcgtccatgacccccacatgaatttttcgatgcggataccgaaaccggttgaatcctgtgtcccgaaccggcaccaatcggagccgacacaggttttgaccgtgcgcagacctttcgcataagcatggccggagacaaatcccgccttgccgagatcagaccagacggcaggcagatcttccttacgaatgcccagcatgtcgatacgctgaccacccgtgaccttcaccgccggaatagcaaatttatcgaccacatcggcaatcgcccgcaactccgcagcactggtcatgccgccccacatgcgcggcaccacggaataggtaccgtctttctggatattggcatgcacacgctcgttgacgaagcgtgactggtaatcatcggcatattcatcaggccattcacagaccagataataattcagtgcaggacggcatttggagcagccgcaggatgttttccactccagctcctgcatcacggcggggatggtcttcagacccttcgcgcggatcaggcggcgcacatcatcatgccccagcgtggtgcagccacagacaggctgtaccgccgcaggctgataggcatcccccagcgtcaatgtcatcacctgctccaccagaccggtgcaggaaccgcaggatgccgatgctttcgtatgcgcccgcacatcgtcgagcgtagtcaatcctttcgtctgaatggcgctcacaatcacgcccttgcatacgccgttgcagccgcagatctctgcgtcatccggtaaggctgcaacggccgccgtagggtccagcggggtgcctccctgataggcctgaccaaaaatcagcgtatcgcgcatctcgctgatattggccgctttcttacgcagatcgttgaaccatgccccatcggaggtgtctccgaacaggacggtgccgatgatgcgctcgttctggagaatgacacgcttgtaaacacctgccgccgcatcgcgcagaacgatttcctcacgatcctctccatcggcaaaatcaccgaccgagaacagatcgacaccagtgactttcagcttcgtcgccgtttcgctgtgtacaaaaccgctggtgggctggccagccagaacggcagccgccacgcgcgccatatcgtaaagaggtgccaccagaccataggtacgaccatcgacctcgacacattctcccagagcgagaatgtcaggatcggaagtcagcatagtcgcatcgaccttgatcccacgcccgacttccagcccggcctgcttcgccagccatgcattgggaatgataccagccgctaccacgaccagatcagccggaagctccgtcccgtccgccagcgtgaccgagcgtacatggccgctgtcatcatgattgaagattttggtattcgcgccggtgatgacatgaataccttttgattcaatcgctttttgcagcagataggcggaagcgctgtccagctgccgttccatcagcgttggagcaaggtgcagtaccgtgacatccatgccctgtgcatgcagacccgccgcggcctccagccccagcagaccaccacccagtacgaccgcccgtggcagcacacccgctttcgactgcgccgccagcatcatcgcctgcacatcatccagatcgcgatacgtcagcacgcccgcgagatcacgaccagggatcggcggaatgaatggtacggacccggttgcaatcaccagacgatcataggattccacaacaccatgatcagaggtaacggtttttgccgcccggtcgatctcgacgatcttatgccccttatagagggtgataccatgatcaatataccagccatcgccatggataatgatctgctcataggttttttcaccggatagaacaggcgagagcatgatacgatcataattcacccgcggctcggcattgaagatagtgacttcgtaccgatccgaagcctgttcgaacagatgttccagcatacggcctggcgccatgccattgccgatgatgacaagtttttcagtcatgattctgatccagtcaaaaatcttattgtgcagcttgcaggatcatcgactgacggcgcatggcccggatcgcagcatgcatccatatcatcgagacaagaacaacaacaaacagaagcataaagcagctctgccacgatcctgtctgatccttcagaaaaccgaagatgatcggaaagatgaatccgcccagaccaccgatcaggccgacgatacctccaacagcaccgacggaatccggataatagctcggcacatgcttgtagacagcggccttacccaggctcatgacgaaaccgagcacgaaagcaacgatcacgaagatgacgggaccaatcccggcgacgcctcctcctgcatgggcaggaaaggacaggatcagggtcgccagcgcagcaacaccgaacatcgcatacagcacacgacgcgcaccgatccggtcagacagaataccgccatacgcacggaacacgctgccgggaatggaataacatgcggccacgagacccgccgtttccagatccatgccatacacgccgaccagataacgcggcagccacagcgcaagtgcgacgaacccgccgaaagcaaagaaataataaaggctgaaccgccagacctgcacatgacgcagcggcgcgaattcatcccggaagcggccccggcgctgagcacgctgcggctcatcagaagtaagaaaccagaaagcccccgccgtcagcaccagcgccaccgcccagactggcggcacagcgcgccagccccaacccgccacaaccagcggggccagcaatttcgtgaccgccgcaccgacattcccggctccgaaaatacccagtgctgtgccctgcttcatctgcgagaagaagggcgagacataggacacgcccaccgcgaaagaaccaccggcaatgccaattccaagcccggccagcagcatagtttcatagctatgtgcaaaggacagcagcagcgtcgcaacggcagcagtcagcataacggcaacatacaccgcccgcccgccccaacggctggcccagatgcccagcagcaggcgtgacaacgaaccggtcagaatgggtgtgccgagcagcaggccgaactgcgtttcggtcagatgcagttcctgcctgatcttgacaccgataatggcgaaaatggtccagactgcaaaacagatggtgaaggcaaacgtcgacatccagagcgcacgcgaagcaccgtcacgcggctcggccggaagcagggaggcagttccattggtcatctggctctccaatcacggagccgctacgccgacaggtatggtgccggaatcgtcaggcggctgcgccatgaaacaaaatcgctcaagggagaagactcagcgcctgcaaagcaggacacggcccctccgttctccggcgtctttgcctggatgcgtccgcctttagacgctgaccgcgcttcctgccttcattggccaagcacatgtcttgaagccaatatacaaatccatgcctgccatgtcgcgcagtttttagcctaaaagcaacgctatttttatttttaagacaaaaaatgccttatttttatcttttataactttaaaaaaaggcaattgattaaattttagtcttttgtcgcgcaatataatcctcgatatgatccggatcaaacagctcgccatcgaagaaaccgtccggtcccagtgtcagaccagccagattggcccccaccggagtgggcctggttaacgcgccctccacctttgcattggctcccggcagcggatagcccaatccgctgactgccgcccgatacagatcgggacaataggtattggcggcaatcactgcattgtccgcgctgtgttccagatagctccagcgcgccagttgtgcataaaaccacatggcatggcttttccaagggaatgtagcggcccgcgcaaaaggcacgaagaaatccggcaccgacaccgcccggctgccatgaccgccgggcacgatctctccatccagcgctgccatcatccacatggccggctgaccgacatatgtctcccgcgcaagaatccgggccagatcggcgtgatgatcactgtcggcacaccacaacgccgctctggtcatggcccgtaacaaagcagtcaaagcctcaggattttcacgcgcccagccggcatgcacacccagcaccttttcaggacttgaacgccagatagccgccttgacggtgatgatccgaccatgtcccccgacaacagaggcggtgttccacggctcgccgacgcaatacccgtcgatcccaccgcccctcagcgcatccgccatcaaaggaggcgacaaaaccacgatttcaatatcgcggtccggcatgatcccacaggctgccagccagtagcgcagctcgatattatgcccggaataggcatgcacgacggcgaaacggagtttcttctgtccccgcatcgcccgatccgcgaccacagcagccagcgcccgcccctgcatggcagggtcgaacacatccccgccactggctgccactccggaatcctgcattgcctgccacagggaaacgctgacggtgactgcatttccacccagtcccagcgccatcgggacgatgatcttctggttccatggtgtcagacccagattgcaggcaatcggcatgggggcaagcatatgcgccgcctgaaaatgtccgaccgccatcctgtcgcggatattcgcccaggaattctcccttaccagagtcagattgacgccttcctgatcggcaaatccacattccagcgcagcaatcagaatagcgctgtccagcagtggcatgaagccggcagtcatccggtatggggcctgttgatgatgcttcacggatcctgcatcaatctctggtagggcactcatttctccgccccttttttctttgaaacggcagacggttcatcagcctctggatcgagcagatcgatagccgtcagcagactgtgtgcaatatctgcgatcttgcggttctggttcatcgcagtccggcgcagcagggcataagcggcatcctcgctcaatccccggcttttcatcagcaatgccttggccttatctaccagacgacggctttccagcgcaccccgcgcctcatccagctcccgctggaggcgggaataagcgttgaaacgactgatcgccatatccagaatcggcttgatgcgttcctgccgcaagccatccaccacataagccgaaacaccggcctccaccgcggcctcaatgccagcctggtcggagctgtccacgaacatcgccaccggcctgcgtacggagcgcgaaaggcgaaacatttcctccaacatatcacgctgaggattgccgagatcaatgacgatgacatccggcgcagcaaccgcaattgtttccgccgctgcggcaacgtcatgcagcacagtgacgcgatcatggccgccttcccgcagccctgtctcgatgatggaggcgcggatacggtcctcgtctatgaccagaatggataggctcggcttctgcatgccgccttatatgcaatgcgcccagtctcgtggccagagggaagacgcctgtccctaagccctaagccggcgcgttttccagatcctgcagaaagctgtgggcccatgccgcagcagtggaagcctgtaccgccgacatcatcgttttccagcgtgcctgccgtgattcccggtccagcccgagcgccatatgcagtgcctcggcaatttcgtcaggatcataggggttaatgatgatggccccctccatctccgaggcggctccggcgaaacgcgacaggatcagcgcgcccggattatcggcatcctgtgccgcgacatattctttcgcgaccagattcatgccatcgcgcagcggcgtcaccagtccaatcctggcttcccggtgaaatccggccagcacattgcgcgccaccgctctggtcagataccgcaccggtacccagtcgaactccgcatgctcgccattgatacggccgaccagttcatccatttccttccgcagggatcggtactccgcgacatccccgcgggaaaccggcgtgatctgaagaaaggtgacgttgttacgatgctcgggaaaccgcttcagcaactgggcatagccatggaagcgatgcggaatacccttggaataatccagtcggtccacccccagaatcagggcacgatcacccatggattccctcaatcgtctcgcttccggacttttctgggcgcgacgtgcagtggcggcaaacgcagcgggatcaatgccgatcggataagaatccgcccggcgcgccacccctgccatggccagacattcattcagatgacccgcatcctcgatggtttgcagaccgatcacatcataggctccgaaagcctgtaacagcagatccccttgcggcagagccgaatacaccgccatcggaggaaaagggacgtggaggaaaaagccgatccgggctttcacacccaacctgcgcagcgccgcgccaagggggatgagatgatagtcatgaatccagatgatatcatcctggcgtaacaatggtttcagcgctgccgcaaaagcatcgttcacagccatataggcagaaaggtcggagcggctgaacaccccgagtccaatccggctatgcagcagcggccagagcatcccgttggaaaagccgcgataatatccctcatacgcatcagtctggagatcaagtgtggcgtaagtaacgcccctggcttcttccagatgcacgtcgggaacgggttgatccacggtcttgccggaccagccgaaccagagggtttcatgcccggcaatggcttctttcaatgcgacggccaggccaccggccagttgtccacgctctttcggctgggggacacgattggaaaccagaatcagccgactcaccgcaccacctcccttaaccaggcgcggacgcccgctgcatcgccgaaggcttcctgtacccgcaaaccggcacctcccatggcgcgacaggccgccattccatcctcatctgtcacgtcatcaccgataaaaaccggcacacggccccggaaaggggcgtgttgcatcaaatgctgaaccgcggtgcccttatcagcccctttcggcttcacttcccacgccatatgcgcggccatcagggtaaaacggtcctcatgaccagccatgacgccgcgcaggccagcctcgacctgcgggccagcctccggcacggcacggaaatgcagcacgaagccgcgctgcttacgttccagcaaaacccccggcaaacgcgccgccaaagcttcaccctgccgcaaccattcaaccggcaggtctgccagtgccacacgctccgtggtctgcattgtgcggtgatacagcgcacccccatgctcccccgcaatggcggtgaaaatgccgggaaacagggcttccacctgctccaccggccggccggtcacgacagcgatggcaccgcccagatcatcatgcagacggctcagcacctcgggtaaaccggcctccacctgcacagaatccggtgtcggcgcaatgtccagcagggtgccatccatatccagaaacaaggcagcccgcgataaaagaggaagcggatcaaaatcagaaacggaatgggacagtgcaaaacagcccagaggtggaaaggacatcatacctgaacaaaccctttagaaagccacgggttgcgtctgtcccctctgataccgagtgaaaatcagcatctgaagaaagcccgattcataccgggccgggtcatcttccgatcagtcgcagcgcatgacacgcacatcgtacagggggctttcatacacggccacccatggctcctttgccagcatccagccggaaaagcgtggtgcaccctccgtatcggcggtgatgtcgagccatgcggcaaaatcctgcggcgcctctgccgcatgtttcaggcagttgcgcatcacaactgtcagatgaccgatcgtatgacgatctccatccttgagggtgacacgggatacgcgatcactcagcttttccaaaatctggagctgtacgctatggcccggctgccagggataggccgagagcggattggccgccgcagccggaggctgggcatcaccagccgcattcccatcaggcgttttatcggtgggattatccggcttggtgcctggctgggagccgggcgtatcgggcaaatctccctcgccggaggaagaagggctgtcgggcctcgtctccggatccgccggcagaggcacaatctgtggggaagggaccggcggcgagaccggtctggcggtcgtacctgcgttgaaacccgtatcattcggatcatcgtaacgcggcatggaatcgaccggcgcgctgccgggtcgggatttctgaaggggtcggcgatcctgcaacgaggtcggctgggcataggcatgcccccccgccaccatgcagagtaccagcaccatgcaaccggccatccggtacgcacgcatccgtttgtcacgagtcatgaagggggcttttcaacgcttggaccatatccagcaggctgcgcctgaacatgtcggggtcaacccccatcaggatggcatcctcataagcatcctgcatcacctgcgccagttccctatgattttccgccagaacacggcgtttttctgcgcacgtgactggcgccccgtccggtgcggtccaatcaggaagcgcttgggagactggatcagggtcaggatcaacagccactgaaggctctcctttccggggccatatccgacatgaccaggatcatgattactccagcggcttgatcgcccctccgcctttccggtccgaaggctgctttaccggcgggggattaccttgcatggccggattctttttaatttcggccacaagatcccccacgctgaacacgaatttgcccagctcctcctccagactgaccgagggcgtggtgatggtgatctgtccacccggcggaatcacctgctcatccccgccgggagacaggccgagatattgagaccccagcaatccatcgctcagaatctgggcggcactgtcttttggcagatggatatcgtcacgaacccgcaaggtcacgacagcctgaaaggttttagaattaagggaggtcttttctaccgtcccgatcttgaccccggccatgcgcacatccgatccggcagtcaggccggtgatattctcgaactgcgcggtcagcggatagccactgacggaagtgcggcccgaattggccatggcataggtcagaaatcctccggccactgccagaatggcagctccgacgatgatttcggctgagttacgcgatgccatgcagtcattccccgacgccagacagacaatttgcggtcacaacgcatcacgacggcgcatggtgcgtccttcgctgtactgatcaaggtggtgatggccgtcaagggagaccgcgtcaaccaaggcggccacctcggacagccggatcaggaacctggcgtccaggcctcataatcgccgctgctgcgcgctctttggccgccgctataatcatggcccggcggccggtagctcaatggcgtgccggtcagattggggcgatgcgggcggacccacggtttatgggtcatcggcagtggctcatcggtgatgaaatgcagccaggcatgccattccggcggcaccttggttgcctccggcacgcctttataggcgacccaacgacgacggcgcggctggtcagggcgcttcttacgatcctcgtaatagcgattcccggcggaatcctcgccgaccagacggccacggagctttgtgaacagccatgtgtcgaagttcatggcgtctttataatctgctccctggcgctggtccactgactttaccgggctttcccgctctgttgccgcatagacaatttcccccgacattcccgaagatgtccccacccttacccacaggattttgtgttcatccccgttatccaacgcaaaacagactcccgatcgagcggagccggacctactataacgggtatgaacaagcgcccttcttcccctgtcccggctgccggtcatgccgatcatggccagtccatctggcatggcatccgcatgcgcgatgtactggccgcgcccagcccggatgatgatccgcgtgccatccgcgtaccggtgtcatgggctgacgaggccgctgcggctctggcggcgctgtgcacggaactggcggcttcccctcgtccgaaacgtggccgtgccgcacgccccacaccgttcgggcaccgtatcgacgccatgatggccgctgatcgctggatcgcaccactggacgaagccgcctgccgggaaggactgcatgaaacgctgggggcctccctgcacaccatgctgcgcgaccggcgcggcacggctggtgtttcgctctggaccgggcaggaagatgcgctgacaccgccgagctttctgatcaatctgcctgctttctatactcggaccgatggtctggatgtcgccgcattggggcaggcggtctccgacgccgtgctggcgctgacgctggcggttccttccgcccgccgcctcgctgtgaccccgaccgggctggcggcactgctcgacaaggccggtctggcctatgccagtcaggaagcgcaagataccgcccgctgtctgaccgccttcatccgtgcctgtgccgatcacgcctccgccactctggcacggagtctgggcggtggagaggccgccagcagtgtcgtctcccgcgatctgcctgcctcctgtccgctgcccggtctggcggaagccgcacgacaggcttgcgagaccgcaccgctcggcgggttgaggcaccgtgccaccaccgccattctgccgccgcagatcgtagagtccctgctgggtgtgcgtatcagcggcattgcccccggcttttctccattgaccagcgaaggcacattatcagaatccgcgcaggactggctgctggcccgtggcctgcgtgccgaggatgccatagccgcgctgatccggggcgagagcgtgttcccttccgccgacacccctgcccgcatcgccatgcatgatgcggttgcacccttcatccatatgatggaagcccgtccggcagcagaaccggacaaggatgccgccaccacgccgatccggtccgctcaggccgaggatctgcccgcacgccggcgcggctatacacagcgggcaacggttggcggccacaccgtgtttctccgcacgggagaatatgcagatgggcgactgggggagatttccatctctctgcccaaggatagccccacggcacgggggctgactgaatgtctggcacaggccatcagcatcggcctgcaacatggcgtcagactggatcgcttcgtggaggcactggccctgaccgatttcggaccggccggcaccgtcgagggcgatccgtcggtggatcgcgcgacctccatcccggactatgtcgtacgccacctcgccgccagctatacgcatcaggccgttaccccggcccccgtggtcgaagggcggaatgaggatgaagataccatctctcccctgctgccgctggatcttcctcatgacgtgcgcaaagtctctgcccgatcccgcaggcgcgggcttcggctggtcaatggctgacggtccgcacttcaggccgccactggacgagggcacaggcgggccatagagacgcagacaagtcctgtgctacgctatctgaaaacagtgcatcgccagaggagaccaccatggccgattccatcgaacgccgtctcgccgatctcggcatcgtgctgcccgagccgatggcccccatcgcgaattatgtgccgtgggtcgtcaccggctctctggccgtgatttcggggcaggtaccggcgaaagacggcaagatcgcctataccgggcgcctgccggaacagagcatcgaatatgccgttgaagcggcccgcacatgcttcatcaacgtgctggtacatctgaaagccgccaccggtggcgatctggaccgtgtccgccgcgtcgtgcgtctgggtggctttatctctgccgcccctgaatttacccagcatgcgctggtcatgaacggtgcctccgacatggcggtcgaggtattcggcgatctgggccgccatgcacgtgccacgatcggggttccctcgctgcccgggaatgctattgtcgaggttgaaggtctgttcgaaatcgcctgacctgcgctcagctttcatatcgtgcgccgggaaggacgcgtttccacggcgtacgaacatgccatatgaactgctccgcaagtggatgagcgtatggagccggaaacgtcgctggatctgaccgcctgcctgcatagcagtgcatcctccatccctgccgccgcatggaatgcctgcgccgggagccgcaatcctttcatcagccatgattttttcatggcactggaggaaagcggctcggtcgcgccccgaaatggctggctcccccagcatctgagcctggccgatccggcgggtgatattgtggggatcgtgccgctctacgccaaatcacatagccgcggtgaatatgttttcgatcagggctgggccgaagccttccagcaggcggggggccgatattatcccaaactgcaaagctgcgttcccttcagccctgtccctggccctcgcctactgcatcgtcccggtctattgcccgtcatgctgggtgaagcactgatacagacatgtcaggcactggaactctcttccgtgcatatcaccttctgccaacaagaagaagcaaaggcgcttgaacagctaggctttctgtcccggctcggtacccagtatcactggcagaataacggctatcatagcttcgacgattttctgggagcgttatcatcccgcaaacgcaagcagctccgccgggagaggcgcgatgccaatgaagcaggcctggtgttcaaaacgctacgcggtaacgacatcaaaccatggcactgggatgcattctacgcattttatctggatacggtggatcgcaaatggggacgagcctatctgacccgggaattcttcaccgccctctctgaacgtctgggagatgctgtcatactgatgacggcgtcatcggatcatggtctcgctggagccgcgctcaatctgatgggtgaggatgctctttacgggcggaactggggttgccgggaatcatacccgttcctgcattttgaattatgctattatcgcgcccttgatttcgccattgccaacgggctgagccgtgtcgaagccggagcacaaggcgagcataaaatccagcgcggttatctacctgttcccacttactccgcacactggattgcccatcgtggtctgtcggatgccgtcgcttcctatctggcggccgaaaaatcggccatggaggcagacatggaggcactggcaaccttgtccccttttcggaaagagcatggctaaacaagctttttcataaaaaaggcgagcaccggagtgcccgccttttccgaaacgaccggaatgatcagaactgcagaatagcatccgcagcgaacaggaactgaccgttatgcccaacagggttggtgtcactataaacgaaggaaccagcaccattcagtgaccggtcatagcgcacttcaggacggagcatcaggccggcaatcggcttcggcagattcggcttccaggtcacacccagcgtcaaatcgccataggtgccaggaccgggagaggtaatcagaggtgtagacaggcccttgatcgacttccatccaccattggcttccttgaaaccagtgataaagtagttatccatgtcgcggaacacttcagcacgcgcattgaaggtccaatggtcattaaagacatgagaataatagccgaccgtgctgaaagattccgcattgatcacttcatcccgcagataattcagctccagcgtcagggttgttttgtccgacgctttatacccgatcacgatatcgtcgaagaaacgcaatgcactgttggccacctcaggaccaacggcaagagagccggtttccgggccgatattggtcagcgccagaatactgagctttccgttcatcagattgtttaactggaacccgaacacaccagaggggcggctgttattgtcaccaccgccgaaggtggtgaaattacccgtattgacgccgaaatagacatccaccatcggcgagacatgcgacacgctgaggaagccggtgtgctggaagggcacggcgaagttgaatgtataggagtgagtatagaaaggtgtggttgccgggtcgatcgtttcaaacccgactggagagatgtactggccgattttccagtcgataccaccgttaaacagccacggcgtatgcacggcaacgttggcctgcaacggcaccagcttgtaacggtcgctggtcatcttgttgaactcacccaggaacggcaggtaacgcacatccgaaccatagataagctgcaggttgaaaccgaaatcataccctttgctggtgctgtcgatgtcacgatgcagcgtcagggccgcttggttcagcgtggcctgattggagcgatcggtgaacagctggccgaaattgacgccattatccggcgtattcccgttgatgacaaagccgccatcaagctgcgcatccagtttgatgctgtcggtccactttgccgcctgagccgcctgggctgtctgagccgcaccagaagccagaatgctcgccgacgccagcaaaatggatgcaagagcatgacgcatgaaggaagtctccttaagaaatcgtgtcgcattcctccattgcaggtgtcgtgccatatactgttgcaaaaatacaactcatcctgcctccgtatcattcaacagtcataacaagcgttgggcgtgccagaatcaggcgctcgtggtaagatgacaccacggttagaaaatgctttgccctcgccatcccgccttaatgagatcgtgatttaggcacttcagtcagaaaatgatgaaaaatagttcattccacttccgaatgcttctgatatcaggtttctgtctggttacgtggcttttctacaaacaggtgccttctcttaaggcattgtatgagcaaacgaccgtttcccttgtttccaggggagaagcggcagaaccggcttctccggtaacaacaccattggcgggcggactgaagattgcgacttggaacctggactggctgactgagcctggcagcgaggcgacgctgcctccggatgcgccgcatcgcacagagaaggatatcagccgcctgagccattatgcgaccctgctggatgccgatattatcgccgtgcaggaagtggccagcccggatattttgcgccgtctgttcccgcccgaccgctatgtgattcatctcagcggcgataaggtcgcccagcgcgtcggttttgcagtccggcgtggattgatggtgacagcgaaccccgatctgtcggggctggatgtctatggaccccatgccgcccaccacctgcgcagcggagcagatattacggtggatctgccagcgtcctccggtggcggcaggctgcggctgctggccgtacatctgaaagccggatgcagacgggacgcttttgccaaaagtctgcggccagcctgcgcaaccttacaagcccagaccattccgctgaccggatggatcgcagaacgaaaacaggagggcgttcccttcctgattctcggggatttcaatcgctggcttcatcccggtgatgatgtgctgcaaaagatggaacaggtggctcccctcaccctgttgacggtcaaccgacgcgacccctgccaccatggcgcctcctttatcgaccatattctggcagggggcgtcgcacgcagctggatcgacccggaaagcctgcgtgtcatgacgtacggcccggccaccacctccaaaccggagggtcaggcgatgcgttatcagcttccatggacgcgcatgcctccggggaaattgattcaaccggacagcagtgatggattatccgatcactgcccggtatcaatccggctgattcctgccctgcctcactaaacagacagcgaccggactacggagataataaaggccatgagcaaaacgcttctcgtgacaggtgccacatccggcttcggtgaggccatcacccgtcgtgccgtccgggacggtcaccgcgtcattgccgcaggccgtcgcgttgatcggctggagacactggaagctgaactgggggaagctgttctaccctaccgcttggacgtaaccgatcccattgccaccgccgccctgcctgatgccctgccagaggaatggcggcagattgacgtactggttaataatgccgggctggcgctgggactggagcctgctcatcagaccgatctggcacagtgggatacgatggtggccaccaatgtgcgcgggctgatacacatgacccgcgcgatcctgccagccatggtggcgcggaatgacgggttggtagtcaatatcggcagtatcgccggcacctacccctatcctggcggcaacgtctatggcgcgaccaaagcctttgtaaaacagttcagcctcaatcttcgtgccgacctgatcggaaccgggatccgtgtcaccaatctggaaccgggtgccgcttctggctcagaattcagtcaggtccgcttcaacggggacgttgacaaggcaacagccgtgtacgatggcatgcgcccactgatgtccgaagacattgctgaaacggtggcctggctgctgacgttaccgccccatgtgagcatcaatcgcatggagatcatgtctgtggatcaggcttccggcccccttgccatgcaccggcgcacagcatgagcgacgctatcagtgaaacagtccggcagttcctcacaacctgccggattgataatggcagggaattcaggcttgccgctcacgacccggatcgtaagccggagatcgatctgtcccgtcaggaaatcaccgattacctgacggagcggacagaatgcctgtctgaccttcagcaaaggctgtattcatcgcagtcatacgggttgctttgcgtgtttcaggcaatggataccggcggtaaggatggcacgatccgccacgtcatgtccggcgtgaacccgcaaggcgtgcaggtcagatccttcaaacagcccggcccggaagcgattcatcatgattttctctggcgcgtttcactctcgctgccacagcgcggggagatcggaattttcaatcgcagccattatgaagaggtactggtcacccgcgtacaccctcacctgctggataaaagcggcattccggaagacctgcgcggcaaaccattctggaaaaaccgtctgcgtgacattcggcatttcgaatcctatctcggccgtcagggcatcgtagtacgcaaatttttcctgcatatctcgaaggaagagcagcgcaagcgcttgctcgcccggttggacgacccgacgaaacactggaaattcagtgtggatgacatacaggaacggcaatactggaacgcctaccaacgggcctatgaaaaggcgatcatcggcacggccagaacagacgcgccatggttcgtcattccagccaacagtaaaccaatcgcccggttgctggtgaaagaggcgatcatcgaagcactggaagaaattaacccgcaacagcccgtgctgaatgaggaacagaaagccgcccttgatgaaggacgtgcagcattggaagaccgctcggacaccactcagtaagcgatccagatggcacgcgttttttattctatagtagtaggcgtctacaacagaaataccaccacgtctgatgaacagccttcgggcgacagccggtctgtctggtgccctgtatcagataacagcttactgcgccaaataggcacgccatccgccaaagcgggtgatatcctgtgctccgaccagaccggccggttcacagacgaaacctttgacagaggttccatcggccagacgcaaagtaccgatggccaatggggccggaaccaaagccgtaaacgtgccgaacgcttccgcatccatgctccataattcgatttcgatgccatccccggtgaagtccggatcagcgaccagccccggtttgggaggaatggtctcagccagagcataaagccggtactctggcgccgttctggtccgtgccaccagagtggcattgcgttccgtcaattgccaatgcagcggctgtccggacagatgggccccgaccacagccagcgcgatctgttccggattagtctcctccagcacaggatcaggcagagaagcacgatcctgtccatagccgggttccagtcggcgatggagacggtcggcgatcagggccattgaatcgtcgctgaaagccggccccaccagagtaacaccgaaaggcaaccccgtttcgatgaaacccgccggcactgcaatggcggcacaatccagcaggttaacgaaattggtataatgccccaactggctgttcaggcgcacaggatcagccatcaccgcctcgaccttgtgaatggtcggagccgtgggcagcagcagtatatccatcctggcccattgggcattggcctgttgagtcagcgctgccagttcgtattggccacggaaagcatccactgccgagagtgtcttcgcagtttcgacaatgctccgtaccaccggatcaaaagaatccggtgcccgggaaagatgatcaccgacagcctccaacctttccgcaacccatgggccaccgtacagcagtttggcagcatcgcggaaaggtgcgaagtcgatctcgaccagttctgcatcgagggagatcatctcatccagcgcacgctgataaagggcggcataagcggtattgccgtagaattcccgctgatcctgtcggggaacgcctactctgaggccgacatgcggcagtctgcgcttttgcgacggacgggagtaaggatctgccgcatcatagccctcggcgatccgacggatcagtgttccctccgccaccgaagcagcaaagacggtgacacaatcaagggaacgacaagccggaacgaccccactggtgctgagcaatcctttggtgggtttcaccccgaccagattgttgaacgctgccggtacccgaccggacccagccgtgtcggtccccagcgagaaagccaccaatcctgccgccactgcgacagcagagcccgaactggacccgccagagatataatcctgatcgaacacgcaacgcggtgccccgaagggagagcgtgtgccgacaaggccggtggcgaattgatccagattggtcttgcccagaacgatggctccggctgcccgcagccgcgccacaaccgtcgcgtccctatccggttcataggtaaaagccggacaggcagccgagcatggcaaaccggccacgtcgatattgtctttgacggcgaaaggaacaccgtacagtggtttcccggttgcgggggaagcatccagggcacgtgcttccgccaagacctcctcgcgggggcgcagggcgatccataccgccttgtcgccatagcgcgtgatgcggtcataagcctcggtgactacctgctcgatggtgccgccttgcgccagaaacgcctgaataccttcgagggtcatgctcagcgtcatgtcaggcttcctcctcgatcagcagcagacgctgcccggcctgtacggttttacccgtctggcacagcacgtcccgcaccacaccggagacggaggctttgacctccatttccattttcatggactcaagaatggccacagcctgtccgggttgaaccttgtggccggtttcaaccagcactttccagacattgccgggaatgggagagtccacggtcgccataccgggcggcaaggcggaaacgtcctcaggcggggcagccgcatcatcttcggagacataggctgccaacccaagctccctccaacgctgacgctcggcctcgaaggcggcttgctggcgggatttgaaggcggcgatgctgtcagcattctcagccagaaagcggtgataatccgccagcctgaatactgattcttccgtcttcagcgcgtaaccgccataggggaaggcatcgcgggcttcggccagttcctgtgccgagacggggaagaagcgtatctggtcgaagaagcgcagcagccagggtttgccatccctgaaattggcggtctggcgatgggtgttccagacctgcactgtacgtccaacgaactgatagccgccggggccttccatcccatagatgcacatataggccccaccgatcccgaccgcgttttcaggggtccaggtgcgggccggattgtatttggtggtcaccagacggtgacgcggatccagcggtgtcgccaccggtgcgcccagatagacatcgcccagccccagcaccaggtagcgggcattgtagaccacatccttgaccgcctgctcatcggccagcccgttgatgcggcggatgaactcgatattggacgggcaccagggtgcgtcggggcgcaccagctcctgatatttgcggatcgccagacgggtcgattcatcgtcccaggaaagcggcatatggatggtgcgggtcggcacgctgatctgatcgaccggcggcagatcggcgatcgcctccgccagcaatccacgcattctgccgatcggcaggcggtcgggatcgagatgaacctgaagcgaacggatacccggtgtcaggtccagcagtcccggcagattttccgctttcagccgctccatcagggcatgggcctgaaaacgcaggctcagatccagttcaagcggcccgaactccaccagcagattgtcatcgcccgactgacgcagcagcacggcttcgttgccttcacggaaacgcgccagcaccgggctttccggtgctggcggggccaaggcgggcgcagtcacagcacgcaaggtcttcagggccgcatcctgcgcgtgacgcagagcatcggcctggtcgatatcgagccgaacgaaacgcagcttgtcgcccggcttcaactggccgattttccataattcggcgcaggccactgtgaccgggcagacgaagccacccagtgacggaccgtccggccccagaatgatcggcatgtcgccggtgaagtccagcgccccaaccgcataggcgttgtcatggatgttcgagggatgcagcccggcctcacccccatcggtgcgggcccagtcgggtttggggccgatcagccgcacgccggtgcgcgcgctgttgaaatgcacctcgtactcggcctcgaacagggtggcgatgtcggtttccgtgaagaaatccggagcaccgtgcgggccgatcaacacgccgatccgccattcgcgggtcagggcgggccgcagggtcggatcgagcggtacttcatggacgggaccggcaccgcttctgttcagacgcagcacatcgccggtacgcagacagccaacgccgtgaccgccgaaacgacccagagcaaaggtagcgcggcttcccatataaaccggagcatcaaagccatgacggaccgccagataggcacggttgcccgcctgccttgcggccgcgatggtcaatacctgcccggcatcgaccctgatcgcctgccagaagggcacgggctgcccgtccagcgtcacgtccatctcagccccgcccagagcgatctccgtgggggcgttgaagcgcagggtgggaccagtcagggtgatttccagagtggcggcttctgacgggttccccagcagacggttgaccagccggtgagacaatgcatccatcgggccactgggcggcacgccgacatcccagtagccaagacgtcccggccaatcctgaaggctgctttgcgcgccgggggccagcacatcgatggtcgagggctgatagggaaaatcccccagcgcccgcgtgctgaccttgccggaggacagcatcccggatgcggcgatggccgccagataatcgagattggtctcgataccgtaaacactggtatgggccaaagcatcctgtaatttactcagggtttcggcacggtcctgaccggtcacgatgatcttggccagcatgggatcataataaggcgtcacctcggtgccgctttcgatccagctatccacgcggacatcatcggcaggaaaggcgacatgggtcagacggcccgaactgggcagaaaccccttaccgggatcctccgcatacagccgcacctgaatcgaggccccccgtggctcaggcgcttccggaacggacaactcgcccgcggcctgacgcaccatccattccaccagatccacgccggtaacctgctcggtcacgccgtgctcgacctgaaggcgggtattcacttccagaaaatagaactggtcggctgcatcatcataaatgaattccaccgttccggcggattcataagcgacatgacgacccagcctgatggccgcatccatcatggcggcacgggtagcagcgggcagattgggggccggtgtttcctcgacaactttctgattgcgccgttgcagtgaacagtcacgttcgccaagcgccacgacatggccctgaccgtcaccgaaaatctgcacctcgatatgccgggcgcgcgcgacatatttttcaagatagatgccgccatctttgaaattgctttccgacagacggcgcaccgtttcgaacagcggtcccagttcatcggcgctgcggcagagttgcagaccgatgccgccgccgcccgcggtgctcttgatcatgacaggatagccgatctccccggcggcttcatgggcggcctgcaaatctggcagcagaccggtaccgggcaaaagcggcacgccgcaagcctgagcggcttcccgggcggtatgcttcagcccgaagatgcgcatgtgctccggggacggcccgatgaaacggatgccttcctcggccagacgattggcgaaagcggcattctccgacaggaaaccgtaaccgggatgcaccgcctgtgcgccggtctgtttgcaggcggcgatgatggcctcaatatccagatagcttgcggaaacctgtgcaggaccgacgcagaccgactgatcggccatcaggcgatgacgggaatggcgatcggcctcggaatagacggccaccgtgcccacacccatttttttcagcgtgcggaaaatgcggcaggcgatggcaccccggttggccaccagaacatgatcgaacatgggaaaccccttttggtcaggccgcgtcccacaccaccacttcgatgggcgtggggttgtaggcattgcaggggttgttgagctgcgggcagttcgagatcagcacgatcacatccatcgccgcgatcatctcgacatatttgccgggtgccgacagcccatcctcgaaggtcaggccgccttcgggcgtgaccggcacattcatgaaaaaattgatgttgtgggcgatgtcacgcttggtcaggcccagatgatcgttctcggccaccgccagcaaccaggaatcacggcatgcatgcatggtctttttgtccagagcatagcgcactgtgttggattcagtcgcacaggccccgcccagagtatcgtgacggccaacggtatcggcggtgatttccagcatcacattgccgtcctgggaataaagcttgctgccggtggtcagatagacattgccctgctcacggacggtattctcggctgagtagcgttcagacggatcttttgccgaaaagaacagggtgtcggcggattgattgccctccagatcgacaatgcgaagattctgaccggccttgacgacatgcatccagtaatcaccggccttgaccgtgttgcgatagctggcgttttccggggcgagattgctttccctgatcatggttcagccctccgatccgcaagaacacaggtgatagattcgattgttttcaaaaccgcgttcattttcaggacggaaatgtttgcaggcatcatcctcggcgactggctccgcttgcaaaagctcataggccaccgggtggcggggatagctggctgacggattaagcggatgcggacaggtatgcagcagaacaagcgtatccatctcgaagcgcagcgtcacatgcgcacccggtctggaatgggtggcatcgaaaagaagagttccatcggcggcaacagccaccttactgaaccagttcacgttggaggccagatcgcgccgccccagaccgtatttcgcgccttccaccagaaagctgtcatggccattctgggtccagtcattatgaccggtctggtaatccacaggctgccatttatgggcgacgctggacctggtgctgttgccgcagaccgtgtcgtgccagcccagactatcctcgatgatcgagcagaaaatccgccccatatcggaatagaggcaattgccgcgggtcagcttgaaggtgtgctggcacttcaggctgtcgggcgcattatagcgctccagcaggttggcgggattgtaaaacagcatgccgacattggccccaccctccagatcggtcaggcgcagcaaggtgccgcgtttgagcgtgaaggaccagtgtttgccgccgggaatcacatcccgatagagaacgtcctgactcataatcctctgtctccccggcaggtcgtcccgccgaacagggccttttgcttctggccgggtcgtcccggcaggccagagtgaaatcagtgagtgaaatcagttagtgatcgccgcttgcatcagcggtgccgagcctgtttttcaacacgctcatggcttcggtcttctgcttcgaactggtccgctccagcggcagatcgaaggtgatcgtcgccccataaactcctctttcttcggggcgggtgcggtagtgatcaaaggcgatcaaccgggtgcccagatgaaaggcctctttcagatcatgggtgaccatgaagacagtgagaccggtttcctcgaacagggtcagcatcaactcgtgcatgtcggcacggatgcctggatccagcgctccgaagggttcgtccagaagcagcaccttgggcttcttgatcaaagcctgggcaatcgccagacgctgctgcatgccaccggataactgggccgggtatttgtcccgcgcatgatccagccccacagccgtgatgatctcacggcactggtcgaacagagcacggcgtccggcaccgaacaggcggcccagaacaggggcggccttcatctccagcccgaaagcgacgttctgcaataccgtcagatgcgggaacacggaatagcgctggaacaccacgccacgctcctcggtcggctcagggggcagcggcgcgccatcgatacggatttcaccgcggctggggatttcctgactcaacaacatgcgcaggaaggtcgatttgccgcagccggacgggccgacaatggacacgaaggagtgggatgcgacttccagatcgaccttttccaggatcacctggccatcatattccttccagacattggagacggaaacgtgggtcatgcgctcctccgcccggcatccagccatggaaacagggtgcggttcagcaggcgcaggccaagatcacacagcagagccagaaaggtgatccaggcgacataaggcaggatcacatccatggcgaggtaacgccggaccagaaagatgcgataacccaggcccacatccgccgcgatcgcctcggccgagatcaggaacagccaggccggtcccagcgacagccgcacggactcgatcaggcgcggcagcatctgcggcaaaaccactcgtactatgatctgccagctcgatgcgccgagagtctgtgccttgatcagttgctcgcccggcatttcctgcacgcgggcctgaaggttgcgcatcagacatggcgccacgccgatgacgatcagcaccaccttcgacaactcgtccagcccgaagatgatgaacagaatggggagcaccgccatcggcgggatcatggaaatgaccgccaccaatggcgacaacccggccctgacataaggaaggatgccattggcgatacccaccagcaacgccaggagcgtggcgaccgtcaggccgatgccgatccgcatcagactggcagccgtatcggcccacagcagcacggaaccggtgcggggatcggcccggaaggccacccgcgcgatgccttcccccagcgcggtgaagctgggcagaagcttgtcggcaggattatcggccagccgcatcgctgacgcggcggcataaagcacaatcaggacaatgaagggcagtaatcccagatagaaccgtgctatttttccgggatgccggttgagcaatcgtcgcgccatgagcattctccgtcaggggcgggcgatgcttacagcttgccgtcagccgccagttgctcataggtgtcgtcgaagcgcagcttgacgttgttcgtgtcgcccagcaccttgccgccggggaagctgataccgaccgcatccttgctctgggcgccatcgcccagcaggtggtgttcgaacgagaagctccgtaccagatccatggccttgaaagcctccgggctgcgcgtaaaggccgcggcggctttggggtcggcatacaggaaagtggttttcaactgggattcgaaaccacgcagatcggtacccgacagtttggccatctcggcgcgggcggccttgccggcctcatcattccgggtcatcagggccatggtttcataccaggcacccgccagagccttgcccagcttcggattgtctttcagagtccggctgttgaccacggtcagatccataatctcgccggggatcttgctggaatcgaaaacctcggtcatttcggggttcttcagcacctccgaaagttgcgggttccaggtcaccacggcggtgacattcgggctggccgcagccccaacgatatcggcatcagaggtattgacggttttaacgtccttttctgatagtttgactgaatccagtgcgcgggccagcaggtaatgagaaacggacaactccaccagattgattttctggcctttgatgtccttcagtgatttcgcctttttcagaaccaccccgtcattgccattggaatagtcccctaccagcagggcggttgtatcgacaccgccagccgcgggaatggtcagggcatccatattggcgacagtcacgccatcgaacttgccagccgtgtattgattgaccgactcaacatagtcattgacctgcacaagcgtgatcttgataccgtattgatcggcccatttcttgacgatcccaacctcttgcgcatagggccacggcatccagccggcataaatggtccatgcaatcctgaaatcagttttttcggctgcctctgcgggggcggtaaaggtcacggcacaagccagagccgtggcggcaatcgtcatgttcttgaaggaaaaggccatcttcggaactccggatctacgtttcgtctatccggggggagcgatggctctgcgggaaggcaagaaagaggcctgcccgacaggaacggaaaccgttcccctcggcttgaacctcccgggcttttatcccgccgtgtgtccagccctttcctgaaaggaggtaccggattgcgactctcggaccagtcactgcacaggcagccggaaccctagtcgcatacgttacctagcacgatgcatgccaatcacgtgatcagtagaattttaaggcctccataagatcacgtctcactgcaagcctctttctgcttgttttctaagcgcacagatgccttctttttgtgccacaggctcaaattccaacttcgcggagagcgagctgctatggtctcaaccgccccggagacactcgtcttctgtggctggatcgttctcaaacttccctgtaaagcacaaaaaaacccggatctgttgacccgggttttttatttcatgcacagcttttaccaatcaatccgctgtttcagccgccaattcctcaccgccatcattggcatccggtctcggcaaggctggtgcactggcctcgacaatatcgaattcaagcgcatcgtctttcagcgtgaccttgacagaaccgcctttgaccagcttgccgaacaacaattcctcggccagcggcttcttgatgtattcctgaatgacgcgcgccaatggacgcgcaccgtacagcctgtcatagccacgctcagccagccattccttcgcggcggagttcagttcgatcgtgacattgcggtccgccagctgggcttcgagctgcatcacgaatttctcaaccacgcgaccgacaatttccgcggtcaggttgccgaatggaatgacggcatccagacggttgcggaattccggcgtaaacagacgcttgaccgcgtcctcatcctcgccaacacgtgcctcacgaccgaaaccgatggcctctttcgccatatcggacgcaccggcattagtggtcataatcaggatgacgttacggaaatcgacgatcttgccgttgtgatcggtcaattttccatgatccatcacctgcaacagaatattgtagagatcgggatgcgctttctcgacctcatccagcagcagaaccgcatgaggatgctggtcgatcgcatccgtcagcaaaccaccctgatcaaacccgacatagcccggcggcgcaccgatcagacgggagatactatgacgctccatatattcgctcatgtcgaagcgaatcagctctatgcccagcgtcgtcgccaactgacgcgccacctcggttttacccacgcccgtcggtccggagaacagatagttaccgatcggcttctcggcatcgcgcagaccggcacggctgagcttgatggcggcagaaagagcctcgattgctttatcctgcccgaacaccatcgctttcagatcgcgttccagcgtgcgcagcgtttccttatcgtcggcactgacgcttttgggtgggatgcgggcaatgcgggcgacaatgtcctccacatcctgcaacgtcaccgtcttgcgccgtttgtgctccggcaacagcatgcggctggcaccgacctcgtcgatcacgtcgatggccttgtccggcagcttgcgatcatggatgtatttcgcggccaactccaccgcgccacgaatggcttcttcggtgtaggtgaccttgtggtgagtctcgtaattcgtcttcagcccgcgcagaatcttgaccgcatcctccaccgacggctcattgacgtcgattttctgaaaacggcgcaccagcgcacggtctttttcaaagtagttgcgaaattccttataggtcgtgctgccgatgcagcgtaaagcaccggaagcaagggctggtttcagcaggttggaagcatccattgccccgccactggtggccccggcaccgatcacggtatggatttcgtcgatgaacagcaccgcacctggatggttttccagctcggtgaccaccgccttcagccgctcctcgaaatcaccacgatagcgtgtgcccgccagcagagcccccatatccagcgcatagatggtgctgttgagcagaacttccggcacatcgctttcaacgatgcgcttggccagtccctcggcaatggccgtcttgcccacgccgggatcaccgacatagagcgggttgttcttggtacggcggcacaggatctggatggtacgctcgatctccgtatcacgtccgatcagggggtcgatcttgccggcccgcgccttcttgttcaggtcaacgcaataggtcgacagcgcgtcctccttacggcggctcgatttttcctcgcgctcgctttcaggtcctgagggttcacccccgccattgctaccgctggccgagccctgcacggggcgggtctgtgaacggccgggcgccttggcgatgccatggctgataaaattcaccgcatccagccgggtcatatcctgaagttgcaggaaatagaccgcatgactctcacgctcgctgaacagcgcgaccagcacgttggcgccggtgacttcatcacggcccgaggactggacatgaatggcggcacgctgcaccacgcgctggaaaccggccgtcggttttggatcgctggcacgctcactggccagaccggacagatccttgtccagaaattccgtcagatccgtgcgcagtttgtctatatcgacaccgcaggcacgcaggaccgcgacagcgtcggcgtcttccgccaatcccagcagaagatgttcgagggttgcgtattcgtggtgacgttcactggccagagacaaggcccggtgaagcgtctgctcaaggttgcgggacaacatggatgggcaacgctccttgatcctgggggccgcaggcagggaccggaaaccgatccggtccaccgcgcaggctcctttgcgcggcatcgatgagctggatattgggttgcagtgccggaaaactagccggcaggacgactcagcagcccagcccggatatgagcttttcacatcctgcttcgtgccgtccagcatctgttaccgtttttggtcacaaaagattcagggacggaggatggagaccatcataccactgcctgatataggctctaacctgcttctttacaggcccagcagatcgagactccgcccgatgactatctgttcgacatagtgatcgagcgcccgttgtcgtcctgccatccccatccgggcacacagggcgggggatgttgcaagcctggtcaaagcctgcgccagaggggccgctgcgcggggcggcaccaggaaaccggtttcaccatccacgacctgttctctcgggccccgtaccgaggtcgccaccaccggcagaccgcagagcatcgcctcgacgatagacattggcagcccctcgaaccagcttggcagggtgaagatatcggcagcagccagcagcgcgggaatatcctcgcggtatcccaggcggcgcagcctcggccccagcgcatccggcgcggcggcctgctggaaagccggttccagatcctccccgtgatcggaggacagacgctcccccaccacccataactcggcctccggaaccgagcgcatcgcctccagcagttccagatgccccttgtgacggaccagacgggaaacgacgatcaccaccggtcgatccatcggtgtaccaagcgcctgcctgatacgtcggcgcgcttcaggatcagggcggaataccgccgggtcgcgcccattcccgaccgggatggcatggcgatggatcaaaagacggcgagcatcccgtgattcttcggtggaaacggtcaggaatacatgcgtcacccgtccggcaatcgcctccatgacccaggacacgatacgccgcggcagaggggatggctgattgaacaaaaatccatggcatgtgtaggcaatacagggcacaccgcaggcccgcgccgccagacgcgccagaaagccactgataggcatatgggcatgcaccatatcgggctgctcggcacgaatcagtctcaccagagcacgaaatgcccgccactgggcctgcggtgagatacgccgcaccatcggcaccgtctcgacccggaagccttccgcccggacagcggagagtaacggaccatccgcacaggcccccaccacctcatgcccccgatcccgtgccgctctcatcaccggaagaatgaaatgccgcagcgcgaagtcgacattggtgatttccagaatcttcaagcgctgacgctcattcttttgccttgcgggtgatggcccatttgacgcagcgcgggccgtccggaggcacggagatcacgacctgttcggcctgtctcggcatctgacctccgagatagacgctttcttccaccgtgatggtgccgccctccacctgcatcagccatgcagcctgcggggtacgcagcaggattgaatcccgcaacgtggcggccggcttttcagtgatcgcctcctcacccgacaccgctccatcgaccgcagccggttcgacagactgtgtccgggcctctgcccccgtattctccatggcctgggtctggcggatcgcatgcaccgccggatggagatgaaaacgcaggacataggggcgcggctcaccgccttccagactatcttcgccgcgcacatcatcgccgttggcagccatgtataaatggcggcgatgcaccagaccggcgctttgtcgccagccatcatgggtcgcctccagccagatggcgccctcggactccagacgctctgctgttacgcgggagggacgacggcccagaccatccgcggtcacttcggaggagctggtatcggccatcaccagcgtcgaatgggcagcggtggcgcgggttgcctcccgccattccgggccgcctgcgggcaaagcgccgcaattggtgatgatccgatcgcgcccggacgaaaattcaaaggccagcgtgcccgcatgcgcatgacggtccagcccccgccgcgccggcagaccggtatcgacgatcacgaccgagcgcccggcctgaagcctctgccaaccaccatgctgcatgtcatgggtcgcccgcgcgccgcgccccgcctgggccagcacaagatcgatcagactggcattctcttcccggctgccattgaacagcgccaggccgccgtcgccatgtcgcagaacccgcaaggccggtcccagacgctcgatcgccagcagcaaaatattcggcaccggcacgcgtgcgctttgcagcaatccgcgcatttccaccagatcacgcaacgcggcgtaatgtgcggacggagaacgctcgacatggctgccatcgggcagaatctggcggtccagttccttcggcagccatttcagcacccgcgccagatagctccctttgtccggcagcgcgatagcagcggcaagcagcccctttaacacggtcaaggcgcgtgcatcggcggtttcgggggggatttcgaacgccagcgcccgcgcatccgccaccagtcgcgccatcatacgctgacggaaattgtcatccgcggaagctgcaaaaaaatcgtaatgccccaaccaggccatcaccctggcccctgttacatcagggcgcgtggcgatgttgtcgagtgcggaagcaccgatccagtcagccaccatgctccgtgccttcaggcgcgcaccatcagtaccgagcgcacgaagatcccgcagccaggagaatccgtgaatggctgcccgcaactcggcagtgccggcgctatccccccatgcgccgggctgaaggctgcggattataccggagtgttcgtattcgccccgcagcaatcttgccccgcgtgtcgcatcgcccggccacagatcacggaccatgacaagcggtgcatcgggcgcacggctcaggcgcaatgtcggcagccgcgccgccgcacggcgcgcacccctgacccatcgggaggcgggaggaggcggactcatgaaatcgattcgaatcggtgactggcgcgcatatctgcttgtaacgacggcagtgccatcaacacaaccgaccggttcggacctacgtaaagtttgatctttccaccacgcgccctcgctgaccgatccggtctctatcgcaccgtcaggcgtgcagcaaaaaacccgtccatccctgttatcgggggtgagccttccggtccggcaaacgcaagtcccggatgggtgcgcaaatatccttccgccgtgcgcgcccccggcaggaaggccagttcctccaccgtgaagggcgacaaagtcacggacggaagcgttttcagcgcatgctcgatccgttggcggccttcttccggctgcatggagcagaccgcatagatcaggcgaccgccgggacgcagcatggcaagggctgcagccagcaggcggtcctgttgcgccgtcagcgcggtgatatcccgctgacgcttcagatgcggcacatcaggatgacggcggatggttccggtggcactgcatggcgcatccagcaggatggcatccggcacgaaaccggccggcggagtccattccgccgcatcagccaccgccacctgcacatccagacgcagccgggccaggttttcacgcaggcgcggcacacgcaccgcttcacgctccaccgcgatcacctccgccccgctcatggcgagttgtgcggtcttgccacccggtgcggcgcacagatcgacaatcttctccccttcccgcgccgccagcaggcgcgccggcaaggaagcagccgcatcctgaacccagaatgctccctcctcaaagcccggcagaatgctgacgcgggtaccggggggcagccttattgtgccgttcgggagtaaaatcccctcggcaggtggcgtgatcccgggacgcaaggtcagatcgagcggagcctccgtctgatgcgccagagcaatggcgcgggcatcgcggccccacgcggtccacagccagccgggcgtgtccagccggggggagtccaacccgttcagcatctcctgcccacccgttgccaccttgcgcagcaccgcattgatcaggccggtgaaaggtgccagccgcagctgacgcgccagatcaaccgccgtcccgaccgcagcatgggggggcgtgtccagaaacagcaacccggctgcgcccagacgcaggatgtcccgcaccggcgcaggcggctcccgtcttaaaaacggctccagcacggcatcaatggtgccgagacggcgcaacgtcgccgcagcgagacgatgggcggcagcacggtcgcgcggctccatcggcggcagggcattcagcgcctcttccaacgaacggtgctgctccagcaccgcattcaacagacggcaggcagcatctctggtcgggtccatagcgacggggggagccgatgggcgacgggaagaagaaggagaacgaattgtcatcatggctttttgcgcggcccggccctttccggcaagcacgcgatacgcatgtcccttatcacacccccttgatcgcaggccacctcggggtggtgcggcgtggcaggtgtggtaattcgtagtctatgcgccagatcctgttcctgaccctgttctgcctgatcgcgtggataccgggttttttcaccctgccaccctccgaccgcgacgaaagccgcttcgcacaggccagccggcagatgatcgaaaccggtgattacgtcaccatcatgaacggcaccgaaccgcgtaaccgcaagccgatcggcatttactggctgcaggtgccctttgcgaaagctgctcaacaggccgggctggcgcaggaaaatccgatctggccctaccgccttccctccctgctgggcggattgctggccgtgtggatgacatacggctttggaatcaggctggtcggacgaaagggggctttcctcggtgcgtggattctgggcgcctcggtcattctgctggtcgaaacgcatatggcgaaaaccgatgccgccctgctggccgcgacactcgctgcgcaagggctgctcgggcgtgcctatctggtcgccagacaaggcgatcaggataccagattcgggtcggttcaggccgcgctgttctggatcgccatggccgcggggattctgatcaagggaccgatcaccccgatggtcagcgccctgacggtgctgaccctgctgattaccgatcgccgcattccggggcagacgcgttggcttgccgcgctgcgctggcgatgggggctgccgctggccatcgcgctgatcctgccatggttcattgccatcggcattgccagtcacggacaattctttgcgcaggcgattggcggggaactggccagcaaggtacgcagcggtgatgacagccatggcgcgccaccagggcttcatctcctgctgctgatcatcaccctgtttcccggatcattggtggtgcttcaggccctgccggcatcatggcgtcaccggtcagaaccggtgatgcgcttcctgctggcctggatcatcccgtcatggatcgttttcgaggccgtaccaaccaaactgccgcattatatcctgcccatgctgcctgccctcgccctgctgggcggcaaagccatagcggagacgctggcagtgccgcgctggatgcaatggctggcaaaaatcctgttcgtgctttcctgcctgttgctggggggagccgcgatcgccctgcccttcgtcatcatgccgggactgcactggcaggatctgctgggcatccctgcttttcttactatggtcatgctgctggcactggggaccggactgctgccgcgccgtcagcgtgacgcgacaccctatcgcaatatccgcctgctgctgatctgcgcaccgctggtcggctggagcatgctgggactggaattaccttccctgcgcaccctctggctcagccccgccatcactcgggccgcccggatcgaaacagcagagctttacggggcacacgcgccactcgatctggtgaccgcaggctataatgagccgagcctgcgattcctggccggaaccgacacgttttttgctcccgatgccgccagcgctgccgcctggctggcgaagcacaagcaggccattgccgccattgcccgcccggatgggaacgccttcctcgccgcagccaccgcacaggggctcagccccgatctgcgatattccatggccggatataattactcgcgcgggaaaaggattttgattgatctttatgcatcaggcactggttccgcctcgactcaatgaccagcttcagcaatcatcgagtttattgagcagggggcgtataactctgaattgacaggccgccatacgctcggcgctgatgtttttctgcacagacgcagaagcggatatgaccatgcaacatgatacggctcaggtgttcaggcagtccgatgtcggtctctccgataccggcgcgatacaggatcgtctgaccagtcttcttctgtccctgggccattgcgattctgcatcagtcagccgtgccacctctctggcgcgcgaaaccggggagcggcgcgacgtcgtgatgcagcgtctcggtctcgtgaccgagcgtgatctggccgaggcttatgcggccctgctgaatgctcccctgcttcaggaggctgattttcctgatactccgctttttgccggcacattgccgcggcgtttcctgcgtacctcccgcattctaccggtttctatcgcaacggacggcacagtgaccctcgccatggctgatccgctggatcaatttgcatgcgactccgtggcagcagcgctgggcaggcctgtgcgcatcggcatcgccgtgccgatcatggtggagaccgcgctgcaacgtctttaccctgaaacagacgcacttcaggatactggtaacgaggcggaaccaaacagtgacggatgggccgacgacacggagagactgcgcgatctgtccagcgatgcgccggtgatcaggctggtcaaccagatcatcagccgggcagtcgaaaccggtgccagcgacatccatatcgagccgttcgaagaccggatcgcaatccgctaccgctatgacggtgtgctgcatgaggcggaaggcgtctccgcgcgcggcggctcggccgcggcgatcacatcccgtatcaagatcatggcccggctggacatcgccgaacgccgactgccgcaggatggacggctgaagctggccgtacgcgggcaggaggtcgatttccgtgtctccaccgtgccttccctgtatggcgaaacagtggtgatgcgtattctggaccgcagcgccgtcgctttcgaattcaatcgtctgggtctgcgcgcgacagtgcgggaaaagctggaacgttgtctgtccatgccgaatggcatcgttctggtcaccggccccaccggcagcggcaagaccacgacgctttatgccgggctgaacagtctcaacagcccgacccgcaagatcgtcaccatcgaagacccggtggaatatcagctccggggcatcaaccagatacaggtaaagccccagatcggcctgagtttcgcggcactgctgcgtgccatcctgcggcaagatcccgatgtcatcatggtcggcgaggtgcgcgacctcgaaaccgcacagatctcggcacaggcggcgctgacgggacatctggtgctgtccaccctgcataccaattccgccgccgcaaccgtaacccggctgcgcgatatggggctggaagattacctgctgaccgccgtgttgcgcggtgtgctggcccagcgtctggtgcgtgtgctctgcccggcctgcaaaacatcgaccccggccccatcggcgctgatcgagcgcttccgactggacgagcacgctcctgccgggcaaacgccccatttatggcaccccgttggatgcccggcctgccgccagaccggctatcgcggtcggatggccgttgcggagtttctggaacccgatgctgcgattgaccggttgatctatgcccgcgccggggaggccgagattgaggaagcagcccgcgccgccggcatgcgcaccatgttcgaggccgggctggatgccgtactggccggagaaacctcgctggaggagatcacacgctgcctgcaccatggtgaggacgcgttgtgagtgagtccgcgcattattcaggtagccctacaggaggtatagccttccggttcaccgccctgtcgaccacgggagagatcactcagggaaccctgtatgccgccagcgtgcctgaagccgaaacagccctccatgggcgaggccttgtaccacttgagattgccccgctgaggctgaacacgctgatgcagcgcctgcgccgtccgattaccggcatgaagcaggcggagctgacacgcatcacccgtgaactctccatcatgctggaaactggacaggatctggaccgtgcgctccgcttcgtgggagagcacagcgcacggcgggagtccgtccgcctgatcgaagccgtccggaaccgggtgcgggatggcagcccgctggccgatgccatggctgagcatccccgcgcgtttccccccctttataccggtatggtccgcgcgggggaggcgggaggcagtctggccgccacgctggaccggctggcagcctatctggaacgacagcagactatgaatgccgcgctggtctctgccctgatttaccccgcgctgctgctggtcaccgcaaccggtgccgtcctcctgctgctgacacaggtgctgccggaatttgcccctctgtttgagcagaacatggcggcgatgccggcctcgacccgtttcctgctcgggctgagccggaatctgtccgtctggctgccgacagtgctgatgctcatgcttggggtgctgacaggggtgtggtggctgctgcgacgggacgggccgcgtctggtcgcggatcggttcggcctgcgcctgccgctgatcggggctatctggcgggaattgctggccgcaaggctgacacgcacgctcggcagcctgctggtcaatggcgtgccgctcatcaatgcgctcgggatcgctcgtgaaaccctcggtaatcgcgctgccgtcgacgctgtacgactggcagcgcaaaatgccagtgaggggggctccttcgccaatgctctcgctgaacagaacgtgttcccggcccgtaccattgcgcttttgcggctgggtgaggaaagcgcccggctcggcccgctctgtctgcgcgctgccgatattcatgaagatacgttccgcatccggatgcagcgagccgtgtcgctggtcacaccctccatcaccgttgccatgggggcaatggtcgccggaattgtcagctccgtgctgatggctatgctcagcctgaacgatctggccgcgcaatgaaaaaggcgacttccaattcaggccgtcggcaagcaggatttaccctgctggaaatgctcgtggtgctggccattctgggggtcgggacggggattgccctgttatacggcacacggataccggagggactgaaagcccgggatgcggcacgcgccatcgccatcgaatttcgcctcgcccgcagccaggcaatctggtcaggtcatacagtcagggtcaccgccaacctggaccatgccacgctgcaacgggacaacgcgatgcctgtacagctgcgcggcgtcacactgcatcgcctctcgcaagacagtgaagcagcaaagcagggtgacgatacccaggtcacattgctgtttctgcctcatggcggcgcgaagggtgacgggcttgttgtcagtgcggggtctacctctatcaacgtgcggaccaatccattgaccggcaccgtcaatgtcgtgccgtaatgtctccacagctggacacggcactggccgggagagcggtttcaccctgctggaaacgctgatcgctttcatcattctggctctggcgctgagtgaaatttttgatggcagtctgatcggcctgcgctctgcccggcgggcggaggaaatgaggctggctctggttatagcgcgcaatcatctggatgagacgatccatgccgcgcccgcaacgctggcccgtacccatatatgggagggtgaggaccgtaacgccatgcattggcgtgtcgtggtgagaccgctgatgcaggcgccgagattgcaaatgccgctgtggctgtcggaaatcactgtctcggtctggtcttcctccgtcagcagcacagatggcatgccgcccctcgtcacattggtgacccggcaaatggcgggggtgcgatgatgcgatcaggcgatcgaaggcaagagaatgccggatttacgctgctggaagttctggtggcgctggtggtgctgggctttctgatcgtggggctgaccgaaggcacccgtttcggttttctggcacagcagcatcaggacgcgatgcaggcaggtggccccgcgctggaaggcgcagatcgcgccctgcgcagcttgctgcgtacgatgcgtcccggcctgccgaccgatgacagcaatccccttccctggccgcacggggacaatcgaatgttattcttcatcgccctgatgccgggcagcgaggatgatccatccagccccgactccactcttgccgacatggttctgctggtacgggataatgcgctgaccctgcgatggacacgccatatcaacggcaccccacggcatccgttacactggcaggaggccacgctgctggcgccggttcaggcactggccattgcctatcaggatgatcagggtcactggtccggccgctgggaagggcctgccattccatccctgatccgcctcagcctgcgccgctccctgacccagaaggagcaggttctgatcatcgcgccgcgtattgatacggaacgtccatgacgatttcatttgctccaggagcatcccacatcacgcgcctgctggcgcccatccggacggctctgaagccgctatcggacaaaatcggcgcttttttcacatggtggggcacgcatcttgctgcctgcctgcctgccagggtccgcgcacgtctgctgacactggccgggcgacacgaaaatttgcttcgtctttccattgtggaacaggatgatccccttctttctccccgtgttaccctatccctcatccggggtacacgcgtgcagaatctgggcatttatcgcacgacacaggccgccgagcttgccgtcctgcgcagtattctcgaccagtggcaacaacgggccactccggttctgcacagcgtcgggatattgcccctgatgcgcacagtaaccctgtcgacgacagccgaagaatggctcgaccaggtactggcccatgaaatggaccgcctgacaccctttacagctgacactgtgctgtggacctacgacatcctgtcacgcgatcaggcgcagcagaaactgaccattcgtttgcatctgctcccctcctcctggcttccaccgcatctttcgtggctgaatagcctcggcttcttcccccgtcaggtagaggcggaaacaatcctgtttccgatccgtaatgccgacattcgggagcggaacaggggacgctatgctattgcggcacgatgggcatgggcaggatgcgccgctctgctgatcctcacagtggcaacccctttcatccatcaatcgatgacactgggacggctggataagaccatcgccagcctcaaaccagaagcacaggcagcgtctgccctgcgccgcaccaataccgcggaacaggcaaaacaggcggctctggccgaaggaggcggccgcagcggagatgtactcggcatgctgaaaattctgaccgatgccctgccggatgacagtttcatcagcgatttgaccctgtcccgccgcgccatcaccatcagcggccagtcaggagcagccgcccaattgatggcatccttcagcaacaatcctttcatccgcaacgcggcctttaccgctccggtgatgcgtagtccggatgagaaaaccgacctgttcgccatccggctggatataagaccggaggcaagaccatgatcaggggttttctggcacaggcaggcacaaacgacagctttaaacttcctaccggccgggcaggccagttctgtgccttcgggcttgccctgttggctgtggttgtgacatggctgggcatcatctcaccgctgctgggctggtacgcagcacgacagtacaggatcgaggatcgcactacgctgctggcacatatgcagggggctgttgcatccctgcctgccctacaaaaaacccgcacgctcatgcagcgtggaaatgcagcgaataccgcctttctgcaaagcccgaacgatgcggccaatgcggcccagattcaggaaagcgtgcgggcactgagccagcaaactggcgtttccctgctgagtgtggaaacattgcccgcagacactctcggcacctaccggaaaatcagccttcgcctgtccgtacgaggaagctggcccgccatcatcgccttgattgccggccttggcgaggcttcccctcagatcattgctgatgaaatacagatgcacgcttccattgcaggtgcgatcaagcctggcgacattgggtactcaccccccatcgacatgaccatgaccgtatccgcactggctgttgtcccctcctcccatcaggcgcagccatgacaatcagccgcctgttgctgcctcttttcctgtgctgtctcctgatcggggtcatcttcaaactggcttttgcaccagaggcatcccacgtgggagccgaaccgggcactgttgccccaaaaaccaccgctgccaccccgccccttcccgcctttacgtcggaggaagcagtcaaagtcattcttgcacggcccctgttcgcaccacggcgacgcccgctgccaagttcagaaacgggtcatatcaatttgcctcgcctgaccggcattatcaccggcccaggtgaccgcaaggcgattttcgcgggagaacctcactccatcgccatcagcgcaggcgggagcatcgaaggctatacagtgaccagcatcgaagcaggaacagtcacgctgagtgggccggtgggaaccatgacattacacccgcagcgtgccgccgataacgcggtcaccactccctcccaaagcaccacgaccgccccgcaatcctccgggtcgaaccaaccccttacgtcacaaccggatgaacagccatccccagccatcatcgatgagatgcgacggcgattactcggaacccagcggacaggagagtgaaaactgcagattttatacagcgaggaacgccagggaataggattttaaaaaattttattgaaaatccaaaagaaaaattttacggtttcattcagaaaattcacattttttatttcaatcattaatagctcaaaatattaatgacgaaataattttatatggctgtatcacatgcacaatgatcctcgtatccccacatcaataacaaaacgtaatctgctcaaaggcatcgccggtggaacagcagcttctgtggccgggctggccatcgctgaagaagccgacgcatggagctttaccagctggctcagatccattttttatcccacctatactgtcaatgcccagatcacgacttttctggattccgccctgtctgcagcattccgcaccatcggcgtgaatgcaggaacacaaaattataccgttcaaaatcctggggtattcgatagccgtaccgctcagcttagcgtaacgggactgaccgctgcttttcagacaaaatcggtcaactggttcgcacagattgcaggcaaccagatcaagcgcagcaataccgaaatcgctccgttcggggatcgcctgagcagcaccgatctgggatccatgctggcctcccagcggtcaatcacaggcggcaatttcagcctcagctacggtttttacaatgcggcaatcagcgacacgatcctgaacgcattcgacggaggcgtttccccccctgcatgcagcgatctatcgcatgcatatcagttctacatgtatctgacggatcgttataatacgtggatgggggatctggtaaacgccacaccccggcttgcttcacagcctttcggtgtattcgtgctgccgggtgctcatgatgccggcatgaatgggatgccgcgtcttggcgatctgttcgccaataaccgtcgcctggatgctctgctgaattctctgctgaataatatttctccggttggtcgccaattgctaagccttggaggcaccgggttcctgcgcgcactgccccaaagcaccctgtcccgtgtgatccgcaatctggccgtgactcaaaaagatgatacggccacaatgctgaatctggggatccggtatttcgatttccgccccggttatatttttccggcaggtgcgtcagaacaggcacttggcctgtttcaccaacataacatgatcccaggcggttcctatactaccttcctggcagatgttttgaactggttgaaagccaacccctctgaaatcgtagtcctgcacatcaattcacagggtctttacaacgatgccatgatcccttcacagggcacgctggattccgcactgtcttccgcactgtcgcaatatggggcggggatcaagagcggtgataaaactgcgttcggctcttcctatgcttccctgatctcagccaacaaacgcctgatcgtattgtatcaaagcggctcctaccgaaccgtcactcgatatgattcctacagcgatggtgcttatgggaccacctgccctgcctctattttgggtgcgctcaacaatatgaatgctggcggacagtccagtgcggattacaccgtgctgcagcttcaaggtaccgccaccaacacgaaatcaggcgcagccgcagctattctgggagatggagatgcctcctcaccactgctagccaccaagcccgtgtttgatgctgcaacgatcccctgggtccggggcgtagcgggcggtcgtttcctgccgcgccagccgctcgtgctgctgaatgacttcgctgacaacgcgatgacatccactgctattgccgttacccgtcagcgcagttcctctgtcgcatgatagcgtcctgatgatcctcagcttataacgtgtgctttttatagtggaggccggaccttgcaaggcagtaaaagtgacttgcttacccggttctccactgataaagccgcacgtcatatccatgaccaccttgatatcctatcttgaggcagtggcggttttctctgacggattaccataaaccggcccctgaaacggcttgccggaatattcatgacacccacgggtaaacacgttttctcacgggccttttccttttcggctgctgtatccttgcagtccctttgcctgtgcatgcctgtcttcttggcaagttgcggaaaagacgaaccgccgcaactggaacccttgccacctctgacccgcgatgctggcattgccgcaagacaggttaataccaccctggcacccagccttccgccacacgggcagatcagctatggacgggttccgatccagtccggcacagcgtcaggcagccatatggcagaggccggtggcaacaacataactctcaatttcacggataccgatatccgtgatgtcagcgcccagattttgggcggcctgctcaaggtaaactatactatcgacccatccgtgcatggcacggcgacttttcatacatcccagccgctcagtgctacggccctcctgccgacgcttcaggttctgctgaaccagaacggagcggcggtcgtacagacagaagggctgtatcgtgttctgcccatcggtgccgctgcgggcatcacagcctccgctggacaaaatggtgaagcgattctgaatggcggggccaccatcgtaccgctacgctacgcctcggccgagcaactggccaaaacattacagccttatgcacagaatggcgcgaaaatcgcagccgatgccgggcgaaatgccgtgctggtttccggcgatccacaggcgcgggaagtcatgatcggactgatccaggcttttgatgtggatatgctggccggacagtcctttgcacttttccccgccgatgccggaggggccaaggaatacgcacaggctcttcagaccgccgcctccagtcagcagggaggcgcactggccggcgtagtacggatattgccgatggaccggatcaatgccgttctggccgtcgcccgcagtgcaagacagatcgaggatttgcgacggatcgatacgatggtcgggcaaaggcggcggcaatcaacccgaagctggcatgtctattaccttcaaaatggccgcagcaacgatgtcgcctatgtcctgcaacaagccttcacgccggggcgcgtgactgcccagccaacaccacgcaacaccacacgtcccgcgggccagtcacaatcctccgccgcacagggaggggccggtggaatcaatggcggcatgacaggaggaacctcctccatgacccccggcggcaatggcggattaccgcaggccggcaatacgggagatgcctcacaaccacaatcgggcagcagcaaccccctgctcggctccctgaccggtgcgggcggtggctctgccggcaatatggatgatgcgggtaccgatcctaatacactgcgcatcgtgccgaatacgcagaataatgccgttctgatcttcgcaacggaaagcgagtatggcccgattgagaccatgctccgtaaaatcgacattctgccacttcaggtgcggattgacgctatcattgccgaagtcgcgctgaacgataccctgcgatatggtacacaattctttttccgtgaaggtggcctcaacagcgccatgcaaaccgcggcagcgacagccgcgacggccagtactggcggtcttcttgccgcggcgataccgggattttccaacggcttcctgctgaccggcagcagcagctcccagttggccatgacgctgctgcaatccgtcaccaaggtgcaggttctctcctcgccggagctgatggtgctggataacgaacctgcaaggcttcaggtaggagcgctggtaccttatctgacagcccagtcacaggcgacaatcgggcaatcagccatcatcaacgcggtcagctatcagcaaaccggcgtgatcctgaacgtaacgccccgcgtcaataacagcggtctggtcacgctcgatatttcacaggaagtcagcgatgttgataccagtatcaacactaacggcatttcctcccccgctttccagcagcgtagcgtacagtcccgcgtcgtggtgcaggatggacagactgtcgggctggccgggttgatccgcgataataactcccgcgccaatggcggtgtgccgttcctgaaagacgtgccggtactcggtagtgtgttcgggcagcagaataataatcgtagccgcaccgaacttctgattctggtcacgccccatgtcattcatgaccagcgggatgcgcgtgccctgaccgaagatctgaggcagaatctgcgtgatgccgcccttgtcccgcaggagctgaatcatctgcgccctaccggctccgccgatccgaaccgccatgtaagacactcgctggggctggaacgctgaagcggccgcgaaaagatcggacagcaactggcctgaccagatcaggccgcgatcgtggctttgcattgctgattgtgctgtggggcattgtgccgctgacgatcatcagcagccgtattgttgccaccgggcaaagtgaattgagactctctacggctctggtcgccgcggaacaggccgatgcggaagcagatggggccgtgcaggacgccatttttcgtcttgcagccggtcaatggccgatcaaggcggccctttatcgttgggcactagcggatgctcaggccgttatccggatcgaaccagaaaaagataaaataaaccctaacacggcctccgtgctcgccctgcaatatctgatggaggcaacagggataaggtcggccacggcagcgatggtggcccgcaatatcgtgctctggcgcactccccctgccctgatgacaacggaggaacaggcggatctggcccggcttgctacctccagcacaatggaggccgtagcgggtcactatttcacgtcactggatggcctgttgtcattacctggaatgactcctgccctgctggaccgattgcgcccccatctgtctctctatcagcctgatataccggataccggggcttctgatccgctggttatgcatgcactgctccgtgccacgaaggtggatgggatcaggctgccatcagcctccagtcccgccgatatacgcagcagtgatcatatcgccgtgactgtcgcagtactgattatccggaaagcagatggtcgggaggccgccgcgcgcgtggcaacagtgcagctgaatccggacaaaggcatcgtcacgatgctggactggcgccgggtgcccttatcccgcgccgccgaaagggttgttaaagggcgctgaagcacaagccggggatctgcccctgaatgtcttgtcattcgttgcagatcatgccgggcgcaggaacatcgcccgacacattcttctcaccacgagagcacagatcatacggcatttcctcccgcgctgaaggtgaccgatacaggaatggatgattccaggggtcctgtggcaatctgcgatccttaagataggggccattccacgcatcggcatccgcggccggccgattgacaagagcacccaggccgtcggacgtcgaaggatagctgcccatatccagcctgtagagatcaaggactgagccaatgcgttgcacggcctgccttgccacagactggcgtgcgcctcccagttggcgcaacacggccggagcagccaatcccaccagaattcccagaatggcgatgacaaccagcatctcgatcagggtaaaacccgcatccgcagaagaacgggcctgaaattgaccactctggctccaaggaaacaggcgaaaccgcattccagctattacgaatgtaaactgattgcgtttagctgtcatatgatgtttcctccctcatcttcacaggatactccaccaaagatcaacctgacgtgagcataccctatattgcctgtatggcatcgactgcatcttactaccaccttccgccccgtgtactgccatcaattcaggcggtggaaaaaggggcggtcggagttgtgcatcgcaatgcgaacgggacagaagatctcggtctgatgcagatcaataccagttggatagagccgattgcccattttaccggtctttccgttcaggccacacgggtcaggctgctgatggatccctgtttcaatatcgcagcggcaggagccatcctccgagatcatctgaatgcatcaggcggaaatatgatgatggcgatcggcaattatcactcccgcacaccgatccatcatttttcatatcgccgtaaggtacagaacgcggcatcccggttattcataggcccatgacaccgtttttttctaacgctttcagacgccctctccgttctgtgtttaggctctgtttccttctgttctccatactggctcaggcaggcttgatgggagtcgtcctccctcctgcccatgctatggcagcggataaaaataccgccgagcatggtgtaatcaatgcaggctattttatcgatccgcctttcgtgctgccgcatcagaagaatgatcatccggccgggctggccattgatctatgggacaagacgtcacagatgcagggctggatcacccattatcaccgctatgaaacgatagccgatcttctctccgctcttgagcgcggggagatcgatgtcggtacggtcggcctgacaatcagcagccagcgtatggagaaagtgatcttcagccagccctggtttcagaccgggctgcggatgatgatcgtcaaacacaatagtaccggcctttccagacttctgagcgaactggctgcttccggccatctgcgtaactatttgttgatttttctggcgatcctggtggcgacactgatcacagccatcatgcaccggcatgtgttgaaggattcatcaccccactggagttcctctctgtcgggcgccttctatgatatgatggcgatgctgaccggcaatcaaacgtccggcaccgtgccagagcgagccggtgcacggatcattgccgccatctggctgctctgtggcgttggcattgtggcctatgtcacatccagcattaccagcgtgatgacggcttcagaaatcaatcagcgcgtggacaatatcactgaactaggccatcgcccggtcagtgcgatgaaaggcagcatcgccatgacttttgccttggataccggcctgaacgttcacggatatacgctcctgtccgatgctgtagatgaactgatccagggcaaaacatccgccattctgggagatgcatcacagctcgattattatatccaacagaaccccacccaatcactgatcgtaacaggcgctacactacgtccggaaaatctcggcttcgtcatgcggcccggtttccctatgcgttatcagatcgacaggaccattctcaagttgcaggaagaaaaaatcctgtcccagatggagtctgcctatttttcacatcgataaaaacgactaacgcagccgagcacctttatattgccgaacatacgctggttgggcagtcaaggagggcaagcgtttatcaatcctgtcggagaacattatgaaaatcatcatttccaataacggagtgcgcacgatgtaggtacgctcggaaatgactccgtgcgtcatggagggaaactcccatgtctcgcacctatcatcacagcctgaagtatggtcgtaatcatcgatgggccaatcgcctggatcgctgtgggtatggaggatcacgtgatgcctctgaatctcccaactggtacagccatctgcatgatatctgcccggctcgtcgtaaagacaaggccattggccgtctcattaccagaggttccattgatcctgttgaggctgttttttcttacaccggaaccagaaggccacataaatattattggtaagcactgatacgtcagcgatttctgccgcgtattttgcttgaacgcatgtacagccggtcccctttaggaattggggatcggttttgtgtattatattagtatgttgatttgagatggttgcgggggcaggataattttgcacccacgctaacacctatctatatgaatcatctgcctattcctgttgcgctacgggccagcacccccatcgatacccccagctaggtctgaaggcgccgaggcggtaaaaatctgcgacaaatggtccaagcagcggcggctcgactatgaggcatcaagtcgcattgaaaccgaatgcatcgctgttttcattgggtacaattttgaagagtacgtcactgccagcgagctttaacgaaccgggctatctcggccgccaagtcgtcgtcctccggggtattcccttgaaatcctccgtgcggcatcccttcaaagacatgcagttcggcatccacatccgcttggcgcagtgcacggtgcatccgtacagcgttggacaggaagaggtctcgcgtgccggattgaaggaaggccggtggcaggccttttaaatctccgaacaatggcgagagataaggatgcgacaggtctgccccaccggcatacagcgcgttgttccgcatcaatgatccgggcagcacgacatccaccatctgattaacctggaaactgtcgccggactcggtcagatcgacctctggagacaggagaaccatgccggcgggcatgggcagtccttcgtccttcgcgcgcaggagcatcgcgacagcaaggttgccgcccgccgatcgcccgcccacgacgatacgcgacggtgcatgccgttccagcacgtagcgatacgcccccatcgcgtcatccaatgccgccggatagggatactcgggcggcatcctgtaatcgacgccgtagctgagcgccccaagccgatccgcctgcatccgcgcctgcacgcgacacgcctcgccgccaccaaacacgaacgctccgccatggaaatccacataggcgccatccggcaccgatatggtctcgggcgtcgcgacatggatcgtggtctcactgatgcaaagcgtctcggcgctggcacgcaacgtaccggccagccctttcactgccgccgcgtaatgcccgtccgctgcccccttgatcttcatccaacccgcatgatcgtccggcggtggcatcgagtagagcgcgttgatcgggacgccatcgtcattcaccagtcgttcgagactggcgcgagcttcctggcttatcgatgagggaaacggtatcaaacggccctggaccataatgccgctcttctggttggtcatgtcgttgcgctcctcatgacgcgcgccggatcgcagctgcgccgcaaccaatgctgacggggcccaagcattgcgtcaaagcgccccctcccctgttcccgtagacggaccttgggcgggttggtcttgcaccgctgggtggccccttcgtttaaggtgatagctgctcaggcccggccgctcaggcatcttcctcataatcggtcgaacgcgttacgctttcccagcgatccatctcgtcgatcaccacgtcgagcttctctcgggcacgtcgcagcgcgtcgctcccaagcagcagatgaagcggcggattgggcgtgtcgaccagttcgaggatcgccgcagctgccttgtccggatcgccgatctggcgcccggccatcgcgtcgagccgtgcgattccgctcccgacgctttcggcatactgctcgctgccctgactgcggcggatcgaatgaccactgagaaagtcggtacgaaaggcaccgggtgcgatggccgtggccttgagaccgaaaggcgcgacttcctgggctaggctctgtgtcaggccttcgagcgcggatttggtcgccgaatagaggccggacgatcccgctggcgcacggcctgcgatcgaggtgatgttcaggatgtgaccgctgccctgccgccgcaagacgggaagcgcggcgcggatgatggcaaagggtgcaaagacgttgaccgcgaacagccgttgaaactcggcgtccgtcgcttcctcgatcgccccgagcaggccatagccggcgttgttgaccagcacgtcgatgtggccaaccatgtcgaaggccgcacttacagccggcgcgatcgccgccgcatcggtgagatcgacggtcaggacatgcagcgtaccatgacccacttccaaatccggcgcagcctcgcgcaccgtgccgacgacggtgtcgcctcgagcgagcgctgcctgcgcgagcgccttgccgaggccgcgggaaatacccgtgatgaaccatgtcttcatagctgttctccttcaccgccagatgtagcgcttcactccaagcggataatcgaccatttgctacccaggcttgtaaggtcagcttcacaatgctgagatgccccctatgatccatcccagcgagttcggtgccttgcgcgcctttgcagccgtcgccgagcaacggagtttcagccgggcggccgagcagttgggggtatcgtcctcggcgctgagccagttgatccgcggcctggaggagcggctaggcatccgcctgctccatcgcaccacccgcagcgtgtcgttgaccgaggctggcgccgcgctgctcggtgatatcgcacccgcgatcgacagcctgacgggcgccctggagcaggcgcgtactgccgcgaagctgccggccggtacagtccgcctgcactgcttccatgctgccgcagacaggttcgtagtgccgatccttccgaggctggcgcgcgcgttccccgacatcacgctcgatctcacgattgatgacacggtcgtcgacatcgtcggcagcggctatgatgccgcaatccgtatcggcgaggtgatcgaacgcgacatggtcgcacttcggctaggcgaggatattcgccagctggctgtcgccgcgcccgcatacctggccgagcacggcgttccgcaaacgccaaaggacctgctccagcatcgttgcatccgctggcgctggccggggcagcccggcccctatgcatgggagtttttcgagaagggccactggttctcggtggcggtcgaagggccgttgatcaccagcagccgcgccgtgatggtggacgccgcgcttgctggcatcgggatcgccttcctcaaggaggagtctgtcgtcgacgcttttgcgcaaggtgccctcgttccgctgctggcggagtggtcggttccctttcccggctattatttgtgttacccccagcaacggcagatggcaccggccctgcgcgcggtaatcgatatgatcagatcgggtgaggatgcggctttctagctagccgcatcgcagtgtgcgtcgaaatcgcgcgccagttcggccaggctgacggaatcgaggcgcgccaccaggagcgcctcggcgtcacggagcacaccctccagcgcagtattaacggctttctcgacagcgcagtcggcattggcgttctcatggccgatagcgaacaggcggggtccgccaaccgcgcggtgtacgtccagcaacgaaacattcttcaagggctgcgcgatcacccagccgccgccatggcccttttccgaccgcacataccctgcatcccgaagaccagccatcgtgcgccgtaccacgaccgggttggtacccagcatgcgggcgagcgcctcggaggtcattggtccctcatgacgcgccatgtggagcagcacatggagcattcgcgaaaggcggctgtcgttacgcacgatgtgatccttcacggcgccatcgagattggcaagggctccatatcacgatacttatcaagttacatgattcgtggagcgtcgattatgcctgcctatgaaaacccagatcattgggacacagccgcccagcattatgagaaaacggcgcatccattcacgtccctttatgccgaggcggcactcgcaaaggtcgctctgacatcagaaagccacgtgctggacgtggcggccgggactggcgcgctgacgttggcagcggcacgtaccggcgcacgcgtgcttgcaaccgacttctcccccggcatggtggcacgcatcgctgctgcgaacctgcccaatgtcgaagcatgcgtcatggatggacaggccctgactctggaagacggcctctttgatgcggtcttctcgatcttcggcgtcatcatgtttcctgactggcgcaagggtctatcggaaatggcacgagtaacgcggcggggtggccacggcgtggtcacgacttggcaggatggcggggcggcaacctttctcctgctcggccagatccgtcgcaagctgtttcccgggcgcgacggcatgaccatgccgaatgcggtcaaggcgttgagcgacccgagcgattttgcccgcgaactcatcgccgcgggatatcaggatccccagatccaacatgtcacccgcgactatgcgctcgatgtcagcgcacttgccgagcccgataccttgttcggtatgtcccccgactggatcagcttgagtgataccgagagggccgccgtcgttgctgaggtgcgagacatggctggtgatcgaatgatcctgcccatcccttcaaccgctctcatcggtgtagccaggcgctgaccatcactatgctacgagatagtgatcgcaatcgaagaacagcagatccgcttggatggagcacaaaactctacccatcagtgcggttataaaaattcccaaatttgaaaggcgtacccaaggggggcatagggagcgccgcggtccgaaagtctttccaaccaaagacttggaaccgcctgttggcatcaaccaaactgaggtcgtttttgtgttcaggatactgcttcgctccatggctcttcccgcttgcgtgctcgcgctttctgcgtgcggaagcaagggagagggaaattcaagcgcggtgacagcggctgccgaccagaacgagatgcagaaatacaatgcctatgtcgaagcggccaatacggcgcgcacgccctttgccgacatagtggccacctatcagcgctccatcaaaccggttttcgacagcggcaaggacctgacaaaacttttctttccgtccgatccgggcatcgaccgaatcaaagtgcagttggacaaggcattggccatgaagcccgccatgccggaactcgacggggcggcgcgaacctatagccaagcgcttgccaagattgcgccgctctatcgcgacatggcgaactatattgaggccaagacctatgtgagcgacaacggcgcccatggccgggaactccagccagcgctgcttaccgccttggacaatgttgcatcggcccaggctacctatgcaaaagccatcgacgccgcggaccgcgcgcgcatcaaggccgcgttcgaggcaacgaagaaggataccctggactattatcgcaagggcaccgtctattatctcaaggaaagcatggatcatgcctccggcgtactcaatggcaagggattgggcgaccagaaggcagcattcaaagcgtccctggaccagtttaataccatggccgtccagttcgacaacaaggtccgcgagaaggacaagacggcatgcgcgagctttatgctgcacgccaatgcctatctcgcagcgggacgcgatatcatccagcgtaccgaggacggcacctatgccaaggatcgcaggaatggcgcctcgttccaaatgatgaagccgagggcggtagaagacgccgaaacgctgctccagacctacaatagcgtcatcaacggcctcaatgtcaaccagtgctgacatcggacagggttttgtgaattaactggcatcccattcctcgatttcgtaggaatgggatgctgaggcgaacggcatcaaaaacagtaggaattttgtaaaatgacccacttgcggtcattggcaggtcgttttccgcttcccaacttcagttatttattcatgtccgcggaaggtgatgtggcaaacaccttcctacccgatggctcggcagcgttcttataaggatggcatataaaaaaatacggatcgaggcgacctaaaccgcgtcgactgtatttaataaccccgcgcgtgtgagcagatcgatcgcatcgtcgatgcgacgtgctgcggtcgcattgagttgagcgcgatcgtcgccaatcagtgcgcgcatctggtggggcacgaaaaccatgtcgatgaaccggtccgcaacatccgatgcttgcgcgatccggtcgggcaccgcgttggttccagcaatcgcctgagcaacgcacgtcacgccgccatcgcgaccgatccggtccaccagccgggcaagatcgggcatccggtgcgcggtggtgacaacaacacgcatcagcgcgaccgcctcgggcgtcaacgcatgctccagcaggctatgccccaccgcgcgcagccggtcttggacggacagatgccacggcaccgcgcctgacggcaccagcgtgtgatccaccatccgccgcaccacggccgcgaacagcgcctccttattagcataacgggcgtagagactcgccttccccgcccccgcctgagccacgacttgatcacagctcgtcgcgtcatatcccatccgcagaaacaggtccgtggcggcatcgaggatccggcgatcgacgtcgccggcctggtcggcggacggtcgaccaccgcgtcgtcgtttggctgaaccgggcttcgggtcggtaagcgtttgcatcacgcaaccatataggccatgcgtccgttagataaaactgaacggtatagttcagtttcttgcgaagggtttgatgatggcggggatgacgcatcaggacgtgaacggccgcgatgacggcgggttcgcgcagcggacgatcgcgcttgcgggtgcgacgggcgatctcggtggacgtgtgctgtctgctctggttcggcgtggcgtggaagtgcgggcgctggtccgcagcgggacgccaactgcggcgcaagatgccgtgcgtgcgcggggcggaacgccggttccggtcaattttgccgatcacgctgcgctgtcggatgcgctggcgggtgcaggatgcatcgtctcagtcctgaacggactggaaccggtcattctcgatcttcaaggccgtcttctcgatgcggcggtcgcggcaggcgtaccccgtttcatctcgtcggacttctcgctcgatttcacgaagacccgccccggcgacaatcgcaacatggacctccgacgccgcttcatggcgcgtgtcgatgcagcgccgatccgcgcaacctcgatcctcaacggcgccttcgccgacctgctgaccggtgaggcgccgattgtgctgccgcgctttcggcgcatcctctactggggggacgccgaccagccgctcgacttcacgacgaaggacgatgtcgcggactatgccgccgacgtggcactcgataccgaagcgccccgtttcctgcgtatcgccggcgacgtcgtatccccacgcgacctgtcgatactgatgacgcggcttgatggtcgccgctggaaaccgttccgcgcgggtgggcttgggcgtctctccaagctgatccgcgttgcgcgcgcactgtcgccacgcaccgatgcgccgttcccagcttggcagggcatgcaatatgttcgggacatgtcgagcgggcggggcaagctctcacccctcgacaatgatcgttacggcaagaccgactggacgcgcgtcgaagccatccttgccccgacactctgatcgctcattccggagtcttatcatgagcaacgccgtccagccgttttctattcgcattccccaagccgacctcgacgatctggtcgatcgcctcgcccgcacccgctggcccgatgccgacacggtgcaggacgggtcgcagggtccgcaatcgaaccgcatccgcgcgctcgcgcagcgatggcaggacggttacgactggcgtgccacggaaaagctgctcaatggctggggcagcagccgcacggtgatcgatgggctcggcatccacttcctgcatgttcggtcccctgtatcggatgccacaccgctgctcctgacgcacggatggccgggatcggtgctcgagttccgcgacgtgattggcccgctcagcgacccgtacgcgcatggcggcgacgcgtcagacgccttccacctcgttattccagcgctgcccggcttcggcttctccgataaaccaaccgagccgggttggggcgtcggccgcaccgcttcagcgtggggcgtgctgatgcagcggctcggctatggcgatcgctggatggcgcaaggcggagactggggtgctgcagtcaccacggcgctggcgcatatgcgtatgcccggtctcgccggcatccacctcaacatggtgatgacccagccgacacccgaggaacgggcgaatgcgacgccggcggagcagcagatgctggatgatgcggcgcgctacgaccgcgactattcggggtatatgaagctgcaatgcacacgaccgcagtcgcttgccttcgcgcttgcagactcgcccgttggactggcgagctggatttatgcgctctttcaggacgtatctgactgcgatgggcaacccgaacgggtcattctgctcgaccatctgatcgacgacatcatgctgtattggttgccgaacgcggggcccagttcggctcgcttctattgggaagccgcgcgagaaatgaggcaagggatgccgagttcacccgtgccgctgccagccggtatcagcatgttccccggtgagcaggtgcggctgtcccgccgatgggctgaggcgcgctttgccgatctacgctattttggagaggccgcgagcggtgggcattttgcggcaatggagaacgccgaaacgttcgtagagcacgtccgcgcgacgttccgagccatatagtacccgacgggttggaagccgtttggcagttcgcgactgggaggacccacatccggtcattcgcgccgttttcgtcgcttctgaacctcagacgtcgtctaatagcggggtttgcaagcacctttgtgtacggacgttgtttgctaggtcacggtcgtcttcacggtcgacatgagccgccgtatcatggggcttcccaggtggtccttccgatgttcgttccgcacgcatcgaaccggggttcgcggtgcaacgtccgaagcggaatggaccagccttcgtcccagcagggacgcctcgccacgccattggcgctgccgaggccttggatcaggcggtagcggcgctcctagtgaatagttcgctggagcgcagcatggcgtgcatgatgaccgcgagcttgcggcaacagcgacggcggcatgcttgaagccgaccttctcgcgaagcttcccatttggggactgacagcgagacggccgaggcatcgcgtttcgagagagcgcaccggcgtcagtatctcagtatagggtgtcggcaatccgctgcggtaatgctcggtcataagcgtccccgtcgatcgccgcttgcgatagcgttcgcaggatggccccagcactgggcagactgtcacgcgcgaccatactctcctgcttccacaatccggcgcggatcacggcgcggctgcactgaaagaagacgctggtcactgtgatgcgaagtatcgacttgggcgcttgccctgccaccgcgaaagcggcgagctgatccgggcttgccagtatttcggcggtcccgttcacccgcagcgtctcgccgatgcccggcaccatgaacagcaatgccacacgcggatcgccgatgatgttccgcaggctgtcgatgcggttgtttccgcgccggtcgggcaggatcagggtcttggcgtcttcaatgtggacgaaacctgccgggtcgccgcgtggggtagcgtccagtccgcccgaccccgccgtcgccagaacggcaaagggcgcagcctcgatgaaggggcgatagatcggatggatatgatccacctccttgatgaccgagggcggtgcgacggcgccatacagcgccgctagttcttccaccgtactgatatgcccgtcgtgctgtacgcccgtcatcgcctgcctcacctgtctactgcaggtttgtagcagatgggcggcgggggcaatcatcgggattttgtgattggaaaggcgcagcgggacagtaaaggtaggatcggtctccgatgcgttcacattgagccgttttccggaaacctgttcccgattgtatttgcccaaaacggtccttcgggcacggagaagccggactgctgcaagttggtgaagctgccggtttggggatatcctgccgatctatccagcggccggattgggttcaaaggcgcctgggaggggacatgttatttgagatcgctacgctctctggttcggtcttcgcagcgcgagatagcaaacagggcgcgcgggcctggctggctgacgcactaaccggatcgaccttgggcatgtagacgaccgaacatggggggatcggcgatctcatcgtgttgcgttcgttctccgatgcgcaggaacttggcctggaaaggaagcgagcgctacgcagcgatgatccattcggcagtgcgtccactggagcgcgtctgacgatcccgtggcaagacactatggcggtatcttcgaattccggacctaccatctcgtacccggcggcctttcaccgacgctcgccggctgggaagaggccgtcgggcccgcccgccgctacaccgaacacctcgtcactgccctatacgccttggacggagacctgcggatcacgcatttgtggggcttctccagcttaggggagcgcaacgagttgcggcgtgagcattatcaagccggcctttggccacccaggggtggtcctgaaaatatcagccgcgcaacttcgacaatcgccttagcggagcctgatttccccttacaatgaacccaaatctggtgcgcgagggtggccggccaatcatctgccgcaacatgcggtggccatggcttcggcataggccatccgggctcaccgaccgcccccctggcccagctggtacgccgactggctgcggaggcagggcgttcgcgccgtgacagacctataaggcgaccttcaaaacctctcgtgggtttgcaattcggctgctggctcatgcgttaacgggccagcaatgccacgcaccatgcgttcatggcattgctgactggctcggtggtgaccccaccagccagcgagcaacggtagtggatcacgccgcggtgatcactgaatagtccatcgcggcaagatcggtgaggagatcgggcccggtcggcacccacccgatccttgcgcgcgtccaggcattcgacgccgtcatgtcgaggctcacaaaggggctcatccaaccgaaataatgttcgacctcgtccgccgcgacggagcgcactggtagcccgctgcccttgccgatcgcctcggcaatggcgcgcgcggtgacgccctcctccgccgaggcatggtaacgtgcgcccggttcgcccttttcgagggctagcacgtagagcttcgccacgtcgctgacgtgcgcggcggaccagcgcgcttgcccctcgccgacataagccaccgcccccgcccgacgtgcttcggcggtcagcggcgtgatcagcccggccctggtagtgtcgtgcacttggggcaatcggatcgtacgcacatcaatgcgtcgcgccatgagtgccgcgcctgcgagttccgtcgcgatgcgcggattggcgtggtgcgggttcagcacgtcttctgtcgctggcccgccattcagcggggtgccgatgccgacccccgaagtgatcaggatcggctttctcgttccctccagcgcctctcccatggccgcgatgttgcgctcgtccttcttggtgttctcgacgaagttcgcgaaatcatggtcgaacgcgcagtggatcaccgcatcggcctccaagacggctcgtgcaagcgtctcgggcatttccagattaccgcgatggacatcgacaccggctgcttcaagctgacgtgcgcctgcgtcggatcgcgtgagaccgagcacctgatggccacggtcgagcagttcgggaatgatatgcgaaccgatgaagccggtcgcgccggtcaggaacacccgcatgagctatctccttgttgtctgagcggtgtatcgccgttcgctgaaccctgttaaagtagtgagcttatcgtggtataagctgcaacaggatcgatgatggccagcgaagcgcctaaccagctcggcatctatttgcgtgatcgccgcacccgcctcgatccggcggcattcgggtttggcggcggtcggcgacgcactcctgggttgcgtcgtgaggaagtggcgagccgggccaatatcagtccgacatggtatacctggctggagcaggggcgcggcggtgcgccatccgcagacgttctcaaccggatcgccaagggcctgatgttgaccgagccggaacgtgagcatctgtacatgctaggcctgggtcgccttcccgaggcgcgctatcagccggtcgatggcatcaccccccggctgcaacgcgtgcttgacgggatggtgctgagcccggcgatcatcaagacggcgatgtgggatgtggttggctggaaccacgcagcgacggtactcctgaccgactattccaagctgccgcgcgaagatcgtaacatccttcgcctgatgttcggcagcaagcatgtccgcagccggaacaaagattgggaaagcatcgcgcgcttcgtcgtcggcgcctttcgcgcggacgtagcgcgggtaaatgcaagcaccagcgccgaggtcacgaggctggtagcagacctcagcgcggtcagccccgagttcgttgcattgtggcaggacaacgacgtgatcgctcatggcgaaggggtgaagcgaatccgtcaccccaatgcaggactgctcgcgatggattactcgtcattcgctgtggaaggccggccggagctgggaatgatcatctacaatcccgccacgccgaaagatgctgaaaagctgcgcatgctactggacgcacatgacgattgatccggagagcacaacccggaggcggcaacgacccacaatgcgacgtttaaacgtccttgcacgctccccaacatcagacatccgttcatgtccggccgacctttcgacgagcaactggggaatgatggattctgggacaaacccgccgttccgcgctgggggagcgatacgtctggtttgatccaagtcggccattcagcatggccctggcacttttaaagaattaccagtcgctcatctcggcatgcggtttccccaccggaatcgggtcccggcaaagcggttgtgtcccacggggtggtgtagctttggcggcgtagccgcattgatctccggtcaggccggggtgttcaggctgccatgtcgggcagcgagacggtgggatcatcgctcaattgcgcgacgctttccagcgtcatgtagcgcccgcgctggactgcccattcgtcgttctgctcgagcagcagggcaccgacgagacgggtgatggcatcctcgttggggaagatgccgaccacgccggtgcgccgcttgatctcgccgttcaggcgttcgagcgggttcgtgctgtgcagcttggtgcgatgctgcggcgggaacgacatgtaggccagcacatcctcctcggcggtatccatcatccgggcgagcttggggacgctggggcgcaattggtcggcgaccttacgccactggttcctggcggcctccggtgtttcctgcgcatatgccgtggcgatgaaggcggagacgacacggcgcccgctcttgccggcgtgcgccatggcgttgcgggcgaagtggacccggcaacgctgccaggtcgcgctgaacacgcgcgagacggcggccttgatgccttcgtgcgcgtccgagatcacgagcttcacgccgcgcaggccccgccgggcaaggctgcgcaggaagtcggtccagaacgtctcagcctcggacgcgccgatcgccatacccagtacctcgcgccgcccgtcgccgttcacgccgaccgcgatggtcaccgcgaccgagacgatgcgcccggcctgccgcaccttcaggtacgtggcgtcgacccagacatacggccagtcgccctcgatgggccggtcgaggaacgccttcacgcgcacgtcgatctcctcgcacagccggctaacctggctcttggtaataccgctcatccccatcgccttgaccagatcatcgaccgagcgcgtcgagatgccctggatgtacgcctcctgcacgaccgcagtcagcgccttctcggcgaggcgccggggttcgaggaaggccgggaagtaactgccggtccgcaaacgggggatgcgcagctcgaccgtaccggcgcgggtttcccagtctcgttcgcgatagccattgcgctgggcaagccgatcgctgctcttctcgccatagcccgcgccggtcaggctgccgacctccaggtccattaaacgctgcgcggcaaagccgatcatctcgcgcaggaaatccgcatccgcgctctttcccaccagcgcctgcaggttcatcgtatcgtcggtcatcggggtctccgtcggttgagtgtcgcaacccaaacctatccgaagatcgccgatggccacccctcagctacaccaccccgtgggacacaaccggcaaagcgggtcaccgccaacgagcggcgacaaaccgcgacatttcaccggccaactcatggtcttccggtgtgcttccctgaaacccgccatgcggcatcgcctcgaagacatggagttcggcatccacacccgcccggcgcaacgcgcggtgcatgcggaccgtattggacaaaaagaggtcccgtgtacccgactgaaggaaggtcggcgggaagtcgctgagatcaccgaacaagggcgagagataggggtgcgacaggtcagcaccaccggcgtacagttggttgttttgtatcagcgagctgggcagcacgacatcgaccatctggttgatctggaaactgtcgccggactcggtcagatcgacctgcggcgataagagaaccaaccctgtgggtagggcaagcccttcatcctttgcgcgcaggagcatcgcaaccgccagattgccgcctgccgatcgtccgccgacgacgatgcgtgacggcgcatggtattcgagcacatggcgatacgccgccacggcatcgtctagcgctgcgggatagggatgttcgggcggcatcctgtaatcgacgccgtaacatagcgccccgtgccgatccgcctgcatccgcgcctgcgcgcggcaggcatcgccgcccccgaacaccagtgcgccgccatggaagtccagataggcgcagtccggcgcggtcacggtatcgggcgtcgcgacatgaatggtggcatcacaggttcggatcgtctccacgcccgcgcgcagcgtgccggccagttccttcatggcggccgcataatgtccgtccgcagcggccttgaccctcatccagccagcatgatcgtcgggcgagggcatggtgtagagcgcgttcaacggaacgccatccgcgttcaccagccgttccagactggcgcgcgcctctgcgctgatcgaggacggaaaggggatgatacggcgttgcaccatcacgccggtttcttgatcgctcatatccatgctccagtcgtgatgcccgcttcatcataatggctctcgaaaccgccgtatcggtgggatagcgagtgatggcagatgacgctgatgcgcgtcatcgcaatttggcggggagaacgccgtccagatagcgttcgagcccgttctggcgttcgtgggtgccaaacaccccggccaaatagccatccggccggatgagcgcccattcgtcggcgcgcaatccataggcgtcggcgatatgaccgccatcgtccaagaggtcgcctcgatcaccgatcagcaccatgcgaaggcccggacgagcgactggccgcgccccggcgtcaaagccgagcagcgtccattgcggcccctgaaacacggtgaatagccgtgtcggctggccagcgcggccgcggcacggtgcgtccggcgcacgatcgccgggttggagcctcgtgccggtctgtgatgccgcgacagacagcgacgagccacgatagccgagatcgagctgcctgacctcgcggttgcgacgcatcggcccctgctgtgcttcgccgagcaggcgggtcgacagcccgagcatgttcgccgcgatcgggcggcgttcctcctcgtagctgtcgagcaaagccaccggcgcgtgtgcaagaactgccgccagcttccagccgagattataggcgtcctgtacgctggtgttgagaccctggccgccggtggggggatggatgtgcgcagcgtcaccggcgaggaagacacgcccgttccgatattggtccgccaagcgcgcgttcatcgcatagatcgacgaccactggaccgaacggatgacaatccacggcatgccgctccgcgccgcgaccagtgcggtcaggccagcgggcgacaggtcgacctccccctccagaggcaccggcccctgaagctggaagaggtccgtcccggcgagcggacagatcatcacctgcgtcgcgccgttgccgtgctgaaaccgatgccatgcggtccgatcgagtccctccaattgcacatcggcgacgaatgcgcggatgccgagcgtctttccggaaaacccgatgccgagtgcatggcgcacgacactgcgaccgccgtccgtgccaaccagatagcgggcgcgaatgacatggtcgccagcggcatccgcgattcgcgcggtgacgccatcggcatcctggtcgaactctaaaagtttccggccgaatgcgggcctgtgtccgagttcggccagccgctcccgcatgacggcttcggttacgaactggggcaccatcaacggcgcggcgtagggttcggccggggtcggcatggcgtctccggtcagcgacgtgtcatgcgtgcttccgtctggacgatattcccgcatcgggggatagggcgcccccattgcagcaagccgatcaacaaagccgagatcctcgaacacctccagcgtcctgggctggatccccttgccccgggagccgccgaacggctgctcgttttgctcgacgagcatgaaggccacgccgcggcgcgcgagatcgatggccagggtgaggcctgcggcccctgcgccaatgatcaggacgtcggtgtcgtacgacattgccctctccacgaataaatgtgcaatatgcacatataattgccctctccacgaataaatgtgcaatatgcacatatatggacacaacccacgaagcaaccaaaagcgtgaataatacacacgacagcgaaattctgcgcgacctgcacagcgccgtcatcgatctggttgacgagatgaaccgcccccgccgcgatgaccggctgatcgaggaggcgggcatcgcgctcgaccgggcgctgttccccctgcttgggcggatctggcgatatggaccgattggggtcgtcgacctggcggatcgcaccggtcgggatcatacgacggtcagccgtcagatggcgaaactggaggatctgggccttgtcgaacgccgaccatcggcgacggacaagcgtgtgcgtgaggcgatagtcagcgccaaggggctcgacatgatcgttgcgctgaatgcggcgcgcgaacggctcgccaatcgcatcttggcgtcttggacggatgcggaattggacgaactgcgcaagctgctccgccgctttgccgacgatctcatgcgctaatggtcggctgaacctggatgtcgcatggcgaatggtgagttccggcgtaaggcggcgcttccgccgcacgtccagaagcgctgctcaggtaatccggttctttgttggcatagtgacggctgttgtccttcaatactcgctatcgatcggcgagtgacctagactaggacgtatcccagttcgcagggctggccgcagtgaatgacgggttctggattgagccgacgttcccaccacggcatacagacgacgtatgttggtcgggagctgccgctcttcccttccgtcctggcgaccaggatgcagacattggaagccccattttttgcaggcgtaatttctgccgttcgctcatctcgccttggcgcggctttctggtgtcagaaccgctcggttttgacccttcacgcgctcagatgtcagtctcttcgtcgatccggctgcgaagcgaggcgatgacgttgtcgaggcggcgcagaaggtcgtcataggacatgatgtccatcacgttcgcgtacttccgcctgaccacctcgagatccaccgcctgctcgccaccgaccccacccgtcggatcccgcccgaggatcacgatggccttcgggttcgtaacccgtatcgacatcccgggaggcagcttcgcggcgtaccgctccgtcagcacacgctcgccgtccagcccccacttagacaggtggaacaagtacttctccgcctgcatgatcgtcccggagagctcccggctcggaaagccgttctcgcggtagtcgccacccgccagcaggcccccacgaggccgcttgatctcgatgacgtctaggttcccggcggcgtccaccagcgcaatgtcgatgaagcgcctgcgcgctcgacccggtgtggagtacacgtcggcgatctgcacgttctcgagtatcgcgacgtacttcgggaagatcagcagcaggaacttcataaggagctgctgccagtcgcgttctaccctgacctcggcggccgcgagccagccacgaagcgtgtcacggatcaactgatacttcgcgagttccgcctccagcagctcctcggtgtcgagcgagccggtcgcgccaatcgccttgtgaggagcccctagatttctggacgccttggatcctaattttgaggacaggaggcgatgatggggaagccgaatttcagtgatgccttcaagcgtgacgcggtggcccagatcaccgagcgcgggtatcgggtagcggaggtctcgcagcggctcggggtcagtgcgcactcgctgtatgcgtggaagcggcagctggcgcaggtcgtatccggcgatgtcggcaaggatgccgagatccgccagctgaagcgcgagttggctcgggtaaccgaggagcgcgacatcctaaaaaaaagccaccgcgtatttcgctcgggatgcaaagtgagatacgcgttcattgccgagcatcgtgatcgcttcggcgtgcgggccatgtgccgctgcctcgccgtgcagcccagcggtttctatgcttggcccaagagcccgctgagccggcgggctcgggaagatgcccggcaaacggagctgcggcggcgggcctggagagacagtggcaaggtctatggctaccgcaagctgcacgacgacctgctggatcacggcgaaacctgctgcccgaaccgggttgccagattgaccagattggcgggcatcaaggcgcagatcggctataagcgccggccttggagccatggcggcaagccgtccctggcggtcgacaacacgctggaccgccagttcgacgtcgctgcgccagaccgggcctgcgtgatcgacctgtattcccgccgcgtggtgggctggtcgatgcagagccgacagaccaccgatgtggtgctgcaggcgctgcacatggcggtatggcggcgcaagccgaagcagcgggtgctgatccactccgaccaaggctcgcagttcaccagcatggagtgggcggccttcatccgggctcacgatcttgagcactcgatgagccgacgcggcaactgccatgacaatgccgtcgccgagagcttcttctcctcgctcaagcgcgagcgtatccggcgccgcacctataaaacccgtgaggaagcccggcaggacgtgttcgattacgtcgagatgttctacaaccctgtacgcaagcaggtcaggaacgggatgctgtcgcccgtcgcgttcgaacggcagcaggtttttaaagcggaaggcgtctagaaaactagaggctgttatggaccggtaatgtcgtgaatactggtacaacgtgtggggctgggcatcgaaatactacggttgagctatgtgctttataatgatgttgatcgaccggtcatcagagagccccggtcacaccgacaaggcaccctccgtcggcagcatcaaacaaaaaagcaatattcgtagtgtgataggttcataacagcctctaggggctcctcagcttcgccgagaacgaggctctctcgcacattctcgggcgtgatcagtcggatgctgccgtggagatggataacggcaccgtgcggcagcttgttgggaaccggttctgagagcccgaccgaaaattgagttgagcgatttcagtcagttgtgattcaccgggggttgcgaagaccacggggatcacatgggctggaccgaaaccgctcgccggagacatgacagaagagggctgcggtacgcaagcgactgcaccgatggggaataggcgctggttgctccgtttctggcccgaacgacgaaggtaggccgcccgcggctccaccgggcacgggatgtgtggaacgcgatccagtacctcgcagcgacggggtgccagtgggcgcagttgccccgggactttccgccgttcacgacggtgcagtatcatttctaccggatgcgcgacagcggcctgctcgatgcgatcaacgcggtgctggtgaccggggtgcgggtcgcggagggccgcgaggccgaaccgacggcaggcatcatcgacagccagtcggtcaagaccaccgaggccggtgggccgcgcggctatgacgccggcaaaaagataaaggggcgaaagcgtcacgtcgcgaccgatacggcaggcaatctgctcgacggactggtccgtcctgccgacatccaggatcgcgatggcgcgccggaactcatcgcacgctgccgggacgcctatccgtcgctgtcacgcctctttgccgatggcggctatgccggacagaagctggcgaccgccatcgagcatctcgaccgcctcgcaatcgagatcgtcaagcgctccgacgcccatcgcccttcgacttcgctcaggagagccttcgtcgtcctgccccgccgatgggtgatcgagcgcaccattgcatggctcaatcgatgccgccgcctcgccaaggactgggaggcaaccatcgcctcatccgaagcgtggctcctcatcgcttccatcaggcgaatgacccgacgcatcgcaaagatcgaattatgagtcgggctctgagggatcgaccaaggcaacacccttcccaattgggaacgggccgcgagacgaccgacgcattcccattgggatcgagtatcgagacacccgccattcgagcaatttgcttttcagacagtccgcgcttatctgttctgtgatactggagtgccctgacagtggtcctgtaacgaagtcatctcggtcgatcgcatcgcgcgatccctgttgagcctgcgcttaaacggcgcagacatgacttggttttatgtcattccctcacgttctgttccgcatcggcctcgcatgatcgactgcgtcagagtgagcgttttacaggcatcatcatgacattctcaaatagttcgccggataacattgtcgcgtataatcaagcagcttgggacaatctcgcagcgcaggattgcgaatggtcccgtccggcgtcgccgcagaccattgcggcagccctgcaaggcgattggtcggtacgattgatcccggccgatatgcccgaggattggctgggccaagtggcgggccgcaacatcctttgcctggcgtccgctggcggtcagcaagcccccatacttgctgcggcgggcgcgaatgttaccgtcctcgatgcttcggaagggcagttggaacaggaccgtagggtggcagcgagggatgggttggccttgtccacgatccagggagatatgcgcgacctgtcggcgttctcggacgagtccttcgacgttatcttccaccccatttcaaacctatatgtgcccgacgttcggcctgtctggaaggaatgttaccggacccttcgcaagggcggccggctgctggccagtttctataacccggtcgtcttcgtcggcgaccgcgatccccaatggcgggagcaagggctcattcgcccaatgcacatgataccctacgctgacacgcaggacatggaacccggccaactggatgcgaaagtcgagcgcggtgaaacgctggttttcggccacagcctgaccgatcagattggtggccagaccgaggcgggctttaggatcgcaggctttgcagaggcccgtgcgccagcgtcgcgcttcgtcatcgacgattatctgccgacgttcattgcgacattggcgttgaagccactttgatccgcccgttttcaatcaggacgcctgaggcagtccccattgggaacggcgaacgagactgccggcaccgtctcgtttgggatggtgaaacgggaatagggatcgtgttctcgaaactcaccgaatgatgtttcgagaacgcgatgacccagtttttattggaaaagctggcgtctctgccgcgcccaagccttaatgctggtcggggtgaagcccggcagccccttcgggtcctgcaccgtggcgagtatctggtcggcttcgtcgggatgttcgcggaagtagcggaacttggatgcgatgcgccggcccatgccaaggcccatcgccacgtctacgtcacgctcgaacacgtccagcggctcggcatgatagctgatcggcttgcccagcgcggccgagaggcgcgactccagctcgtcgcccgtgacgctctccggtccactcacgaggtgatcgccgccaaagcgatcctgctccagcagcacgatcgcagccagcgcgcagtcgtcggcgctggtccatgcaatccgctgctcgctcgcgatcggcggggagaagacgccgcgctccgctatatcggcgcgggcggacggcttcaggaggttgtcgaggtacatggtcgggcgcacgatggcgacggggatgccggcgctgcgaaccagtgcctcgatcgcggcgttggcgacaaagctcggttcgttgcagggagcggggcgactggcgctcgccagcttcaggacgatcgagcgaacgcgggcatggcgtagcgcatcgagcgcgttcccgacctggcgaatcatggtgggctgctcgccggtcggcacctgaagcacggcgtgggcgcacccttccgctgccgcggcaaggctgaccggatcgtccagatcgccgatcacggcgtggccggcactgtcgctggatcgcttgcgtatcagcccccgcgccagatgcccgcgctcgcgagcgacgcgcgcgacggcgctcccctgagtgccgttggcgaggaatacgaggatgggaccggatacaggcatggctcactcctttggcgatccgccaaggagcatcgtcacgatgacaacccggacagacccgatgatgcctttcggcaccgggactgtcgggggttcacggcgggggccggaacagagcctccgatcaggaggggcttgggcctacccagaccaagccagccattttcgacgccgcctcatagcaaaaggacgcggcgcgggaaagctaacggctttcccatcgggatcgcattttgggaaagcgtgctaagagcccgactcataattcgatctttgcgatgcgtcgggtcattcgcctgatggaagcgatgaggagccacgcttcggatgaggcgatggttgcctcccagtccttggcgaggcggcggcatcgattgagccatgcaatggtgcgctcgatcacccatcggcggggcaggacgacgaaggctctcctgagcgaagtcgaagggcgatgggcgtcggagcgcttgacgatctcgattgcgaggcggtcgagatgctcgatggcggtcgccagcttctgtccggcatagccgccatcggcaaagaggcgtgacagcgacggataggcgtcccggcagcgtgcgatgagttccggcgcgccatcgcgatcctggatgtcggcaggacggaccagtccgtcgagcagattgcctgccgtatcggtcgcgacgtgacgctttcgcccctttatctttttgccggcgtcatagccgcgcggcccaccggcctcggtggtcttgaccgactggctgtcgatgatgcctgccgtcggttcggcctcgcggccctccgcgacccgcaccccggtcaccagcaccgcgttgatcgcatcgagcaggccgctgtcgcgcatccggtagaaatgatactgcaccgtcgtgaacggcggaaagtcccggggcaactgcgcccactggcaccccgtcgctgcgaggtactggatcgcgttccacacatcccgtgcccggtggagccgcgggcggcctaccttcgtcgttcgggccagaaacggagcaaccagcgcctattccccatcggtgcagtcgcttgcgtaccgcagccctcttctgtcatgtctccggcgagcggtttcggtccagcccatgtgatccccgtggtcttcgcaacccccggtgaatcacaactgactgaaatcgctcaactcaattttcggtcgggctctaagaaggaggcttggggctatcccctgagcataggcttatgtccgtgtccgagatcatcaccgacggcggtcgtcgccgttactggagcacgcctgagaagctgaggatcgtcgaggagacgctcgacggtcgcgagagcatatcggtggtggcgcgccgcaacggcgtggcgcccaacctgctgtaccgctggcggcgactgatgctggaaggcgggagcgtggcggtcgccggcgacgatgacgtgaccagcaatcgccaggtccgcgagatggagacccgcatccgcgaactggagcgccagctcggccgcaagacgctggaggtcgagattctgaaggaagcgctggagcgctcgcgcccaaaaaaagcgagcttgctcatgcactcgccgctgccggagactatccggtgagcctggtcgccaagacgctcggggtcgggcgctcgacggtgtacgaccgcctgaccggccgcacccggactcgcgggccgtacgccaaggccgacgacgcggacctgctgccccgcatccgccagatcgccgcgcagcggcccacctacggctaccgccgcatcgcggcggtcctcaatcgacagcggcgcgccgatggactggcgctggtcaaccacaagcgcgtctaccgcatcatggcggcggaccgcctgctgctggcgcggcgctataccgagcgggccgactatggccatgacggcgtcgtggtggcgatccgctcgaacctgcgctggtgctcggacggcttcgagttcacctgctggaacggtgaggtcgtgcgcggcgccttcatcatcgacgcccatgaccgcgagatcatcgcctggcgcgcggtcgccaatgcgggcatcagcggctcggacgtgcgcgatatcatgctggaggccgtggaaacccgcttcggcggaatgcgcgcgcccgtgccggtcgagatgctgtccgataacggctcggcctataccgcccgcgaaacccgcacctttgcccggcagctgggcctcaaaccctgcttcacccccgtccgcagcccgcagtccaacggcatctccgaggccttcgtccataccctcaagcgcgattacgtccgcgtctcgccgctgcccgatgcatccaccgcgttgacatcgcttgccggatggatcgaagactacaacgacaaccacccccattcaggactcaaaatgcgttcaccgcgcgaacatcgcgcattggtttctgcaaccgcttgaacccgtccggtgaaacgggggccagatcatcgtggagggcccgtaatcggccggacagtcgcaccagcgacaaccgacctttagcacatgtacgatcccggagatcacccgccggtcgtccactcgccgcgcgccgggctggttcttcggcagatgcggctcgatcgccgcccacgcttcatccgacaaccagaacagcgccatgcctcaatcctcctgatccacccgacagtgaatcaggaaaaacagcatccctcaagatgctgattgggtttcgaccctagcattacagttgcgttcttgatcggacatgcgcgcgtcgagcggcggcttgatgggcgcgtcgccagcatgaccatgcgatgacgtggcgaggcgcgatgcgccgctgtgcgagcctgatgacgatacggcggatttcctggacggaccagcggatcatctccgtggtatcgtccagggtctttttgggggcgtggcattggcgcgggtgcggatggccgccagcatcgcgaaggccagcatgacgagcgagacgtgccggtgccagccatgccaggagcgggtttcgttgtggtcgaggccgagttcgttcttcgccgtctcgaagctgtcttcgatgccccagcgatgcccttcgaccccgaccagggtttcgatggtcgtaccggccgggcaccaggtggtgaagaaggcgaggtcgtcaccggcgacgtggcggcggatcaacaggcctctggtccatgtcccgattgcgccattgacgtactcgtcggcgtccaggtcggcgagctcgaaataggcccagtcgtgaaagcgctcgcccttggtgccctgacctgcggacagacgctgccatgcagcaggatcgagttcgcccgcgatctgcgcggcggtgcccgcgacgaccggcttgtcgccccatgagccgaagcgatggtcgcccttcacgcccagcacatagcccttgccggcacggcgcaagctctgctcgatgtcgccgacgccgtagaccgcatccgccgagacccaggcaaacggcatgtcggccgcgatcgcgcgctcgatcatttgcactgccagcgccggcttggtggcgaatgccgtgccctccggcacatgcgcggccgccaggcgggccgggtcggccgtccagctcttgggcaggtaaagtgcccggtcgacgaaagcatggcccctgggcgagacataagcggcgaatacgccgatctggcagttggtcaccttgccggccgacccggtgtactggcgccccacgccgcatgacgccttgccctgtttcaggaacccggtctcgtcgatgaccagcaccgcatcatcggtgccaagatgttcgacggcatagtcgcgcacgatgtcgcgcagcgcatccgcatcccaccgcccgcgccccaggatcgcctgctgccgccacggtcctgcatcgcccgccgcctcggcgcgcatccacccggtcttgcggcgctcgtcgcccagcaagccatccagaaaactgttcgccgatgccgccacacgcgcctggctgaacaagggccgcatccgcgccttcacctcgcgcagcgatgatgcccaaagctccagcgtcgcctcgatcgatgcccccgtcaccacgacctccctcgtcatggtcacccattgattcagatcatgatcaagaacgcaactgtaatgctagggtcgaaacccaatcagcatcttgagggatgctgtttttcctgattcactgtcgggtggatcaggaggattgaggcatggcgctgttctggttgtcggatgaagcgtgggcggcgatcgagccgcatctgccgaagaaccagcccggcgcgcggcgagtggacgaccggcgggtgatctccgggatcgtacatgtgctaaaggtcggttgtcgctggtgcgactgtccggccgattacgggccctccacgacgatctacaaccggttcaaccgctggtcgcgccgtggcttctggctcaagctgctcgacgcgctggtgaatgctggcgtggtgacgaaaagcaccgcgatcgacagcacctacatcaaggcgcagcgcgcggccttcggtggaaaagggggcgccagatccaggcgatcggtcgctcacgcggcggatggacgaccaaggtccacgcgctcaccgatgtcatcggccgcccctatgccctgatgctgacagccggcaatgtcagcgacgtgaaggcagcccccgcgcttctcgaacgggcgggccggatgcgttatctccttgctgacaaaggctatgatgccgaccggctgcgccgttcgctccgtgacgtcggagccattcccgtcattcccggacggcgaaaccgcaaacgtaccatccgttacgacaagtgagcagcccccatcgggtggtccgggttattagttagtgcattgtcgtctccgccgccattgccggtcgtaggtggagcgaagcggaaccggaggccggcaatggcggtgtcgccgcttgtggtgcgggcggccggtagcccaggctgctgtgcggccggacggtgttgtagtgacggcgccacgcctcgatcagtactcttgcttcagcgaggctgtagaaaatctcgccgttgagcagctcatcgcgcagcgagccgttgaagctctcgttgtagccattctcccacggcgaacccggcgcgatgtacagcgtcttcacgccaacctgcccaagccatttctgaaccgcggtagcgatgaactcgctgccgttatccgatctgatatgcgcgggcggacccctcgcgatgaacaggtcggcaagcgctgccagcacgtcttcgtgtcgaagctggcgcgcgacgaccagtgccaggcattccctgctggcctcatcgatgatggtcagtatccggaacttgcgcccgtcatgcgtccgcgcttcgacgaagtcgtacgcccacacatgccccggatactccggtcgcagccggatgcatgagccgtcgttcaaccatagccggccacgtttaggttgcttctgcggcaccttgaggccttcacgccgccagatccgctccacccgtttatggttcaccgaccagcccgccgcatgcagcagtgcggtgacccggcggtagccgtagcgcccgtactgcttggccagcgcgacgatgtcgtcggtcagcacctcttcgtcatctgccccgcacggcaccttgcgctgtgtcgaccggtgctgccccagcacgcggcacacccgccgctcggatatgtccagcacctctcgcacctggtcgatgcagcgtcggcgtcgcgcggggctcagaagtttccccgcgccgcctcctgtaaaatcaacttgtccagtgtcaggtcggagatcgcacgccgcagccgcaggttctccttctccagatctttcatccgacgcgcctgatccgtcttcaagccgccgtactccttgcgccagcggtagtaggtctgctcgctgaccgcgatccgccggcatgcctcagcggtcgtcccgccctggcccagcatgatctcgacctcacgcagcttcccgatgatctcctcaggcttgtgcttcttggcaggcatgcatcgtcccttccttgatccagactgtcatagtcgatggaccactcagaagggggcagctcacgcgcagcgtttcaactctcctgccactcccatctggatagaccatggctgacgaaaccatcaccgatgccgcacatgcggtcgaactcgccaccgaactgaccattgcctggctgggcaatcccaatacccgcatcgacgccgagcaggtcccggcgtttctcggcagcatgcacagcgccatcctgaagctggccggcggcagcgagacggcggcagcagacgccgtcgacaccaccgaatacacgcctgcggtgtcggtgcggaagtcgctggcctcgaaggaccacatcatctcgatgatcgacggcaagccctacaagacgctgcgccgccacctcgccaccaacggcctgacgcccgagcagtatcgcgagcgctataacctcaaggccgactatccgatggtgtccgaaacctattcggaaagccgccgggtgatggccaagaagatcggcctcggccgcaagccgggcaccaaggtcgcaagcgcagccaagccgaagggcgtgaaggccgccaagagcgccgcggctgcgcatctgtcaggcgaataatcggtcaggcagggctggcttcgagcagccgaccctgcccgctacttttggccacggccaaggcctcatcggccacgggcgccgcgctcagatggctttggatgaaaccggcccagtcctcgagcatgcgccggcgcggggaaagatagagcgcggcgttatacgcccccctcacctcatcgcgctcgacatgagcgagcgccatctcgatccagtcgggctggtagcattcggcctcattggcccaggtcgaggccagcccacgaaaaccatgcacggtctggcgaccacgatagcccatccggtagcaggcatagatcatcgtgttctgcgagatcggctggtcgggcttctcaccgacaaagacatagtccgccaaactatagacccgcacctcctgaaggagcgcgacaaccgcgggtgccagcggcacgacatgctcacgcaccatcttcatgcgctcggccggcactcgccagaccggggacgccccgtcgagatcctcgaactcctcccagcgggcatgacgcgtctcgttggtccgcacccaggtcagcagcgtgaacaacagcgccgcccgggtcactgcgcgacgccgcggcgtctcctcgccgtcatagccgtcaatcgcccggatcagcgcaggcagctcgctgcggccaatccgcggcatatgccgggtacgcggtttgggcttgagcagttggccgagatgctcggccgggtcccgctcggcccagccatgggcgatggcaaaacgatagatctggctgacatgctgcttcaaacgccggctgacgtcgagcgcgccgcgcgcctcgacccgccgtaccatcgccagcacatcggtcggcgtgatgacagacaagccaagcttgccaagcaccggaaaggcatcgcgctcgagccgggtcagcagccttgtggcatgcccggcatcgagcgcgtcgaggcggtggccatgccatttgcgtgccgcttcctcgaaggtcatctgcgtcctaggcttgttgcccgcgccaggatcgcccccctcgcccagcaccactttggccttggcgcggcgcagccgcgcctccgccaacgacacgccgggataggcgccaaagctcaagagcttttccttgccgccatagcggtacttcatccgccacagcttggagccgttggggcggacgagaaggtagaggccttcgccgtcggtgagtttatagtcttttgcccgcttggtggcttagcggacttcgagctccttgagggccatgggggtatctcctgccgaggccgggatgatacccacgaaaatacccccaaaggcaaatcgacgtcgtggcacccagaggcctcgaccgggacgcgatgagagccgctgagcgagggctaactcacggaaaaatgacacaaaaaatccgcctcgggatgatccgggcggttatgacattggaaagtatggttgcgggggcaggatttgaacctgcggccttcaggttatgagcctgacgagctaccgggctgctccaccccgcgtttgtggtggtaggtagcgtgaggggtgggttggaagacctggcggcgacctactctcccgcatcttgagatgcagtaccatgggcgctggggcatttcacgtccgagttcgggatgggatcgggtgtagtttccccgccatagccaccaggtcgtccaacccacctttttgggtggtgttgtgatgggatgttctggtgttttttaggatgtgctgtttgtcatgtgtggatgacttctgtgcatgatggaagttcttgagcctatcgggctattaggaccagttagctgagtgcgttaccgcacgtatacacctggcctatcgacgtgatggtctttcacggccctcagggagacctggttttgaggtgggtttcccgcttagatgctttcagcggttatcccgtccgcacatagctacccggctgtgccgctggcgcgacaaccggtgcaccagaggtgcgtccatcccggtcctctcgtactagggacagatcctctcaagtctccaacacccacggcagatagggaccgaactgtctcacgacgttctaaacccagctcacgtaccactttaatcggcgaacagccgaacccttgggacctgctccagccccaggatgtgatgagccgacatcgaggtgccaaacctccccgtcgatgtggactcttgggggagatcagcctgttatccctagagtaccttttatccgttgagcgatggcccttccacgcgggaccaccggatcactatggccgactttcgtctctgctcgaactgtcgctctcgcagtcaggcgggcttatgccattgcactcaacagccgatgtccgaccggcttgagcccaccatcgcgcgcctccgttaccatttgggaggcgaccgccccagtcaaactgcccgccatgcagggtcccggaccgggcttaccggtctcggttagacaccagaaaaacgcagggtggtatttcaaggttggctccacacaagctagcgcccatgcttcaaagcctcccacctatcctacacagcattttcctggtgccactgcaaagctgcagtaaaggttcatagggtctttccgtctgaccgcgggtaccccgcatcttcacggggaattcaatttcgctgagccgatgccggagacagtggggaagtcgttacgccattcgtgcaggtcggaacttacccgacaaggaatttcgctaccttaggaccgttatagttacggccgccgtttaccggggcttcaattcagtgcttgcacacctcctcttaaccttccggcaccgggcaggcgtcagaccctatacgtcgtctctcgacttcgcagagccctgtgtttttactaaacagtcgctaccccctggtctgtgccacccacacccggttgcccggacatgggtcttgcttatcccgaagttacgcaagcaatttgcctagttccttcgacatcgttctctcaagcgccttggtatgctctaccagtccacctgtgtcggtttcgggtacggtctattcgctggagctatttcctggaacgatccggctgcaggggcaatccagtaagtccccacaacgcttcacattcgtcacttccagcaggctcaggaatattcacctgattcccatcgactacggctttcgccctcgccttaggggccggctcaccctgcgtggattaaccttgcgcaggaacccttggactttcggcgacagtgtttctcgcactgtttgtcgctactcatgtcagcattcgcacttccgatacctccaggaggggtcaccccatctcccttcacaggcctacggaacgctccgctaccgcgtagatcactctacacccgcagcttcggtgtgtggcttgagccccgttacattttcggcgcaggatttctattagaccagtgagctattacgctttctttaaaggatggctgcttctaagccaacctcctggttgttttggaattcccacatcctttcccacttagccacaacttggggaccttagctggcggtctgggctgtttccctctcgtccacggaccttagcacccatggactgtctgccgcgctatacttcccggtattcggagtttggttaggtttggtaagcctttggagccccctagcccatccagtgctctacccccgggggtaaacacgcgacgatctacctcaatagatttcgcggagaaccagctatctccgagtttgattggcctttcacccctagccacagctcatccccgactttttcaacaggcgtgggttcggccctccagtgcgtgttaccgcaccttcagcctggccatggctagatcactcggtttcgggtcttctacctgcaacttgacgccctattcagactcgctttcgctgcgcctacacctatcggcttaagcttgctgcaaacagaaactcgctgacccattatacaaaaggtacgccgtcaccgcagatgcggctccgactgcttgtaggcattcggtttcaggtctatttcactcccctcgtcggggtgcttttcacctttccctcacggtacttgttcactatcggtcactagggagtatttaggcttggagggtggtccccccatgttcagacaggatttcacgtgtcccgccttactcatgtccttaatatcgctatcgcatacggggctatcaccctttgtcgccggactttccagaccgttccgctacacaatatcaaggcactggcctgttccgctttcgctcgccactactgacggaatctctgttgatgtcttttcctccaggtactgagatgtttcagttccccgggttcgcctcacgaccctatgtattcagatcgtgatctccttgcggaggggttgccccattcggatatccacggatcaatgcctgctcgcggctccccatggcttttcgcagcgtgccacgtccttcatcgcctcctagtgccaaggcatccaccgaatgcccttatcgcgctcaagagctaacacagatcggtcaaccaatccgtgctcatcatgcacagaagacatccacacctttcagtgcaacgcttctgcgtgattttactcagcacaccttaaacgcctctgatcatgatacccttcaccgtggacgacaggtctccccgtcaatccggtcagacaaccggtcaaggcatgcgcagaggcgcaccagaacatattcaccataacaaagaacaaatagcagagccttcaacaagaaggcccatcccgcatgatatcagaacccgaccggggccagactatcaccggaaatttttaacccatgcgacgataagggaaccggtcggcaaaccgccagtcaccacacgcaatggtggaggtgatcgggttcgaaccgacgaccccctgcttgcaaagcaggtgctctcccagctgagctacacccccatcacatcaaaccagccgcttcctcaaaaagcggccgatcatcatggtgggccagggaggatttgaacctccgaccccacgcttatcaagcgtgtgctctaaccagctgagctactagccccaagcagatatcgtcgcagcaaaaaataaaccagaccatcatctttcaatgacaatccagtccacctttcgcagaagggatacgtggacggcgcttcctgcctgaacaggtgcaccaggttgacagtgccttcgacgatcccatcgaaggacttcttataaaaccatcccaattcatccatccgcatggataaaactcaggacagttccttgaaaggaggtgatccagccgcaggttcccctacggctaccttgttacgacttcaccccagtcgctgacccgaccgtggtcggctgcgtcccttgcgggttcgcgcaccggcttaaggtcaaaccaactcccatggtgtgacgggcggtgtgtacaaggcccgggaacgtattcaccgcggcatgctgatccgcgattactagcgattccaccttcatgcactcgagttgcagagtgcaatccgaactgagacggctttttgagatcagcatggcatcactgcctagcttcccactgtcaccgccattgtagcacgtgtgtagcccaggacataagggccatgaggacttgacgtcatccccaccttcctccggcttgtcaccggcagttcctttagagtgcccacccgaacatgctggcaactaaaggcgagggttgcgctcgttgcgggacttaacccaacatctcacgacacgagctgacgacagccatgcagcacctgtgcagagggtccttgcggaaatgtccatctctggacacagccctcccatgtcaagtcctggtaaggttctgcgcgttgcttcgaattaaaccacatgctccaccgcttgtgcgggcccccgtcaattcctttgagtttcaaccttgcggccgtactccccaggcggtgtgcttaccgcgttagctacgacactgagttactaggtaacccaacatccagcacacatcgtttacagcgtggactaccagggtatctaatcctgtttgctccccacgctttcgcgcctcagcgtcagtcatgagccaggttgccgccttcgccaccggtgttcttcccaatatctacgaatttcacctctacactgggaattccacaaccctctctcacactccagcccgcacgtatcaaatgcagcccccaggttgagcccgggaatttcacatctgactgtacgaaccgcctacgcgccctttacgcccagtcattccgagcaacgctagcccccttcgtattaccgcggctgctggcacgaagttagccggggcttcttctgcgggtaccgtcatcatcgtccccgccgaaagtgctttacaatccgaagaccttcttcacacacgcggcattgctggatcaggcttgcgcccattgtccaatattccccactgctgcctcccgtaggagtctgggccgtgtctcagtcccagtgtggctgatcatcctctcagaccagctatcgatcgtaggcttggtaggcctttaccccaccaactacctaatcgaacgcaggctcctcccaaggcgacttgcgcctttgaccctcaggtgtcatgcggtattagctgtagtttcccacagttatcccccaccccaggacagatacctacgcgttactcacccgtccgccactgtccggccgaaaccaaaccgtgcgacttgcatgtgttaagcatgccgccagcgttcgctctgagccaggatcaaactctcaggttcatcaagccaggcacccaaaagcacccaacataacgaacgacccttggtctctccgacagtcctaaaaccgtcagtctcgaaacatactgtcaacgcatccaagatacatcaaaagcaagcgtcaataccaaagaaagaccaaaagtaaatcagtccaccagatacatacttaaccataaaagctaagcaaaacgccgcccgcgtatcccttcatatcttcattcaaatttcaaggaacaaatccgcaacttcaaaaaccagccaaccagccagtccatcgctgcggtggcggctatctacgccccacagacacctgtgtcaactcaatgacaaaaaataccccaaaccaatcctaacactctgataaacaataagtcctcacccacaaaacaacataaaaaaccctcaccaaccaactaaaataccaaaacaatatatatctcagtcgatatgcaaaaaacgcatgggttggagatcaggcaggaacggtctccggacggatatcaagcccatccgctccggcactgacctgcacggtctggccgtcctggatttcaccctccagaatcaggcccgccagcgggttttgcaggctacgctggatcacgcgcttgagcggccgggcaccgtaaacagggtcgtagccctcattcgccagccagtcctgcgccagactatccagtttcagggtgatcttgcgatcggccagcaggctccgcaaacgtcccagctggatatccacgatcgaggccatatcctgccgctggagacggcggaacagcacgatttcatccagccggttcaagaattcaggccggaatcgggcacgaaccacctgcatcacctgcccatagaccaggctggtatcctcaccatcggcctgagcagccagaatctcgctgcccatattgctggtcagaacaatgatcgtattacggaaatcgaccgtacggccttgaccatcggtgaggcggccatcatccagcacctgaagcaggatgttgaagacatcctcatgcgccttctccacctcatcgaacaggatcacctgataaggccggcgacggaccgcttccgtcagaacaccgccctcatcatagccgacatagcccggcggtgcaccgatcagacggctgaccgcatgcttctccatgaattcgctcatgtcgatgcggaccatggcgcggtcatcatcgaacaggaactcggccagagccttggttaactccgttttgccgacgccagtcgggccgaggaacaggaaactgccgatcggacgattgggatcctgcaatccggcccgcgcacggcgcaccgcattggcaacggcccgcagcgcatcctcctgtcccaccacacgctgacggagttcatcttccatgcgcatcagcttggcacgttcgccttccagcatccgatccaccggcacgccggtccagcgggacacaaccgcagcaatctgctcatctgtcaccgcctgactgaccagcctgctgccagcgttaccgtgcgcggcattttcggcctccgacagctttgcctgaaggtccgggatcgtgccgtagagaagctcgctcgcccgttgaagatcgccgcgacgctgagcaacctcgacttcgttgcgcgcctgatcaagttgttctttcagcttctggctttcggaaacgcggtctttctcggcccgccattcggtggtcagggcaaaggatttctcctccagctcggccagttccttttgcaggcgctcaagacgttccttcgcgccctgatcatcctcccgctttaacgcctcgcgctcgatcttgagctgaaggatgcgacgatcgagttcgtccagcgcctccggcttgctgtccacctgcatgcgcaggcggcttgcggcctcatccaccagatcaatcgccttatccggcaggaaacgatccgtaatatagcggttggacaaagttgccgccgcgatcagggcagagtccgtgatccgcacaccgtggtgaagttcgtacttctccttgatgccacgcaggatcgagatcgtatcctcgacgctcggctcctctacatagacaggctgaaagcggcgagcgagagccgcatccttttccacatgctttcgatattcatcaagcgtggtcgcgccgatgcagtgcagtgcgccacgggccagttccggtttcagcagattggatgcatccattgccccatccgccttgccggctccaaccagtgtgtgcatctcatcgatgaacagaatgacttcgccgttcgcagactcaatttccttcaggaccgccttcaggcgttcctcgaactccccacggaacttggcacccgccaccatcgcaccaagatcgagcgccagcagctttttattgcgcaaagcctccggcacgtcgccattgacgatacgcagagccagcccttctacaatcgcagtcttgccgacacccggttcgccaatcagaacagggttgtttttggtgcgccgggccagaacctgcaccgtacgacgaatttcctcgtcacgaccgatgaccggatcaagctttccatcgcgcgccagttgagtcacgtcacgcgcatacttcttgagcgcatcaaacgtggcctccgcgttctggctggagacggtacggcccttacggagttcaccaatggcgcgttcaagcgcctgaggagtgactttggcctccttcagaatacgcgaggctggaccatccgccagagcaagcccctgcagcaggcggtcctgagccacgtattcgtcaccggccttcttcgcggcctgttccgctgcgtccagcgcacggatcaagtccggcgtcgcctggggctgtccggcccctgcaccctgcactttcggcacccgggcgatttcagcctccacggcacgacgggcctcgtcagggtcgccaccggcagtcctcacaagacctgccgccgccccttcctcatcatccagtaatgctttcagcagatgctcagtaccgaggcgctgatgaaactcccgcgccgcaatagtctgggcagcctgaagaaagccacgcgaccgctcggtaaacttctcgatatccatacttccatgtccctatatacccaggcgaccagaagacgccgacccctcaaaaggcagtcaggcgtcccttttcctacagctgatatggcaaaaaaaatcgtcatctcaagagggaccccctctatggaaacataacagacgtgaaattttcatcctgccccaaagggtaaaattttttgtgcgattttttaggaaaggagtttcatttaagatttttgtctcaaaatttaaaccaaataatacaaattaccgtctataaaatagataatttgttttaaagtagaggtattagcctccttactctggttcaaaataaatccaatgaaacaatgtgtttgcccttgcatttccacaacaccaaccatcatattcacacgattatgatgttgcacatggcaagaagtttataagagccatctatgacccccacgaattcttccagtcagttccagaattacgtaaacgatcttgaccagattgttgccaaggctcacgaggatggcaaccccgacatagcctgcatggtttcttcaatggccgacgcaatcagggcgatgcaggctacacaggataatgcgccggaatggggttatcatgacatggatatgacgcatgtcgttccctttcccctgatcaggtccgcaccgaaacatcaggctaacgggcggtaatccacatcgagaatatctagaatttccgtcttgaccggggtgataaccgttacctcgtcacctttactggctcccagcagcgcttttgcgaccggtgaaagcaggctgatgcgccccaaggccatatcggcctcatctgcgcctacgattgttacctgcaccgtttcatccgctgcattaatataagtgactgtggcgccaaaatagatgcggtccttatgcggttgcgttgcaggatcgatcaccaccgcattttccagacgtttggtcagaaatctgaccctccggtcgatctcgcgcagacgtttttttccatacaggtaatcaccgttttccgaacgatccccattccctgcagcccaggagacgatctcgactattttcggtcgctcctctcgcatcagttgcttcaattcagcaaccatctgcgcatgccccaccggagtcatgtagaaagaaccgccggatgagggctttggtgatgtggccaaaggatattactttccggctttattgatgagaaagcgagaggaacggcttccactcacgaaaaccgactccgcctgataaaaccgccatggcgtttcgatggcccgtgtgatgccaatacgcggacctgccgcaatcaggtctgatgcttcaccggtcttatgacagggctgaaggtcgaaggggggcctgcacagggacaggccatccattccgtcagtgatcccgagtgcctgacacaaccgtcccggcccacggcacagatcacgtaaccggatagcaccgcggcggagctgcatggcctccagaccaaacatcggatgcaacgcccggattaggactgctccaccgggaacagggccgcacacgatgttgaagcaccagtgaatgccgtaggaacgatatacataagcgtgtccaggaagcccgaacatggacgcattgcgacgggtgaggccggagaaactgtgagaggccggatcatcccgatcatacgcctccgtttcaacgatgacgccgccgcacccatcaaccagcaaggtcattcccaccagatcccgggcaatttccgtcaccggacgagtccagaacccgtccggcacaccggtggaggtcacgggcaatgaatcaggacaatccttcaaagaaatcgttgcccttgtcgtcgatcacgatgaaagccgggaaatcctcgacctcgatcttccagaccgcctccataccgagttcaggatattccagcacttcgaccttgcggatacagtcctgcgccagacgggcggccgggccaccaacactgccgagataaaaaccaccataggttttgcaggcatcccgcactgctttcgagcgattgcctttcgccagcatgacgaaactgccgcccgctttctggaatgcgtcgacatagctgtccatgcgtccggctgtggtcgggccgaagctgccggtcggcataccatccggggttttggccgggcctgcataatagacggggtggtttttgatgtaatccggcagtccttcaccagcctccaaccgttcagccagcttggcatgggcaatgtcgcgggccacgaccaccgttccggtcagggacaaacgggtcttcaccggatgcttcgacagtgcggcccgaatttcatccatcgggcggttcagatcgatgcgcaccacctcgccacccagaatgtcatcggttgcttccggcaggaagcgggccggatcggtttccagctgttcgagaaacacaccctccggcgtgatcttcgcccgcacctgacgatcggccgagcaggacacaccgattgcgatcggcaggctggcgccatgacgcggcagcctgaccacccgcacatcatgacagaaatacttaccgccgaactgcgctccgattccgatggaacgggtcagttccagcacctgctgctccaactccagatcacggaaggcatggccggtcatatccccctgcgtcggcagagtgtcgagccatttggtggaagccagcttcaccgttttcagtgtggtctccgcactggtgccaccaatgacgatcgccagatgatagggcgggcaggcggaggtgccgagcgtcctgatcttcgtttccagaaacggcagcagcttttcagggctgagcaccgcgcgcgtctcctgaaacagaaaggttttgttcgcggacccaccacctttggcgacaaacatcagctggaactcatccgcatgatggccacccggcacggcaagaatatcgaactgaaccggcaggttgttgccggtattcttttcctcatacatcgtcagcggcgccatctgggaatagcgcaggttggtctcggtataggtacgatgcacaccgagagagagagcctcctcctcatcgccctcgacccagacatgctggcctttcttgccgaacacgatggcggtgccggtatcctgacacatcgggagaacgccaccagcggcaatattcgcgttcttcagcagatcaagcgctacgaaccggtcattggcgctggcctcgggatcgtcgagaatgcggcgcaactgggccagatgggcagggcgcagcaaatgcgcaacatcgtgaaatgccgtgcgggccaactcagtcagggcttcaggcgcaatatgcaggatacgccgcccctcatgctccgatacacggaggcccccaatatccagtttacgccatacggtctcgtcatgcgtcagcggaaacatcgggctgtaggcaaagccggggaaagcagcgttcggggtatgggcatccatgatcgggggaagtcctgaagctcaagggagggggaggagaaagaaataccgcttcagtccttacggcggcggaaagcatccaggctcacgacctgcggcgcgctctgggccgatgcgctgtcttcattttcctgctctccttcggcagtggcaggggaagctgttgaagacgcggcagcagagccggggaaggttgcaagcttaccgctttcggatccgtcttccgcctcatcgtcacgttcatcctcactggcgttttcatcacctggctcatcggcctggaaacgaaggcccaccccgacatgcggatccgcaaagcccagcaatgcggcaaaggggatacgcagcgtgctggccacaccgccaaaggacaggccgacgctgaaactgtccgggccgaccgccagatcccagaactgatgctgaagcacgatggtcatttcgtgcggatactgcgccttcagacgggaggggatggagacgccgaaataatccgtgcgaaaagtaatatagaaatgatggccctccggcatgccatcattggcgacatgctccagcgcgcgggcaacgacttgcctcagcgcctgttcggtccattcatcataggggagcaggctctccggccgctgttccgtggtatcggtcatgtcaaaggtcacctcaacgcgttgccttgcaatagcgtgactcgccacgcgatggaagcaagggaacggtggaagaatgccacagccatcccggcagatcactgaagctggaagtggggcaagatggaagtggggggcttctgttgcccggtgccccccgaaccgcgcttatcgcttatgcagcgacagcgagcgcctcatgattatcattggcacctgtaatatggcccgataacggcggaaccatgccgggcaaaaaacgagtctttaccgcgcgcgtcgagcctgtttcgcccccatgaaccccgcagaacggagttatatggtggaggcgccgggtaccgcccccgggtccactacgcttattccactcgccgtttatcaccatagtcagcgaactgacgacttctatataaggtataactgcctgctttggtagagggatgcatcaaattggcatcatcccctcccctgacggttgggggcatgttagtggaaagccatgacactcagcatagaacagcaagcggatattgaagccgcccgtgcccagtcaaccgccacgcggcgtgcgaccgtccccgcgctggaaaatatgctgtatgaagccgtaccggtgctggatcacggctttgtccgtgtgattgactatatgggggatgatgccgccatcgtgcaggcggcccgcgtttcctacggcaagggcacccgccatgtcaccgaggatgccgggctgatccgctatctgatgcgccaccggcattccaccccgttcgagatgtgcgagatcaaatatcacatcaaattgccgattttcgtggcacggcagtggattcgccatcgtactgccaatgtgaacgaatattcggcccgctactcggtgatggatcgggaattctatatcccagcgcccgagcatctggcggcacaatccgtcagcaaccggcagggacgtggcgatgtgcttcagggggaggaagccgcgacggtactgcgtctgctgcgcgaggatgcggagacctgccacacccattacctcgccatgctgaatgaaaacggaaccgatccagagcggcagggactggcccgcgagctggcgcgcatgaatctgaccctgaacacctacacccagtggtactggaaaaccgacctgcacaacctgctgcatttcctgtccctgcgtgccgatccgcatgcgcagtacgagatccgcgtttatgcagacgccatgatacgcagcgtagaagcatgggtaccgctggccatggccgcattccgcgaataccgtctgggtgcattcaccttctctgccgccatgctcgccgtcctgcgcagacggttgaacggtgaagccgtccgtcaggaaaacagcggactgagccgacgggaatggctggatatggaagccgctctgtctgctcaggaaggcgcgtaacacttccggaatcggaaagggcggcagacatgatcgtctttggctcgatcaatctcgatctgctgttgtctgttccttccctgccggagccggggcagaccctgcttgccctcgacagccagaccgcaccgggtggcaagggggccaatcaggccgtggccgcggcgcaggatggtgccagcgtgcgaatgatcggggccgttggtcaggatggttttgccgacgctgccctatacggactgaaacaggccggggttgatctcagcgcggtgcgccaggtgcaggacagaaccggtctggcctccatctgcattgaccatgaaggacgcaatcacatcgtcgtcgcacccggcgccaatcgcgccgtgcgggcagcgtggatcgaggacaaccggctgctccccggcaccgtgctggtcacgcagatggaggttccaccggacgaaacagcggccgccctgcatcgtgcgaagcaggccggtatgcggactgtgctgaaccttgcccccgctgtttccttgcctctggaaacaatgcgatccgtggatattctggtggtcaatgaagatgaggccgcatggctggcccgtcatctccagaccgatgacagcgccgcagcccttcatgccttgctcggcagcaccgtgatcaagacactgggcgcggacggcgtccatatcgccaatgcggaagcaacaacatccctgcccgctttcccggtctccgccatcgacacgaccggtgctggagactgcttcgtcggggtgcttgccgcggcactggaaaggggcgcatccaccatagaggctgcccgacgcgctctcgtcgccagcgcgctctgctgtacccagcccggcgcacagacagcgtcaccggcgcagcatgaaattgaagcggcactgcggtaaataacaggagcaagctacccgatcaggcggctgatcccgatgcgcagcagacgcgccatacgcgcggcccattccgcctgacctgccgcatcggcaatcagatcctgacggatttccatctccagataggggaggccacgccgctcggcatggaagggcaccgtatagtccgtctcgtcactcacgctgtagggggcgttatctcctaccaccagccccttttccgctcgcagcaggtccagcatgatatgcggcagcgccgtgtggcgattatacagaacgcctgcctgcattcccctcacctcgcctttataaaccggtgtaaagctgtgcatggccaccagaaccgtgttgcgttcggcccggcgatccagctcggcggcgatgcgggcgtgatacggggcataaatttccccccgccgcgcttcacgctctgcctcatcgagccctgcgttaccaggaatcaaggtgtcttcgctgatctcgggaatggcgctcggcacatgcagcgggcggttgcagtcgatgaccagccgggaataacgctgcatgatgcaggttgcatccagatgctgcgacaaagcctcactcacgcctgcaatgccgatatcccatgcgatatgccggtccagctccgccggagccaatcccagcaaacccagctggcggggaatggcgcggccggcatgatccaccaccagcagaatatccgtttcggcctccggtcgcagcaccataaccggtgcctcatcctcgggggcctgcaacaggctgttatgcgccatccgccctgttccttctgtcaccatgccctgcggagggtcttatttcatcaactggttgaggcgctcattcagcatcgcaccatttttagcccagaatgcggcatcgattttcagccccttctgccaatgattgtccgccgtgggcatccagcggatgatctgcggtgataaccctgccagtgcctcaggggaaaaagtgccgaggccggtttgcccggccatggcctgctggacctccttaccggcccatgttctcagaaagtcctgcaccatcaatggattggccccggatggagccgcccaccagccaatccggtagagattgccgctccattgcacaccatagcgcagggtctttcccgttgccgacggagcacccgtttcagcttcccggtccgcaagaaaaatccgctccgccggcgcactttccatcaggacctgtccggatgccatcagatgcacggcctgcgcatccgtctcccaccacacgatatagggacggagctgagccagcttgcggaaggcgcgatcctgaccgtccttgccggaaagcacgttatagacatcgcccggcgataccccgtcagccatcagggcaatttccagattgccttccgccccacgatgcaagccgcgcttgcccggatatttggcgatatcccagaaatccgaccagccttccacggattggaatttggacacatcccagaccagaaccatgctgcgcatccatgcgcccagcccgcatttgccctgcccctgcggcaaccagtctatccctgcggcggtcgatttgtgcggcacaggattatgctgcggattgcctgctgtggcggatggtttcacaatgtcgggggatatcgtcgagagtggtgcgggcgcggcgtgagtattgccctgctccgcttctccggtcgcagcatgatgagggtcggaattgtccagcacttttgtcagcggcagcaccagaccatgctcgcaggcagtatccagggctgcttccggccattcaagcacgctgtcagccggcccatccagatgaccgagtgtatcagcgtcgccattccactggaagaaacgaagcttgagatgcgtacgtgcttccagatcgaccagcatgtttttgcgcaggaaatcctgattgacccccggcagaaaacctacacccagaacagaaggcgacgtatcccgcttctcctgcgcccccgccccgtaagtgacaagggtcatgatcgcggcaacaccagccacgataatgccagcaaagcgaggtttcatccgatagggtatccgtccaaaaacacgcggggctggcctctttccgtcatggggcaggcaggattattgcaggcgcgaccactcattccccgatgcttctacacaggcagactgccgaaagggagaggagaagcatagatgcgttcattccggcacccaaccacctgaacgctcatgaagcaaccgcccatgaggacgtcgcgttaaaagaggcaacaggccctgcggcaaggtctttcctaccaggatcccaacgatctcgtgcggtattgattttgtgcagggtcacgcatgacgcaccaaggagataaccttatggcgctattccgccgctcccgttcctctgccgatgacgcacgggagcagattttgcacctgcgtgagcaggtggaagcgctgttgaacgaccgtgttactccggcgctggccgatgcagccggccgggccgaaagtgcagcacggaatgcacagcgctatacgcgtgagcattccagtgtgatttgtgagcacgtgaaggaaagacctttggtcgccctgcttgcagccggcgccgcgggatggctgattgcccgtatcttccgctgatacgggactcgattcatgcgcacccttcgcctcgcacgtaccgcccttgaggcggagggactgatcctcaaacggcaggcatggcaggtcgccctgcgggtgatcttcctggccattgccctgctgtttctgggggcatccctgatgatgctgcaccttgtcctttatctcgccttgcaacctcatgtcccgccgatcggtgcggcggggatcattctgggcggcgatctgttcttcgtgctgattttcgctctgctggcactgaaaggctctcctgatccgatcgcccatgaagcaagggtggtgcgcgatcaagcacgggcggaactggctggtatattcacgactgcggccactctcgcgcccctggcaaaacgatttggagtgacaggcatactcggggccttgctgacaggtgccatcgccaatatcgttgccctgtggaacaagaaaacctgatttcccccgcccctactgtcgcaatccaggctggcacagtccagactgtcgcaatccggcagagcggcccgaccggctggatcacgctcaaccgcccctcggcccttaacgcgctgaatggggaaatggtacgagccattcagcagactctgaacctctggcgtgatgatccagccgtcaccgccatcatattgcagggtaccgggcgcgctttctgtgccggagccgatgtgaggcgtttacgggaagccgtactggccgacgatatggacgtcgtggaaacatttttccgcgaggagtatacgctcgatcataccattgcgacctatccaaagcctgttcttgctctggtcgacggattatgtgtcggtggcggcatggggttggcaatgcatgcccatagtctggttgcgacccgcgctgcctccttcggtatgcctgaaacagccatcggcctgtttccggatgtcggcgccagccaggtactaccgcagttgcgaggccggaccggactttacatggcactgaccggacgccccatccccgccgagatggcccatgctgccggacttctcacgcatctctggcccggagaaatgtccgagcttgtcgccggtctggaaaaacacggtctggctgcactggtggaaaccgatcttcccgttccttcctccgcctttgaccatgttttctcacggatcgacacctgcttctccggcacttcgctcattgacattctcgacgcccttgcgggcgagacaagccaatggggggaggaaacacttgccgccatacgcgaaaaatcacctgccgcgctgtgctggaccttcgagatgatgcgaaccggtcagaagctgacgcttcaacaggcccttaaccgggatctggccatggccatgaccgtcaccagattgcccgattttgcggagggtattcgtgccctgctggtagacaaggatcgcacaccacattggcaggatgcgcgggtcgaggatgtcgatgccgccatgatcgccagcgtgttgcaatccgctgcatcctatccgggcacagtctgctgatcgaaggcacggtggctctcgaagccctgcgcctcaacgaagacccgcctgacttcgggatagttgtttctgatacgctgctcgatccgggaaacggcggcttcaacggccccggcgctgcgctggttctcgaaatccatgctgatcgccaccagcacctcggacgggccaaaatgcatcgtcaggatttcattggcacagaccacaccgggttctgatgccacaatccgccgaatatgctcccgcaccgctaaaggcgcagactcgccgatcaacagagagcggctttcgcgcgccagaaacagcgccgtgaccgccaatatgccgccgatcaccagcgaggctatcgcatcaaacgccggctgatgcagccattgggccagccccaacccgacccccgccgtcaacaaacccagcaatgctgcggtatcctcaaacaggacagtgaacacggtcggatctttgctggcctgtgctgcctccagcacacccagccttcccttctgacggaggaaagcacgcattgccagcagccagacaatgccctcgaacacgaagctgccgcccagcacgaggtaattcggccagacatgagtgacagaaacggggtgacgcagcttttcgaccccctcgaagatcgagacacccgcgccaagaccgaaaatcagcacggccaccatgaagctccagaaataaagctccagcccatgaccgaacgggtgttcgggtgtggcaggacgggccgcacatctcatgccccacagcatcagcaattggttgccggtatcgaccagcgagtgcaccgcctcactcaacattgcggaagaaccggtggaggctgccgctgcaaatttcatgacggcaatcgcgaaattaccgcccagcgcggcaaaaacgacgagacgggaagaagatgcagatgccatcccgccactatgatgatcatatgccatcctgcaaacgggcagatataaaaaaggcagcccggaagctgcctttttcaatcagagatcgccagtcaggatcaggactgggcgtccggggacaacacgatgcagccgcctttgccatgattgattttactgcatgcagcctgagcggattcccgtgacatgccggtcaaccgcgcccgatacagcgttgcaccgcgttgcttgacggtgcccacagccgtatggccatgagtcacggaggctttggcattggccgccgctgccttggcaagatgcgggctgttataggctcccacctgaatagcccatcccccgcctccaaccccccgcgtctgaatgggggacgcttccgccctgttgatcaggctgaagccaccacgacgcggagcggaagtcgccgatgccagctgaacacgcgcggcaaccggggcaccatgtcgaccataggaagagccgccatgcgtggagttggatgccatacgcaccgtctgaacccgcccatgcgtggcggtggagcgggatcgcccatgactggaggaagattgatccagcgccgcataggcacgggggctggaaaaatggcttccccccgtagtcaactgatcatagctgagcgtggtagaagccagctgctcggccggagaacggctgatcggatagagaccgtcgatattcggagcgattgaggccacataacgccgggtttcctgcggcagggagcgaccgctattgaccagatcatccacccggcccggcccggcattgtaagccgccagaaaagccggagacccatagaggtcgtaaagctccctcagataggccgttccggcgaggatattattgtggggatcataggcatcttcaccgaggctgtaacgtaccttcagctcgtcataggtgccgggcatcacctgcatcaggcccatcgcgccaaccggcgatgtcacgagatcaccgttatggaacagacggccaccggattcgacgcgcataacctccctgacccaccgctcgggaacgtcgaaacgctgagaagcctcggaaatatagggaccccatggatcttcagcggaaccgggagcagaataattgcgggatgcacgcgcctggtattgcgctgcctcctgactttcgttcactctgccgctatgattgccgcaggctgtcatcagcgccagcatggcaacgcaggcgagttttccgaaagcgggccggaacgccttgcggcggagcgatgctgagggggggtggatctgatccatccgggctgtttctccgtcgtgacacagccacatgcatgtggccggagggcacggcgacgcccatgactgcaaggctgccgtcgttgatgttccttttcaggaacggcgtgtaagtcctttataggcaggcgattttgaacacaagtcgataatcaggaaaatcgcattttcttgacgtcctgatgttttttcatgctcactcatgcatccatgcaacggcttggcaacggcttgcgcttgtatcaaccgcccattccgggctactcgccacacggatgcagatgcggtcctgacaataacggccctgtgctatcctggacatgccgtgaatagcgctgacaccgctgggataaggtagacatcttgccggatcatctttcttccccggatcctgtggtccggaccacgcaaccgcctcatcagggacagagaagcgtgcgtgaaacagaattttttgtggaaagcggcagcagtttcagggtgcgcaaccgccttgccatgcaggatatcgccgacggtctgaagctgatgcggctcggctgcacgctcgggctgctggatatcaagggacgctatcgcggctccatgctgggtccgttctggatgaccctctccaccgctgtgatggtcctggcgctcgggctgctgtattcccagttgctcgggcagaccgtcgcccaattcctgccttacctgtcgctgtcactggtgctctggggttttctgcaaaacatcattcaggatggctgtgctgtttttacctcctcggaaggcatgatccgtgccgtccgcatgccctttttcgtgcatgccacacggtccatcatccgcaatctggtgattctggcccataacatgctggtctttatcgccgtcttcgcctttttcaggatttggccgggcgaggctgtgttcggtgccattccggcccttttgctctggttgattgatggatacgcactgaccatcatgatggggattctctgcgcccgtttccgtgacgtgccgcccatcgtctccaacctcgtgcagatcgggttctatatcactccgatcatctggaagccggaacagcttctgtacggtcgggactatctgcccctgaacccgttttacgccatgctggccgttctgcgtgatccctttctgggactgacgcccagctggcaggtatggacctccgcccttgtctacagcaccctgctgtgcatcggcagctggttcctgttcgcgcgcgtgcgcgggcgcatcgcattctggatctgaccaacatggcctttttggaagcccgcaatgtcggagtggattttccgctctatcatggcaacgcccgcagcctgaaacgggccgtgttcaacgccgcctcggccggacggttcgggcaggatgcccgcaagcgcacggtcgtgcaggcgcttcaggatatcagctttacactccgtcccggtgacaggctggggctggtcggcagtaatggcgcgggcaagaccaccttgctgcgcgtgctggccggtatctatgagcccacgaccggcagcgtgagggccagcggtaccatcaacgccctgctcgataccacgatgggcaccaattccgacctcagcggccatgacaatattcgtctgcgcggcatgtattccggcctgtcccgcgacgaaatcaccgcgctggaaaaagacgtcgagacctttgccgatctgaaagaattcatgcacctgccgatgcgggtctattcctccggcatgacgatccggctggcttttggactggccacttcgatccgcccgcagatcctgctgatggatgagtggttctcggccggggatttcagcttcatgagccgcgccaaggcgcgcatggaggggctggtcagagactccgaaattctggtcctgtcgagccattcgcatgacacggtcgcggaatggtgcaaccgggtcatctggatggatcaggggcgcatcgtcgcggatggtgctccgaaggatgtgctggaagcctatctcggtcgtccgctcaaagaggccgaacgcgccgacgcctttgttccatcgtaaggacatcaccatgacggcaccatgcaggcaggccatgccgggggtcatgcggcgtttccgtgccgcccgtttgctgatgctgctgggcacggccccggtgcttgccccgctgggtgcctgcgccgccaataccggcctgaccaatctgagacccatcaccctgcgggatggctccaacaccgtggtgcacttcgtcccggacgggcgtgtcgggttgatcgtcgccgcccatagtggcagcgcgccggcccgtaatgatgttttcgtcgttctgctaccctcgcccatggcgggagaaggctggaatatcgtctccatcaatgccggaccgacccttcgcggagccgggcaggctgcggttcaggacacgattaccgccgctcaggacggcattcccggcctgcgcgccgtccgctttgcccgtggcaaaatgaacgggattccacagactttcctgctcgccgccatgaaggacggggacggacgcagccccgtcacgctggaaatttaccggctcagcgaaggtaaccgcacaggcggcgagcaattcatacaggtgcggcagttccgctccagccgccattactgctcggcggcggatgctttgtcacgggaattcggcctgccctccgactcacccgatagcgcctgctgagcctgcacagcatcctgttcctgcgcctccagcacagcgcgttgcgtcatggcattatcgccatgcattcatcactctttctgctagaaagatcgtgttgatcaggcatgcccatctcatatcgaccggacaaaatcatgacgagacgccttacgctgtgccgccaccttctgacagcgacattgctgacaacccccgccgtctttacggctttcctgcctgcggcttatgcggcagaggacgaagccgcccgcacgggatggtatttcccggcccaaaccctgccgctggcaaaagtgctggctcccccgcctgcccccggctccgccgcgcaggaaaaggatctgaagaccgtgcgcaaggctgaagccgcccgcacaccggagttgatcgcggccgtcaaggcagacgcccatatcagcgtctatcgctttgccgatgtcatggggccgggcttcaagccggagaatctgccgctggccgacaagatgttcaggcatatgtccgacgatattcgtatcgccatcatggatgccaagaaagaattcaacaggccccgacccttcgtggcggatccgaaaatcaccaccatcgtgccgcagccgcccaatgcctcctatcccagcggacatacggcctttgcctttgccaatgccatcgtgctctccgccatggtgccagagaaggccgccgagatttttgcccgtgctcatctttacgggctgcaccgcattatgggcggggtacattttccgaccgatgtcgaggcaggcaaggtctccggcagcgtgatcggcagtaatttcctgcaatctccccggtttcaggctgatttcaccgctgcccgcaaggaagtgcgacatgcgctgggcctgcctgaaacaccctgatcccatacaagactgaacatggcaggaaggaggaccggcatgaccggtcctccattttttatcgaccaacctgacgcgatggccgggatcaggcagacagcagccgcccggcgatcaccgccagcacaccccccagcaaagccagataaggcagcagaccggcacggctttccacgccttcctctttctgcatatgcagatccttgatcgcggcttcggggaagacgcctttatcctgcacgtaatgacggaacaggaagaccgggatgaccatcgccgcaacgatgatgccggtcagcaaggtaccactgccccatacacctgcacccatccccatcaggaaagcgttgacgaaacccagcaccgccccggttcccagcagccaggccgggcatttgaacggacgagccagaaacggacgatcaatccgatgcagccagcctgcattgaggttcatgaagctgaaaatgatatagccgacattggaagccgccagcacgaatacgttatcgctcagcagcagcagcaacatgttaaagcagagatctgtccacatcgcatgggtcggcgcaccatgatggttcacatgcgacagatagcgcggcagccagccatcgaccgatccctgatacagcgtgcgcgatgacccggccatggccgtcatgatcgatagcagcaaagtcagcacgagcatgacaacgatgatattcagcataaccccctgtgccccgatcatcgccgccatggcacggccaacccccatgccactgtaaatgtcgggtgccagcatgccatccagccccagagcgccctggaaagccagtggaaccagggtgaacacccccagacagagcagaccggaaaagaagatcgccttgaacgtatccgtgctgggattacggaattcccgcgtgtagcaaacagcggtttcaaacccgtacgtggaccaggccgcaataaacaggccacccgccatcagcgaaagaccggccatgtcccaatgcccggccacaaccttgcccgccgcgtcatgggccaaaggcgcaaaaggcgtgaaatggctggccggcagatccccggtcagcagcggcaccagcccgatgatcaacaacggcaacagagacaccaccgcaaaaatcatctggatacgggcagaggccagaatcccgcgatgctggatagcaaacacacacagcatcagcacagccgcgagcccaaaagtggcgttgatccggagagtcagaccatccttgatcatccccagatcaaacagggtccattgccagctgttcacaacactatccgccgggaacagcacagacagaatatagccggcccccagcgatgtgccgatggccagcaccggcgaccatgcgaaccagttacaccagaccgaaagcggcgcgatcagcttgctgtagcgcacccaggccacagcaccataaacagatgccccacctgatttttccgggaaaagcccggcaatttccgcataggtaaaagactgcaaaaatccgaacaggattgaaataatccagattgcccaggaaggattgcccaccgtcgcggcaatcgagccgatcgtgaacagaaccagggcaggcacgccgctggaaacccagaacgcatctacccatgtcagtgaacggaccagctcattgccggtttttgtcaccgtctcgcctactgccttaccgcctgcaggcaacgcgatatccaaagcaccctcactcatgacgctcctccatactcataaggtcatgacgtggcttttcccgtcggtgatgcctgacacccttcaggatgcgatcaccttaattttcttgataggaaatattatttctaaaaatcgtaacctgatcaaaaccgatgcgcaagcggacaaatcaggttcaaggcaacagaaaggcaaattaatccgctttttttgctttttgacggctgcgggaggctgccgtcacggtgcgtaccacttcctctggctcatccagtaaagggctgaacaacgcgaccagcgcacgttccgatgtcacattcgcctttcgataaaggcgaagtttatagtttttgacagttccttttccgatcccgagactctgcgcaatctccccggttgagcggcgctgcaaaatcaatgtcagcaaggagcgctccctgcccgtcagcatggcgatatcaggcaatggaaaagaagcatgttccgcaggcgtcgtgtcctgcacgggtttgctcagcagcacgattccacgtccacccggtgccagagaaaaatccttatcaaaacacgccacttgaacatggtatttttcatcaaaaggaaaaagaccaggtttgtcaggcaatgccgcgcaatcattgagatccggtgataaacgagccgcctgccgccatgcagtattggcaaagatcggtacgccgacacgatccagaattaataaagggtcggtatgcaaatggctggagccacgatgggccgtctccacggccttttcttctccaaacatgcgcgccagatgtgtccggtgcaaagcttccagaatcgggaacagggcctcggccccctgcctgtcctgatcgctgaagcgtccctctgccagaaccagaaacagcacgatacaggcccgaccggcagaaggcagaaacacgcccatctcgtcactgacgcgtacccgcggagcataaacgtcgccatagaccgtgctgtcaggcccgagaacctgccgcagaacatacacgccaggctgatgatggcgcgcccagtgttgggcaaaaggatccgcgtgatgataccgcgtcaggtaaaattcacggatatggaccggcacgttcaccgtatgcaccacatcctgccgtgaatgcgccgtatagcggatgatccaggcattatcgtgtccgatcacagcacgcagcagatccagcaaaacctcataaaatcggcggctgccgacctttctgatcgtgacggccagttcccggcagaatgccgcttgcccgggcatcacccgtgccgggaaaacaactgactgcttgccagcatcatgattgcccaaaaactgctccccaccccgccgagacaaagcgcatttgcctgaaaaacagacatctatccgtttttgtagtgccacttggcactattgtgaatggacctgccaggcaattacctttcctgcaagacaacattactgaacagaggaaatgttccttggacatctttcctgctgatacacctactcctagcagaagcagtgccattcttcgtggcggccaatggacagtgctgacaataccggcaggcgggtcgctcatgctggtcaatatcgaaggcggccagaaagtcgatctgtattgtctttcaacagcttccctcattttgccggaggatgccagcgtttctccttctccggacatgctggcgggtctggtaagtgcgcaggaacgcaccggcacagtattggcacgctatacggatgcagagttggccatcatgggatggaggctgtttgacgacagcacacccgataagaccgccttgagtgtcacggcccgccatgatgcagtctgtgtgctgatatcagccaaaactgtgatgacgccagacagccacaatacagcaacagatattgctattcatattacacaggatgaaacagcgctgcgtcttccggcaccgctggcaccggtcaaggccgaaattcatattccgcccgccagcgcacgcgcctacaccgtcaaggccggtgactacatacagattatcgacgtgcagggtaaacaatgctctgactttctggcttttgatgcacagagtctgaaaaatggcgatctgaacgggctggatgccgcggtaacacgcaccttcaccggcgttgccaatccaagcccaggcgtccatgcgcgatatttcgatcgcactatgaagccgctggtcgagatcgtacaggatacagtcgggcgccatgatgcattcctgctggcctgtaacgcgcgatattacgaaacgcagggatatcccggacatacaaactgcactgataatttcaatgcagtcctcgaggatcatggaatcaaacctcagataacctggcctgccatcaatttctttttcaatacacaggtcaatcctgacgggaccatctctctggaagaaccatggtcaaggccgggtgactacgtactgttgcgggctatgaccgatctggtctgtgccagctccgcatgccctgacgatatagacccggccaatggttggatgcctacggatatccatgtgcgcatatacgatgcctcggcgcagttttccaaaggcattggccatcgcatcacgcgccatacggaggcacgattgacaagggaatcaggttttcacagccgtacatcacctctggcaaaggagatgatcgactatcaaggcttctggcttccacgggaatacagcggcagtggagccattgaagaatactgggcctgtcgggaaaaagccgccctgttcgacctgacggccctcagaaaattcgaaatcaccggcccggatgcagagaaacttctgaactatgctgttacacgcgacatcagcaagctttccatagggcagatcgtctatacagcactttgtcatccgcatggcggtatgatcgacgatgccaccgtgttccgcatgagccagcacacattccgtcttatatgtgggcgggaatggtgcggcacctggttgcgtatgctggccagtgaaaaagacttcaaagtctgggttcgaagctcaacagaccagcttcacaatatctccctgcagggaccgctgagcagaataatcctcagcacggtttttagtccttatctgactcaacctgatgcaaaagacctgaaatggtttcatttttcaactggcatgcttggaaagcatgatccctctcctgtcatgatttccagaactgggtacaccggagaactgggatacgaaattttttgccatccccaacatgcgggttctgtatgggatgccgtgatggaggccggtaaaaatcatgctctcaaaccagcgggactggatgctctgaatatgctgcgtattgaagcgggactggcgtttgctgggtacgaattctgtgatcagaccgatccttttgaggcgggaataggctttgtcgtcagtcagaaaaaacaaagcgattatgttggtaaaactgcccttctggaacgtggtagcgcttatcgcaacaggctggcaggacttgtgatcgaaggcaatgacaccgtttttcatggcgatggcgtttataatggaatggcacaggttggcattatcaccagcccggtgttttcgcccatccttggctcccaaattgccttggcacgaattgatccgtcggttgccgtatctggaacccaaattgagataggaaaagataacggcatgcagctgcgtattccggcccatgtcgtaggatttcctcactatgacccacaaaaaacaaaagtccgctcctgactgttcactttatccaagacacggatgttcatcatgaaaaagaaaattgccattatcggtggtggcccaagcggtctggcatttcttcgcgctatggaaagtgcgcgtaaagcaggggcagaggttccagagtatgtctgttacgagaaacaggcagattgtggcggactctggaactatacatggcgtaccggcctggatgaattcggtgaaccggtgcatggcagcatgtatcgttttctgtggtctaatggaccgaaagaatgtcttgaattcgcagattattcctttgaagagcatttcggccgcgccattccatcctatccacctcgtgctgtcctgcatgattatatcaagggccggattgaaaaatccggtgtcagacaattcatcaaattccatcatgctgtcaaatggattgactatagtcaggaaagtcgcaccttttctgtgacggtcaaggatttaaagacagatacgctcaagaccgatacgtttgaccatgtggtcattgcgaccggacatttttccgttccaaacgtgccatatttcgagggtttcgaaagcttccccggtcgtatcatgcatgcacatgattttcgggatgccaatgaattctctggtaaagacatcctgatggtcggaagctcctattcagcggaagatattggaacgcagtgtgcgaaatatggctgtcgctcggtaacgttcagctatcgcacccgcccgatgggatttcagtggccggaagggtttgaggaaaaaccccttctgactcatgtcaaaggcaacatagcttatttcaaagacgggacttcaaaaaaggtagattccattatcctctgcacaggataccaacattcatttcccttcctgccggattccatgcgcctgaaaaccaataatcgcctgtatccgcttaatctgtacaagggtattttctggaaggggaatacagatctcatctatattggcatgcaggatcagtattacactttcaatatgtttgatgcacaagcatggctggcacgggatgccattcttggacgctacatccttccggatgccgctacacaggatgccgacataaaacactggagagcactggaagaaaaaattcaaaatccttaccaggcgattgatttccagaccgaatatgtccgcgatcttctagcactgacggattatccccatcttgatgtcgaccggattgcagccctgttcaaggaatgggagcaccataaggaggaagggatcattacgtatcgtgatcgcagttatccctccaccctgactggcacgatggcacccagccaccacacgaaatggatggatgccaaagatgacagcatggaagcgtttctgaatcacccccgtctggaggccgcagaatgaccatctcatacccggaacgccactccgcccttaccagccgtcatgtggcactcggatcaaagatggatgcatcctggaatgggatgcctatccctcagaactatgtatcaaacccttatgatgagaccgttctcgtcagaaccaaagcagggctttttgatgttacggcattgcagatcatcaatgtctccggccctgatgccatggctgttcttaataatctggtgacatcagatcttgcaaaaatttcctctggcagctccctgattaccagcattgtcaatgatgaaggcggcatcattgatgacgtcattatctatgttgatagcaagaccgagttccgtgtttctcatggtggcggcacacttgagccggtgctcatgaaggatattgtcgggcataatgtagttgctgagcgggatgatgatgtccacatcctctccctgcaaggccccctctcaggagatattctgcaaccccatacagaattacctttatcttcgctatcctatttctcccatgcccaaacaaccttgttcggaaaaccggtcagaattgcacgtggtggatattccggagagacgggatatgaggtgttctgcacttcagaagaagcaggcccaatctgggacatgatcctggaggccggaaaatcctatggtgcggctccagtgagctggtcctgccttgatatcgtccgccttgagggaggattgctgtttttcccctatgatatgccggcggaaaataccaccccatgggaggtcaatatgggatggtccattgacctccagaaaacagctttccgtggcaagaaagcactggaagcattacgcggccaggaacgcagcacgattatcggtctggaagtactcagcaaggaagcagccgaggccggcactcccattttccatgatggtgttcaggtcggacaggtaaccagcagtatcttcagccaatatctgatgaaatctctggctattgccacgattaagccctccctgtctgcgctcggcaccgcggtatctgtaggagaatcagcacaagcaaatatcgttcgcatgccattctatgatcccctgcgactgagaacccatccacgataaaaagggagagcggcagacatgcttctcagtaagccagtctatcaggatctgaaaattgatccgacaggaagcagacatttgtttgtttttgaccggtctgccgctcaatggagaagcagatctgatatctgcactcattcctccttttacgtgatgcctgacagccggatcatgccggaacaggcaccggatgcagagacaaacagtctctgccttccgttccgctctgagacccagttgctgagctatcttgagtcttatcttgggacagagaccatgggcctgaggctctatgcagctggccaggaaagtttcgtatgggattgttaccgcgtggcacagcaggctggtatgacccgcccggaaattcatctggccgtctcaggagaagtcagcaggcgggtttactgtgttcactgtcagaccatcaatcatggcgcaaaaagcacactcatccaatgtgatggctgcaacgcaactctttttgtccgtgatcatttctcgcgtgagcatggcgcctatatgggttttcaggttgatgctgaaaaccccggcgaaattccttcggccgaggcactttccctatgacagagcacaaaaatacaccccgtcagatagatgtcaggctgtctgatatagagccactttctcccactttgaaacgcctgacttttgttcccataaaagttgctgcttttcccgttatcccgacaggcagccatatcatcgtgtcgataccagggagaagacggtctcataaaaacgcttattccctgatcggaccggcagataagacagattcctatcagattgtcgttcgaaaggtggataaaagccgtggtggttcaaactggattcatgagccaggccaagataggcgacaaacttcagatcagctggccatccagcctctttcccctttccaatgtggcgcgtcatcatcttctgatcagcggcgggatcgggattacccccattctgtcgcatctgcacgccctgaccgcccggggcgcctcgttcagcctgcatcatgcctgtaaagctgaagacaagaatgcctttttgaccctgctggctcctttccatggccatgacatcaccctttacgtggctgatgatccatcatcctcccgactggatcttcaggccgtgatgggcagacagcctctgggtaccgttctctacacatgcggcccacaaaagctgaccgatgccatcatggagacaggccgcacactgggatggcctgcgtcaagccttcagactgaaagtttcggtggggctcgggccggtacagcgtttaccctgcatgcacgccgagcggggaaaaccattcttgtggatgaagagagcagcattctggaggctctggaaagcgctggtatccagccgacctatctctgccgtggtggagcctgtggtcaatgcctgaccagtgtgattgatggcattccagaacatcgcgacgactttctggatgagcaggaacgcgccacaaacaaaaaaatcatgatctgtgtttcaagggcatgcagcccttctctgacccttgatatttgatttaccgataaaagaagggatttctgtcatgactgtgcagttcaagccggatgaaacgttccggggtaattataacttcaaaaacagcgatgaagcgatactcagtttcccgtttccgtttcctgaagataaatacatgtattcaatgaatgccgaaccacatgtcagatccggaccatccccatcctatcatcatgcattcgacattgatgagcactacatcgctgaatgcagggagcgcgcaatcattctggagcaagacccgaaacgctgtcaggtcatgccacatcttcagattgccgaatgggatacgcttgaactcctgatggattccctgtctaccgactaccctcaatggttcagcctgacgaaggctgctgacaaatggtgctgggtcaatcgtcttctgacgattgagcagaatttcatttttggtgatgcatctacgctgcctttaccacccttcgagtatatcaccagacaggttcaaggagatttcacccttcaggatcagcgagataacaatctgttcatcgaaggcggaatggtaacttctcaggcggattggtcactcaatttcgacaaaggcatgagctttcatgaatggcatgcgcctgtgcccttagcccatgatatgggggtctttgatcgagccctcaaatttctgctcaaactgcaatatgggcagcctgtgcgacgtctgaattggactttgaccgttaatccacgcctcgatacgtccccagagaattatgcagtctggggaccggatcgtatgacggtaacacctgaaaatgtaaaacagaaagtgcatcttcgtgtcgagttgcaaagtctgttccgtctgccacgcagcaatgccatcctgttctccattcgcggctatctggccagtatagaagaaattcagcgcgttccgaaatggcgccgccgactgcatcgtgtgatacgggatctaaacccttcgatccgaacctataagggtttctcccgctattacgacacgctggtatctgctctagcagcaggggatgatgggttaccaacatcttcaggtattcagcctgatattgacaggctctcgtaacaaaaaaggccctgctctttaaagcagggccttttaaatggaaatcttagtgactgatcatccatggtcgttgggcaggaaaacttttagcggctggcggtgagtccgccgtcaatttcgattttcccttcgttgtggtacagcaggagcatccggatggatgactcccgcgtgatcggcgcggcgcatgcatactgcgctcattggtagcaaatgcagttcgccgggcagaatccatagcggcaaatgatggtgcggtgagtaacacacgcggagcagatgtgccgcaatccgggcagcacgcaggctgctcgaactccgacatcggacgcatcacagtaaaaacgccgcatgactcacaatgatagtcatagaccggcataggagacctccttacagatcctgcgcaatcggcatatccaccaggccaggtgttacaccaccgctgggaccatccgcacccggattgatatcaaagtcaaaaatttccgtgggtacccagagcgtggcacaggaattgggaatatcgaccacaccgctgatatgaccctgtaccggtgcagtgccgaggatcgaatatccctgtgcaccggaatatccaaatttcttcagatactcgatagcattgaggcaagcctgacgataggcgacattgacatcaaggtaatgttgttcgccttgctcatcgactgaaataccctcgaagatcaaatagtcactgtaaacgggtttgatgggactcggcttgaagatcggatttttgattccatactttgccattccatccttgatcagattcacacgcatatgaatccagcctggcatttcgatagcgccacagaaggtaatttcaccatcgccctggctgaagtgaagatcaccaacggatagaccggcccctggaacataaaccgggaagaatacccgggcccctcgtgacagatccttaatatcgcaattgcctccatgctcacgaggaggaacggtgcgggcaccatgagcggcggcggcatcacgtgcctcacctttgagacgccccatatgggctgtcggctcaaaaggcggattggccaaaggtggcacacgatttgggttggttgcgatcagcgctttctcccgcgcattccatttttccagcagatcgggagatggcaggcatcctatcaggcctggatgaatcaggccggcataatttacgccgggaacgtggcgagaagaggcaaacatgccatggaaatcccagattgatttctgggctaaaggaaaatggtccgtcagaaagccgccaccattctttttggagaaaaacccgttaaagccccacgcattatgcgggaatgcaccaatatccagaaagtcgacaaccaacagatcacccggctgagccccctcgacaccgatcgggccgctgagataatgtacggttgtcaaatcgacatcccgaacatcttcggctgagtcattattttttatgaatccgcctgtccagtcatagcattcgacaataaaatcgtctcctggcttgactgtggcaaccattggaatgtcatgatgccaccgattatgcaccatatcattactgatagcgggttgtgacaggtcgattttgatgatcgtatcagtcatggcatcatcccgttgaacaaatgtttgattttttccggttatatttttagacagccaggaaacgggctactttttcctgatcaagattttcttttgtatcctgatgaacaatcttgccaccttcaattaccatgatccgatcagcaacatccagtgcaaaggataaaacctgttcagacacaaaaattgaaagccctttctgatcacgtattctacgcagtgttctggccatttcgagaataatggagggctgaataccttcagtcggttcatccagaagcagaacctttggctcagtggccagagcacgggcaatggcaagctgttgctgctggccgcccgataggtttccgccacggcgtcgacccatttctttcaaaaccgggaaaagttcatataaatcagaaggtattttcaattttcctcttacaaaaagacctgtttcaatgttttctgtcactgtcatcgttgaaaaaatcatacgcccctgcggaacataggcaatgccggtttcaacacggcggtggcttttcatcgtcgtgatatcggtgccatccagcatgatcttccccccgctaccgggaaccatcccgatcagcgatttcatcagcgtcgattttcccatgccattgcgaccaacaatagccacaatttctcctgcaccaatatcaagatcaatcccgtgcagaacttcactttgaccatatgacacgcgcaattcgtttgtagtcagcatagcgtgtctcctcaatgtcccagatagacttcaataactttcgggtcattctttacatgtgccatggttccatctgacaaaacctgcccctgatgaagaaccgttactttatgggcaatatcctccacaaaacccatgtcgtgctcgataaccagtacagagcgaccttcaatgatcctgtgcagcagctcagcggttttctgccgctcggctacgctcatacctgcaaccggctcatcgagcatgagaagttcaggatcctgaatcagcagcattcctatttccagccattgtttctgaccatggctaagatactcggcccgttcatgaagacgatcctgaaggaaaatcatctcgctgatttcctcaattctggaacggacttctgcgtcacaccgaaagcttaatgctccaaacacagatcggccacgcggataagaaatctcaagattctcgaaaaccgtgagatcttcataaatcgatgggttctggaatttacgccctactcctgcacgaacaatctgatgctccttcaaggtggtcagttcatgattacggaaccttatagaccctgatgatgcttttgttcgcccgcagatgaggtcaagaactgtggttttccctgctccatttggaccaatgatcacgcggatttcattgcgatcaacgtagaaggacagatcattaacggccttgaaaccatcgaatgaaacggtcaatccctccacagccagaagaaaatctgtttctgatgacatgacagctttctcccttacttcacaaccacaggcgtatcggtcgaagaaagtacttctttggctgcattattctgtctgttacccatgccgagcaggcggctgacatagggatcgagatagctgcgatacaatccggccagaccgttggggaacaccattgtcacaatgatgaacaatgcgcccattgcaaacagccaggcattggggaacgcttctgaaagggtggagcgggcccagtttaccagcaaggttccatacagcgcacccagcagagaggtacgcccaccgacagcagcgaaaatcaccatttcgatagaaggaacgattccgacaaaactcggggacatgaagccaacctggagggtaaacattgcgcctcccactccggccagagctgccgcaacacaaaaggcaaaaatcttgaaactcgcaacgtcatagcccgagaagcgaacccgatcctcccgatcgcgcattgccagcagaatacgaccgagctttgatcgcctgataaactgaagcagaatcagactgcccagaagcaggccgcagcagacgaaatacagcacgtttctggcatgatctgtacggatatcccaaccatgaaagctgcgcagatcggtgattccattgaccccaccggtatatccctgttggccaatgatcagaatggtcagaatggcggcaatggcttgcgtgatgatggcgaaatatgtgccgcctacccgccgccgaaacatggcgattgcgatcaccagtgccagcaccatcggcactgcaggaactgcaaaaatggtaaaggcaaggctgtgaaacggcttccagaaccatggcagtgaggtaatctggttccagtccatgaaatcaggaatacctggtgtagactggattttggtcgcttccggcgttgatgattccagcttcagatacatggccatgcagtagccgccgagaccaaaaaacacgccctgaccaagactgagaatacccgcgtcaccccagcacagcaccagaccgagcgctacgaaaccataggtcagatactttccgaacaggttcaggcgaaacgtatcgagaccaaggggaaacacaacaaggatcagaaaggcaaacaagccgatacacagaatatctttgcgattgaggaaactgctgttcatgtgaaatatgctcctcagcgccgaaccttgagaacaaacagaccctgcggacggatcatcagaataatgataaccgacagcagcacgattacctgagccatcgaaccactgaggaagaattccagcgtggaccgtgcctgggaaatcgtgaatgcggaggcaatcgtaccgagcaggctcgatgcaccgccgaagaccacgacaaggaatgtatcgacaatgtaaagctggccggcagtcgggctggtggatccgatcatcgtaaacgcagccccggccacacccgcgatgccacagccgaggccgaaagtccgacgatccaccctttctgtatcaatcccgacagctgccgccatcgggcggttctgcacaacagcccgcacctgcttgccccatcccgagcgaaacatcagcagatagaccccgactgtgatcagtgtagtgagacccatcaccaacagaccattgatgggaatttcgatactttcggaaagatgagttgcccccatcatccattcaggcagattgacgccgacttcacgcgccccgaaaaccgagcgatagatctgctgcatgatcagactgagaccccatgtcgccagcagactgtcgagcggtcttttgtagagatgacgtatcatcagccattccaccagcatcccggcaaggcccgaggcgcagaaagccagcacgacggcaatagggaaatagattgcaaatgcaccgggaataaactgagaaaaaagctgtgacgtcagataggtcacataagcgcccaggatcatgaattccccatgcgccatattgatgacgcccatctggccaaagataatggccatgccgagcgccatcaacacaaagacggagaacaggataagcccggaaaacccctgcatcacaaagatggaaccgagttcacttatcgagtagccacccatcaacctgtcctccgtgtttcactgccttattcagccaggtttctcactgatatcctttggggaacggatcaggcttgatcagatccggcgtttcccacaccactttgaactggccatccagctgggcctgtccaacccgtgtgcggctccacagatgatgattgggatcaattttgacgtaaccttccggcgcggttttcagctccaggcctggcgacgcggcaataactttgtctacatcgaaactgccggctttttcacaggccattttccaaaggaacggaccaagataggcggcctgtgtgacatcgccgatgacgcttttcggtccataggcttccttgaaggcggcgacgaatttctcgttgttggggttcttcaaggactggaaatacttcatgcatgaataagcgccggcaatattttcgccgccaatcccaagaacctcgtcttccgtcacggaaatggtcagcacggtctgtttgctcagatcaatgccagccgctttcagttgcttgtagaatgcgacattggacccaccaaccacggcagcatagatgacatccggctttttcagacggaacttgttgatcaccgaattgaactgggtatggccgagggggaaataatcctcgcccaccaccttacagcccggcagatgattttcgatgtgcttgcgggcgattttcatcgacgtacgcggccagatgtaatcggagccgataagatagaaggtttttgctcccttcaccttgttgacccagtccagcccggcgataatctgctgtgttgcttcctgcccggtgtagaaaacgttcttggactgttcgaggccttcatagaaggtgggataatacagcagcccgttatactgttcgaacaccggcagcaccgccttgcgcgaggcagaggtccaacagccgaaaaccgtagcgcatttgtcgttcaccagcagcttgcgagctttttcagcaaaagtcggccagtcactggcgccgtcttcctgaatatacttgatctgccggcccagcacgccacccgccgcgttgatctgggaaatggcgagtttctccgcctcaatggagccggtttcgctgagcgccatggtaccggtggaggaatgcaggatacccactgtcaccgtgtcatcggtcacagccagcccggtcttgtcgattgccgcggtggcgggtttgccatccgcccatgatgtgccgggcagcagggcagcggccggcagtgcggccatgccctgcaacaggcggcgacgcaggccggaacggggagtgtccatatcggaggcatcaaagggggaatgatcggccatatgttttgtcctgacggtcatgtcggaggaaaaaatcgtttccgcttcgcgacatactggtccggccggacgccaatcatggatacgtcatatgacgtatggcaacgcatagcggatgaagggaggctccctcaccatacacggccatacggtggcgaggatggtaaaaggtcaggcgaaaaaaccgggccattatggcatactgcccccgacatgacccaaagaccgctccctgaatcgccggaaggcagcccctggatttcccgtcagcgcattgtccgcatccgcagggattataatcgctgggtcgctgatgaaacgctggaagattatgcgctacgctttacagcgaggcgtgcccggcgctggagcggcctgcgcattgccaataccgcgctcagtgccatctccttcctcgcgttggaagccattggtggcacgatcacggtgggatacggctttaccaatgccgtcagcgccattttcgcggtcgggttgctgatttttctggccggactgccgatcagcctgcaggcggcccgggccggggtcgatattgatctgctcacccgtggcgcagggttcgggtatatcggctccaccatcacatcgctgatctatgccagttttaccttcctgttctttgcgttggaaagcgtcattctggcctcgatgctgaaaatctgcttcggcattccgctttatgcggcctatctgatctgctctgtcgtcgtgatcccggtggtggtacgcggtatttccgccatcaaccgtgtccagctctggacccagcctttatggctggtactgcactgcatacccttcatcgccattgctctcaacgggcgcgacattctgggtctctgggttggttttgcggggatttcacccctttccggcatgcccggcggtcatgggttcgactggctgggctttggggcagcggcctcgatcatcatgtccctgatcacgcaaatcggggagcagatcgattatctgcgctttatcccggcagagacacaggaacgtcacaggttccgctggaccatgaccgttctggcggggggagccgggtggatttttcccggcatgctgaaaatgctggccgggtcgtttctggcggtttttgccatccatgcgggtattcccgccatggaagccattcagccagcctggatgtaccggatcgctttcggctcgctgggcctgcatccgacagccgcgctgtttctggcagcgctgttcgtgttcatctcccagttcaagatcaacgtgaccaacgcctatgcaggctccatcgcatggtcgaattttttttcccgcctgacccatgcccatccgggacgggtggtatggctgatcttcaacattgccattgcgctggcactcatggagctgggtgtctttcaggccatcgaagccacgctgcataattactccagcatcgccgcggcctggatgggagcactcgtttcggatctgacaatgaaccgggccctgggactggctccgcgacagatcgagttcaaacgtgcccatctgccggacgtcaatccggtcggagttggagcgatgctgaccgccattacggtttccctctgcgctcaggccggatggttcggtgttgcggctggcgtgttctcgccttttctcggctttgcaaccgcctttgcggcagcacctgtgatcgcatgggtaacggggggtaaaacctatctggcgcgcaaacccaggcggagctgggcgcatcgccaaagtctgcattgcgtggtctgcgaaaacgacttcgaaccggaggattcggcctattgccccgcttatggcgacgcaatctgctcattgtgctgttccctcgatgcacggtgcgatgatctctgcaagaaaccggagacgaggctttcagtccagtggcaccgcatccgacaatggcttacccccacccgcctgcaacctgtgctgaacagtctgggaggacgctactgcattgtctttgcgatgctgggaggcagcaccggcctgatgttgctggggatttatcaccagactgtttccggcctgacccggacggaccctctgttacgcagcgccttctggcaggcatggtgcgtcatgctgctgatttcaggcattgccgcgtggctgctggttctggcgcttcaaagccgacatgtcgcacgagaggaaagccgccgtcagaccgcgctgctgatgaacgagatccgcgcccatcgccgcaccgatgccaagctgcagaaagccaaggaagcggcggaatccgccaacctcgccaaaagccgtttcgtggtcggggccagtcatgaactgcgctcccccctgaatgcgattctcggctatgcgcagttgatggatggggatgaaaccctgccccccagatggcagcgcgccatcggcatcatgcgccgcagcggagaacatctggccgggctgatcgagggtctgctggatatctcgaaaatcgaggccggacggatcgatgtggcccgtgatgccgtcaggctcggtgattttctggatcagattgtcagcatgttccgcattcaggcggaggcgaaaggcatcgacttcatcttcgatcgcccggagacactgccggatcaggtctataccgatgagcgcaggttaaggcagattctgatcaatctgctgtccaatgccatcaagttcacacgctacggacgggtaactttccgtgtgcggtggcgcagccagattgccgatctcgacattaccgataccgggatcggtattgacgaacaggagctggaacggattttcgagccgttccaccgcacatccggcgccctgcatgccagtatgcccggaatcggactgggactgacgattaccaaactgctggtgcagattctgggcggcgacatcaccgtgcaatcaaagctgggcgaaggcagcacttttcatatccgcctgatgctctcggaagtacagcagagtacggaagcgcctgcggaaacgcttcagcctacatctgccaccattgccgcgacgctacgcccgggcatgactgcgatcattgcggatgatgatccggtccatcgtgatatgatgagcgatattctggcacctttgggaatcaccgccattcaggccgtcaacggtcaggcctgtcttgaactggctgaagagcagcggcgcgctggcaacgtcgttgccctgttcctgctcgacatccagatgccggggttaaatggatgggaagtcgcgcgctatctgcgtgaatctggtttcagtgaagcgaccattctgatcatctccgccaattccggggccatcagcggcggcagcatggcaggcgatcatcatgacgggctgttgagcaaacctgttgatatcagcatgctctatgcgtttctgcatcagcgactgcatctgcaaaataaaacgatcgcaaaaagcgagccgttgccgatcatcggcgccacggccctgccgccggagcagggtctgaccaaactcgatgccagacagcgtaatgagttgcgccagctcctcgccatcggatacatgcgcggtctgcgcaacaaaatggaggatatcgccacgacccacccggatacccgtcccgatatcgaccggctgcgccatctggcggatcaattcgacctcaatggtctgtcagccctgctggatcatacttcggcagaatcgtcccctcttctttcagacagcaatgctccatgacaccacgcgacatcgtcctgctggtcgatgatacaccgggcagtctgtccgtcctgcatgatgcgctggatatggccggctataccgttctggttgcacaatcagggcaggctgccctgacgctgatcgaacaggtcacacccgatatcattctgctggatgcgattatgccgggcctggatgggtttgaaacctgccgccgcctgaaacagcatccaacctatgccatgattccggtcattttcatgaccggcctgaccgacaccaaacatgtggtgcaggctctgcaatgcggcggggtagattacgtgaccaaacctgtctctccggaacaggtgctggcccgcattaccgtgcatctcggcaatgcgcgtctgatgcagagtgcgcatgtcgcacttgatcgcgccgggcgctatctgtttgccgtcgatgccaccgggcatatttcatggagcaccccacaggcggctcttctgctgggcgcttcagatggcagaccggtgctacctgcttttctgctgccctggatcgccgaatgcgccagcggtgaagcgatgaccggcagccgccgggtcgttgtggaaagccggctttctcctgaaggcacgggatcgcgggaggtggagatcgtgttcttcggcacctcacgcgaggacgagatcctgatgcgcctgatcatcaatgatccagccgaggagcagactatcctgcatcagcgtctgcccgtgacggcacgggaggctgaagttctgctatggatcggccgaggcaaacagaaccgtgacattgccgatattctgggtctgagtccgcgcaccgtgaacaagcatctggaacagatctacaccaagatcggggtcgaaaaccgggctgctgccgcagccgttgtcatgaaattgctggcctcccgctgacgggttttcattcttccgaaaccggacgaggtcaataagcagaacaacgtatcctctgccatcgaacagaagagcagcatgcatcatcattttctgtcgcggggaacaggctcatgatgcatggtgacatttccagctctgccgatacagtcggcgttgctgtcgtcaattacaaaatgccgcgtctgcatacgatcgaggacgtacgcagcaatgcccatgccattgccgagatgatcatcggcatgaaaaccggtctgccgggcatggatctggtgattttcccggaatacagcacccacggcatcatgtatgatgaggccgaaatgatggaaaccgccgtttccatccccggaccggagaccgatattctggccgatgcctgccgccgggccaaagtatggggcgtgttctccctgactggcgagcggcatgagcagcacccggaaaaacggccctacaacacgctgatcctgatcgacgataccggaaaaatcgttcagaaataccgcaagatcattccgtggacaccgatcgaaggctggtatccaggcgatcagacctacgtgtctgagggtccgaaagggatgaaaatcagcctcatcatctgcgatgacggcaattatcctgaaatctggcgtgattgcgccatgcgtggtgcagagctgatcgtacgctgtcagggttatatgtatcccgcaaaggaacagcagatattgatggccaaagcgatggcatgggccaacaacgtctatgtggccgtggccaatgcggctggatttgacggggtgtattcctatttcggccattccgcgatcatcgggttcgacggacgcaccctgggtgaatgcgggacggaggaaaacggcatccagtatgcccagctttccaaagccctgatccgcgatgcccgcaggaacgggcaatcgcagaaccatctctacaagctgttgcaccgtgggtataccggcaccattgcctcccgcgagaatatcagcggcaaggcggaatgcccctattccttctaccgcgactggatcaccgatcctgaaggcacacgcgccaaagtcgaagccctgacccgcagtgaacccggtgttgccgattgtccggttgccggtgtgccgacaccgacagggtcataatttttaacgcgcagcagagggtctgatcaccgccagcatgacgagcatggcttctgcggcaatggcgatgccaaccgggagccgaaccatcccgctactgaaccatgctccggccgcataaagcggtatgatcaccagtgccgggaccagatcacctgcatgccggagccgaagggcaagacctgacacaatcaggcaagcccccggaacggattttatggcaacgtcccatggatggagccggataaacccgtttccaagtggcccttgctgaccaatccccgttggcagcatcacctccagcagccaatgcatgatgtttgctgcatcacgcagactgtccagcaccatcgtcgccagcaggatcagaaccaatggcagcaatgccagcgatgccgcgcataatgcggccatgatacctgcccatcccaatccggcacgaaaaacatgcctcattcccgcgctatccatcaaaccgcccggcaaagggcatgcttgtcaaaacaggttccggcccagaataataccgaagactgatgacgggacatatcaatgctcgatgtgctgcgggcaatgcgggtttttctccgggttgccgaattgggctcattttccgcggcagcgcgggggatcaacatgtcccaaccgatgatctcccggcaaatcggcatgctggaggatcatttcggcacgcaactggtgcagcgctccacccgccacctgcatctgaccgaggaaggggaggccctgcgagaacatgcccgccgcatcatcgatcagctggaagccgctgaggaagcgattggccggggtgccagacccccttccggacgggtgcgtctcagttcacctactgcattcggcctgtatctgtccgggcagatggccgcctttcatcagctgtatcccgatatcgacattgccctgagactgagcgacgaaaccgtcaatctgattgaggatggacttgatctggcgctgtatgtcggtggagtgcctgaaacgtccatgatcgttcggaaaatcggcagcgcgcggcgcctgctggttgccgccccttgctatatggatgggcgggctgaaccttcctcccctgcgcagttgaaggatttcgactgcctgacctatgccggaccgggcagcgataccgcatgggccttcatcaccggcggcgtctcctcacccctgccggtccatagctggttttccagcagcagcagcgaggccacgcgccgtgccgctctggcgggggccggtattgccgccctgccccattacatggtggagcaggatcttcaggaagggcgactgatcgaattgttgccacaggatcggatggaaccattggccgtgtttgtcgcctatgcctcaacacgccatctggctccacgctgtcgggtgctgatcgattttatcgcccgcaccttcaaaaatgctccgggaacgatctgatttcatcctgtgctgtctgattttggatgaaacaggccgcaaacggcttcagtctgcaaaggacctcacgcgcccatgtcacggaaaaccattctgattgccgcgcctttgatcatcgccgccgtcgggaccggaggctactggtggatgcatcagaaggtggaaaatcgacttctgatggaattgcaggcctttcagaacagactccggcctgacggaagcatgacctattccagtgcggaaccagccttgtggcagcggggcgtcattctgcatgacgtgacgctgcactatcaaacgcacctcatcacggcccgcacggtctccgcccatgacgtatccggcaataccacccatgccgtatccggcaataccatcggacagctcgatctggaggatgtcaccgaaacagagcctgaagagcgggcgacagcaaccgccagacacgtgacggtcaaggcgctgaccatccccgataaaggggaagaagaagcgatggccccagaaaaactgcgctttgaccggttggatatggccgaatgggcagtggttttcctgccccacccgcccaaggccaacgatgaggatgcagagggaaaagaacgtcccgtccaggcccgtttcgaaacctttaccatcgaccactgggggatgggtcagacctccgatcttcgcttcacggggctggatgccctgatcccgcaagcaagccagacggcgcatctgacagtccggcaaagcgcactgaccggggctgatctggccgccctgatcgaggatgcccggcatggtcgccctcgatcctctcttggtcagaatgtggtctttgaaaccagcggcatcaaactggaacagtcctctactgctttttcatgcggacatgcccgttcccgggaaacgcactctgctgccggagatgtggagacggatgttgccgtggaggatctgaccattccttccgttcaggagaccattgccccgctgacgcatacggacatcctgcggcagcttggatatacaagtctgtccggttcttttgccatgcaaagccactacaccgcaggaaaccagacatggcggctccgctcgctgcgggcggatgtccagaaggcaggaaccctgacgatatccggggcgctggtcggtttaccgcctgcagcgctggataccgggggaccgctggcttttcttcaggccagactctctacactgagcctcacatggaatgaggcaggactgatgaaaaacatcgtcaccatgatcagccggcagcgccaggcaacaccggaacaggtacagcaggcaacgctccagcagatggacatgctgtctcaaagtgccccggcgaaaatcatgccggctctggacgcagtgaaagcttttctgcgcgatccacgttttctgagcctttcggcgacgatggatcctccggccccgctcctgtccctgctcaacccgaatgacagcctgttaagcggcatgaccatcagcgccacggccgatcctgtcataaaataatatctccttaggtatactcttcgatatcttacagaattgtcataaaccgggcggaaacagagtaaaatccgacatagttcagcctttatttttgaactgagcggcagatcaggcgttaagatttcgcaatccaccggcatttatggggttgtattcgccatcatggcagacagaagggtatctgtccggattgtcacttgagagagacgggttccgttcatacacttgatccatcgacttcagatgtcttccccaactgatcaactgcggggccggaaaaccggctccgttttttttgcctgccacaaggatgtaaaaaaacacgcaggaatgatgccctaccgcacatgaggacctgcaaaatcgtgcaggatcgtgtatgattgctccagcaatatgacctgcttcgcctgatcggggcgttgagaccggagcaccagaagaaacaatggcagtcgtcgttatcaccaaggctatgaccgatgaggccttcgccgccaccgctgcacagagcagccctgctgccaagcagtttaaaaccggcgatgcggtggtctatccgggccatggtgtaggccgtgtcgatcatgtcggtatgcaggatgttgcgggccacaagatcgagatgatccagatatctttcgctgaaaaccagatgaccatccgcctgcccgccgccaaggtggcaacgaccggcttgcgcaagctgtccagcaaggccgatgcggaaaaagcgattgccgccctgtccggccgaccgcgaatcagcaaggtcatgtggtccaaacgggcacaggaatatcaggcgcgaatcaactccggcgatttgctggcactggccgagttgctgcgtgatctacgccgcaacgcaggcagtcaggatggcagcttcagcgagcggcagatttttgaaacggcccttgatcgctttgcctccgaaattgccaccgtgcgcggtgaggacaaggccgatacctcccagcaactgattgcactgctgatcaaagcgcaacctgcctcggttgccgccgctgccgaaaaagccgccgccaaggaaaaagccgaagccaaggacggggataccgaggcggaagactgatccccctccacagcaggcgttttacccgtagaccgtcatcgcctctccccctggctcccggctcaggggggtcgcactgccggtgatgctgagcgccacggcctcggcaatgcgaataccgtccactccggcggagagaatcccccctgcgtatcccgccccttccccggccggaaacaagcccgacgtattcaggctctgccctgttccatcgcgccggacccgcacgggggaggaggtgcgggtttccaccgccgtcatcaccgcatcatccattgcgaagcccttgatgcgtttgtcaaaagcgggcagcgcctccctgatcgccgcaacggcgaaatccggcagacaggtggacagatccgtcagcgtcacaccgggacggtaggaaggcggtacgctgcccaatgagacagagggccgtccggccagaaaatccccgaccttctgtgccggcgctttataaccaccgcccccggcctcgaacgcacggcgctcccaatgacgctggaaggcaatgcccgccagcgggtccatcgtcgcgtcccccggaaaatcctccggcgtgatcccgaccacgatcccggcattggcgttgcgctcggcgcgcagatactggctcatgccgttggtgacgacatgcccgggctcggaggtcgccgccaccaccgtcccccccggacacatacagaagctgtatacatcccggccgttggaggcatgatggaccagcttgtaatccgccgcccccagcaagggatgacgcgaaaaatccccgaaacggttgcggtcgatcagagcctgcggatgctcgatccgcacaccgatcgaaagcggcttggcctccatatagacgccccgcgcatgcagcatcccgaacgtatcgcgggcactgtgaccaaccgcgagaatgacgtgatcggtggcgatgcgcgctccattattcagcaccacaccccggacctgccggcgaccatccgccaacacctcgatatccagatcggtgacctgcgtttcaaagcggtactctccacccagcgcctcgatactggcccggatacgttccaccatcgtcaccagacgaaacgtgccgatatggggtttgctgatggtcaggatttcctcaggcgcacccgccgcaacgaactccgtcagcaccttgcggccatagaaatgcggatcccggatctggctgtagagctttccatccgagaaagtacccgccccgccttcaccgaactgcacgttagagccgggatcaagctccccacgccgccacaacccccacgtatccttggtgcggggccgcactgacttgccacgctccagaatgatcggacgaaagccggtctgcgccagtatcaacgcggccatcagcccgcatggaccagccccgatcaccacaggtctggagggcagattctggggagcctgcgccacgaagcgatagccggtatcgggggcaggcatcacgcggtgatccgccgcacagcgcgccagcactgcctgctcgtccttcaccgccacatccaccgtgtagatcagcgcgatggaggaacgcctgcgggcatcatagccgcgacgaaacaccgtgctgctcaacagcacatccggcgtaatgcccagccgggcgatcaccgcctcatccagcgcagccgggccatgatcaagggggagtctcagttcagtcaggcgtaacatcggcaggaaaaatccgctttctcgcccggcggcgatatgccggtccggtgcttcagcctgtgctagaggaaaatgcccgttcatgaaaaccggcaatcatgagaggcagacggaaaaacacgccaaccaccggccaccccccgcgttatagtctgctaccaagcatgaccgtacggatcaggagaccatccgcatgaccgaaagcagccagagccgggattcagccggtgccctgacccccgccagtctcagcctgacccctgccgatgccgcgacgctggaagaagccgtccgcgccctgcatgacagtcgcggcctgctggtgcgtggggccgatctggtggcagggctgatcggtcaggcagcgacctttggtatcaaccgcctgtcgctgacgcggcgctatgccgaaaaaatccagggtctggcagaggctgccctgcggcgtgctttcgatgtggccattctggggatcgaccacggcagccgcctgtccagcgcgggaggtgcacgtttcgtcgcagcaaccagcggtgcactgggcggcctggcaggcatggccggttttctgcccgatgcaaccgcgacgaccctcctgatcatgcgcaacatcgccactatcgcccgggaagaaggggaagatctgagccagccggaggcgcgggaggcatgccttcaggtgtttgccttcggggggcctgcgctgggaaggcttggaacgctgtcagaggaagccgataccggatactggtccgcgcgcctgttcctgcagggccgtccgctggtcatgctgttttcagaggtcgccagccgttatggcgtgcggatcggggaaaaattcgccatgcaggccataccgctgatcggggccgctggcggagcggtggtgaataccgtgtttctggatcattatcgcaggctggccaaagtgcatttcaccattcgccgtctggagcggcaatacggtactgtagcagtgcagagtctcgctcgcacgatttccgaccgtatccgctatggcaatgccctgccggaggatgcctcggcggctgcctgatttgattcttcccatgattgacaaggggcctgcttccatggtcccccattgcccatgagtcagaaacgccacggcccgatatggctgctccctgtcctgctcatgatgctggtgatctggccggcttgcctgcgggcggaaaaccgggcggaagatgcagcccctccgcgccctgccccgtcatccctgacgcccgatcagaccaaagccgcgctggaagtgctgggggatgcccgcaaacgggacgaactcatcaggattcttcagacgctgccaacagacagagccgacaaggcttcttcctccgaccgggcgcagccacccaaagcggctgatgataaagcgggccataccaatccagcggctgcaaccacccccccgccggagcagactaaaaaagacacgccgacaacgccgaatgcagcctctgcaaaacccgatacagccgggcttgctcccaacagcctgggcgcggagttgatcaaatcgtccggctcggcactggatgatgctgctgtcaggctcaagcattccatacgctccatcgcggaagcgccgcttttttattactggctgcaagggcagatgagccagccggagcgaaagctgttgctggtgcgcagcctggtcgcactgactgcctgcatggtggcgggtggtctggcggcatgggggaccgtcgtgctgacggcgccattcctgaaccgtctgtttgcccgacatgccgcttcatcctccgctgaaacagaagagggttttctgccatccgaatcatcggatgaagatgcagaacaggtggatgaggaggatagagaggaagaaacccctcccgagcggtcgcaacagcatattcatgcggaacgggtcctgtctcgttttccctccattctgctggcagccatcatcaccgccctgccagttggtgcatttctggtgacggcaggcgcgcttttatggctgaccacctcccctgaaattcgcggtcctgcaacggcctgtatcaaggcaaccgttttcggtgccatggtactggtattgggacgcaccatgctgcgcccggagacaaaagccctccggctgatcaggatacaggactccctcgcgcaatatggctatcgctggttgcgacgcctgatcatcgtcgagacgatcggggccgccattgccggaatcggtgccagtctgggtctgtataatcttgccgtcgaggctattctcaaaatcacggcactggccatctacctctgtctcgtcatcatcatcctgcaaaaacggacgtccgtggcgaagcgcatctcccatggtgcggaaggccggggatcatgggcagcgctgcgccgtactctggcccccatttggcactggccagccctgatcggcctcgcagccttctggctggtctgggctttggaaatggaagacggcctgcacaggctggcacatggcgccattgtgacgatttccatcctgacagcggcaaggattatctcgctgctgctgctcggcctgctgtcacgcattgtccgaccatcccccgagagccgcgaacggcatccggaaatcgcgttgcgggcggatctctattatccctatctgaaacggcttctctccgccttgctggctgtggccacgctggtaatcctgctgcaaagctggggtattcccaccctgatatggttcaatcagggtgccgtcggcagtcgtcttctctccgcgctgattaccatcggcgtgacggtcacgctggcggtcatcatctgggaaagcgtcaatatcgccagcgagaagcatctcgcccgcctgaccgccagcgcccagtacgtgcgcagcgccagaatgcgcaccctgctgcccatgttccgcacggcactgctgatcgtcattctggcgatcatcatcatgaccgtgctgagcgaaatcggcgtcaatatcgctccgttattggccggtgcaggcattgtcggcgttgccatcggcttcggctcccagaaactggtgcaggatctgatcaccggcattttcctgctgctggaaaatgccatgcaggttggagacagtgtgaccctgagcggcctgtccgggacggtagagcatctgtccatccgcaccattcggctgagagcgggggatggctccgtgcatatcatcccgttcagctccgtctccaccgtgaccaatgccaatcgcggtatcggcaatgctgccatcagcgtgacgctcgcactgggggaggatacagcgaaggtcagccagatcatcagggatatcggtgccgagctgcgagaagaagaagaattctccgacaggatcaccggcgatctgagcgtattcggcgtcgataaagtggatgcctccggtgtcaccatcaccggacagattccctgcaccgatacaggtcgcaccccggtgctgcgcgaattcaaccggcggatgtatcagcgttttcaggaagccggtatccgcttcgccatcccacagcaggctgtgaccgtactctctggcgatatacctgacgccacaccaacaggctgaaaaccatcgaaaaaaggcggcgccatcacaacagcgccgcctttttcatggtcctgcactattgcgagatcagaaataaccctcgcgcttcttatgttccatcgaggcgctttcatcgcgatcaatgatacgaccgccgcgctcggaaaccgcggcattcgacaattcttcgatcacgccatcaatatccgtgaccgtgctttccagcgctccggtcagcggccagcaacccagcgtgcggaaacgcaccatgcgcgggcggatttcctcacccggcttcagatcaatccggtcatcgtcgatcatgatcagtgtgccatcccgctcaagcacaggacgctctgccgcataatacagcggcacgatcggaatgttctcggcccggatgtattcccacacatccatttccgtccagttggacagcgggaaaacgcgcgccgtctcccccgggccgaggcgggtattatacagatcccacaattcagggcgctgcgctttcgggtcccatgcctggctggcactacggatagagaccacacgctccttggcccggcttttttcctcgtcacggcgggcaccaccgaatgcgaaatcataaccgcctgctttcagagcctgtttcaacgcctctgtcttcatcacctgcgtgtagatggaggcaccatggtcgaacggattgatccccgccgcacggccttcctcattggtatgcacaatcagcttgataccgtattccttggcgatgcggtcgcgaaaggcgatcatctccccgaatttccatttggtatcaatgtgcagcagcgggaacggcatcggcatcgggtaaaacgccttgcgcgccagatgcagcagcacggaactgtctttaccgatcgaatacagcatcacggggtggcgtgcttccgcaacgacctcacggatgatgtggatgctttcatcttccaaccgcttcagcggggaggacggatcgagcgtggcggctttcgtggcggtcatggtcagtccgattatggcaaaagtgagtaacagcgtatcgtccaggcggggctttacagggtcgttttatccagcgcagaagccgtcttatacaggccgccgccccagcaccagccacccatcccactctgcgcctgcaacagctgcgcggcatcacgcgcggcatcgggatgatcgaacaaggtgaagcaggttgcccccgagcctgacatgcgcgtcaggcgggcgcctggcaacccttccagagcatggagcagtatcccgatggcgggacaaagccgcatggcgggaggctgaagatcattgcgggataattgcagatcacgcagcagcgccgccatgtccggccagcgtgatgccagcgtggcctccggcgtgaaaccgtgctcacggttgcgaaacacctccggcgttgacaccggcacacccggattggccagcaacagaccgatctccggcatggcaggcagcgcctccaacctttcaccgataccacgcatccggtaggtgccgggttcgagacagaccggtacgtcagcccccagcgaggtcgcaatacggtgcagatcctccgccgcgggagataccccccatacacggctcaacagccgcagcgctgccgcggcatcagaggagcctccaccaatgccggatgcgaccggcaggcgcttgtcgagcatgatggttccacgcggtttgatcccggcaagcgcagccagtgcacggcccgcccgtaacaccagattatcgggctcggcccgcagcgtctctgcccccggcccttccagctgcaaacccaacccggccgcctgatcgccatcccgatagcgcagcacatcacaggcttcggcgaagaccgcgagactgtcgagcagatgatatccgtccgaccgcctccctgtcacatggaggtacaggttgatctttgccggagcgaaagcaacgttctgatcaacgatcatgagtcagggggcaattttggtcgtggacgcatccgcatcctgattcgcctgttccaaccgggattcaagccgtggccgctcggtcggatcgggattgaggctcagggcacgctgccattgataacgtgcttccagcttgcgccctgtctcccagtaggcatcgccgagatgaccgttgatggtcgggtcattcggcaccagctccgccgcgcgttccagataacgcaccgccgcgcgccggtccccctgacgcagcagcacccaaccaaggctgtcgatgatcgcgccgtcattgggcctgatctccactgcacgctggattagctgacgggcacgatccagatgcattccctgttccgtccaggaatatcccagatagttcagcacggccgcctgatcgggagacaggctgagtgccttctgaaaatccgcctcggcccgcggccattgatgcagccgctccagcgtcaccccacgattgtagaacacactccaatcatgcgattgcgggtggggcagcagagcaatggccttgtcatacgcgttcagggcggcttcgaactgctgcttgttacgcaggatgtcgccacgcaggaccagcggaaacgcaaaactggggaactgcttcgacagcttgtcaagaatggccagcgcctgatcggtatgaccggtttcatccagcagcaccacccgacgcacctgagccagaggagccaacggatcgctgtccttgataccgctgagctgttccaatgctccttgcttatgcttgtcagcatcgagaatatcggcggagagcagcttggcttccgtaaaatcaggacgcagatccagagccatgcgcagcaacaggcgagatgcgtccgccccttccggctgctggcgcagcgtcgcggccaaggccagataggcctcggcaatgccatctgcgggtgtggggacaaccggcttcgcactggcttcgatcagcgcagggatcgccattcccagcacctctcccccacttcccagattgttcaacagacgaatggcggcttcagggtgcccttctctggtttgccagctggccatgatgcggaccagacgcagattctccgcccccagactatgggccgcaatgtcatagaacgaggccgcttcctgcttccgaccggcctgatcagcgatcaaggctgcatgcagcgcgtagataccctgaagctgtccgccctgaatatgcggcagcaaggttttcaatgcaccattgatccggtcggcgccagcctgtgtccaggcggaaaacaggggctgaagaagctgggtcaaaccattctgaccgatgcccgcatagcgctgggatgctgcatcccaatccccatcccgcacggaatcattggccagtaccaattgggccgccggattttcgggcagttgccgggccagattaacggcctccggccgcccggccatgagacaggcgataaaggcctgccttaccagatcacggttacccggatcggctttcatcgcctgcaacagcgaatcggctgcctgattgaaagccccctgcaatgctgcatgtcgtccggcgagaaaatcaccgtacgcccgcgcgctggcatcctcggcagcactctgatgcgcccccgcagaggatgaaatatgcagcaaatggccgatccccgaagacgacccgcttcctacgccagaagcagcacatcccgctaacaaactggctgccagcaatatgccgcgcctccatgttgtcctcatgggtgtcatggcgggtacatttccggcccggctcaaaaatccgggaaatcgcatatccggcaggagagaattctgtgacatgcacggcatcttatccatccccagccccgccgccaatcggcaggaagaacagtttcttttcttcgcacttgcatctgtgcggtttcggtcggaataaccgctcatggatgcgctcgcggctttgcacctgcaactggaatggggggcggacgaggcactcggtgactcgccggtggaccgcttcaccattgtcacggcccctgctcaggcgcattccggcatcgcccctgcggagctgcaaacggtgccagccgcagccccacatcctgaaccgcacagtgtccctgtccaggccgttcaaagacccgcaccctttgcaggtaccgcatcactgttaccgcaacagggtgccgcccgtctggcggcggatatagcggccgaggcatccactctggacgctttacgcgctgcgatggagcaattcgatgcctgtccgctcaaggccacagccacgcagctggttttttcagacggcacctatgaagccgggctgatgctgattggtgaagcacccggggcggaagaagaccgggccggaaaaccgtttgtcggcccttccgggaaatttctggaccgcatgctggccagtgcagggatgacgcgggaacgggatttcgtcattgccaatctgattccatggcgcccccccggaaaccgcaacccaaccgaaaccgaaattctccaatgcctgcccttcctgctgcgccatatcgcgctggcgcgcccccggatgctggtgtgtctgggaggtgtatcggccaaggctctgaccggcagcactgtgggaataagacggctgcgaggcaaatggacggatattaccatccccggactggattcgccgttgccgatgctgccgatgctccatccggcctatctgctgcggaatccgggtgccaagcgggaagcctgggcagatatactgacccttcgaaaagcactggatggctgatatgctaccagagcatatttttgctgaaaccgttgaaaaacgttgcgttccccccttcacgaagcgatttggcaatgatatttgtcgcgctgtgaagccctgaaagcttgcctgcaccgcttttggcgtgtagcgcacccccatcatgcgtgggatcagacaatcgatctcccgactggcaggtgcgcgtgccctgctggcgggagcggcttttctggccagtgcggccagtgggcatgctcagtccatggatgaagtggcgatggcgatgccgcggatccatcctcctcaattcggcgtccccgggctgccgcaaccgctgtcgcccagcgatgcagccctggtacggcatattttcgatgcacaggctcatggcgacctgacggaagccagacaggcgaccgacaggcttgatgcgaactttccactcggcaaggccatgctcggccatatactggctgaccgctatctgggttcgttccacaaaagcacacctgccgagctgaaagactggttggcccattatccgaaccatccttccgccccggcaatccatgctctgctgctgaccaaggcagacaaaaaggatacgcttcccccagccccccagctggtcaccttcgacccgacgcccggcaacgaccccgttcccgaggatgacacgcctcaggatctgagcttcaaacgcctgccgggactggatcacagcgttcatgaacgtgcaggctccggccatgccgatgcagccctgcggatgattgccgccaacacgtcaatctccgcaacttacggggcacagcttcgtgccgaagtcgcgcaaattctgttcacactcaatcaggacaatgaagcgctgcggatcgcgctggacgccgaacaacaggggcatggcaaggtcgggctgggcagttacgtgtccgggctgctgctatggcgcaaggccgagtatcaacaggccatggcgcatttcgaggcgacatggagcgcggagatgacgtcagccgccattcgcaccgccggagcgttctgggcggcacgctcccatctgcgcagccacgatccagccaattatgctgtctggatgcatcgggctgctgagcagccgcgcacgttctatggcttgctggcccgtcgtgttctgggggtggggatcgaaggttcactctccctgaccagagaaaccctcggcacggccgatctggaagccatctcggccaccgaagccggaacaaccgccttcgccctgcttcaggtggagcagccggatcgggcagagcaggaattcaggcgtctggccgggcaatcgcgcgataataccgccatgatccacgcgctgatgctggtggccgacaaggccggtctgcatgatctcagtgcccagcttgcggcccttaatcaggcagccgatgggcatccgcatgattatgcacgcttcccggtgcctgccctgaaaccacagggcggtttcagcatttctccggcactggtctatggcctgaccagagtggaatccaacttcaacgcctcagccgtatccgccgtcggcgcgcgcgggttgatgcagttaatgccgcaaaccgcgaattacgtcgcagagacacataccggtgcagcacggctccatgacccggcggtcaatctgaagctgggacagcgctacgtggcctatctggcggatagcgatgtaacgggtggagacctgctgcgcatcctcgccagttataatagcgggccgaacagctttgcccgctggggcgcccagatccagcatcatgatgacccgcttctgttcatcgaagccgttccgctcgcggaaacccgcagcttcatccagcgtaccctgacatatagctggatctacgcggcgaggcttggcattgacgcgcccggtctggacgaactggcagccgggatttttccgcatttcacggcgacaaccccggacagccagagcctgaaccgtatgaaaatcagacttcactgaacaaagcagcagaggtgattttcagaccttgcagtgccatagctatcttttggcaagactgccattctcgttcataagcagccccagatgcatagaagcgatacatcgcctgattaatatcaacaatgcctgccaccagttgcaggcaaagctcgacacccaatgcgaatgcgtgaaggtaatgacaacccttattcccggcttgatgggaaaaaggattattggctgaaaattctttcagccgatcaaccaggggtgatggcttgcagataactattcctgattcctgcagtgcattttctgacattggtgtataatttttccaaattccaaaaaatgcagagaaaaacaaaagattttttgcagcaccaaatcatcttttcaacatgatacgagctgtctttttccagcatcgcgacatgatgaatattaccctcctccgataaccgaatgatacaaggcgggtttttggggacaatatctgaacgccttatcaacccggtctacgcacacatttgatactcacagcgccgtcagattgctctaagaaagaatccttcagatgtatcaggggagcttgcggcatgtcgcgcattgatgagaccagagcctttgtagcggtcaacattgccatcctgacggtttccgatacccgtacgctggccaatgatacgtccggagatgcgcttgccacgatgatcggggaagcaggccacactgtgttcacgcgggaaatcatcaaggatgatgcggatgcgctggaggccactttccgcggctggatcgccaaccccgaaatcgacgtgatcatttcctccggcggcaccggcgtcaccggtcgcgatgtcacgccggaagcactcgaccgcgtgctggaaaaaaagatcgaagggtttggcgagttgttccgtatgctgagttaccagaaaatcggtacctcgacgatccagtcacgcgcgttggcaggcgttgccaacggaacctatatctttgcgctgcccggcagcaccggcgcggtgaaagatgcctggcaggatattctgcgctggcagctggatatccgtcaccgcccctgcaattttgtggaactgatgccacgcctgaaagaacgttgagccatcactctgtcagtttttgtgccgtgatacggtcaatgatctgccgtcttgcggcacgcccctctgccagcatctcctccacctcggcgcgtatggcaggaggcgcctgttccggacgcccggactggaatggcggtgccggcgcatattccatctgaagctgaacggactgggccaatgcctccccgctcatggcggcgatgacactgagcgcaaggtcaagcccggctgtcacgccgccgccggtcagtagctttccatcccgcacaacgcgcgcctgcaccggctccgccccgaaagcagccagaaaatcatgcgccgcccagtaggtggtcgctttcttcccgcgcagcaatcctgccgcccccagcaccagcgcccccgtgcagacagagcagacgaagcgtgccgtttccgcctgtttgacgagccagctcagcacctcccgatcttccagcagagcgttgatccccctgccgccggggatacagatcacatcaagctggggcgcttcggaaagcttcgtgtcggcctcgatacgcataccgccttctgccatgaccgggccggtctctttccacagcaaatgcacctgcgcatcggggacatgccggaaggcctcccacggagccgtcaggtcgagctgcgtgattgccggaaacaacaataccccaatatgaattgtcatttgccttcctcctgcacggtcttcctgaccggagacgggacggggatcgtcatggcgaagcgccgcgccagcgcaccataaagggcgcggcggcacaccaaacgcgacaccgcaaacgccatcatcgaagtggccatcaacggtatcagcatcgactgattatccgccatctccatcacgatgacggccgccgtaatcggggcctgcaccacaccggaaaaatacgccaccatccccagcagcaccaccgatccggcggcaaggcccggcaccagccgcgcgacccattccccaagcccggccccaatagcaagggaaggcgcgaaaatcccgcccggaatcccgctgagataggatgcggccgaggccaccagtttcaacagtgcgaatttcagcccttctgtatcgcccggaaggccggtcaccatatcacgcgcctgctcatatcccgtgccgtatgtctcaccatgagagagcaggccggtgatcgccacgatcaggccgcacaatgccgcaaacagcaccggatactgtttcaccaacctcccgagcgccccaggaaagcccttcgcggcacggatcagcaaggcactgaaagaaccacccagcaggccccccagtaccgcacagatcaccatggccatcacttccgatggtccgaaccgcatcgtcgcatcaatatggccgaaataactgtaattccctaccagagcgatcgttacaacgccggaaatcaccacggccgccagggtattgccggaggttctggcctcataggaatggctcaactcctcgatcgcaaacacgatgccggcaagcggggtgttgaaggcagcggcgatcccggccgcgccccctgccagcacaacgctgcgtcgtaattccggcgtcggcagatgcagcaagcgacccagcgcatgcatcacggaggcccccacctgcacggttggcccttccctgccgatagaggcgccgctggcaagacccagcagggtcagcagaattttaccgacagcgatgcgcagggacaaaatcctgtccacctgccgcacatccgccagatcaagcgaggcaatcacctgcggaatcccgcttccctgtgaaccggggaagacatgtcgcgccagcagaaacgagacaaccagcccgcatggcgccagaatcagaatgatccaggcaccatgggcgatcaccgcgctgaacacatcctgcgcccggtccgccagttttgcgaacgcgatggcggtcagcgaaactgccacggcaccaccccagaacaccatccgccgcacccaaagccgtgtggacatcatcggcgaccgccttagccgccgcgcccgggccgagcgtgtcatgcggcgcactgaatcagacagggatgaagcactgtcatgctctgttccattcgagcatggcgtatccgattgttcattcattgttctggactccttgcccggatcgcattaatctgcaaaaagaacataaagggaacaaacgatgggccgccaatcgtcatccccccattcagaccatgcctgtgacgccgccatgccatgcccctctcatgccccgatggaactgcctgaggcaatgccatctctggccagaaaagggcgaggcgctgtatcggaacccggtatccgctatgaccgttaccaacccgttccatgggatgatggctggggtagtctggaagatgcccaagccgcgctgccgacgaccctgatccgcgacagcagccgcacggctatcagttggaatgacagcccggatatcggtttcgatcgtgccatcaacccttatcgcggctgcgaacatggctgcatctactgcttcgctcgccccacccatgcctatctcggctactcgccggggctggatttcgaaaccaagcttctgttcaagccggaaatcgcctccctgttgagcaaggcgctcagccgcccttcctacgtgccacgccccatcgcgctgggcagcaataccgatccttatcagccggtggaacgcagcctgcgcctgacccgctcgatcctcgacgtgctggagcggttcgaacaccccgtcaccatcgtcaccaaatcagccggcgtgctgcgagatcgcgatattctggcacggctggcggagcgaaaactggtcagggtctatctctctgtgacaacgctggacccaaccctgtcccggctgatggaaccgcgggcggccagcccgtccagacgtattcagacccttgaagccttgcaacaggcgggcattccgaccggtgtgctggcagcacccatgattcccggcctgaacgatgcagaactcgaatccattctggagcaggccgccaaagtcggggccagacaggcaggctatattctgcttcgcctgccgcaggaggtcgcccccatgttccgggactggctggagcatcacttccctgccaaagcccgtaaagtgctgaacctgatccggggcatgcgaggtggaaagctgaacaatgcggaatttcatagccgtttccgcggggatggtccctatgccgccatgctgcgcagccgttttcagcgtgcggtcaaggcttacaggcttaatacagccatggaaccgctggacgtgacccggttctcacatgccgcacaaaactcctcaggaacggatgaagcagtctccgatccatccagcccatcaccatcccagcttagcaggcaaaacacgaaacaggccgacagacaggcgcggcaactgtctttattttaaaatcagcaagagcctgctgaacactatctggcagtccgtggattcggctgcctgagaaaggcatgcccttttcagcaaaagcagtcgcagccccgtcatgtcggcagtcgtgaatcacggagggagccgttgaacgtatatgcacccttgcttcacgccgtgaatgtcggcggcaccggcaaactgccgatgacgacgctgacgtagatatgcgagacaattggattcaaaaaagtcaaaacctataaagcaagaagacagagcagcaggtgcgatccgcccttgaagatcagctctatgtttacgctggcaaaagcgtgggggtgatcgtgcggaccgctaccgagatcgccgacacactggcccgcaacccttttacagattcacccgacaaccgtgtcatggcgttgttcgtcgatcgggtgctcccagccgatccactcgatcatgtccctgggctcaagaatgagccggtgcgatcgggaaaacgagagcttttcgccctctacccggacgggatggcgcatactcaccttcacctacccctcgaaaaatcgggaacagcgcgaaatatgaacacggttgcaaaacttgcggagataacggcagtcatgtgatccggtcgcatcctctcaccccacctttttcaactgcaccgcatatttttatgacgtccgggattccacgacgcggaatccgtctggtaaggcaaagatgcgactcggcggttcaacagggtttgaaggctccgccagaggctttgcatctcctgccgctcttgcgtgcagggggctgagagggggcggatgcagatgccggatgacaggctggaaagagaagcaggcgggcttgtcgcaggggtcgatgaagtcgggcgcgggccgctggccgggccggtggtcgctgccgctgtgctgctgcctgcctccggttttccggctcatctggccggactcatcgatgattccaagaaactcgatgctgccgcacgggatcgggcttttgcggccctgctggctgaaccgggaatcacgataggcatcggcgcagcctccgtcactgaaatcggccgtttgaatattctgcatgccagcatgctggccatgcggcgcgccgtcgaacgtctgccgacgatccctgatctggcgctggtcgatggcaaccgcgcaccagctctgccctgcgccgcccgctgtgtggtcgggggagacgcaaaatgcctctccatcgccgcggcctccatcatcgcgaaggtggtacgggaccgtgccatggcgcggctcgcccgtcgctatcccgtctatggctgggaacgcaatgcgggttatccaaccccggcccatcgtgccgggctgacagaattcggccctaccccgcatcatcgcactgcattcggactggttcgccagttgctcgccatgcggatggaggccgtcgtatgacattacatttcataccatcagcattgacgccctgccgggcgcgtcggcacgattgagcggggtttctggaatgcgacgtttgaacaccgtcagcgaactgccgatcgatcaggtgctgctgggcgactgcgtgcaggtgatgcagatgctgcccaccggctcagtggactgcatttttgccgatccgccctacaacctgcaattgcggggagaattacggcgtcctgatgaaagcatcgtcgatggtgtcgatgatgactgggaccgctttaccgattacgcggcctatgatgcgttcagccgggcctggctgaccgaatgccgccgccttctgcgcaaggatggcacgatctgggtgatcggcgcgtatcacaatattttccgcctcggcaccattctgcaggatctcggcttctggattctgaacgatgtggtgtggagaaaagccaaccccatgccgaatttccggggtcgccgcttcaccaatgcgcatgagaccctgatctgggccgcacgcgggcaggatagccgccatcgcttcaactatcaggccatgaaaaccctgaacgatgatgtccagatgcgtagcgactggtttctgccgctctgcaccggctccgagcggatgcgtaacgatcacgggctgaaactgcatccgacccagaaaccggaaagcctgttatatcgcgtgctgctgtcaagcacggtgcccggtgatgtcgtgctggacccgttcctcggaaccggcacctctgccgccgttgcgaaacgtctgcaacgcagcttcatcggcatcgaacgccacccggcctatgccgaggccgccatcgggcgccttcgctctgtcgagccggcaccgctggataatctgaacatcatgccctcccgccgggagcagaaacgggttccgttcggtagtctggtagagcagggattgctcccgatgggcagcatcctgatggaccgcctgcgtcgggtctcggcgctggtccaggcggatggctccatcgccagcggagcgcatcgcggctcgatccatcaggtcggggccgccgtgcagaatgcgccgagctgcaatggctggaccttctggtttttcgaactccgcggagaatgggtgccgattgatgtgctgcgtgatacccaggcgccccctccggtcgaggagcaggaggatgttcagccacaggcggcgcaggagcgttcctgacagacctttgatccggcggtcatgaaatcgtacggattctgccacaaagatgttataattcgggcgttccctgatcaggcgttagtctgaaaggacgctcgatatgaaaaccatggtgcgggcttttaccgctcttgcggtggctgccgctctcacagggccgctgctgacacccgccaccgcccatgcatggtggcgcggcggcccgggctggggtcctccgggaccgggctggggtgggccgggctggtatggccctcgccatcactggcacggccccggctggggtggtgtcgccgccggtgcggtcgccgggctggccttgggggccgtcattggcgggatggagcgtccttactatgcaccgcctccaccggtcgtttatgcaccacctccaccgccggtgatctatgcgccgccgccggtcgtttatgcacctgcaccggtctatccgttttttccgggctattaagacgcgcgcagacggctgacgaagcgaggcgctgctggcagtataattgtcttgccatgccacagactgtcgtagcgccatcgtgaacacccctctgacacagccggataaccggacccgcgcctttattgccgttctgtccatcgagttgtgggaacgctttggctattatgccatgcaggcgatcctgctgctgtttctgatacagaaactgcatttttccagccatgatgcggtgctgctggccggggccttcgccgccagcgtctatgcgacaccggtgctggggggatggctgggagatcgggtattgggggcgcgacgctgcactctgagcggtgccgtgatcctgaccgccgggtacagcctgctgggtctgcccaccgcatggtccgaccctgttcttgacgaaacatcgctggcttttgccgcactgggcatgatttccgttggcaatggcctgttcaagcccaatgccgcggcgttggtgcgggtcattcacgaagggcaggaccagcgtctggatgccgctttcacgctgtactacatggcggtgaatgtcggctcctctgtttcaatgctgctgacaccatgggtgcagcaacaggcaggctggcacagtgcttttgcagtctcttttttcggtcttgctctgggaattgccggttatggcatgatgcgatcatcgctgggccggacaggaaccgagaaggaccaccacccggtcccgctctcgcatctcctggcggtgagcgctggctgtgcattcctgatcatcggcatcgcgctactcctgcattccgcatcgcttgcgatgtggtgcaacatggcggccgcccttggcgtgctgatgctttggagcatctgctatggccgcgctgcaccagaggagcgaccggggctggcaatcatgtatgcgctggccgggcaatcattgatgttcttcatattctatcagcagatgtcgacatccctgacgctgttcaccgtgcatggtgtctctccggcgctccgcctcggcggccacacgctgatgacatggacaccggcgcagtttcaggcgctcgacccgatctggatcatgctgcttgggccggttctggccggtttatatacggttctggcgcggcgaggccgcgatgtcagaatcgccgccaaattcacggccggttttgtgagcgttggcaccgcatttctgatctggtggggtgcggcccgtatcgccggaccggacaggctggtctcgccatggatcatggtggccggatatggagcgctcgcattaggggaattactgatcggcggtctcgggctggccatggtcgcgcgctatgtgccgaagcggctgaacagcctgatgatgggcagctatctgctgaccatgggtctgtcgatgtatgcgggcagccggatcgccggcatcgctacatcctccttctcaagccagacagcacagacccctgccgcgttcgtcagcctgtttggcggtctgtccgtcgcggccttcctcgccgctttggtgtgtttgacgatggcaccatggctgcggagactggatcggcagcaccgggcatttgccctccccggcccagcgccacacatttcatcatgacggagggcagcgcctcctcatccagcaaggcaacggaagcacttttctcctgccgtgccggatcggcccaaagatgcccgacctgcgccgcatagacggtgaggtggagcgcgaaatgcgtgaacacatgcgtggccacaccgagctttcgccagccggtttccgctttgggggcgtggaataaggcatcctcttcctgccatacagtgtcctgccagggcgttcccggcagttccatcatgccgcccaacaggccccgctccgcccgacgtcgcaacaacacattgccctgctcatccgtcagccagaaatgcaccccgtatcgctgcggcctgagttttttgggtgccttgcagggaagggaggcggcaatcccctgccttcgcccctcgcaataccgcatccacgggcaaagcgcgcaggcgggatcgagcggtgtacagatcgtcgctccgagatcgaacagagcttgcgcgaaatcggaaggctgttccatcgccactggatcggtccccagttgcgccgcctgcgctgcaatcaacggtctggattgaggcaggggcgcctcaatggcaaacagacggctggtaacacgctccacattgccatcgaccggcaccgcgggaataccgaacgcgatcgcagccaccgccgccgaggtatacacaccaatccccggcaggctccgcaaagcctcgatatctttcggaaaggcccccatcccggcaaccctgcgcgcacaggccagaagattgcgtgcccgcgcgtaataaccaagcccggcccaggcggccatcaccgcctcatcctcggctgcggccagagcctgcaccgtggggaagcgggtgatgaaacgctcgaaatagggtatgacggctgtaacggtggtttgctggagcatcacctcactgagccagacgcggtaaggatcgggggtttcccccggcagcgcacgccatggcaaggagcggcgatgccgggcataccactccagaagcgcagaggcaggcggaatgggtaatcgttccaaggaaaaatccgggatcaagggcggcacggatgccgatatgcggcaagctgatcccttgcgccagccccgtaacggcatggcgcagccctattttcagcgcggcccgcgcgccatctcggccctgctgcccgccattacccgacccgtgtttcgtaaaagtgctccgggcctcgctactattttgtccgaatggacgaccattgccgggccggttttgtcctccaccgccacaccgcgcaagctggccaatggcacgctggtgctgggctgcaccgggccggccgcgatggaattgcaacacagtacgccgcaactgatccaacgcatcaatttctttctgggcaacaaagcggtcgagcgcatccgtctgacacaggaagcccccccagcacctcccacagttcggaaaaacccggcccgggccgaaacacctgctatacgcgccgctgtggagcgtcgtctggacggtctgccggaaggtggattacgcgatgcgcttgcggggctgggcagcgccatgctgagcaaacgctgacgcagagaatgccccgactcgtcccctgacatctgatggggtgacggcgacgcgcattggcggcaaaaccccgttactgggtaaagaagatattgacgaggaacaccatgtccatcacccgccgctctttctgcacggccgctctgttctccctcccgctgattcaggccgcccgcgccgaagcccccgccacctctggtggagatctgtccagtttcctgtcagagcgctctatcggcaaagccgatgccaaggtaacggtgatggagttcttctccctgacctgcacccattgcgcggctttctcccagaacactttaccggaactgatcaagaagcagatcgataccgggcatctccgcatcgtgttccgcgatttcccgctggatcaggttgccctcagcgccgcgatggtcgcccgcgccctgccgcaggaacgttatgagccgttcatctccgcgctgttcgccagccaggatcgctgggccttcaaccgcgatggcaatgtcacagagtctctggcgcagatggcactgttggccgggttgtcccgcgccaaattcgatgccgtcatcaataatgaggctctgaaacgcgccatgctggaacggcagcaacaggagtccatcaaatacaacatcaacagcacaccgacctttgccctgaccaacgggaaaacgcagtccggcgcgctgtcctacagcgatttcgtgtccttcgccggcctgtcctgagtttcagccccccatgcctgtcagcttctcccgcctccgcattgccggtttcaaaagcttcgccgacccgcaatccattgagatcctgccgggtctgacaggtgttgtggggccgaacggatgcggaaaatccaatgtcgtggaagcgctgcgctgggccatgggggagaactcggcccgtgccctgcgcggcggagagatggacgatgtcatctttgccgggaccgcccatcgctccagccgtaatctggcagaggtggtgctgtcgctggaagatgttgccggtcaggctccgcccccctttggggaggttccggaactggaaatcagccgccggatcgaacgtggcggcggcagtacctatcgcatcaacggtcgcgaggtccgggccagagatgtacaaaccctgtttgccgatctggccagcggcgcccgctcctctgcaatggtcagtcaggggcgggtcggcagcatcgtcaacgccaagccggaagagcgcagagccattatggaagaagccgccggcatcaccggccttcatgccagacggcatgaggcggagctgaaactccggcaggccgagaccaatctggaacgggccgaggaactgcgcggtcagttgcaggaccagctcggcggtctgcaaaaacaggcgcgacaggccagccggtatcgcaatatctccggcctcgtcaggcaggcggagctggaatggctgggcctgctgcaagcgcgggccatggcggcgctggatcaggcctccacggcgcgtgatgcagcccgcgctgcgcttcggcaagcagaacaacaggcagaagccgccacgattgcagcttttgaggccgacaaggctctccccgcgctacgcgaggccgaagccgtggcccgtacggccctcgaacgccgccgcatcgccctggaaggacagatgcaggccgaagaacaggcccgcaacgcactcgatcaggcgcaggcgcgtctgcatcaggcggaacaggatctgcatcacagcgaagacggtctgaaagatgcgactgaggcactcgaacggttggccgcagaagaacaggcgctgcgtgatactctgatcgccctgcctgcccggcaggaagaggcagagcgggacgtaaccgctctggaggaagaagcagaccggctggcgcaggctgccgatctcgccactgcccgggccgcagagggcatggcccaggccagaagcgccgaggctgatcgcgccgccgccgaacagcgcctgcaggtggtgaatgcggagcatgcccgtctctccgccgcgctggcggaggcccgtgcccaattggtggaagaatccatcctcaccaccgcgcaggagagcgccgccacggcaaggctggctgtcgaagaagcccgccgtgctctggagcaggtggaagccgcccgtccaccgctggtggaacgctacgaagccgcacgccgcaccctggccgatgcacaggccctgcgcagccagacggacatggttctgaaagatgcaggcagccgggctgaaaacatcgccgcccagaccgaggctctggaacgcgatcacgccgctgctcagagccaacggattgaagagaacgcgctgcagggcgccagacagacagccgaagctgccgccgccgcgcttgaaacggcacggatcagacaggaagaggcggaaaccgcactggcacaggcatcagcataccatgccgaagcgcagcgtgccatggaaaccgcaagcagcgaccgggaacgtgccacccttgccgccggacagagcacccgccgcgctgcccagatcgaagaagaacgccaatccgttatggaggaacaggccagagcagaagcctccctgccgcccacggagcaacgtatcgcggcagaaacagcgctggcacaggccgagcaggctctggccatcagcgagcagaccttggcatccgccgaaacggcccggatcgctgcccgcgcggcacatgagcaagcgcgtgagacccatgccaccgcccaggccggtctcgggcggttgcaggcagaggttgatgggcttgccgccttgctgcgtcacgacgacacggccaaaggcggttttcagcccgtgtccgatcttttgcctgtgccggaggggctggaacgcgctgtcggtgccgcgctgggggatgcgctggacagcgcactggatgaagccgccgatcgtttctggcgcagcctgccggcagcaccggaccggatgcagcctttaccggccggcacagtgccattatcctcattgatggagccgcccgccgcgctacgccttgcctgcgaccatatcggtatcatcgccgatccggcgacgggaccgtcgttgcaatccagactgcatcccggtcaatgcctcgtttcccgcgacggcgcgctctggcgctgggacggacattgtatagccgccggggcacccggtgccgccgccatacgtctgacccagcgcaatcgcctgctgacggctcaggatgcgctggcgcaggccaaacagggggctgaggcagcgttgcaggcctatgcgcttgcacagcagcaggaagccgcctccatcagcgccgaacaaactgcccgcggcaaccgccagcaggccgagaaacaggctgccgaagcccgtaatgcccattccaccctggcggctgccatggagcgggtcgaaagccatctgaccgccctcgccagccgtcgcgcccgtctggagacagagcatcaggaagcgacacaggccgcgcaggaagcggccgctttgctggctgctctgccgccgctggaacagatgcgacagcaggcccaggcagcggccgcgacccttcaacaggcccgggaagcactggacaatgccgcggcaaggcggcgcgaggccgatcgcaccatgcagaccacacgggaagaggccgcccgcctgtccgccagggccatggaggcagaaagccgtctgggtgcgctgtcaccccaactcgaccggctgcgcgctgagcgggaagccgctcaggctgccttgcaggatgccaggcttgctgttgaatccggtccggacatcgcgatcctgacggcggacagagatgctgcaaaggccgcgctggatcagacactggccgaagaaaaccgtctgcgggcggcaaggcaggaagccgaaagcgccagcgaccgtgccacagccgccctcgccgcgctggaagcgcgcgccgcagatacgaaagccagcctggctgccatccagccgcaggccgaacgggccgaaacggaccggcaggaagccgaagccgccctgatcctgcatcgccagcgacgtgatgccatggacgatcctgccagccttcaggaaaccgcggagaccgcacggcaggcggcagccacggcccagagcagccttgctgccgcccgcgtcaggctggacatggcaaggaacgaggcggacaggattacgtcccgtcaggaaacgctcctccgggaacgtgcggactggcagatgcgggccgatacggccgcccgccatgtcgcggaactccgtacgcggcatcaggcgctgctgacggaagccgatacgctggcagaccgtcccgaacaggctgcacggctgatgcaggatacgcgcagcgcgctggaagaagcggaaacaacccaccgacaggccgccgacaggctgcgtcaggcggagaacgcacacagggaagcaggcgaggccagacggcaggcggatgcggatttcgctacggcgcgggaggcgatcctgcgtctggacgggcaatgcgcacaggctgaaaccgcccgtcatgcggtgcaggagcggatcgaggagcggctcggtgcgggggcatcgctgccgtcagacattgccattccccccgagctgtccgacatggcggaggacaaggcccgccgcaagctggaacggctttcgcgagaacgggaggagatggggccggtcaacctgcgtgcggagatcgaggcacaggatatagaaacccgcattggcggaatcgatcgggaaaaagaagaactcggcaccgccatcgccaagctgcgcggttcgatcggacatctgaaccgggaggggcgggaacgcctgaacgccaccttcgcccaggtgaacacgcattttcaggcgttgttcaaccgcatgttcgagggcggcaaggcctatctcgccatggtcggcgatgatgatcccctgaaagccgggctggagatttatgcccagccaccgggcaagaaactggccacactgtcactgctgtccggcggagagcaggcactgacagccctgtcgctgattttcgcagtgttccgctgcaacccggctcctgtctgcgtgctggacgaggtggatgcaccactggacgacgccaatgtggagcggttctgtatgctgctggccgatatggtgcaggaaaccggcacgcgctttctggtcgtcacgcaccaccatctgaccatggcgcggatggaccggttgtatggcgtcacaatgcaggagagaggtatctcccgcctgctgagcgtcgatctgcatcgcgccactgccatggtcgagggagaagaagcggcagccgcagaataatctccgcagcctccccttcttcactcatctcacatcaggagtgccggtcacatcaggaatcccggcgttccagtgcggcaagcatagcctgaccgccctgcgcctcggcgatgccacgcgccgaattgccttccgtatctgtcaggtcaggatcagcgccatgcgccatcagcaggcgcaccatcatttcacgcccgaacatcaccgcgaacatcagcggggtacggccagccgcattaggatgattgaccgtggcccccgcctccagcagcatccgcgccgcagcttcgtcacccttgaacgccacgccggacagggccgtatcgccgttggcatcaaccgcattcaccgccgcaccacgccgtaacagcaaggctcctgcctcaatctgcccgttataggtggccagaatcaaaggcgggaaacctcgtgcgtccggacggtcagggtccataccggaatcgagaaatgcctcgatcatatcaacccggccttcacgcactgcgccatagaacaatgcctccagctgctcctgggaaagagacgtacccccgtccttttgatcaggaatgcgaatagatgaaacgggaaagggcggccgcagctgggtcatgaaatacgggtccggattacgatcttgaatgcttataaggcacattgagaaagaaaagtggataaaaagaccgttctggtgatgcaatcgtcatctaaacagcccatgcttcttgacactccccctacccaccggtagctagccgtcgccttccggcaaggcgacttgtcgaggatggatatgaacgagaacaggcagcctcagtcgcagccgggtcaggaaacgacttccggagtatcgtcccggggaatttcctttccgcagcgactgaatgcggcacgaaacagacagggtcttgggacggacgggcagaacccggcttccgtgcttcaggcccctgatggcagccctggcccttctgccatgggtattggcttgcgaatcggtgctgacctcgtgtccgcactgattgtcggggtcgccatcggatacggtctggatcgctggctgggtacgatgcccctgtttctgattttgttcatcctgatgggaggcgcggccggtattctcaacgtatggcgcaccctgcgccgtatgccagccggtcaaggccaaagcgaagcagatgacgccaccctcgggcggcggtaggtgatggagcattaaggtggcggcagaacccacgatcgacgcgctcggccagttcaggctgcatcacggccttggcccgattggcgggctggtgaattttacccaatccaatgaaatcatggttctgggcactgccatcgtcctgggcatcatcgctctgggtatgcgccagcgtgccgtagtgcctgggcgcctgcaatccctggtcgaaatatcctataatttcatcatgggcctgtgcatcgagcagatcggacatgagggaaaaaaattctttcccttcatcttcacactgttcttcttcgtgctgatgggcaatctgctcggcctgttcccctatttcttcacctataccagccatgttgccgtgaccggcggtctggcagtcctggtgatcgtgctggtgacggcggtggccctgcgctatcacggcctgcacttcttctcctacttctttcctccgggcgcaccgaaggcgctggcacccatcatcgtgccgattgaaatcatctcctatctgtctcgtccggtcagcctgtccatccgtctgttcgccaacatggtggccggacatgtgatgttcgaggtattcgccacgttcatgtttctgttgatcggcgctctgggtacgttcggctatttcgccgcactcctgccgatgacactgaacgtgaccctcgttggcttcgaattgctggtggcgttccttcaggcttatgtgttcgccatcctcacctgtatctatctgcacgacgcagtgcatctgcactaagaagacgcgcagattgatctccgccccttcatatcaagcaaggaactgaacccatggacgtcgcagccgccaaggccctcggtgccggtatctctgtcatcgccctcgccggcgtcggcctcggcatcggcaacatcttcgcctctctgatcgccagcgtcgcacgcaacccgtcttcccgcgaccaggtcttcagcatcggcattctcggcttcgccctgacggaagccgtggcgctgttcgcgctgctgatcgccttcctgatcctgttcgcctgatccagtgatgacccggggcgggatcgtgacgaccgcgcgcgacggcgcccttcgcgcctgccgcgccgggtaccgtcaagtgttgcttgggactgtcgtaacagttctgagcacgctgccggctatcgcttatgccatggaccctgaaagtcccgagcatgaggggatgcctcagctgaattttgccaatccgctgaccaccagtcaggtggtgtggatggcccttatcctgcttgcgttctatcttctgctgtccaaatgggcgctgccccaggtcagccaggtggtggacgatcgcaatgcctccatcatgggtgacctcgactccgcccatctggcaaaggcagaagccaacgccgccgtggaagagatgaacgacgccatccggcgtgccaatcttgaaggccaggccgaaatcgaaaaaacagtgtccgccgccaaggccaaggcacagcaggaggccgccgaggcgcatgcgcgtctggaacggcagcttgccgatgcggaggcccgcattgcttcctcccgcgataccgccatgggcgcattgcgtgatgttgcaaccgacaccacacaggccctgattgcccggctgaccggccagtttcccgcccaggatacggtggaacaggctgttggtcaggcgctggccgcccgcagctaatatcggaggatcgccatgcaggctcatgaactcagcggcgctccctggcaccatccggttttctgggtggccgttgcctttgttctgttcttcgtgctgttcggccggaaaatctggggggccctgacctccaagctcgacagctatgctgacgaagtgcgtcagaatctcgacgaagcacgcaagctccgtcgtgaggccgaggccatgctggaagatgcccgccgccgcaaggaacaggctctggccgaagcaaaacgtctgctggaatccgctcatgcggaagcagccagggctgcacaagcactcagtgacgatgcggaagcaagcatccgtcgccgtgagaaaatggccaatgaccgcattgccgctgccgaaaaggctgctgtcgatgaagtccgctttgccgccgccgacattgccagccgtgccgccaaggacattctggcacgtgaattcggcccttacgccgatgcagcgctgatcgactccgccatcagcaaactgccccaggctctgcgcgcagcctgattgcagcgttctgaacaatattgatgctggaaaaggccaccctcatcggtggcttttttcatgcccgccgtataaccgccaaaggttgttaagttcggttactcgacaatgaacgctggctgtgaacgatagccgacatgaaatgcaccagacttcttatcgccctgctcctgatagtctgctgcgcgggatgcgatacgctcaaccctttcgaaggcccctatcatccgccgggcgcgccgctggcggctgaaggtccggccgatatagcggtggtacctcccatcagcggtgccacaccctcacaggctgcaacagtggaagaagccgccctgcaggcactggaggcgcgtaatctgttgtccgaggccaaacccgactcggctcggctggtcatgcggcttaccgtgctgcaatgggatgtcacatcctccggtgggcggatcgcactgggcatgtctctgttcgaccgtgcaaccgggaaaacgctttatgaaggacgtagtacagccaccaacctggatggtcctgttctgctcaatcccgccacactggccgccaatgagggcttactggtgcaggatgcgatgggaaaactgctcagccagcagggtttcatgaaagcctgcgccgaaccgccgcaccactttctgtttttccaaagccgtcagagccaatgattcaggcacaggcaaggcgctgacctcgcgggtgaatttccggcggaaggcatccccgaactcccggaaactttctgcaggcaccagaaagcctccaggccctccgacgacatggctggcataccagcctttcaaggtcgtggcctcatctccctccagaataggcaggccgttgatggtcacaccatcgccggccagcatatcccgcatggtgggaacatcagggctgctgttgcaattgtcatgtccatcgccggaaacatcaatcacgacgcgctccacctgcgccggcatggagggtagggtcttgtcggaaatcatccgcagagcctgcgccatacaggtgaaatcgcccggaacacggggcagcatacgaatacgggcagccactgcattggcgtctgcctgaccggtgattaatgtccacggcacggacagaacgggcctgtccgcccattcgacgaccgccagcagcatagaacgatgccgccccgacagcattgcagtcacaacggctgggtcttccagagcgcgggcgatgccctccatttgcaggacgtagcggctggtatccatggagccggagacatccaccgccagcaccagagccaggtcggccttgggtgttgcagcctctacagaccgggattgagatgaggacaacagcgccatggccgccaacatcacactcatcatcaccggccaccgcagaccgggagataaaaatcgtctcatggatacgctacagtccggaattgcgctggcagtcccttggccgaatcgagaccacgcgcaccatcaaaatgcgccccctccagatgggcgccggaaaaatccgcacctgtcacatcagcacccgaaaaatcggctccggccagatgagcatggcgcagggaagtatgaattagtctggctccctggaaatgggtaaattccagaatcaccccgtcaagattggcacggctaagatcggccccatccatccggcagccggaaagatcggttggaaaagctccgagcatacgattatcgagttgaaactgtgctccgacgagcttcgcccctcgccaatccccccgattcagccgcccgatcagcctcgctcctgacagatcggccccatcgaatcggggactttccgacgccagcgggtcaagagtggaaaatgcggccagcataaacaggctggccccacgtaaatcggcatggctgaagcgggtgcgggtgatgacgctgtgatccagcacggccccacgcagatcggcaccgctgagattggaatccgtcaggttaacgccatacagattgctgccggacaattgagcatggtggaaatccagccccgacagatcaagctcgaaaagcacccgattgttcagctgtgcgggatgggcatcggtggcgcgcagcagcgcacgcactacctgccggacggtcatgtcagcctgcaacgggtctctggaattttcaggcagggaggcggcatgacagggcggagcaggcaggagcattatgcccagcgtcagacagacattcaggccatattttgataatcgacttctgcccattgccattgttccggtggaaagacggccaagtccgtcaccgaccccaaaaccggcgggcctgccaatagaaaaacccggcaggaacagcctaccgggtttttcctgttctgatccagcggcgtcttactttgtaacgcccgtgctggtgccggtgtccggaacgccggcagcggccggaggcgtggtaccagccggaacatcggcaacgcccttctgggcggcctgcaggctctgctggttcaggcgatcaacttccgtttccttggcagtgccatacgtgccggcatgcttgaaatccttgtgcgcatgatgggccgctgccttggtgtcaccatgcttcgcagcatcatgggcctgtgccggcagacccagcatcgccacaccggcagtcatgccaccagcaaaaatgaaagctttcgtcagacgattcagcatggaaaccatctccttgtaagcaaccggtcagagaatccgacaggaagggaacccgatcctacaggccgggaacattttcagcccatccattcccaaggtgcaattggctacattgagcgggacaggaacgatcgtatcgcataacgcaacgatcccccttctgttgcaaggaaatcactaatcaggtcccccaaaaccatttctgatacgcctgccccggatgatgcacccaaggcacatcacaataggcacgaagcgggtggcgcgactgcaacggtgacaagataagtcggtacgcaggcaagggatgttctccaccccggtcaggcggagttgcgatgcaacggcagcttctctatctctcggtctgcggtccgtgatgggcttgcggcttttccttggactcatgccggtgaatgctcatgaccgataaaccctccctgcgcatcctgctggctggcccgcgcggcttctgcgccggtgtcgatcgcgccatccgcgtggtggaggaagccctgaagcgctatggcgcgccggtttatgtccgtcatgaaatcgtccataaccgctatgtcgtcgaaagccttgaaaagaaaggcgccatcttcgtcgaggagctggaggaagtgccgccgcatgcccatgtggttttctccgcccatggggtgccgaaatccgtacccgccgatgccgaggcgcgcgatctgtcctatctggatgccacctgtccgctggtcagcaaagtccatcgggaggccgagcgccactatgccgggggcggtgccgattccctgcatattctgatgatcggccatgccggacatccggaagtggtcggcactatgggccagctcccccccggtgccatgacgctggtgcagaatgcggaagaggctgaagccgttcagccgcaggatccgcacaagctggcctttatcacccagacgaccctgtccgtggatgatacggccgagatcgtcgccgtgctgcgtcgccgcttcccggatatcgaggggccgaagcgcgaggatatctgctatgccaccaccaaccggcaggctgccgtcaaggcaattgccgaggattccgatctggtgctggtcatcggcagccccaactcctccaacagccagcgcctgcgggaagtggcggaacgcgccggtgcgccgcgcgctattctgctgcccaatgccagtgcgctggactggaccgtactgaacggcgtcaactgcgtcgggatcagcgccggagcctccgctcccgagttgctggttgacgagctgctggaccggctgagcgaacgctatcatctggatattgaagaacgccgcgtgacccgtgaggatgtggtgttcaagctgcctgcgcccctgtgcgactgaacgccatccgatcccgcctgcattaaattcttctcctcggggtatggcataccataccctgtaacccttcctatttctctcctgttacaggccgcaccgcacccatggccgtctatactgaagtcaccgatgaggcgctggccgcgtttctggctgaatacgatatcggcaccgccgtggcctttcgcggaatcgcggaaggggtagagaacagcaattacgtgctgcgtactacaggcggcgactacatcctgacgctgtacgaaaaacgggtggatccgaacgatctgccttggtttctcggattgatggagcatctggctgcacggggcatcacctgcccccagccggtgcggggccgggatgggcaggccctgcgcatgctctgcggccgccacgccgccataaccggcttcctgcccggcgtttggccacgcaaggtgcaggtcgcacattgtcatcccgtcggagaggtattggcgaaactgcatgaagccggagcagattatgcgccgactcgcctcaatgcgctgggacctgaaggctggcctcccctgctggccatctgccgcagccgtgccgatgaaatctcccccggtctgggcgaggaactacagaaggcgctggaccgcgtgctgacggcatggccgtctgatctgccggccggccatatccatgccgatctgtttcccgacaatgtattttttctggatgacaggctttcgggcgtgatcgacttttattttgccgccaccgatgctctggcatacgacatagccattgccctgaacgcctggtgcttcgaaagcgatcatgcctacaatatcaccaaaggcagcgccctgctgcgtggctataatgccatccgtacgctgacggaggcagaaaaagccgctttaccggtcctgtgtcagggagccgcgctgcgttttgcactgacacgtctgttcgactggctgaacacacctccgggtgccatggtgacgcgcaaagaccccatggactacgtccatcgcctgcgtttccatctctctgctcccaatgcaggtgcttatggcctctgaccaaaccgccatggatacaatgcagggcgagagcaatatcgtcgaaatatggacggatgggggctgcaagcccaatcccggtcccggcggttgggcggcgatcctgctctatcgcggcaccgagaaggaactctccggtttcgaccccgagaccaccaataaccggatggaactgaccgccgctgccgcagcactggaggccctgacccggccctgcaaggtggtgctgaacaccgacagcgaatatgtgcgtaacggcattacccgctggaaagatggctgggtgcgtcgtaactggcgcaatgcgtcgggggatcccgtcgccaacatggatctgtggcgacgcctgctggatgccgcggcccgccatgagatcgactggcgctgggtccggggccatgccggcaacccgatgaacgagcgggccgatcagctggctaccaaagcccgtatggaaggctgatcgcggcggctacagcaccgccagaatctgctcggcccggctgacatcgaagccacccggtggttcaatggccagatgggtgacaacccctttctccaccaccatcgcaaaacgctggctgcgcacgcctaatccccgtgctgtcaggtccagctccagccccagcgcccgggtcagcacggcgctgccatcggcgagcatcaggatacgctcctcaacgccctgctctttggcccaagcgcccatcacgaacggatcattgacggacaggcaggcaatgatatcgacacccttctgctgaaaggcttcaagagcattgagataaccgggcaggtgtttcgcgctgcatgtcggcgtaaaagcacccggcacggcgaacagaaccactttcttatccgcaaacagcgttccggtctccacctccttgggaccgtccggcgtcgaggccatgattttgatggccggaaagacatcacccgttttgatcgtcatacctgctttcaatcccatggtcattgatcgatgcgacaagaaatcccggcggccctctcggcctgcggaatccctgttttacgtccggtctacagaagcgcagaagcagcctgtctgccagcaaaatcggctccagcccagtttgggcagacaatctggactgattgatgaatagcatatctcaacctgtcgcttgcaggattggccaagattgacaatctatagggcatgaaagacgaacagccctcccctgatgacaacaccaagccgtccgttgcgacagcggatacgctttctttggctggacagcttctgatcgccatgcccggcatggaggatgagcgctttacgcggagtgttatctacctctgcgcccattccggtgagggggcgatgggcatcattatcaaccgcccggtcgataagccgcgttttgatgatctgctcagtcagctggatacgccacctgcaccgccgatccgccggattgaggtcatggaaggcggtccgatggaaagcggacgcggttttgtactccatactgccgattggtcgggcgaaggaacgttgccggtccagaacggcctgtccctgaccgccagtctggatgtgctgaaagccatcgccaccggtgacgggccgagtcatggttttctggcactgggctatgccagctggaccgcaggacagcttgagcgtgaattgcaacagaatgcatggctgtctgcgccagccaaccagacgctgattttcgagaccggtccgggggacagatggaaaggcgccatggcccagctaaagattgatcccaacctgctctctaccgaggcagggcacgcctgaagtgatcatggcgcaaagccggaaactttcttaccagttgaaacgcgccgtcatataacgcggtgcgtgctcagcctgctcaaggactgaaacggccccttcgtgcaggctgtcgctatgggcagcaacctcctgccaatggatgccgcccagaacccagcacgcatccagcccggcggcacgggcgcctgccatatccgtggccagcgagtcaccgatggccacggcatttcccctctcacagccaagcgcagccatgaccggctcatagacagtcgcatcaggcttgccgacggagcgcacgattccgccaatctccgtatagcgcctggccagcgcaccggcgcagagaatggcgacgccacctttgatgactttcatatccggattggcgcagaccatcggcagccctgccgcaagacaggcggcaagctcggcctcgaatggttcgagactggttggatcacgatgatcatccgggccggtattcagacagaattcagcctgagcgggcgatgagaccggatcaagcccgcttccctccaacaggttgcgatcccgctccggccccagatgatacacacgccgaccgagagcagcgaaaaacggatcatgccgggtcacaagcagatcataggtgacctctccgctggtcacgatcccgtcatagagatcatcccctacccccagcacacgaagtgcagcggcggcagaagcggcccgccgcggagcattggacagcagcacgatccgcttgccggcctgcttcagccgcctcagtgcctccagtgctcccgggtaaggggccagaccatcatggatcactccccagagatcgacgacaaacccctgatagcgctctgccagcggcgcgataccgtccagatacagcgtcacaggaccataccctgcaaggctttacctctggctgcggcaatatcccgatagcctcgttcctccagcaatgcctgcgtttccttcaggatacgcggcaacagagacggcccctgcaaggcaaaggcggaataaagctgcaccatggtcgctccatgctcgatcttggcgagcagatcggcaccactggcaacccccccgcatcccaccagcgtcagacgaccgggggccaattgttcgctcagcagcgcggcacggcccagcattctggtggaggttgccagcaaaggtctgccggataaaccgcccgcctcctccgcatacgggctgcgcaaccctgcgggacgggcaatcgtcgtattggagatgatcagaccatcaaccccggccgcgatacagcatcgcaccactccctccagcccttcatcagacaggtcgggcgcgatcttgaccagcagaggtggcctctgcggcacggcacggttaatggaggccagaatagcggccagcttttcctctccttgcagatctcgcagaccgggcgtgttgggggaggagatattgacggtgatcgtatcggcataaggggcgactgctgctgccagttcggcgtaatcagtctccggtttggctccctccttgttgatgccgatatttgcaccgatcggcgccggatgatgcttcaaccgcttcaggcggttcagaaaaaccgcaatcccgtcattgttgaaacccatccgattgataaccgcccgatcttcgcgcagacggaacaaacgcgggcgtggattgcctgattgtgggcgtggagtaacagtcccggcctccacccaggcaaagcccagacgcagcagcggcaggacgacacgggcgtttttatcaaatcctgccgccagacccagtggatgggcaaaacgccggccgaatgcggacacagccagccgcggatcatccggcatgctctgccgcccggccagaccaagcgacagggcgcgcagcccccattcatgagcatgctccgcatccatacgacgcaatgcggcaaatccggcctggcggagaagattagtcaacatgatccgcttctgccggaaagcggcctgtcaggaaagagggacatgcggcaacattgtcctcccagccagtggcccacccagccagaagatcgtttgcatcctatatctgatgggatgttttcatcattcacacccttgcattgaacagcatagaagtggctattcaacggcatgagccaggcctcttcctttgtctataacgaaccctatctggaaacctgctgccgttccgcgctccaccggctgagcctgagcggagcagcggggcggccggacgggctgaaggacggggcctgtctccatcgcctgcaggcgatgggcctggcacagcaggaaaaagatggacagtttcggatcactcacgaaggcgtcacccgccataatagtgaagtgctgaaacgacgctgatttttatgcgttctgatttttatcagtaaccggactttcgaattctctctccagatccaatctggtggaatatccctgtccagagcaggacttcctatatgaagcatgaggatatctggcgcgccatagatactctggccgccatcaagggcctgtcgacctccggccttgccagacgggcagggctggatgcgacaacattcaacttgtccaaacggcaaatgccggatggacggcaacgctggccaagcacggaaagtatttccaaaattcttgttgcgaccggtgaatcgctgggtgccttcacgtctctggtcaatggcgccgagaccctttccgcagacagcggacaaaacacccactatggccggcgtattccgctgttctccctgcccgaattacgggatcttccgatcaagggtgaagggaacgccttgccttccgcccgggatgaaaccagcctgccggatgtcgcagaccgtgaagcatatggcatcgaaatccacgatacctcgctggcaccgctttttcgagaagggaccatcctgatcgtctctcccaatgctccgctacgccgaggcgacagggttattgttcgcctggcagcccatgacggggaaccatccgaaactgttttcggtcattttcacagacgctcggcacgttggatggacatttcttcgctgaatggcgacaaagctgagcggagtatttctttaacttcactggtatggatacacagaatcgtgtgggccagccaataggaagtggttacagaatgacactccttcacaaggggtctcttgaaccaaaggcagggtcatgggtttactggtagacggggtctggaaaacagactggtatgataccgcctcccatgatggacgcttcgaacgcgatgcatcctctttcagaaacagtattgacccggctggcccttttccacctgaaacggggcgttatcacctctatgtttcccttgcctgcccgtgggcacaccgtaccctgatctaccgtgtgttgaaggggctgacggaggctatttccgtttcagttgtaaactggctgatggaagatcacggttggactttcgaaccgggcgaagcaaccataccggatacgctttacggtgcagactatctgcaccagatctacacacgcgcgaaaccggattactccggccgggtcacggtgccggtgttgtgggacaaacagcgcgaaaccatcgtgaacaacgaatcagcggaaatcatcagattttttgatgatgcctttgattcggttgcaaaataccaggttcatttctacccccctgaataccgggatgacattgatgcgctgaatgcgcgtatctacgacacggtcaataatggtgtttacaaggctggatttgccacgacccagcacgcctatgaagaagccgtatatccgttgttcgctacgctggactggctggaagaccgcctgtcccgacagaattttctctgtggtaaccgcgtcacagaagcagactggcggctgtttaccaccctgatccgtttcgattccgtctatgtgggacatttcaagtgtaatattcgtcgcctgagcgactatccggaacttctggattatatgcgggcgctctaccaagtgccgggcattgccgatacggtcaattttacccacatcaagcggcattattacatgagccaccgaaccattaacccttcctgcatagtaccggccggccctgagctgcaactgacggttccagcccggcgcgatgcggcaggagccatcagaccgtgacagcaaccgggatcggggcaggccagattgacagacttgccctgaaagacgcgcttgaaaacgccattcacgcagcaccggaggataaaaaccttctccgccgctatttcgatgtcctgggcgagatttcagcaacctatcaggggccgctgacggtccatctgccgggcactgcccacgcaattcgtattcggtgcggaacggatgacagcgccatttgccggggcattttcctggatggctggtacgatcatgccctgcccgcttcaccgcgccatattctggatctgggcgcccatgcaggctttgcagcgatctatttcgcgaaccgttaccctgatgcacatattctctgtgtcgaggccgatacagcccattatcgcgccctgctgatgaacaccttgccttaccccgggattgcgcatctgcatggcgcagtttccgcagcgtccggctgggccagccccatggatatcggcagggaccgtcaatcccgcgatgggtggcaacgtttcacggtggagggggagactctctcggttggtggccagccatccggggggaagctgcgcgcctatggaataaagcagatcctggatcagttcggatggcaaagcgccgacaccatcaaatgcgccctgtcaggagatgaggccgccctgttttccgcttccacctccacatggcttgattcagtgacaaccctgctgatttcgcgccgcaaggccgactcccccctggatgttctgaatgccatgaccgatgccgaactctttgaacccgttcaaggagagggcgtcacgatgctccgacggctgggggctggacattctgactcccgccctgctccggtcaggctgattgagaccggaacgcttcgacccgttctatgggatggcacggaacctgctctgtcgcagagcggttttctggatgatcaggccgttctgatccaggctggccgcatgggcgccaccccgaccagcctgacgatcagacgcgatttcagcggccaaagccggcttggcggtatcatcgcctcaccgggtgatcccgacagcatagcccagttgtccatgaccatcaggcgcgtccgggatcaggccgttctccttcaaagcgagctgcgcctgcctgcaggacagcaagccacctggaatgccgccacccctctgatgcaaggtctgcacgacatccggttttcactggagaatgcggcggattcctctcccgaccagtcggcctgcatcaggctgagccatctgatagcggatatagcctgacctatgccggcccggtccacactgcctcctgccccacctcatgcagagcgggcagcatggccggtttacccggtggaaccagagatcaaggcgcgtgtcacaagcgccatgcccgcccttgccgcctcgctggaccgggaagtcgagcggatatggcaatcagcgcttcagcgcaccggcggcagactgttcaatggccaggtgttcagcgccgatgatctgacacccaccctgctgaccgggcatatgacggaatttcgtcgcattgtcgcccagatggagcgccctgatctctatgaggccctccacgtcagacccctggctgtgtgcgcttccgttctggcctgcccggaagccaggcccgaagaaggcggcgtcatcatcggacggcgggcaggccattcggtctatcaggccggatactggcagacgcctcccgccggcagtgtagatgcgggggccttgctgcctgacggctggctggatctgcgtggacagctgatgaaggagctacaggaggaactgggtatctctccggctgccgtcactgagtgcgttcccctgcttatgatcgagcatccagacagccatgtgctggatataggccaccgcatggtggtcaatctgactgcatcccaggtgcagaaaacccatcggtctctggccgatgatgaatatgacccggtcctgatcctgaagctgccggaactggaggccaccctccatgctctgggcggtgttctatcaccgccatcccgtgccatcatgcaggccagccactggtttgatgaaaaaatctgaatttttttgatctatctaaaagagacgagattatatctcgtaataataagatcatctcggaaaaataccaaaaatttagtcctaaaatcctaggattttaggtttttagtcctttattttttcttttccctgttccccgacttatcgcacctatccagtcctcaatgcgatggcatctttggcagcaaataaaacatcatcatcaaagaagaaaaaacagttgataaatattgataaaaatatagctgccacaaacccgccctatttcctgccatatttccaatgatgagtcatttggactggacatgatatctctacgtctgctagtcaggctccaccacgatgaagggatagattatatccctaccctccggtcaggtttttaacctgccgagcaccattgtgcacgtctgtggcgtgcgcgttctttgtgtttggcgtttcggtatagtgcgttccggagcgtcccgatcaggagcaggcgatgcgccaccttagtaaacgaggctttccagccttgttaagttcagtcttggtcttgggaagtgcaggtcaagcgttcgcgaccacccatcgaccgagccatcacgtttccacgcggcacttttcccatcacgccagcacaccccgctcggtttatgctgcttatgctgacgaaaccgttagcgccgacgatcttaacagcggtgagctgagcaagttcaattcagccaacggtttttctgcttccggcagtattcaaccttccaccaccccggcacgtcatgccattgcgtttcaaggcaccattgccgggcaagatgttcagcccaaaccgattgagaccggagttgcctcctggtacggcaagaagttccggggccgcgtttccgctgatgggaccgtttttgatgagcataatctgacagctgcgcatcggtggctgccgcttggctccaaggtacgcgtcacactggccgatagtggtcgctatgtcgatgttaccattactgatcgccccggcacacgcaaacgtgtgatcgacctttcaaggggtgccgccgcagaactgggcattatcagccagggcactgccaaagttactttaagccagctttaagcatctgcgattcctctattcatgcggccttccagccttttcatccgtgcacttcgacgctttcaggtcataagacctgccgccttattgtttctccttgttccagcggcctgcaccagcacagcgggtggaggatataccaagcgtttgaccggccagaccgtgccgacaggcccaggtcatgcaggggatcgctgcgccggcccttccagtgcaacgctggttattgatcgctcctcccgccgctttacctttgctccggccgatggcgccctgcgcctgtccgggcttgtcggggcaaacggggccatccaggcaagcaccaatacccagccgccggggaaaacgccctatattgtgacactgcatggcgtgctgggaaaagacagtttcaacggtacctatgaaacaccgctctgtctgtctgccgtcgccctgaaaaccagtgatgggcttggcattatcctggcggctccggacaatccactgggtctctgacagaccaaatcacgtcacatccatgattgccccgccatgcctgacttatcaggccgaactatcatctatccagcagacatttgccccacacaagggtagccgccacgggtgcatatttttgccagtcaccggataaaaaggtctcagggagcgccggatcggcattcagggttccagcgctctatcccatgggcaatggtcggaaccagctccgtgattatgatggtggggcaaagaatttccaggaatgccgcacatccagccgcctgcatgcggtaagccgtaaaatagattattctgatttcataatcaggctattttcattgaaggaccgccatgagcatcgtcccgctgaactctgcaccaggattacgggtttttcccgtccttgcgatccttgtttctgtcctcgcctggttctggccggagccttttgccgtcgccctgccctggatcagcccattgcttgctctggtcatgctggcgatggggattacactcacccttgatgatttccgcaggcttgccacccgccccgccccggttctggcagggctggggctgcattacctgatcatgccgttggccgcactgggaattgcccggctgctgcacctgccgcccgatctgacagccggtatgatcctgaccggcagtgtcgccagcggaaccgcctctaccgtcatggtctatctgtcaggcggagaagtcgctctctccgtcacgatcagcgcctgctcgacccttgtcggggttgccatgacgccgctgctgacctggctttatacctcatcaacgattccgattgattatggagcgatgttgctcagcatcgtggagatcgtgctgttgccggtcgggcttgggctgctgctgcggcagacaatgcccgccatgatcacacgggtggagccggggctgccgatcctgtgcatggcctccgtgatcatcattatcggcgcaatcgtctctgcggttcccgacaataccttgaccgaggccgcgccgatgattctggcggtcgccatgcataataccaccgggctgctcggcggctatttcggaggccgcctgctcggtttcaatgaagccgtctgccggacgctggcgctggaggtcggcatgcagaattccggcctcgcagcgaccctggcacggctttacatttcctccagcgccgccattccgggtgtttttttctcgatctggcacaatttgtccggttcgctgctggctggatactggtcccgccatcctgcctcactttcaacccggcaagagactccggcacggcacacgtcgttttctgaaagatgaatgtcggtttttacattgcatggccgcatcaatccggcagacgatatggtctggaaaaaggtctgcatcgtgggaggcattctcccctgagcggcatacagccctccatgaccaaaacggcagggaaggacatacaccgtggcaagccataccgcgaccgcaggcggggagcggcatcgtttcgatgacctgaaatccgttctcgccgctgccaccccccgccgttcgggcgatgaactggccgggctggccgcttcaagcgatgcgcagcgtgtggcggcccggtttgttctggctgatctgccgctgcgcagttttctgaacgaagccgtggtaccgtatgaggtcgatgaagtcacccgcctgatcatcgacacgcatgatgcagccgcctttgccccgatcgcgcatctgactgtggggggatttcgggaatggctgctttcccacgaagcggatgcagctgctctggccgctgtcgcccccggtatcacaccggaaatggctgccgcggtctgtaaattgatgcgcaatcaggatctgatcgcagtagcgcgtaaatgccgtgtgatcgccggattccgtaatacgctggggctggagggacgactggcgacaaggctgcaacccaatcaccccaccgatgatctgcgcggtatcgccgccgccacattggacggactgctctatggcactggcgatgcggtgatcggcattaacccggccagcgacaatgtaccgaactgcattgccctgctggaaatgctggacgaactgcgtcaacgctacagcatccccacccaaagctgcgtactgacgcatgttaccaatgcattggagatcatgaaacgcggcgcaccggtcgacctggtgttccaatccattgccgggaccgaagccgccaatcgcggcttcgggatagaccttgccatcctgcgggaatcccatgaggcagctctgtccctgaaacgcggtacggtcggtcagaacgtgatgtatttcgaaaccggacagggggctgcactctctgccgatgcgcatcacgggctggatcagcagacggtggaaacccgcgcctatgccgtggcccgggccttcaacccgctgctggtcaatacggtggtcggctttatcggcccggaatacctgtatgacggcaagcagatcattcgcgccgggctggaggaccatttctgcggcaagctgctgggtctgccgatggggtgcgacgtttgctacaccaaccatgccgaggccgatcaggacgatatggatacgctgatgaccctgctgaccgtggcgggcgtcaccttcctgatcgccgtgccgggtgcggatgacgtgatgctgaactatcagagcctctcttttcatgacgcgctgtatctgcgctcggttctgggcgtgaaggccgcaccggaattcgagacatggctggaacagatggacctgaaagaccggagcggacgcatacgcgctctgcccccgcaggatgaacgcgtggtgcgcctgatcgcggaggccacctcccatggttgaaaaatcagccgggaacccacctgaccacacgaccacccccaccatcgatccatgggcgaagctacgggccgccaccagcgccagaattggactgggccgggccggggacgccatgcgcacccgggatgtgctggattttcagctcgcccatgcgtgcgccagagatgccgtgcatacgccgctggataccgcagcccttcaggcggccctggccccacgcgaaactattctggtgcaagccgatgtcgatagccgtggcacctatctccgccgtcccgatctcgggcggcgtctttcacccgactgtacaaatgtgttgcagaaaggggattgggatgtggtgttcgtcatcgccgatggtctttcctccaccgccgtgcaggtgcatgcggccccgtttctgcaacaggtgatcacgcttctgcccggatggcgtatcgcccctgtcgtgatcgccacacaggcacgggtcgcgctgggagatgatattggcgagcggatcggcgcgaagctctgcgcgctcctggtcggggagcggccgggcctgaccgctgccgacagtctcggtgtttatctgacctatgatcccaaacggggacggcgggattccgaacgcaactgcatctccaacattcatggtggtggtctgtcttatgcgaccgccgcagacaagctcacctggttgatgagcgaggcccgcagccgcaagctgaccggtgtggcgctgaaggatgacccccttctgccgggagcagccgtccccacccccctttctgccgatccgcccggctgaccggtttgcctacccggatcagagtgcgcttttcactatgatccgcaaaaacagcgcagaaagcgcccgttttaaaacgtcatcacgccgacgatttcaaacagctgcttcatgaaacgttccacctgagaaagaatcatccatggcgtctccctcctcttcccctcctccctcggtccccaccctcaacaaaagcctgaatgttttccacttgtggggcattgccgtcgggctggttatttccggcgagtatttcggctggagctatggctgggccgccgccggaacgctgggctttctgatcaccacactggtgatcgccaccatgtataccgccttcatcttcagcttcaccgaactgaccaccgccattccgcaggcaggcggcccgtttgcttacagctatcgcgctttcggcccgacgggtggtttcattgccggttttgcgactctgattgaattcctgtttgcgcctccggccatttcactggccatcggtgcctatctgcatgtgcagttccagacgctggatccgaaaatagccgcgctcggtgcctatgcggtgttcatcgcgctgaatgtgatcggcgtcaccattgcggcaaccttcgagcttgtgatcaccctcctcgccattggtgaattgctggtattcatgggtgtcgtctcacccggtttttcatggagcaatttcacccataatggctgggcaggaagcgattatttttccagcgccacgcttggcggcatctttgcggcgacgcccttcgccatctggttctttctggccattgaaggcgtggctatggccgccgaggaagccaaaaaccctcgccgtaccattcctgtcgcctatattgccgggatcgtgacgctggttctgctggctttcggcgtcatgctgttcgcaggtgccagcggtgactggagcaagctcagcaatctgaatgaccctctgccgcaagccatgcgtttcgtggtcggggatcacagcggctggctgcatatgctggtctggctgggtctgttcggcctgattgcatccttccacggcatcatcatggggtatgcacgacagattttcgccctggcccgtgccgggttcctgccgcattttctaggccgggtgcatccgcgcttccacaccccttatatcgccaccatcgccgggggtatcgtgggcgtggctgcaatctacagcgataatctgatcgtgattgcaggtcagtcgctgaccaccaccatcgtgaccatgtctgctttcggtgccctgaccatgtatatcatgagcatggccagcctgttccgccttcgtcgtacagaaccggatatgccacgcagctatacggcaccgctctatcccgtcctgcccgcactggctttggggctggcagttctggcactggccgtcatgattttctacaatattgagatattcatgatcttcgcggccatcatgctgttggcaaccgggctgttcttcgtccttgcccgtccggccgtcgcggcggcactccgctgaggctattccggttacgattcaggcggcgcatgatgcgccgcctgacaaagtctcataaccggatcaaaaatataaggatcagtccttgatccaccatttcacaggctgaggctctttttcacgcttgacccgctttacgtatgttcttggctgccgtgtgcgaacaggcgcatcttccaaagaagatgtcgtcatccgttcaggcggaacaggacgcggctttagcgcctgatcgcgcatgttcttcaaagcagcaatcgcttcatctctcgcctgttcggcgtggtagagacgtgttttctgattttcaaccgtctgctgagcctctttcagcgcccgcaacagacgatcaatttcagaccgtgcctgttccagcagattgaccgccacctgatcgggctcggtaccggcggaacgctcatcgggaacaggatcacggcgcgcacgattgattgtctccacctgcacctccccgtcacgcacgaatcgtgtgcgtctggcctgctggtgggtgcctccctttatctgctgtgccgcaggccgccatccacgcggtgcggcaccatgacccgtcacggcagcattacgatcctggctgcgctcatggcgggtctgctggctgtctatcgacgcaggcgcgaatacctccggcatcgttgccgcaaccgcatcccttacgggatgcgatcgggctgcatcaccttcaccgatgcccagtgcccgacgtgcgcgtgcttcagcctcatccaatgcggaagcggagaagctttcttcttctgtatcactggataaagctgagcctggctgaatcataaaatgcatgtttaatgaggactctataagcttacagattttcaaaaggctgaatataccacttaattaatcaaaatatgccactatcttttcgattgcatcgcatatttcagcatcattcttttagaaagaatgagccatattttcatagaatgcaaccttttatcctttaatacttgttttattcataatcatggcaatccaacaaaccgacttcgaaacaagctttataaaaattcaaccaacaaaaattgtgaaaaaaaattcacacaatccattgccgatatatttaacagaagatataagaaaattatgtaattaacggactaaaattgtaatttaaggatcgccaactccatgaaaagtaccgtacgtctttccttgaccgttctgctgggactgggtgcggtcagcacatgcatgcccgcaagagcccaagcagaggaagtaaccacgcttcttaatgtatcatacgatccgacacgagagttttataaagacttcaaccgcctgttcgaacagaaatggcatgcggaaggccacccggatatcagtgtcaaaacatctcatggcggttcaggggcacaggcgcgctcggtgctggatggggtgcaggcggatgtcgtgacactggccctgtcgatcgacatcgatgctctggctgcccatggtttgctggcaaaagactgggcaaaccgttttccgcatttctcagccccctataccagcacgattatcctgctggtcagaaagggaaatcccaaacagattcatgactggtctgatctggtcaaacccggcgtacaggtgatcaccgccaatcccaagaccggtggtggcgcacgatggaactatctggccgcttatggatgggccctgcaccagccgggcggcaatgaacagaaggccaaagagtttatcacggccttgtacaaaaatgtgcctgtgcttgattccggtgcccgtggctcaaccaatactttcattcaacgccatgtcggcgatgtactgatcgcttgggaaaatgaagccctgctggcacagcgtgacctgggcaagggagagttcgagatcgtctatccctcggaatccattctggcggagccgccggtggcggtcgtcgattccgtggttgacaggcatcatacgcgggaagccgccacagcgtatctgaacacgctttacacaccggaggcacaggagctgatcgcaaaacattatttccgcccgtctgaccctgccgttctggcccgatacagcgcgacattcaaaccgctcaagctgttcgatattcgcagcctgggtggctgggccaccgttcaaaagatccattttgccgaagggggtgtgttcgatagtatctacacacccgtgaaacagtaagcttgtccgatgagtcaccctgaaagcctgaccataccagacccggtccggcccggcctgagccttagccgcaccatcttccggtttccggacaatcatgtcctgcccggtttctggctgtctttcggtgtgaccatgggctgggtttcttcactggttctgttacctcttctggcgctgtttgcaaaagcatccagtgccggaatggggcagatgctgcatgccgtactggctccacgggccctggccgcgctggagctcagctttggcgtggcagcgatcgccgccctcattaaccttccgctcggcctgctgctggcatgggtactcgtgcgtatcccttttcccggccgctctgtggcagatgcgattgttgatctgccctttgccctgccaacagctgtggccggtattacactggccacgctgtatggcccgtccggctggatcggtgcgccgctggcatccattggtatccagattgccttcacccgtctcggtattgtgctggcgttgattttcatcggcctgcctttcgtggtgcgcagcgttgctcccgtgcttgctgattttcccgccgagcaggaggaagccgctaccacccttggcgcatcaccatggcagagcttccggcgggttatgctgcccgccctgttgcccgctttgctctccggcttcggactggctttcgcacgcggggttggcgagtatggctccgtgattttcatttcgagcaatatcccgatggtcagtgaaatcgcaccgaccctgattgtctccgaattacaggaattccactacgcatcggccgcctgcataggactggtcatgctggccggttccgctctcagccttgtgctggttgccgcactgcaacggcactgggcatcccccgcctcccgcaagcatcgccttgtcgccggaggtcagaaatgacccggaaaaaacatctgcacgccggcaatattctctgcctgcttgcgggattactgatcgtgatcggttttctgctgctgccgctgattgcggtgtttgccgaagcgttgcgggggggagtttatgttgctctcaattccctgagcgacccggatgcgctctcggccatcagactgaccttgctggtgaccgccattgccgtgccggtcaatacgctgtgcgggatcgccgccgcctgggtgctgagcaaattctcctttcccggccagaagctgctctccatgctgatcgacctgccgctcagcatctcgccggtcgtggccggtctggtgtggatcctgctgttcggcacacgcggctggtggggggcggcccttcaacagcatggtattcagattgccttcgccacaccgggtatcgtgctggccacgctgttcgtcacctttccctatgtcgcacgcaccatcctgccgctgatgcagtctcagggcacagagcaggaggaagccgccgtgatgctgggggccgggttcggcactatgctgcgccgtatcgtggtgccggatatcggctgggcgctgctgtccggcgtgctgctctgcaccgcccgggcaatgggggagttcggggcggtctccgtgatttccggacatattccaggcgtctctgaaaccatgcccgtgcatatccagaccctgtatgatggctatcaaagtgcggccgctttcgccatggcggcagtgctggcgctgtcctccattgcttttctggccttgcgtcgtctgatctcggtggtcaaccgatgaacctcatcctcttcccctttctggctgccctgtatggagacgccgcgccatgagcatcgaactgcgccatatcagcctgggtttcgagggggaggcaggagtccgcgacatatccctgcccatcgaaagcggcgaattcctcgctctggtcggcccctccggcgcgggtaaaacgacgttgctgcgcctgatcgccggattgttgcaaccgcagaccgggcagatcctgatcaacgggcgggatgtaacgcatgcccccgccaaggaacgtaatatcggcttcgtctttcagaactacgcgttgttccgccatatgagcgtcgccgacaatatcgcattcggcctgactgttttgccacgctcacgccgcccgtcgcgtgccgcgattggccggcgggtagaggaactgcttcatctggtgcaggtgccggaactggccgggcgcatgccggatcagctttccgggggccagaaacagcgcatcgcccttgcacgcgctctggcgactgagccgcaaaccctgttgctggacgagcctttcggtgcgctggacccgctggtgcgcaaggatatccgcacatggctgaggggggtgcatcgtcagctcgggctgaccagcatcttcgtcacgcatgatcagggggaggccatggaaatggccgatcgggtcgccgtcctgcgggccggacagttgcagcagatcgacagtccacagcatctggaagcgcatcccgagaccgccttcgtgcaccgttttctgggcgagacagttactttcaccgcggaaagtcgcggcagccatctgtcactgcccgagttgccccatcacccgccccttgcaaccgcccttccggatggcaaggctttgctctctgtacgtccctatcatatccgtttgaccgagggtcaattggcccgggtcgaggatattgcgctggccggacccttcacacgggttgtgctgtcgcttcaagggcgcatggtcgacgtgctgctaccgccaggggcagaggttcctgaacggggcagcatacacgggctggatgtcagtctgggccatcattttcctgacaaccactccgcagacaagctgcatatcaggaccgggacagcaaatttattacataattttgctgaagccgcctgaatcgtcccctgccctatggcgataaataaacggaatgatagtttaatcgttcttttttagtcattcagggcagcttgttcatggttgatcagacgatacagaatgccatgacggcagagaatgccggagccccctatattctcgtggtcgaggatgatcccggtatgcgcgtgctgattatgcgcgtgctgcgtgaaaacgggttccggaccagtgccgtgcgggacgggcgggagatgtggccttccatcgaacagctgatgcccgatctgatcctgatggatgtcatgctgccgggcggcagtggtttcgacctttgcaaggcactgcgtcagtccagtcaggtgccgatcatcatggtcagtgcacggggcgaggaaatggaccgcgtgctggggcttgaactcggtgcggatgattatattgccaaaccattcggtaaacaggaacttctggcccgcgtccgcgccgtcctgcgacgcggcccggtgaacgagccaacggcgaaaggcaaaagcgagacaataagcttcgcgggctggcagatcgacatgaagcgccgcgaactgaccgatcccagcggcgccgtcgtcgatctgtccggtgcggaatatgatctgctgctgagctttctggaaaacgcacaacgggtaatcgggcgcgaccgtctgctggaactgtcccgcacccggctgggcgatgtttccgaccgtagcattgacgtgctggtcagccgtctgcgccgcaagatcggcaatcgcgtcggggaacgccccctgatccgcaccattcgcggagtcggctatatgttcgccgccgacgttgaacgggaatgaagcggtttcatctctggccacgcggactgatcggtcgcgtgacgctggtgctgctgttggccacgctgctggaatttctgggcagcaccatcgtctatgaacagaccgagatctattacgccgacgatctggccgtccagcgtgtcgccgaacgtctggcactgagctatcgcgtgctgatggcggcggaggaggaagaacggccggcccttgcgaaacgcctgtcctctcccgacctccagatcgggtggtttgcctccggtgccggcacatctccgagcaatccggttcagatcggcacgctcagcgtgccggggaatgccctgtccctgcccccaacatctccccgagacgccgggctgctgcggatgcaggggctgctgatcaacagtcaggatctgctcgaaaatgtggagctgcgtctgagccggggcggccgcagcctgatcggtaccagacgtgatctgatcggcaccatgcgtcttccgggtcatgtcgacaaggatggcccccgtgacagcgccatcgtgtttttcgcgaccggcgttctgggcaggttgccgggattttatggtggtctgctctctgcggcgattctggcctgctgcgtactggccgccgccgccatgctggtgcgaacactgggtctgcccctgcggacactggctcaggcagcagatgcgatcggccatggcccaccggtccagatcaagccaagcggcccgcgtgaggtgcggcaggtggcacaggccttcaatgccatgcagacccgtatctcccacctcatcaatgaccgtactcaggctctggcagcggtctcgcatgatctgcgcacccccatccaacgcctgcggctgcgcgccagctttctggatgatacggaggctcagaccgccattgaggacgatctggacgagatggaggccatggtctcctccgtgctggcttttttggccggggatacggatcctgaaaaacaccgccccgccgatctggccaccatgctggaaacgctggtggatgatgccagtgatgccggacagcttgccacttattccgggcctgaacactgtgtccacacggtgcgccccgtagccatgaagcgggccttcgccaatctgatcggcaatgcgctgaaatatgccagccgggccgatgtgaccctgttctcgaccgaccacaacatacaaatcctcatcgaggataacggccccggcatcccggaggcggagctggaaaacgtgctggagccattccgccgcatcgaggtctcccgcaatcgtgacacgggcggtatggggctgggccttgccatcgtcaggcagatcgtggagcgggaaggcgggaccatcaccctgtccaaccgcacaggtggcggattacaggccaaaatcgtgctgccgctgcattccaccccgaccaaagatcaacagaccggctgaagcgttttttcagccagccatattttgtcacgggctttttgcaactgcgaaaaatccatgcgccataacacaggggcggccgggtggtcgcttcctcctgaggaggatcgttcaggacagtacaggagaccgtcccatggatacattcatcagcggtatggcccgatttcgtggcgaggtctttccccagaaccgggccctgtatgaaaagcttgcgcgtgaaggccagcagccgaaagcgctgatgatttcctgtgccgatagccgcgtcattccggaaatgatcgcccaatgcggccctggagagctgtttgtttcccgcaatgtcggcaacatcgttccgccttatgtagatgaatcctctctcaccggcgaagtcggctctgcgatcgagtacgccgtggccgtgctgggggtcagtgacattgtcgtatgtggccattccgattgcggcgcgatgaaggccattatgaacccgtccgcgctggaacccctgccgcatgtcaaatcctggctgcgtcacggctgcggtgatcaccagcgtctgtgcgagggcctgccctctacggaaaccggcggcgatccggtccgtaccctggccatgcgcaatgttgccttgcagctgaataatctgcgcagctaccccgtcgtacgggaagccgtcgcggatggtcggttaaggctccatggctgggtgttcaacatcgaatccggcggcgtctatgcgctggatggcgaaaccggacgctatcacgaagtgatggatcaccgcctgccggtcgccattcatgccgccaatgaggatgcggcctcgatcattccgatggccgctgaataaagacggctccccttcctttcctgccccccggcaagttggaggagtgccgttgacctcgaccgcgagaaaagaatcctcttttctcgcggtttttttatgcagcctggcggccttcgtacaatctgtcatcaatcacagctatttttttgaaaaagcgcacggattatacccggacagccttcccccttacaggatcaaacgataaagcatgccacggtgcggccgaatggcagtgtcaccgcacagatcggcacaagcgccacaatacggcggaggattttgatgactcttcgttatactggacctgcaatcgcatgtatggcgcttgccctgtcggcctgccagaagccgccggaagccccatccaaacctgcctacatttatgaagcggatacggtcggtgcagccccgtcctgctccgcacaggacgtcaccctgaccccgggcaaggaaagcgccatcaccatgaccgtccagaatgacggtggctggtgcgcagccaaggtcacggagcctgatcgcaccccctatacggccggcctgctgatcgcccgtccggctcatggcaaggtggttgtgcacagtgtcggctatgacacccgcaccgattacacacccgatccgggctatcagggtgctgacagctatgtggtccagttgctgccgggggatgctatcctgcgcgtgaacgtgaccgtgacccctggcaagacgaatatcacacccgccgtcaccgctccgaagcctgccaaggcaacggccgcgcataagcgcagcagcaagaagcgctgaaacgtaaagacgcgacccgaacaaaaaaccgccggacaacagcccggcggttttttaatgccatcgctcagagagaggagtgcgaaaacattcccgcaccctgccttgatcagctcagtgcttcttgctgcgacgggaagaagaaggggtggagacggcaggcccatcctgcaacacccgacaggcaggtgcagtggcgggatacgtatccttcccggctgcatagctggccagcatgctgtctttcggcaacgccatcacttccgtaaacagcggcgtcccaagcacgcagaaatcgctgccttccttgagggaactggtagactgcccgttggcaaggccggtgatgaaaatatcatggactttctgcgcggacttcccggcagccttctggaaccaggcgctgacatcctgatgcgccgctgccagagccgggcgatagcgggtgacaaagctgttatacgcatcttcggtgtggcaggccttggcgatcacctgcaattcgctctggagggcgacggtatcgaaggccgcctgctctgcctgactggagcaacccgaagcggccacagccgggacagccccccccattgctgcggcggcaaggcttgcggaaaagcaaaatccgtaaaggacggcgcgcatggatatcatcccttgcatctgtttacaccggctcaggagccagcgtgcggatactcccgagcctcctcgctgcctgatacttacgaccggcaaggcgagtcatcgcggcaagtcttttatctctgaccaaaaatgccttgaggatcagagtttagcgaggttttgataaagcgaaacccgaaagaatcaagcccgcagcttcgggacaattccatcgtcatgaaaatatttcctgactctgacaggcagagggtgcagtggagggctggtgattttcagtgccgctggctacagcggcattggcgcaggcggatcgaaggagcaaacggcaggcaatgtcggaagaccagtggcaaataccgcagaacatgcagcctcatccttcggattacagcttcgatctggaggctgtcctgcaaggcattgtcttcctgcgttgtcttggcccggacgggtttgatcccgatggcagcgacgatcagggcgcacagcggaccgggagcggtgtcgcgatcgaggtcggttccagccagacaaaaatggtcatcaccatgacctatctggtgaacgacgccgatgcgatctggatcacgacacaggacggtcaggtcacgccgggtcatatcatcgcgctggatcatgaaagcggctttgcgctgatccgtccggctgacgccttggcctgcccctccatccagatcggcgattcctccagcgtcgccagcgaaagcggcgcgattctggcagcctccggcggcatcacccatgcgatggaaacgcggatcattgcccgtcaggaatttgccggatactgggaataccacattcccgatgcactgctggtgaccccaccgcatcccgtctggggtggctgcgccctgatcggcatggacggtcgcctgcttgggattgctgccgtggtgttgcagcagggcgatgtcggtgcaggacagctcgacatcaacctgatcattccggtctctcacctgcaggccattctgccagagctgctgacccatggcagaaggctggccagtcggccatggctgggcctgctggccgctgaacaggaagcgggaatcctcatcagcgacgttgttccacacggcccggcagaagccgccggtctgcggcagggcgaccagatcatcgccatcaatggcaaggagccgggtgatctggcgacgctgtggcggctgctatggcaaagcggtgcgccccccgtgggggttgccatcaccatcctgcgggatggccagaccatgcatacgcaggttcaggccattgaccgctatctgtatgacaaaaccccccggatgcattgacatcccggccttgccgcgtcaggccggaacattacccttggcccgttcgaccgcatatttgatcagcgccgccgcggaattatagcccagcttgctgcggatttgtaacgctgcgtgggccgccgtgcggtagctgacgccaaggatcacggcaatctcgttcaggctgcgtccctgaccgagcagatcgaacacctcgcgctcccgtcgggataacgggcgcagggggtcatccggctcccgcagcgtgtggagggcgattttctcggccaccctcgggccgagatgcattccccctgcaagcaccttgtccaatgcctccagcatgctgaacggatcgtcattcttggtcagataggcggaagcccccccctccagcgcgcgggagacgaaagcgggatcctcatacatgctgaacacgatgactttcagggaaggcatgtccgccttcatggcggccagaacctccagccccggcatgtccggcagattgagatcgagcaccacaatcgcagggctgtgctcccggttcagacgcactccttcagcacctgtgctggcctcgatcacctcaacccgctcctcggcatgatcctgagcctgaccctgagcagagccgacaaccattttgcgcgcaggggtataatccgtcagcaagcgtcggcatccggcacgaacaatcggatgatcctcgatcagcagtaccttcatcctgtattccttccccgcgttcatacggcatccttcagaccgtcagcgccgtcagcggcagaccggacagcaccaccgaactgcaccacccggacggcaccgtcagcgggataccctcttatagatcgtggatattagccgattggctacgggaagcgactcccccgcccttcgcatgccatggaattccggcaaaaatcaccgcaccgccgtgcagccagagatcgtgaccatcatccggctcatcctccccccattcttcgggggaaagcccggccttttgtgaggccatcatcatttccgccagcttgcctgcggcaccgggctggccattatcgccgatataaagctttccccccgccgcacggacacgctccgtcatgcccagcagaccgtaaccataagaaggggctcccgaaaatccggtgccatcatcgcgcacatagacgcccagccatgcaggctccgtcttgcaatcctgcgcggctccggctggtttctcccgcgggggaagccggggaggcagccagaaaaaaccaacctccacatgtctggcatcggcgtgacgggcaatgttggtcagacactcctgcaccagacgaaacagggtcagagccagatccgtctgtgtctgctccagcccggtacagagcatgatatcccattgtgtttggggaacgcgccgccgccagtcctccaccagacgctccagcgcatcgggcaggcccatttcctccagcaccatcgggcacaaacgctccagcatggccgcgtttatgttctggatggcatcgaccagagacccgatcgacaagacccgcgactcgatcttctccacctcgcggatcggtaagccagcctgctcctcacgctgctgttgatccctgcaccaacgggtcagggaggccagctcggcccggatggcgaaaaaagccgggccgaactcgtcatgcagctcatgcgcgacatcacgccgctccgcttcctgcatggagatcaaacggtcgatcagatgatggttatcctgcgtgatgcgttgcagccgtgcggccagactgtcgaagcgaaccgcgatcggctgcaactccgccaccgttaccgggccgagacgggtggcatattcccccgcctccagagcctcgaacccctccgccaggcgcttgagcggacgcagcgacagggacgtggccaacatgatcagcagcacgatggcaaccgagattgcggcaagctccaccgcgatcaggcacagctctccccagacctccttcatctcatcgaacggattggcgatcatgatgatctggccaatgatcgcaccgtgatacagcaccggaaacgaccgggcgacgatcggctggggcagcagatcgacaaaccagtgcggcacacgcggacgctgcccgaccagcaaaggcggcatccccatcgccatcatctcaggcgcaggcagcagtaacaggtccagatgccggacacgcggcaactgttgcgccaccattgtcaacgcatcctgctgcgtcggcatagcgcgggccgtcaccagcacggcctccaccagcacacgcccaaggcgaaaacctgactccatttcattccggattcggtggttggcccggtgaaggctcagcgccagagaaacaatcagaccaaccagcaggataaaggccggcaacaagaccagtcgcccttgtaaagagcgtgttaaacaaggccagaatggcatcctgaagaatagtttctgcattttatgcatattctatatcatatacggcaaatatatattcattttatgtgccacagcttccaacaaaatacttttaaaggtcaaaataccatagacattaccaaaaactaatttgtaggacgcaacgagttaaagggggtcacaatgagaaaaagaattgtacttgccgccgttgcgccttttattcctgccgtcgcaatggcacagggaacgatgaagaatgccgcgagccaaggcaatcaggcagccgcttcgtctaccgctgagaacaacacacccaatttcacgctgccttccttgcaggtagtgggaacgacccctcttcagggatcaggcctgaaccgggaggaagtacccgcggccactcaggtttataccgggcttgatacccagaaaaccggcccggcggacctgctgcgttcgctggaacagcagggcaccggtatttccttcaatcaggcggtgggcaattcccttcagcccaatctgatctatcgcggcttttccgcctctccgctggccggtgatccgcagggccttgcggtctatgtcaacggcacacgcttcaaccagtcctttggcgatacggtgaactgggatctgatccccagcatcgccattgatgaaacacagctggtcggtgccaatcctgctttcggcttgaatgcgctgggcggtgccctgtccgtgcgcatgaaggacggcttcaactatcagggcggtcaggttgaggtatcgggcggttcgttcggtaatatcaccctgtccggacaatatggcgtaaagtccaaagacggcacgatgtccgcctatatcgctgccagcgggatgaacgaggatggctggcgtcagcattctccctctcaggcgcgtcaggtttacggtgatatcggctggcgcagcgaccgtgccgaagcgcatgtcaacgtgacctatgccaacaatatccttgtcggcaacggcacgactccggttgaattgcttgccgcagaccggagtgcggtgttcacctatcccgaccagacccggaacaaatatgtccgcgtcgtcggcagcaccacggtgacagtgaccgatgagtggtcggtgcagggaaatgtctattacagcaatctgtcccagcgcaccttcaacggcgatgcggccgaggtcgagccgtgcgataatgaccccactctggtctgttcagaggatggccccccgctgcaatcccgtcgtggcggatatgttccgaatttcgtacagaacagcccgtataaccagcacggcttcgattatgacgagggcggcccctacgcttatctgaaccgcaccgcgaccgataccaacgggttcggagcctcggcacagggcgtgaataccgccacggtgttcggccataagaaccatttcgtggccggtgtcagctatgatggcgggcgcagcaccttcactgccaacactttgatcggcccgctgaccctggatcgcggctttggcggcccgagcatcgaggttgatgactccactgccaatgtcctgccggtgcgggtgaacaccagcaacgactattacggtgttttcttcacggatacgttcgacattaccgaaaaactggccgccaccgtctccgggcgtttcaactccgcccagatcgcgctgaacgaccagatcggcaccagcctgaacgggcagcattcctataaccgtttcaaccccgcagccggcctgacctggaagatcacgcgctccgtttccgcctatgccggctatgccgaatcgaaccgcgcgccgaccccggcggagctttcctgcgccgatcccaccgccccgtgcagcctgaccaacttcttcgtcggtgacccgcccctgaagcaggttgtggcccatacctgggaagccgggttccgtggtcatcacaaggtcgagaccgccaccgtcaactggcataccggctatttccataccggcagtgatgatgatctggccttcgtctccagcgagacctccgggcgcgcctatttccggaacgtgggccccaccacacggcagggcgtggaagcctcggtcaacctgattgcgggcgcatggtcggtcttcgccaactattccttcaccgatgcccgctatggcagcaatttcacgctcaattccgaggataatccttacgctgatgacgggctcgtcaatgtgcgcaagggcaactacatcaccggtattcccgcccatgtgttcaaggtcggggtacaatgggccgtgacgcccaaatgggtcgtgggtctgatcgggcgtgccgcaagcggccagtatctgatcggcgatgaaggcaaccagaaccagcggaccggcaattacttcgtgatggatttcaacaccgcctaccagatcacgaagaacgtgcagctgttcggcatggtgcggaacctgaccaaccagaactatgccacgttcggcacattctccccggttggtgaagttccgatgcttcaggctcccaatgccaccaataccagaagcctcagcccgggcgctcccatcgccggttatggcggtgtgcgcgtttccttctgaaacggcttgatcctgtatcatcatgaagggcggtctccggaccgcccttttttgatctctgtcttaccggctcagggtgagcagtccttcaaatcggcatcgccgattgcaaaagcataggggccgtcttccttcgcctcgacatcatgaaccacacagctccgcccgcgcttcagtttcagcttcacgtcatagcggcccggctgaataccgaggattttcaggcgctcatccgcctcaacctctccatccttatcgttcttgcactgatcactgccccatgccgtcgtaccgacaggagccatctgaagtttcacgatggtgtcggaggtcgtattccagaacctcattgccttacccgcagcaattgcgctgccaccagcagttatgatcaggcccaacccgatcaggccgccgaaccacagcatgcgatatccccgaccagaacgcttcatgggggcaagggtgattgctggaattgagtcacctgtttcaattgaaataatcatggacttttgttccttcctgaaacccatcatgctgcggtctggagccggttggcaaagatgccatgccggtgccgcaaaattgcctcaagaatgcctcgacgaacggctatcggaaagggcgtcaacaagataatgtcccggcgcggctcattgggggccgtgcctttccgaaccaccttgcaacgggacgaaacgatgcaaagcaaactggttcctgctctcgctttttccgcttttgcgctgctggcctccggccaggcgcacgcggatggcgatgccgaagcaggtaagaccctcttcaagaagtgcggcttctgccactccaccgaagccggcaagaacaaggtcggcccctccctggccgccatcgtcggtcgcaaggcaggtgtcgagcctggcttcaactactccgatgccctgaaaagctccggcctgacctgggacgaagccactctgaacaaatgggttgagaatccgaaaggcctggtatccggcacgaagatgatcttccccggcatcaaggacgagaaggatcgccagaacctgatcgcctatctgaagactctcaagtaatcaggtcttccggggattggaggtctgccgcaaggcgggcctcctcctctgccgtcaggctgcgttctgacggatttgcaccgggcagattaacctgcctgatcatgctggcaggctttccacccagcatcatcacccgattcgcaagccttgccgcgtccagcgcctcatgcgtcaccattaccgttgccatggtgccggagcgccagaaacgtcgcaataaacccatgcttctgccgatgctgtccttgtccagcgaggcaaacggctcatccagcagcagaatatccggtttcgacgccagcgccctgaccaaagcagcgcgccgtgccatccccaacgacacgcgaccaggaaggctgtcagccacttccttcagtccgagttctgtgaacagacgctctatcagcgcctcatccggggcaggcatcatcagcgcgacgttctgacgcagcgttttccatggcagcaataaaggttcctgaaacaccatgccgatgcgcggaaacgcacggttgcggcgctgcctgatgctgtaacccgcccaactgacctggccggaatacgcatcatccagaccggccagaatgcgcaacagactggtcttgccgcagcctgaccgccccattatggccagcacatccccccggtgcagatcaaacgaaatgtcccttaaaacaggggttacgccatgatttttggcttcgatccgcacctgcagcaaggtggcggcagcatgtgcctgctctatcgccatgaagagacccgccgttccagcacttgcagcacgccccattccagcgcctgtacgacgagaataaaagccagcgtgtagaccagaatcccggtcacatcgaaaagctggaaatacacctgaagctgaaatccgactccatcactacgccccagcagctccaccaccagcacgattttccagatgatcgacaggccggaacgggccgctgcaaaaatatagggtgccaattgcggcaggactgcgtggcgcaggatggcaaggcggctcatacggaagctgcgcgccatgtccagcagagccgggtccaacgcccgcgcgccttccctcaccgtcacggcagtgttgggcaacttgttcagcgccacagccatcaccgccgcccactccgtcagcccgaaccagatatagatcagcacgatcaacacgacggcaggcaggttgagcagggcggtgagcagactgtccatgatcgcattgagacggggcatcctgcccaaggccacgccaatcgccgtcccgaccaccagtgcaagcgtgaaagactcggccacacggcgtagcgtaatcgccaatgttggcagcaaggccccatgcattgcctgctgcaccatggcgacgatgacagtgctggcggatggcaacaagggatcatgggcccagaccgccgcgccctcccaaatcgccagcagcaacaccatcgacgcgacccgccagccgaagccgatctggccggtgcggggggcctctccgcggacagaaaatgcggtcagagcgtgacctccgccaaaaacagtccgaccggtatccgcgtcggcaggccggaggtctctgcaccgggcagggcatgcaggatcgtcagcaagctctgggccgcatcaatctgcgccttgccccagtgatgcggaataccagcccggtatgcatcccgcagcaaggtcaactcacgatcgtcttccgcaccggtcagggggcgaatggcctgccactccgtatccgatgtcgcgagaagggcctgtgcctgcgcagcggccttcagaaatctctgcccgggctgaccggggccattcgcccaggcggagcgaaacacatagcccacaagaggcgtatccaccggcagccccagccccgccagagcatcgccaatatgcagcagaacgcgcccaccatgcgcctccccccgtgccacgaacggccaataggtcaaggcagcgtccagtcttccccggttcaactgctcgttcaacagcggtggggcggcaaaaaacggggccaggctctgcgggtcataacccagcttgcgggcggcaaaagcgcggaaaatcagccagcttttatcgatcgggcccccagccacccctaagctggcctgtttcagatcatcaatcccatgcagcctgctatcagcccggaccagaatacccccggattcgctggagaaaggggaaaatacccagtctccgccctgttcgcgctgtcgggccgcccagagccaatcctgcacggcaaggtcggccgagccagcctgtaacgccacctgcgtggcctgtgatccggcgagtgacagctccaccaatcgaaagccggcatcacgatccagattatgacgccggatgacatccagcagccaggaaaggctgccgaaacgcaggctggcaaccctgatctcaggcatggaagggtccgccgcccgcgcgattcctctatgaacggcaagggacagcccaagcccgcccgtcagcacgcggcggcgggaccagagcaagggattctgtatcctgcccgtttccaataagctcacggcgttttccccaagccttgtgatcaaggcgttttgggttatatccggcccatatcggcataaattgtcaatatttcatggatattttcaccataaacgtatttttatccctgttatccatcgccacatcagcaggcacatgagataaaggtaaaagcgtctgccaatgtttcggcccctttatccggggaagccgtgtgtgtggcggggatgcggaggaaacatatgagctggatcaagcacgcgagaaacgcggcaccggcactgaccatactgacctgtctggcggctctgccggccggagaaatgctgacgccccgtgcagcgatggcacaggacgcggctgcaacgccggaacagacgatccgcatcgtctatctggagctgcatgaaacgcgccggtggccctccacatggctggatcagcctcccgccgatgaaggcgtggaaggtgcacgtctggccctgcgcgacaatgcgaccacgggccgcttcctgaaccagaattacgtgctggacgaacagattcatccaacgcccgaggccgtaatacaggccttcaaggacaggttgaaagcaggtgaccggaatttcgtgctcagtgtgccgcctgacctgctgctgcgtctggcgagtcttccagaagcgaaagacgctctgctgatcgatgcgaaattgccggatgaccggctgcgtggcgcggattgccgccacaacgtactgcacaccatgcccagccgcgccatgctggcggatgcgctgatgcagtatctgaccgtcaaaaactggcaccacgtcatgctggtcagcggaaaaaccccggatgacgccttatatgccgaggccattcgccgatcggccaaaaaattccagatccgcatcgtcgccgatcgcccatggaccttcaacccggcgacacagcaggcggatacgggacatttccagatcaataccgaggtttcccgtctgactcaggatgtcgattacgacgtgctgattgttgctgatgaggcaggcaatttcggtgacagcctctcctaccgcaccaacacgcccagaccggtggccggaacgcagggaatggtgccggaggcatgggccagaccgttcgacgaatatgccagcacgcagtttcaaagccgttttctgaaactggcccatcgctggatgaccagtctggattacagtgcatggatggcagtgcgcagcttcggcgaggccgccacccgcaccgggcaatccgatccggccaaactggcggcctatatacgcggcgattcctttgctctggccgcctataaaggaccaccgctcaatttcaggccctgggacgggcagttacggcagcccgtgctgctggcggatgatcgttcgctgatctccatttcgccgcagcccggatttctgcaccagttttacgaaacagatacgctcggcatcgaccggccggagagcacatgtcacatgcaatgatccgccaccgcttggcagccgcgattgtcagtgctgcgctggcaatcccgcttttcgccaccagcgcgatggcgggcaaaattcttgtctccaatgaaaaagacaacaccatcacggtgctggatcaggactctctcaaaatcatcaagaccgttccggtgggtgcgcgcccgcgcggtatcgtgctctcgaaagatggaaaaagcctttatatctgcacatccgatgccgatcatatcgaggtactcgatctcgccagcctgaccgtcaacaaaaccctgccgagcggacccgatccggagctgttcgccctcagcccggatggaaagacgctttatatttccaacgaaaacgacaacatggtctccgtgcttgatatcgggcaaagcaggattgtcgatgaaattcccaccggcgtggaaccggaagggatggcggtcagcccggatgggaaaaccatcgtcaacacatccgaaaccaccagcatggcgcatttcatcgacgccaaaagccacaagccggtggccaatgtgctggtcggcacccgcccgcgttatgcggaatacaacaaggatggctctctggtctgggtttcttccgaagtggcgggtcaggtcgccgtgatcgataccaagacccataaagtgatcaagaccatcaccttctcaatccccggcgtaccgaaagaagcaatccaggctgtcggcatcgccctcagcgatgacggcaacactgccttcatctgccttggcccggccaatcgcgtggcggtggtggatgcccatacctacgacgtcaaaaaatacctgctggtcgggcaacgcgtctggcacgctgcgttttcaccggatcagaaaacactttataccgccaacggtatcagcaacgacatgtccgtgatcgacgtggccggcctcaaggttctgaaatcggtgccggtcgggcagctgccatggggcgtggtggtggccccctgatgccaacaccgtcagcctcttcatccgccgcgctggcagtcacccgcctcagccatgctttcgggccacggcgggtgctggatgatgtcactttcaacattcagcccggtgatttctccgtcctgctcggactgaacggggccggcaagaccacattattcgggctgattacaaggctctatcacagcaaaagcggccatatcgccgtgctgggtcatgatatgcgccaggaaccaggtcgtgcgcttgcccgtatgggggcggtgtttcagcaatccacgctcgatctcgatctgaccgtattgcagaacctgacctaccatgccgccttgcatggaatgccttcccgagaagcccgcgaacgcgccatggaggaacttggccgtatcggccttgctgatcgtgcgggggatcgggtgcggcagctttccggcggacagcgcagacgtgttgagctggcacgggcactggtacacgcaccttcgctgctgctgcttgatgaaccaaccgtggggcttgatatcgaaagccgccgcttcctgcttcaacatgtgcgcggattgtgccgcgatcacagtcttgccgtattgtgggccacccatctgattgatgaagcggatgagcacgcccgcatcatcgtgctgcatcaagggcaggtactggcacagggtgcgcgtgataccattatgcaagacgccgatgccgttgatctcggcaccgcgtttgagcgcctgacgcgcaagggtcagaataacaagcgggaaaaagccgcatgacgacagcgtttttatcacccggccagtacctgcgctgcatgacggggattgtccgccgggaggctttacgctgggtacatcaacgcggacgctttatctccgccttggtgcggcctctggtctggctggtcgtgtttgccgcgggattccatttcgtactcggtgtctcgatcattccgccttacgaaacctacgttccctatgaggtttatatcgcaccgggtctggtggcgatgatccaattattcaacggcatgcaatcgtccctctccatggtctatgaccgggaaatgggcagcatgaaaaccctgctgatcagcccgtttcctcgctggttcctgctgttgtgcaagctgctggcaggtgtgacggtttctattgtgcaggcctatatttttctggccattgcatggttctgggacatcacgccgcctttgaccggctatctggctgtactgcctgcgctgatcatggccggcttgatgctgggggcgctggggctggttctttcctcctttatcaaacagctcgaaaattttgccggtgtgatgaacttcgtgatttttccgatgtttttcacatcctctgcgctttatccgctgtggagggtcaaggatgccagcaccacattatggtggttctgccagatcaacccttttacccatgcggtagagctgatccgctttgccttgtacgataagttcgccacccaatcggcgctgatcgtcctcgcctataccgttttgttcatggcagccgccattctgggctacgatcccggtcgcgggctgatggcccgtcgtacggcggcagattgaaagtgtcgaacctcatgcttcgcaacaccgtctttcgtctgacttctctgctgctgctgacaacggcggccaccacgccgtcatggtccgcgtctttcgacaaggatcctgactggccgtgccaacaaaggctggtgccgcatgtcgcggcagccacctactgggccggagaagcgcctgttccttccgccgaggatgcaccacaggacaaggcccgtaccgccgtgattgctgccgtctccgaccgctcccttccgctggcggatggtcaggccaggcttgcggcctatgccgataccattccgcaggcagagcgtagcaaggtgctgggaaccctgttcgcggatattacggctgcggtcgatacggaacgcgcatcgctgatttcccgcatcaaggaattgggccgtcaccaacgcggaattgccagacaggtggaggcggtcaatggcgatctatccaaattgccggaagagccgcagggcgccgatctggttaaattcaacgacctgaatagtgagcgtggattgctggtccgcagctatcaggaaacccagcacacgatgcgctatgcctgtgaagcccccgctgatctggaagggcggctggcggcctatgcccggacgttacaggcaaaaatccagtctgcgcactaaatcctgcgcgtcatacaggggtgttaaggctgctctggcgggaaaacaggctggttcggcacaagccggtaaccagctgctttccatgcctcggttcctcccggaaaccatgcgacatggggatagccgtaggagagtgcgcgcttggccgcattccagctcatccagcaattgggcaggcaatagaacacaagcagtttgcccttgtcgcccatggtggcgttggcaagctgatgccggaaccatgtatcaacgcctggcggcaatgttcccagtccgatatcggccagccacagactaccgggaatatcgaggcgcggtggaggcatccatggcgtttccggcgcacttcctttcggcttgcgaggagcgaccatggcatcaatcaggaccacccggccccgctcgatcactgtatgcagcgcctccgcatccagcacgatggcgcctttaagcgtcgcgggggtcggcgcccggaaatcctgcatccggtaaccatcaggctccggcgcaggggatgcggcccccaccagcaaggatgcaatcagcccagccgcaagccgcatcgttctcatgctttcctccgccatctttcctgtggggccggctcactgcgcggcaggtgccgctttcgggatgatcgggtggttttgttcatccagcaacggtacatgataggccatgagaatatcgtcgatagcaggctggtttttgcgcaaggccgcattcagacgacggcgccattctgtttcattcggacgcacaccgagcgcaacacgataatcaagccgtacttttccatccgactgcaaaaaatccatatgcagcggcagcttgccctcggcgatgaaatagccggcgaaaggcccccagatcagggccacatcgatcttgtgatccagcagatcctgcaacatctggcgcgggggcgactcgacacgtgtatcgacttgcagagaataggcggtcgcacgatcaatcagatgagcatgcaacagaagatcggaaggcggggtcgccgcaatcaggccgaaccgtttgcctgccagagagggatccgtcacggaggtcgcagtgaggtgatcctcctgccgcgtcacgatcatataggcggagtgataataggcgctggtgctgtccatcatgccgttacccggcacgacaccaatcacaacatcacatttttcggcgatcagcgtgttgcgcagaaaaccaacagtctgtggaaaccacgtgtaactgacgggaagcgacaaggttttcgccagcaatgtggcaatcttgttttcaaaaccttcccgctttttattggagaaaggcatatcggatggatcggcgcagacgcggaaagcagaccgactgaccagatcgacatcatattgggcaaaagcaggcgcatgcgccgcacaaaacgccagaaaggtcgagacggcggccagaaaccgcaaccgcccagtcatgacacgacgcatggcacgctccaggaatcctgatccggcgaagcacgacgccccgccggaaaggaagagggactgatcagtcgtcgaaacgcttcggacgaccgcggcccagcgccccgtcagaacgggccttcaggtacatatagatcgaatcgagattgttgacgacgtcggcgacttcaccaaaagcaggcatcacgctgtcgctggtggtggaaacattcttgcgaccattaatgacggtctgggtgaacgtgtcatagctcatggtcttgagcgagttggtcagattaggagcataggagctgccggaaccatcgggaccatggcaacgcaggcagttatcgccataaaaattgtagccatgagcaatcgtcttgtcgcccttgccgtctttcacatgcttcttgtaatccggcgcatcatccgcatgggccgcggaaatggcaccgccagcgaaagccacgctgagcaggacggcggcaaggcgtgttttgatgtgtggcatggatcgtcttttccttcctcagtcaaaaggccgttgtcaggggcgacatcggctttgggacaaattccgcgttatctgcatatttgccccagactaattccggcatccgaggcattttggacgcgatagcaagataaagaaccccggcgacacgtcaatgtcgccggggccaataatcagtctgtcagacgatagccggcatcaatcagttgtcgatgccgaataccgtcagcacgccaccaagctgcgtgtagttggcgagcgagcgataggcacccactgcacccagaccttcagcgtccccggacaggccagcggccataccgataccggcccagccaccaaggccggacagaacggcgatatactgcttgcccttgtgctcataggcattgacgttgccgatgatgccggacggggtcttgtatttgtagagcagcttgccggtcttggcatcgactgccttcagatagccttccagcgtgccgtaatacacaacgccaccagccgtggagagcgcaccggaccatacggagaacagttccggatcggaccaggcaatcttgcccttgttaacatcataggcgatgaagttgcccagatggttttcgcccggcggcggatacatattgacggtggagccgacgaaaggctgaccggcggtataggataccttgaacggctcataatccatgcagatgtggttcgtcggcacgtagaacatgtggttctgcggatcgaacgaagcaggctgctggtccttgacgccgagagcggcggggcagatgcccttcgtgttgtggtcttcaccacccgcttcggtggagtatttcttcacacgatcaggcaggccggtcttcagatcaacgccggtggcccagttgacgatcggatcgaacttgttcgcctgcagcagctcacccgtcacgcggtcaagcacataggcgaagccgttacggtcgaaatgcaccagcgccttggtttccttgccgttcactttcgtgtcggcgaggatcatttcgttgatgccgtcatagtcccattcgtcatgcggggtcatctgatagacccactttgcaacgccggtatccgcatcacgcgcgaaaatggtcatggaccacttgttttcaccaggacgctgcaccggattccaggtgctgggattgccggacccgtaatagaccaggttcagcttcggatcgtaggaataccagccccaggtcgcaccgccacccgttttccactgatcgccctgccaggtcttgatggagctgtccttgccaaccggcttgccgagagcggtggtcttgtcatcgaacaggatctggtcatccggcccggtggaaaacgccttccagaccagcttgccgtctttcaggctgtaagcggtcagacggccctgcacaccgaattcaccaccggagataccaacaatcaccttgtccttcacgatgaagggggcgctggtggaggtttcacccttcttcggatcgccgttggtgactttccagacttccttgccggtcttggcgtcgagggcgacaaccttggtgtcggcctgggccagaatgatcttgccgtcaccataagcaacgccgcgattcacggtgtcacagcacatcaccggaatgacttccggatcctgcttcggttcgtacgaccagatcacgcggccattgtcgttcagatcgagggcgaacaccttgttcgggaacggcgtatgcacatacatgacatcgccaatcacaagcgggccgccttcatggccacgcagaacaccggtggagaagctccacaccggatgcagcttgccggcattggcaaccgtgatctgcttcagcgcgctgtaacgctgattggcgaaatcaccggcctgcatggaccagttggccgggttcttggacagtttcgcgagatcttcattggcacgcgcgccatcaaccgcagtcaggccgacaaaggctgacacggcaacggacatcgcaagcagtcgcttgctggacttcataaaaatcctccctgggtttggccgacccccaccaaaaacgcccacctttccggcaggtctggcattggcagaagccggtcgaagccacccccacctgtgctggcggatgtggcgcgcgggagattatctcccaccgccttccaacgacaagaggcaatatggcataaaatgcataaaacaggttacatgattggaaaatacatcgtcacaacagcgcatgatgtctggatattatagactctctgtcactttccggcggtatctgctgtcatgattcgtcacttaaattacgttttagagaaacgggatgatcactttgctcattccagaacgtgggaagaatgatagactaaaaccgcgcacaactatcattataagcaaataaactggcattaaatgccgtcaggttcaggaaatgctccgttactccctctctgccttgctctccgccatgttgctgaccgctccggcctttgccgccgatcagcccggcaccgaaccatccaccaatccggccgtccatgccgtgttcgaatcaccgcatctggccaatatcacccagccggaaacgctgatctattcctatgagtacaaaggtccgcagccttttacggacacggtgtcagagcagatcatcaagatccatcccgatggaaccaagctggtcgggtttcacttcctgactggcgaccgcttcatgttcacaccatcgctggatgattatcgcggcaatccgctggtgatgatctttctggaacatgatgtcatggagatgaaaaaatccatcggcatggccgccgcctatttccgtgcccgcgtcaaggaaggctttttcaaggctgccgtcacggataccaccttcacccatgacggcaagtcactgcctgccaaacaggtcgtcatggaaccgttcgccaccgaaacccggttggagaacgtgccgttccttcagcacaagaaatacaccatcatcctgtgcgaccagctacctggcggcattgctcaaatcagcacggaacagcccggcgattcgaaaagcggtattccgccggtcagccagatcctcacgttcaaaacggtgaaaccctgatatggcttatgcacgaaaaatcctgcctggcttaccgacagtctcgatacgctgggcggttttgttgacgggccttctgacactgccgacaatggcaatggctgatgaggccgccgaccccaatcaacctcacaaaccgcgctatgattatccgacctcagcccgcgccgattacgtgatcggttgccttgcctccaacggcatgaagcacgagtttctggataaatgctcctgcgggatcgacacgattgccgatcagatgagctacgacgactaccagcatgcggaaacagtcctcagcatgctgcaaggcgcgcttggtcagcgggccgaggagtttcgttccaccgccatactgacgaaactggtggacaggctgcggcaggctcaagctgaagcgaatctacgctgccattaaatctgatgtgagaggccggtcatggaggaaacattcctctgtggccggcagatcatcagcaccccgctattcggcaacgggggacagaacctcgttcggaacgggtgcattgccgatccggcgatacacgtaatccggcgccacatcaccacgcgcagaaacggcttcttccatcacatgatgcgcaggtgacagggcgcaggccggatcggtaatatccatatccccggtcagcgcgaaagcctgacagcggcaaccgccccaatcgatttcccgccggtcacaggaacgacacggttccggcatccagtccgtaccacgatatttctggaaagccggtgcgccactccagatatccgccagcgaccattcgcgcacagacggaaattccagcccggtcagagtctctgccgcatgacagggcagagccttgccggagggcgaaatattgatgaagcgccgcgcccaacctcccatgcaggctttcgggcgtttcgcataataatccggcgtcacgtaatcaatgaccatgacacctttcagccgctcccgcgcctcttccacggtcgcggtggcaatttccagctgctcccgactcggcaacagcgcatcacggttgaccagaccccagccataatactggacattcgcgatctctgtacgagtcgcccccattgcctgggcggcttccagcatgcgtggcagattttccatgttctgccgatgaattacgtaattcagtgtcagaggcaggcctgcttccttgatcagccgggcggctttcagctttttcgactgtgctccggccagaccgccgatacgctcggcattctcgacatccacatcctgaaaactgagctggatatgatcgataccggccttcatcagccgttccatcatcgcctcatccagcagcacaccggaggtgatgatattcgtatacatctgccgctcgaccgctctggcgatcaactccggcagatccttccgcaccatcggctcgccgccggagaagtgcatctgcagcacgcccagttcggccgcctcatccatgatgcgcagccattcctcggttttcagctcgattcccgcgcgctccagttcaagagggttggaacagtacggacattgcaggggacagcgatgcgtcagctccgccagcagccccataggaggttcgatggtgctcataaccggatggctcccttcgccgacatatccacaaacatggtgacgacatcagccgcgatcacctccctcggtgccgcaaaacgggataccagctcatcgatgattgcgccgatcgttttctgaccatcgacgagcttgagaatttccgccgccacagggtcgggctgaaacaaccgctccggcccaaggatgacccatgcgtcacgcaccttgtcatgccggaacttcataccctgaccgaaacgcggcaccgcttcttcattcaaagcccggggcagagcttgatcctgaggggcagacattttgtctctagacctcaggtacgaaggcaccgggcggaatattgccgggggccacataggaataatacagcgcatcaagctgcgaccagagcacatcacacttgaaccgcagggctgcaatcacggcctgctgctgttcgggggtgcgggcatgctccttcacataagccagcgcaaaatccacatcgcgtggagcctgggtcaggcgcggcttgaaataggccagcgtttcctccgacacccagtcataatttgccagcatgccggacacccgttcccggataatggtcggcgagaacatctcggtcagagaagacgcgatcgcctcaagaatcggcttctcgcggcagaatgtcacataggcatccacggcgaagcgggtcgtgggcagcaagccctccctgctctcgacataggcggcatccagcccgactccctcggccagtttcaaccagcgggcgatcccgccagtgccgggttcggtgccgtcatgatccaccagacgccgccgccactcgcgccgtaactcggccgtcggcagacgcgacagcagggccgcatccttggccgggatgctggcctgataatggtaccggttgagtgcccaggcctgcacctgtccacgcgtcagcgcaccatcgtgcagcaagcggtgaaacgggtggagattatgataacgctcggctccgacagcccgaagagcggcttccagttcgtccggcgtcatgaccctgttggtttcctgcccggctgtacggttatgaagctgtgtcataattctatctgcatcccatcatgggcgacggtccaccccgccgcgagcgcttcagcacgctccgcgctgtcttccaacaagacgggattggagttgttgatatgaatcaggattttctgtcgtacacccagatcgcggaacgaagcgatggtgccgtcttctccgctgacgctcatatgccccatgcggcgaccggtttttggaaccagcccggcacggatcatctcatcatcagaccataacgtgccgtcgaaaaataccgtatcgacacccgccagacgctgcctcagagaatcggtcatcatcgcgcaggctggaataaaacaggccgtagagcgcccgtcggaaatagccgcccccactgtctgctccccttcctcaaccggcgcgggggcattcatcagcaggccttcctgttccagatagagggggactttgcccggaaccgggaagaactcgacagtcaggccggatggttcgccacccggcagggtcaggacaaacggcccgctggccggaatgatccggcgctccaccacatcccgtgccaaaacctcaaaaataggattgtcattgaggataccgtgcacccgactggtagcatacacggtaaaagcctgcctctcccgcagggtcagcaagccggcaagtgcatcgacatcgccattggtgagcacaacacccgcaattggtgtcgaacggatggcaccgctcggatgcagcaccgcattcgcctcgatctgctggcggatatcgggcgaggcattaaacaaaaaccagaaaacgccgtcctgactgacggcaatggacgcctgcgtgcgcggtgccgccttgggatcgcccgccctggcgcgacgacatccggcggcgttggagttccactgagggaagccgccacctgcagccgacccgagaacgacgattttcatcgcacggtccgaccatggttaaaatgaaaacaacagaactgcggcgacctgatggggccgccgcattactgtatcaggaccatccggccaagctgagaagcgttatcccggacggtcgggcgcaatcactcagcgcaggcgtaagcgttgatctcggcgcccagagcgatttcggtcacagaaggtgtgttccaagccatttttaaagttcctccagtattttggtttttggacaattccaacgatataagcgtgttgccctgcccgtcaatcgcctggatcaattggccaatggaaagttttgcctccatgataggcgtgcagacagattcgcgccggagaattaggccggatagcgggatgagagagttggaacagagttcgtgattgataagctggaatacctgctggccctgtcgcgggagcatcatttcgggcgtgccgccgaaacctgcggtgtgacgcaacccaccctttcggctggcctcaaacagcttgaggaacagcttggggcgctcctggtgcaacgtggcgcacggtttatcggctttacgccggagggtgaacgcgcgcttgactgggcacggcgcatcacgaccgacaccaaggccatgcgtcaggagatccaggctctgaaatacgggctgaatgggaatctccgcctggccgtcatcccgaccgcgatgccgatcgtctcaaccttgacgacaccatttcgagacagacatccggatgtcacttttaccattgtctcgaaatcatccattgcgaccctgtcgctgatcgagaatttcgaggcggatgccggtatttcttatctggataacgagccgttgggccgggtccgtgcgattccgctctatcgggaacattactgtttggtaacggcccctcatgcaccgcttggtgaccgggaggaagtggcatggcaggatctgtccggtctgccgctttgtctgctgacacccgatatgcaaaatcgtcgcattcttgaccgaatgctatcctcgaccggggtcgaaccgaaggtcagtctggaatccaattccatgatcggtctgtggtcccatgtccgcaccggagcatgggccagtatcatgccggcacggctggtcgatattctaggcctgaatcccgaattgcgggctattccgattgtcgggggccctcccgcacctacggtaggactggttattcctcaccgcgatccgctgacccccctgatcgccgcgcttttcaaggaagcggaagccattgcagcccatcttgaacaagtaaccatcaatcaggctggccaataaaataaggccctgcctcaagccgaggcagggcgagtttattattcagacaggaccacgatcggaattggtttttttggatataacgcaggtacggcgggcaaattccaccgtactgaccgacctgtagttctcgtgaataaaaagatcgtgttccggctcatcatcaaacgcgctgtccgccaccacgcggcgggcaagcagtgaaagatagtcaaatgcgctgattcgagaatagccttccagagcaccgcgtttcagatgcgcccgaaaactcgtatccagatcctcgacgacataatagccgcccttcagcaaaatcggaaacaaagtctgaaacgccaatatctgatgatcccaacggtgagagccatcatccagaacaataagcggtttgccaaattcattgataatatcaaacaagaaatctacattactggaatcgccaattcggacagaaataccattattattaaaacgcatacaatcctgattgatatcaacgcctacaacggttgcattctcgaagtattccctccacattgagagagattgaccttcgtagacaccaatctcaagaaataaaaatttttcttttcttaaatgattaaatcttcggtcatagaaatttaaaaaatcatgataccttgaagatttatcggtaccatgcctaaggccaattgcatcgagcatttcaaaaatccaaaattttattttacaagaaagcactttctctaattttaaagcatatattttttattcattcaatgttattgtttttaattaaaaaataacctgttttgtaacttagcgaagcattaaatttcaaactgcccaatcaatgcgaaccattctcatttaaattgttttcccgctaggatgatagaattgttctatcgcagcataaagactcgcaccttgatggaagaagatgaagggcgcagataacagcttccagaggaaactgaatcaagcgcggtgagccaaatcatggccaaggacgctttcagcgcggaacgcgctgcaagaattatcgatacccatcgtgaccaggaaggcgccatgttgcctatccttcatgatctacaggccgaattcgggtatgtgccggaagaagtcgtgcccatgcttgcggatgcgctgaatgtgtcccgcgccgaagtgcatggtgtcatcagcttttatcatgatttcaagaaccacccgcccggtcggcacgttctgaagttatgccgcgcggaagcgtgtcaggcgatgggtgccgataccctggccgatcatgttcgtgagaagctccgcgtggactggcatggcaccacggtcaatggctccgtgacgcttgagccggtattctgcctcggcctgtgcgcctgcgcacccgcggcgatgctggataatgagctgcatggccgtctggatcaggaccatgtcgatacgctgctggagagcgtggcatgaccatcaaagtatacgtcccccgcgatgcggccgcccttgcggtcggcgctgacgccgttgcccgcaagctggagcaactggcgcaggaacggtcgctggacatcgccattatccgcaacggctcccgcgggatgctgtggcttgaaacgctggtcgaggtggaaacaccgcacggccgcgtcgcctacggtcccgtgaccgcacgtgatctgcccggcctgctggatgccggcatgctggaaggcaagccgcacgcactgaatcatggcctgaccgaggaaatgccctggttcaagaagcagacccgtctgactttcgagcgctgcggcatcgtcgacccccgctcgctgagtgattatcaggcgcatggcggctacaagggccttgcccgcgcgctaactatgacgccggaagccgtggtcgaggacgtgaccaaatccggcctgcgcggtcgtggtggcgcaggcttccccaccggcatcaaatggaaaacggttctgggtgcgaaagccgcccagaaatacatcgtctgcaatgccgatgaaggcgatagcggcacctttgccgaccgcatgatcatggaaggcgatcccttcgtgctgatcgaaggcatgaccatcgccggttatgccgtgggcgcgaccaagggctatgtctatacgcgctccgaatatccgcatgccattgacgcgatgaaccgcgccattatcgccgcacgcgaagcgggtatgctgggtgataatattctcggttccggcatttccttcgacatggaagtgcggcagggagccggggcctatgtctgcggtgaggaaaccgcactgcttgacagcctggaaggcaagcgcggcgtcgtgcgtgccaagccgcctttgcccgctttgtccggtctgttcgggcagccaaccgtcatcaacaacgtgatctccctgacctccgtgccatggatcatgacccatggtggtgaggcttatgccgcgttcggtcttggccgttcccgtgggaccatgccgatccagatcgctggcaacgtcaagcaaggcggcctgtttgagatcgccttcggtatcacgctgggcgagctggtcgatgagatcggtggtggcacactgacggggcgtccggtgcgcgctgtgcagatcggtggtccgttgggagcctatttcccgcgcgccctgttcgataccccgttcgattatgaggcattcgcggcgaaggacgggctgatcggccatggcggcatcgttattttcgacgataccgtcgatatggctcacatggcccgcttcgccatggaattctgcgccgaggaaagctgcggcaaatgcacgccatgccgcatcggctccacgcgcggcgttgaaacgctggacaaactgctgcgcggtgaacagcacgaaaaaaactatgccgtgctggaagatctctgcaacacgatgaaattcggctccctgtgcgcgctgggcggcttcaccccctatccggtggtcagcgcgatgacccatttccccgaggatttcgctccccgcaccgtcccggtggcagcggaataagcgaaaggagacctcccatgccgctcgtggaagaaatcgactatggcacgccaaaagtcgtcagtgagaaatccgtcaccctgaccattgacggacgccaggtgacggtgccggaaggcacctccctgatgcgcgccgccatggataccggcattacggtgcccaagctctgcgcctccgacaatttgaaggcgttcggttcctgccgtctctgtctggtggaaatcgagggacgtccgggtaccccggcttcctgcaccacaccggccatggaaggcatggtggtgcatacccagaccgaccgtctggcacgcctgcgcaagggcgtgatggagttgtacatctccgaccatccgctggactgcctgacctgctccgccaatggcgattgcgagcttcaggatatggccggggccgtcggcttgcgggaagtccgctatgggtatgagggtgaaaatcacctgcatgacagcaaggatgttagcaacccgtatttccagtacgatccgtccaagtgcatcgtctgtaatcgctgcgtccgtgcctgtgaggaagtccagggcaccttcgccctgaccattgagggccgtggcttcgaaagccgcgtctcccccggtgccgcacatgacaatttcttttcctcggaatgcgtttcctgcggcgcctgtgtgcaggcctgcccgaccgcaaccctgatggaaaaatccgtcatcgaaatcggccagccggaacattccgaagtcaccacctgcgcctattgcggtgtggggtgcagcttcaaggcggaaatgcgcggcgaacagatcgtgcgcatggttccctacaaggacggcaaggccaatcatggccatagctgcgtcaagggccgcttcgcctacggttatgcattgcacaaggatcgtcagcttgagccgatgatccgtgaaaaaatcaccgacccgtggcgtgtggtgagctgggatgaagccatccagtataccgcgaaagaattccgccggattcaggacaaatacggccgctcctctatcggcggtattacctcctcccgctgcaccaatgaagaaacctatctggtgcagaagctggtgcgcgccgtgttcggcaataacaatgtcgatacctgcgcccgcgtctgccactctcccaccggctatgggttgaagacgacctacggcacctccgctggcacgcaggatttcgacagtgtcgaggaaagcgatgtcattgtggtgatcggtgccaatccggtcgatgcccatcccgtgttcggcagccagatgaaacgtcgcctgcgggatggcgcgaagctgatcgtgatcgatccgcgcaagacagatctggtcaaatccccgcatatcaaggccgatttccatctgcccctgcgccccggcaccaatgtcgccatcgtttccgcactggcccatgtggttgtgacggaggggctgctggacgaagctttcgtgcgtgaacgcaccgattgggagtccttccaggactgggtgcagttcgtgacccgcccggaaaacagcccggaagccgttgccgaaatctgcggtgtcagtgccgaagatattcgtggcgctgcccgtctctatgcgaccggcgggaatgccgcgatctattacggtctgggtgtgaccgagcacagccagggtacgacgacggtgatggccatcgccaatctcgccatggcgaccggtaatctgggccgccgtggcgtgggcgtgaacccgctgcgtggtcagaacaacgtgcagggttcgtgcgacatggggtctttcccccatgaattcaccgattaccgccatgtttccaacgatgccgcccgcgcccagttcgaagcgctgtggggcgtgtcgctggatgccgagccgggtctgcgcattccgaacatgatcgatgccgccgtcgatgggacctataaaggcatctacattcagggtgaggacattgttcagtccgatcccgataccacccatatgattgccggtctgaaaaacatggaatgcgttgtcgttcaggacctgttcctgaatgaaaccgccgactatgcccatgtgtttctgccgggctgctccttccttgagaaggatggaaccttcaccaatgccgagcgccgcatcaatcgcgtgcgcaaggtgatgtcgccgaaaaatggttatggtgactgggaaattacccagatgctggccaaggccatgggttatcccatgcactacaaccacccgtccgagatcatggacgagattgccgctactactccgaacttcgcccttgtttcttacgcgaaactcgatgaggccggctctgtgcagtggccttgcaatgacgagcatccggatggcatgccgatcatgcatatcggccagttcagccgcggcaagggctatttcgtcgtcaccgaatatatcgcgaccgatgaaaagaccggcccgctctttccgcttctgctcaccaccggtcgtattctcagccagtataatgtgggcgcgcagacacgccgcacccataactccatgtggcatgaggaagaccggctggatatccatccgaaagacgccgaggatcgcggcgttcgtgatggggactgggtgaaactggaaagccgctccggcgcgacatcgctgcgggcacgcatcaccgaaaaggttccgccgggcgtggtctacaccaccttccatcacccggcgagccaggccaatgttgtgaccaccgataactccgattgggctaccaactgcccggaatacaaggtcacagccgtgcaggtacagcgcagcaatggccccaccgagtggcagcgtgaatacggcgatcactccacgcaggcccgccggattatcccggcagctgcggaataagggtgttcaatcccgcgcctctgtttgacggggcacgggattgatcctttttctccgctcatgcgcaccagccataaagtccggcctgaccgctacacgaccggcgcatccgcctatcagcctcacgaacgattcatcccggaggaaacgcctgtcgcgctgacttatggccgtgccacgcatgccgtgatgatggcgacgcccgccgatctggaagattttgcggttggtttcagtctggcagaaggactgatcgacagtgttcacgacattgaaagtctggaaattgtggaggtgacgcatggcgtcgaactccgcatggatctgacgcagacccgtgatgcggccttcattgcccgccgacgccacgtaaccggtgccaccggttgcggcctgtgcggcatggaaagtcttgatgaggccgcgaaatctccgccgcgcgtctctgccgatctggtgattgatgctgaaaccatcgtcacggcgatggaggccctctcccccgtgcagacgctgaatctgcgtacccatgcggtgcatgcagcggctttctggcaacccggacagggtctgctggccatccgggaagatgtcggtcggcataacgcgcttgataagctggccggctttctggcacgcagcggtatccctgcctcctccgggcttgtactgctgaccagtcgcgtttcggtagagatggtgcagaaagcggcccgcatgggggctggcatcatcgttgctgtctctgcccccaccactctggccatccgtactgcggaagccgccaatatcacgcttgcagctgtcgcgcggcgtgatggattcgagctgttcacccatccatggcgtatcccctgccatgatgcggatacaaacagcgacgtggccagcaacgtcacctggctgcatccgggatcaacacccccgtaaaacggtgtgcctgacctctgcctgatcgcctccaaccatcgcaagggaaattgtcccgtgaccgcaaccaatgatcgcctcgtgacaatggccaatcagattgccgggtttttctcccaccggccggaagaaacagccatctccggcattgccgagcacattgtgctgtactgggaaccgcgtatgcggcgcgccttcgacgccatcatagaatcacataatccggccctaagccctctggcgcaaaaagctggagagtatttaatgtcccatgatgtgaaaccgtccgaccacgaccctctcgcggggatgcagccacgtgcggtgacgggatccgatccaaaagaagatccaaacacacctccggggggattcaatacagatgagcagcacggagataaccgcgcctcaagctgatccaggtattctggaccgggcgcgcatcatcgctcagcctggtttcaatcgctggctggtgccgcccgcggcgctggccattcacctttgcatcggcatggcctacggcctgtcggtgttctggctgccgatgcagaaaatcatcggcacggcctgccccgcttccatgggcgaactggctcaattgaccacgacagactgtgactggtctgaaggatctctggtcaccgccttcaagctcggcattgtttttctcggtatttccgccgccatctggggtggctggctcgaacgggtcggcccgcgccgtgcaggcgtcgtggccgccttgtgctggtcaggaggctggctgatctccgcgttggggatttatcagcaccaactctggctgatctggctgggcctcggcgtcattggcgggatcgggctgggtattggttatatctctccggtttcaaccctgatcaaatggttccctgatcgtcgtggcatggcgaccggcatggccatcatgggctttggcggaggggccgttgtcggcagtccgctggcattgatgctgctacagcatttccgcgtggtcgatccggccacccatgtcatcacacaacatggtttgtggcagaccttcaccgtgatggggctgatctatctggtgttcatgctggggggtgccttcgcctatcgcattccgccggatggatggaggccggatggctttaacggcaccgcggccaccaaacggatgatcgcacagggtcacgtgcatcttggccgtgcctggaaaacaccgcaattctggctgctctgggcagtgctgatgctcaatgtgagcgccgggatcgcagtgctgtccatcgcctcccccatgttgcagcgtattttcggcggtgccttgatcgatcagccgggtgtgacgctcgccaacctgtccctcgcacagaaaaccgctgttgcaggtgtagccggtggtttcgtcagcctgctgtccctgttcaatatcgggggtcgcttcttctgggcgaccatttccgacaagatcgggcgcaagctcacctatacgattttcttcattctcggcgcggtactctatacgctgacccccgtcgccgcccatgccggacacaaggcgctgttcgtgctggcgttctgcgtcatcctgtccatgtatggtggtggtttctcgacgatccctgcttacctggctgatattttcggcacacgattcgtaggggccatccatggtcgcttgctgacagcatggtcaacagcaggcgtcgtcgggcctactctggtaacggtgctgcccgccatgttcggatcatccgatccggtgcatctgtatgacaccaccttccatattcttgccggattgctgatcctcggcctgattgcaaactggctggtacgtcctcttccggcctatgcgttcatgtcagaggcagagctggcaagccttcaggctgatggcaccaaagggagttatgccactggatccttcgggatcggtgtcggtggattttctgccgcgttgatcctgccatggctgatcgtcggtctgccgattgcctggggtatctggaagaccattatcaaggcagcgcctttgttcaattgaccatcggatcaactgaacaggatatttcgatcaagctctcctcccctttccgcagtgagatggaaaaggggaggagaccgtttttcggatcagcgtttacgttcaacttgcgacacgtcacgcactgcgccacgggccgcattggtcgtcatggccgcataggcccgcagggcaggcgagaccttgcgctggcgttcggcgggtttccatgccgcctcccccttcgcttccatggcggtgcgacgtgcggccagcacctcatccggcaatgcgatgctgataatccggttgggaatatcgatcagaaccggatcaccggtttccaccagagcgatcagccccccttccgccgcttccggcgagacatgcccgatcgacaggccggacgtaccgcccgagaaacggccatccgtcaccagcgcacagagcttgcccagacctttggatttcagatagctggtcggatacagcatctcctgcataccgggaccacctttcgggccttcgtagcggatcaccacgacatcccccgccaccacctggccgccgagaatgccggataccgccgcatcctgactttcataaacccgggccgtaccacggaatgtcagaatggattcatccacgccggcggttttgacgatacagccttccggggcgaggttgccgaacagcaccgccaagccgccatcatgcgagaacggatgctcagtggaacggatcacacccttctggcgatcctcatccacgctgtcccaccgtgcagactggctgaacgcgacctgtgtcggcacgccacccggtgcggcgcggaagaaggtgcggacttcctcgctgctggtgcggccgatatcccagcgttccaacgcatctttcagcgtcggcgcatgcacggtcgggcgggaggcatcaagcagaccggcacgctccaactcacccagaatagccataatgccaccggcccgatgcacgtcttccatatgcacatccgatttggcaggcgcgaccttgcacaggcagggcacccggcgcgacagacggtcgatatcggccatggtaaaatccacacctgcttcctgagccgccgcgagcagatgcagcaccgtgttggtggaaccacccatggcgatatcgaggctcatcgcattctcgaacgccgcatgggtggcgatgccgcgcggcgtggcggagacatcatcctgctcataccaccgccgggcgagatcgacgatcagatgcccggcctcccggaacagcttttcccggtcggcatgggtcgcgagcacggaaccattgcccggcagcgacaggcccagcgcctcagtcagacagttcatggaattggcggtgaacataccggagcatgacccgcaggtcgggcaggccgagcgctcgacggcctgaacctcttcatccgtgtaggattcatccgccgccacgaccatggcatcaaccagatcgagcgcgcgcgttgcccctttcaccacggtcttgccggcctccatcggaccgccggagacaaacaccgccgggatgttcagccgcatggcggccatcagcatgccgggcgtgatcttgtcgcagttggagatgcacaccatcgcatcagcgcaatgggcgttcaccatatattcgacactgtcggcaatcagctcacggctggggagggagtagagcatgccgtcatgccccatcgcgatcccgtcatcgaccgcaatggtgttgaattccttggcgacgccgccggcagcctcgatttcccgcgccaccagctggccgagatccttcaaatgcacatggccgggcacgaactgggtgaagctgttgacgaccgcgataatgggcttgccgaaatcaccatccttcatgccggtcgcgcgccagagtccgcgtgcgcccgccatattgcggccatgggtggtggtccgggatcgatactgtggcatggttcgaaccttggaaatgttccgcccctcatacgccgtttagcagagtaggaaaaatctattattctgcttccattcagtcgctggagatatcactgatggaggcccgacagctccggcattttctgacggttgcggaaacgctgcatttcggacgggcggccgagcggctgaacatgacacagccaccgttgagccagtccattctggcactggagcgacaattggaagcggcgcttttcatccgctcccgccgcagcgtggcgttaagcccgttcggccagcaatggctgccgcatgtccgcgccgcgctggcctcgctggaagcactccccggcatcgcccgccgcctgagggacggggaaaccgggcggttggaactgtctttcgtcagcacggccgattacagcatcctgccatccctggtgcgccgatatgcagcgctgtacccggatgtagagatcgtcctcaccgaggccaccagtgacgtccagatcgacgccctgctgcatgggcgcggtcatgcagggatcgtcatccatccggatcgcagcacattaccggccgcgctggcatatcaccccctgacgcgggaaaaactgatcgcggctgtaccggataacagtcacgacctttcaccccatgccatcatgcagtcgccgctgatcatctttccccggcactccgcaccggctttctacgatctggtcacgcactaccacgccagatatggcggaggagccgccatcgctcaggaggcgatccagatgcagacgatcatcagcctcgtctcggcggggatggggatcgcactcgtgcccgcctccctgcgccaccttgcccggacaggtgtgcgctatgtcgatctggaggaggatgcgccgatcctggaaaccggcatgatctggcgccgtgatgatacagcgccaatcctgtcccgtctgctggaagtcgcgcaggacatgtcggagcagattaccagcgataaccaagcgtagcgaacacggcccggcccgtcgcgtagtagcagctcgtcatccgcacgcagccggccacgatacggcgatccgcgagattggttgcattaacctgcaaccgccagcgatccatttccacccgtgccgttaggtcgaactgcaccgaactcggaacattgaacgtgttcggcacagcccccgatgtctcaccattatagcggacgccgctacccagcgcgaaattccagcgttcagaaatcggaaattccttttccatatacaggctcgccatatggctcggcacgaaaacggggcgtgatccagtcgctcctttttcggtgctgctggtgatcagcggctcctgataggtcagggcggcgatcatgcgcagggttggggtcagattgcctgtcgcctccgcttcagcaccgcgcgtacggatttctcctgtctggatcgagaaattgacgttgttcggatcaggcgtcagcacattctgctgggtcagatcgaatgcatcgaccgtgaacatgatgtcgcgatgcaccggcttgtatttgatgccaacctcgacctgattaccggtggtcggcacataactgttgccaacccgatccacccccgtttgcggctgaaacgaagtggcataggtcacataaggcgacatgccattctcagccgcatacagcaatccggcgcgatagctgaaatgcgtcgggtcgctgttctgcgtggagcgggttttgttgttggtcagactgtcagagacgaaatcctcacgccctgtcagcgtcagacgccagtgctgccaggcgatctgatcctgcacataaacaccggtctgaatctgggtctcgttggtgttgatcgtcgaggcataggccggagccgtcacattacgatagacgggagcataaagatccagcgacggtcccgttccctgcccacggcgtgtggagatgaactgtgtcgtgatattcacacccgtcagcagatcatgcgtgacagggccggtcgcaaaatgaacttcggactgattatcgaccgccagcgtgttgaacatgttcaactgctgctgcgcctgccgggtaatactgcgctgattggcggcaaggccggtggtggtcaccgtgcgataattcagatcctcatgcatgaaacgaagattctgccgaagcgtccagcgatccgtcacatgatgctcggccaaatatcccaccgaaacctcacgcttggaatagacatcataattcggatcgccggtattcaaactttgccggatatagccgtagcgacttggaaacaccgtaccgatagcgggcagaaactgggccgccgatccggcatcaatctgcatatagctggacagaaacgttactgtcgttttctcgcctgaccatttcaccgacggcgcaacatagatcctgttgttcagcacattatcaacaaatgtatcggatttacgcatcagcccgttcagccgccacagccaggaaccatcgttcgtgagccggccacccagatcggcagccccctgaatacggttgaaagaaccgccctgcacctgcacttcgttggtatgatcgaggcgcggttgtttgctgactgcattgataataccgccaagctgaccggaaccgtacaaggccgcattggccccacgcaacacgtcgatccgttccagcccgtacggttccagatcgaaagtctgcgaggcactggccatcggcagtttcagcccatccagataggtatcaggtgtaaaacctcggatcgtgccgccgaaaccgcgcggatcatcccggccaccgacatccgtcacgccggccgtataacgcattgcctcggcaatgctgcggatgttcagatcttccagcctgtcacgggtgatgaccgtgacattctgcgatgtctgcatcaggggcgtatcggttttcgtggccgcaatacttttccgggccaggaatcccttgaccggtcctaacgccgtttcctgctgtcccgatacattcaactgcggcagtgcccctgcctcctgcgcatgggcggaaacccctggcaaccccatcgtaaggcaaaaagccccggatatataaccggctttgcgtatcctgatgcgccgaggcagccttttcatgtcatcattcccgaatggatcgggtgctcatagtgaaaatgcgaggtattctcaataacttattttgattacgcatcaatgcgtctgcaacatggcaatatctccgcctgtctttgccagcatttcctgggaaaacagatggacttcgccagccgtcaggacgctacaagcgcagcaatacaggaaataataagtagaaagaaaggatagctggtctgtcaccgcagaaatacggcaagatcaagcatgtaaacctggtagcggtggacggatttgaaccgccgaccaagggattatgattcccctgctctaccgctgagctacaccgccaggttgggggccgctgataccgccgtactggccggtacgtcaatcacctgcgagacagatttacgaataaaaccaccccccagaacccggtccccatcatagaacacacaggcctgtccaggcgcaggcaaggcttcggtttccagtatgacctcgacaccgccctcgatcacccggaccatcgccggatgcggcgtttcccgcgccctcagcttgaccatacaggcaatgggggcaatgggcggggtcatcagccagttgacttcagaaagcacgatacgccgctgggctgtgccggcaggccccactaccacgcggcggctgccggcatccagcgacaccaccacatggcgcacgccgccgatcatcgccgcattgccgaggcgcttcgcctgaccgatcgtatagcgtcccacaccttcatgctgccccaccacctgaccatcccggtccacgatctgccccggctccagcgcatcggggcggaagcgggccacaacatcggcataggtgccagcgggaacgaagcagatatcctgactgtccggcttacgtgccacagccagccccaaccgctcggcatgggcgcgcacgtcatccttgctttccatgccccccagcgggaacaggctgacatccagctggtcccgtgtggtggcgaacagaaaccagctctggtcgcgggaaggatcgaccgcgcgatgcagttccgctccatccggcccgtcgatacgccgtacgtaatggccggtcgccagacgctctgcgcccagatcacgcatcaacgcggtcagatcggcaaatttgactgtctggttgcagcggatgcaaggaaccggtgtttcccctgcggcataggcatcggcaaaatcagccatcaccgcattgcggaaccgttcttccgcatcgatcacgtaatgcggaaagccgagccggtcagcaacccgcctggcatcgtaaatatcctgcccggcgcagcaggctcccttccgcttcgctgccgctccgtgatcatagagttgcagcgtcacgccgatcacctcgtgtcccgcttcctgcaacaatccggcgacgacggagctgtcgactccgccggacatggcaaccaggacacgcatcggtgatcagccccccgcgttacggctgccggatggcaggcgcacgaccagcccgtccagagcctcggtcatcaccagctggcagccgaggcgggaagtcttctgcaggccgaatgccagatcaagcatgtcttcctcatcctcggtcggctgttccagacggtcgaaccattccggatcaacgatcacatggcaggtcgagcaggccagcgatccttcgcatgcgccttcaatatccacgccatgcttatgggcgatctccagcacggacaaaccggcgggggcatcaacttcccggtgcgtgccatcctgttcgacgaaagtcatcttgggcattgcgtctcgtttccgcattcttgtcgcgcccggcacaggccgggcggctgggtctcaggtggcgtcccggcacaaaggaagggagggagcatcccgccacacccgtgccagcgcggcaaccgcgcgatccacatccgcggcggaggtatagcgtccgatgccaaggcgcaagcttcgtgccgcctgcgccccgctcacccccattgcacgaagcacataggacggctcaacctccgcggatgtacaggcggagccggtggacatcgccagccatggcagggcggccatgagctgctgtgccgtcctttcttctggcctatcagcaggaaaagccacgttcagattacccgccacacgctgttcgagggagccattgacgctcacccccggcagagcctcccgcagaagggacagcaaacgatctctcagcccggcgatgcgcacagcttcggcctccccttcctgacgggcaatggcgcaggctgcgccgaaccccacgatcagcggcgcgggcaaggtgccggagcgcaagccgcgctcctgaccgccgccggagaaaagcggctccagccgtgtgcgcgggcgtcggcgcacatacagcgccccaatccctttcgggccatacattttatgggcgctcagcgacatcagatcgacccgcgcctcaccattgccgaccgaaagcgggattttcccggccgcctgcgccgcatcggtatgaaacagggcaccccgctcatgcgccagacgggccaaggtggggatatcctgaatcacacccgtctcattattgaccgtcatgatgctgaccagcagcgcaggcaaaatcagggcctcccgcagcgcttgcgggtccagcaacccgtcagccccgaccggcaggatcaccggctcaaacccttcccgtgccagatcatgcacggattcaagaacgcatttatgctcggtggccacggtaatgatgcggcggggcgaagatggcgcatgatgcagggcaaagcgggccgcgcccttgatcgccagattattggcctcggtcgcgccggaggtgaacacgatctccctcccctccgcaccgatcagcgccgccacactgtcccgggcctgctctaccatggcggcaacctgctggccggattcatgagcagtgctgtgcggattggcggacatctccgtccataagggcgccattgcctgcaccacacgcggatcacagggtgtcgtcgcctgataatcgaaataaagaggcgtctctggcaaactcatcaccgggccgatatgggatgagacacagagaaaggaaagggcttggaagacggttctggcctcaaccgggaggccatggtggcataggcatccataaaggcttgcacatccgcctctgtcacattccatggcagcgagacacggattgcctcccccgcctgctgcccaagccccatcgccgccagcacatggctgcgcgctaccttgccggaactgcatgccgatccggctgaaacctgaataccggccagatcaagcgccatcacctgacgctgcgccgccacaccgggcaggatcagacatgacgtgttgggcaaacgccccagcttcgcccctccacctgctaccaccgcccctgccatggtggctgcctgttccagcctgtctctccattcaatcagccggccccacgctcctccttgctcatctgtccgcatggccgcacgagccgcggcggcgaaggcgctgatcgccggtaaggccggagtgccaccgcgccagcctctttcctgaccaccacctttcatcagcggcctgacatcccgatgggccgcatcacgcagcagcagcgcccctacccccggaacgcctcccagcttatgggcggacaaagccatactgtccgcatccagcgtcctcatcgacaccgccatccggccagccgcctgcgccgcatccacatgcagaagggccccatactggcggcagagcgcggcaacctccgccaccggctggataacgcccgtctcgttattggccagcatcaggcacaccagagcctggccgccctgcgccagccgtgcttccagatcatgcagatcggtcacaccttcgcgatcgacaccgatcagttccgcatccgggcggcaagacagcaacgcaggatgctccgtcgcaccaagaagcaaacggcgcccctcccccagtacatgcacggcaagactgtctgcctccgtaccgccggaggtgaaaatcacctcatccggcccggctccatagagcatcgccagagtttcacgagccgtttcctgccggtccctcgcccgacgcccggcgcgatgcagcgaggatggattgcccggttcccgaacgacctcctgcaatgccgccatggcctccgggcgcaccggctcggaagcattcgcatccagataaactgacaggggtgccacgaatctcgatttccttttgcggtctgccggaactgcaaataagccatcaggccgccatacaggacaggcaggccacaatttaatggcgtattcatgcgctttttgttagcaaaagtgactgctggtacaatatgatggtcaaacagagctgctgcttgcagcaggacaatagaatagcaaaaggaaaaagggacggtacagtggccgcagaaacgctcgccgttaccgggttcgcaggacattccagtccttcacgtccgcttccggttcagacatccgcaccgctacagaaccagatatcccgatcggattttaaacatatcaggtcagaccccgatacgtgacggcagcgtcatgtgcctggccttgaatatccagcaaaaatacgtccggagcaaccggataacgatagcctcggcgcgtgcccgttgcacgcagtcgatcagagaacggaattgaactgctcatgcctgaggtgatgtttgccggccccgacggccggctcgaaggtcgttaccaccactgtaaggaagcgggtgcgccgctcgctctgatacttcatcctcacccgctgcacggggggacgatgaataaccgtatcacctataccatgtaccagtcgtttcagcggctgggcttttccgtaatgcgttttaatttccgcggtgtcggtcgcagccagggccgttatgatggcgggattggtgaaatcggtgatgccgccggggcactggactggatgcagtccgtcaaccccaaccatggcggtctttggattgccggatattccttcggtgccttcatcggcatgcagttgctgatgcgccgcccggaaatctcaggatgggtcagtgtcgcgccgccggccaatcattatgatttcggcttcctcgccccctgcccctgcggcggtctgatgctgcatggcgatgcggacgagctggtgccggaacccgcagtgcgcaagctggtggacaagctgaacacccagaaaaatgtcgaggtcgattaccgcgtgttcaagggtgcggatcacgtcttcgcttcccatgccgaaaaagtctccgaagcggtcgaggactatgtcggtcgctcgatcggtgctcgaccgatggcgctggcggctgactgattaaaaatatggctccccggtcagactggtcttgttcagactggtctgactggggaacacctgaccaatctgcctccgctgatcggcgttttcacaccggttgtcgccggttcactcaacggcaatccccgaacgcttctgaccgccagatagccgaagcactgcgcttccagcgcatccccatcccatccgaacgcctcccctggatagaccggcacagcgagccgcccctgcagggcctccatgatcgccggattgcgacgcccgccccccacgatgatccagccgcccggctcccggcccggccagcgcagggccgcaatggaggccgcggtaaaggccgtcagcgttgccgcgccatctccggcggaaagatcatgcaccccgctttccgtcaggctgtgcgagaaatccagccgatccagtgatttcggtggaggcaggcggaaaaacggagccgccagcagccgcgccagcacggcctgatccacgcgccccgaccgcgccaaggctccgtcacggtcacattcctgcccggtatgaagggtggcccaatcatccagcgggccattacccggcccggtatcggaggccgagatcgtgccatcccgcccgatcaaggtgacattgctcacgccaccgatattcaggaccgcgatataatccgccccatgccatgccgcctccggcaggccctctgccagcgcacgatgaaacagcggcaccagcggcgcaccttgcccgcctgcctgcatatcggccgagcggaaatcatggaccacatcaatcccggtcagccgggccagcaaggcggcatcgccaatctgccaggtccaaccctcctgcggacggtgcaatatagtctgaccatgaaacccgagcagatttgcgcgcacccccagcgccttcacggcatcggcatggcgttccgtcaggcggcgctcgacatcatgcaggaaaggatcatacgcccccttcacaagacccggcgcactatccagcaaacgccgtagatcagcccgtaacccaggatcataagaaacggtcactgcgggaccatagccggtgatgctcacaccatccgtctcgatcaccgccgcatcgaccccgtcgagagacgtcccactcatcaagccgatggcgcggagaggaggagacatattctgcggctgcgttgcatcagcggccattcaccagcgccttttcccgtgctaacccgcgcatcatgtcacgcagcgcatttcttcgcgaggccgaggcccgcggtttcctgttccagtgcaccgatcaggaggctctggacaacgccctcagcaacggcacagtcagcgcctatacaggcttcgactgcaccgccgacagtctgcatgtcgggcatatgatgcagatcatgctgctgcgcctgttgcagcggcacgggcatcggcccgtcgttctgctgggcggcggcaccacacggatcggcgatccttccttccgcgaggaagcccgtcagcttctgaccgatgcccagattgccgcgaatatggatggcatccgcgccaatatcgagccgttcctgactttcggcaccggccctaccgatgccacgctggtgaacaatgccgactggctggacacgctcggctatatcgagatcctgcgggaggtgggtgttcatttcagcatcaatcgcatgctgtccttcgacagtgtccgcacccggctggagcgcgaacaagggctgacctttctggagttcaactactccatcctgcaaagctatgatttcagggagctgaaccgtcgccttggtgtgacgctgcaattcggtggctccgatcagtggagcaacatcatctccggcgtcgatctggtccgacgcacggatggaaagcaggttttcggctttaccgcgccgctggtcaccaccgcatcaggggcgaaaatgggcaagacggcgaagggtgcggtctggctgacggcggaaaagctcagcccgtatgattactggcagttctggcgcaatacggaagatgccgatgtcggccgcttcctgcgcctgttcaccgaactgccgctggacgagatcggccgcctcgccgccctgcaaggtgcggagatcaacgaggccaagaaaatcctcgccacggaagcaaccgggatcctgcatggccgggagtcggcagaggccgccgcggaaaccgcccgccgcgcctttgagcagggcgaagccgccgacacgctgccgagtgtcgccattgcagcctccgagctggcggaggggctgccgatcctccgcgccctgacggttgcaggtctggcgcaatccaatggtgaggcccgccgcctgatccggggtggtggcgcgcgcgtgaataatgaggccgtcacggatgaaatgctgaaactctcccccgccgatcttcaggatggggccatcaagctttcggccgggcgcaaacagcatcgtctgctgaagccggtctgaacaacggctgatccggtcaggcggctacaggcctgaccggattgaaagcctatccagccagaacggcgtggaaatgatccagcgcccagtccgcctgatcccgcgtcaggaccagcggcggagcgatacggatcgtgtggtcatgcgtttccttgcagagcaggccgcgtgtctgcaactgctcacagatgcggcgcgcgccgcctgcatcggggtgcagctccaccgccagcatcaggccacgcccgcgcacctccctgatgatcgcaccaccgatggcacgcaaaccattcaacagatgcgcgccgatcacagcggcattctcgatcatgccttcctcgatcagcacccggagcgccgcacgagccaccgcgcaagccagcggattaccgccaaacgtgctgccatgctcgccgggacgcagaacgcccagcacctcatcagtcgaaagcaccgctgaaaccgggtagaaaccacccgacagtgccttgcccagcaaggttacatccgcctcgataccttcatgttcctcggccagcaatttgccggtgcggccgaggccggtctgaatctcatccagaatcatcagcacacgatgacgggtacacagggcacgtgcagcccgcagatacccatccggcggaatgatcaccccggcctcgccctgaatcggctcggccataaaggcgaccgtgttggggccgatcgctgcttccagcgcggcgatatcgccatacgggacgacacggaaacccggcgtgaacggcccgaattcgcgccgcgccgtttcatcggtgctgaagctgacgatagaagtggtgcggccatggaaattctcggcacagacgatgatctccgcctgcccatccggcacgcccttgatctgataaccccatttgcgggctaccttgatggcgctttccaccgcctcggccccggaattcatcggcagcacccggtgggagcgtgtcagcctgcacagctcttcataaaacggagccagctggtcattgccgaaagcacgggaagtcagggtcagaaccgaagcctgcgccttcattgcctccagaattttcgggtggcaatgaccttgattgacggcggaataggcagagagacagtccagataacgcttaccctccacatcccagacccagacgccctcgccacgactcagcaccactggcagcggcttataattgcgcgcgccatagacggcttccttggcgagaaaatcctgattggtccctgtggagctggcggtgcccgccagaatgtcgctcatcggtggtgatccctggtctacagtgcgattatacggagcaaccgcacctcaaggggacgcttcataatcccccctcccgcaaaagccgaccaaaaaatacgctggcctgctcagacaggagccatgccatatcgtgctgccaccagcgccacacagcgttcgaaaatatcgaggcaggcgaaatcacggctttgtccattttccggcagtaccagagcgataccctgttcctccagcagacccggtatcatcagattatctggcagaccgaaatcctctacctccatccccgctacgggatcgggacagcgggcgatatgggcgtagctgcgggatgcgaaggacgccgcatcgttgctgtaaccgtaaacaggccgtcctttgccaccgaaccagcccagctccaccagcgtccctgcatccgccgaagcgccgcgaaacggggtcagattggcgatgaccacgtcgcaggcctccatcatcaccagattggcccggaaaatccgttcccatggtggcagcttcactgtaccactctcggctaccggcgcgcgggcgtgcaacccgtaatgctcacagatggcgatcttgcgggccgcgcgctccggcgcatccggcatgaaaacatcaggcccggcaagataggcaatcggtcggcgcaacagaaatactccgtgatcaggcggactcataaaaggcggttccaaccacccatcattacggtcgtctgaaatagtcgaaaatcccgcgtaaaaaaccgggggtcaaagtggcaaggggattcaggctgacctgtggatcctgcaagctgccgctcagggcataggttgccgcaaacacgccgccgcctttttcaggactgaacaattttcccaccagcggcaaatggcccggcaacgtgttgaacatataagccggcacaatcgtaccttccagcgccagtgtctggccggacaggtcaatacgccctttcatcgtcccccccagcgaaatggtgtaggcacgggcgtcattaaaaatcagttcgtcatcggtcaggctgaacggcgcaatcagatcatttaccggcaaaccgggaccactgagcgcatcgaccagcccatacagcgtcatcgcctgcaacaccttggccgccgcaggggcgccgcgcacgctgaactgatgcagttttgcggtgccgctgagccggtgatcagggctggtatcgtcaaagtggccatgcagggtcaagcggccattgataatctcatcggtcagatcgagcgtactcaacagggcgcccgcatcggtcgcctgtgcatccagcactcttcctctgccatccggaacgataacaaaggaaaacaggccacctgccgtatctcgccccgttaccgtgacattgcgataaagcgtgccgtcattgacgatggcaatgctcatgccgagcactgcgccctgatccacggcgatcagccggtcgagctttccgctgatctgaaaaggctgacctggtttctgatcctgcacctgatcgcggcgtcgataggaggacttacgcaatccctgacgcttcaacggatgactgagatcgatcacgccacctgtaagacggccctgaatgggtgctcccgccctgcccggaaacaggatggagccggaaagatgactgtcacccacctgtaccgtctcgaactgaagcagtgtcccgcccccatccgcaccagccgcactgcctgaaagagacaaattcggcgcagacacctgaagattctgcacgacggacagatgatcgccctgaagagtaatagaggcactggcattgcctggctgacctgcgcttttctgccagcccaaccgatcgatcacggcagatagatcagtcagatcggccgacagatcgaccgttgcttttccgctgcgatgacggttgtaggagacctcgatatcagtggtacccgacagattgatcttgccactttttatccccaggcgctccagatcagccaccgcggcatgcgcctgaatggccaccttctccaacacctgctgcggcggtccatgacggaaatccatgcctgccctgatccgggcagggatatccgccaccacgcaatgcccggtcaatgacagaccgttctccgaaacatcatagttaaaatcaccctcttccagatctcgcccggccaatacatcatgcagaaccaaagcattgatgcgcccttcggaggctatggcgacatcttccatggcgactttttttctcaacggcagcgccacgttgagaatcccggagaattgtccctccggctgccccagatccatcggatgatcactgagcagatgcagtctcggatgcgagagaagcttctcaagtcctggaacgctccctgaaagatcaccctgaatgacggattgctgatctttctccgacaatccagcgatctccatcactgcatgcctgaccgcgattccgtattcgggcacatgaccgcctccggcctcgatggtcagccggtgcgggtcaaccacccgtaccgtgccattcattccctgaatgggcggtaccggacgcagccaatgaatggaagcattccgtatcgtcagaagaccatcgatcccatccagcgccggatgacgaaaattctcaccgactgaggccatcaaggtgagcgtgccggattcaatccggcccaccttcatgttctgggtgatccattcatgcgcaccatgcgcaagacgggaaggccacagagagggcagcccatccaacggcagaaccccgacatccagatggaattgcgcatggcggcgaccttccgagaccggctccagactgccgctgcctttgaaaaccggtgcggcgcccgcatccccctccagccccagcgtcagggaagacagaaaagtgcgcccggtgatcatgtcggcatcgagacgggcggcaaaaatccgtatcttcaccgtctgattgtctatcgttacggtgccgggctggctctggacatcaaggctcgcccgtttgaaagcaagatcagaaccaatcagcgcggttgcacgcagaccaaccggaacctcagctgcggccagcatttttgcctgcgaagacaggtcagccagagcagaaacgggaatcatcccggcctcgaacacgatccccagcccgtttcgatccgatccgttttgtaccagcgccgcgtcaccgactctcaacgataagggggtcgaagcacctcccgccatcaatcgggcgtgaaccgatccatccagcggtggcggagaatcatctaccttctttctctcgaccgataaggcaggtccacggtggaatgaggcttctacttcctccagacgccacgacgccgccgaaatttccgtgcgggccgccacactcagccgatgaacctcgagatgatcggggagcagtgcccagctccggcgctcccatgttctgaacgcctccagatgacgctgagggtcgaaatcgtcaggcgatggagcagagacagccccttcgcgagaaagtggcagcgtaatagaggtatcctcgatcagcaccgtctgcacacgcggctgtcgggacagcagcaggccggggatcgccccgaccctgatcagcccgatccgggccagatcaggcgcagttttcggctggcgcaaatcccggatggccgcaccgcgcaattgcacgtccagcatggtatcgggaccatgtttccagccatcccaggtgatcaccagatgctgaatatcgatgtgaaaaggcgcaagcctacccggcagacgcacagccagcccttgcccaccggctttgctgaccgccgccccgcccggcaggtcgttaccggtccgggccaatccctgtaaactgcgcccgagaatatcggtcagatcgagtggaccatgcgacaggcgcaaccccagcgccacgaagccgaccgaaaccagcacagcggccccgatggcgatctgcaatgccagacggataaccctgccgagcagccatccggcttgaccactccaccgcctcacgggaaggcttccagtctgccagcgcatgcgtaaggaaccggcacgtgaccgacagcctgcctcccacaaggatcgacattcccctgaccaaggaacaggcatcgggtgatctgctgaaggcatgttggcctgcccccgccaatcaccatgccgccgagcggttgctggagcagtttgctgcgctgggggaagccgaggctcaggcgctgatgcaccccgccttccgtgtcatgttgaaagcggtgggagggaacagcccctatttgtccgaactggccctgaaagaatccgctctgttgctggaagccgtggcgatcggtcccgaagccagtctggaacagattttttcccgcctcgccgccgtaccggccacgacgtcccgtctgcctctggctgcggcactgaggacggccaaacggcaggcggcgctgatcattgcgctgggcgatacgggaggattgttcacacttgaacaagtcacctccgccctctccacccttgcagagagcacgttgcgcaaggccgtggcacatctgttgaacgaagcggcctctgccggtcgcattcatcttccagacccgtcggaggctgctgccggcagcggtttcaccgtgctcggcatgggcaagctcggcgcgcgggaattgaactattccagtgatatcgacctcattcttctttacgatcctgcgtcccaggccggatctcaggccgagtcgcgggatgagctgggcgccctgtttacacggattgcgcggaatatcgtcgccttgatggaaagtcgcaatgaaggcggtgcggacggaggatatgtgttccgcaccgatctgcgtctgcgcccggaccccggcgccacggcccctgccatctctctgccggccgccctcagctattacgaaagtatgggacagaattgggaacgggccgccatgtccaaggcacgccctgtcgcgggtgacctcgcactgggtcagatgtttctggacgccatccggcccttcatctggcgtcgctatctggatttcgccgccatagccgacgttcatgccatgaagcgccgtatcgacacccatcgcggcaacgggcgcggcacgccccctacctccatgttggaccgactggccggcttcaatctgaagctcggtcagggcggtatccgcgagatcgagtttctggtgcaaaccctcgaactggtatgggggggccgcgatccggaattgcgtgaaccacgcaccctgatcgccctgcccctgctggtcgatcgtcaacaccttgcccccgatgtcgcgaaggaactggcggaggcttaccgctttctgcgcatggccgaacaccgggtccagatggtcaatgatcgccagacccattccctgccagcgcccggaccctatatggcggaacagatgcaggctatcgccctgttcctcggctttcccgatacggacaccttcggcgcgaccttgctgcatcatgtggatcgggtgcgcgcccattatcgtatgctgttcgagagcgtaccggacggccctgatcaggccaatcaactcgatttcagcggtgacggcgagccggcagccacgatcgaggctttgcaagccatgggatatgcaaagccgccccaggtggtcgagatcgtccgcgcctggcatagcgggcgactgcgcgccttgcgctcggaacgggccaggcagcttctgactgccctgctgcccagcctgttgggaacattcgcccaccagagccagcccgatgccgtgttgacccgtttcgataaattgttggcgcagcttcccgcaggcgtgcagattttgtcgcttttccagcgcaatcccgcgctgctggagcgggtggcacgggtattgggggctgccccgtctctctccgatcatctggccagtgtaccaggcgcattggaggggctgatcatccccggggaaacacctccccaggctgtccggcagattgtggatgcgctcagtgactgccgcgatctggaggaagtcatccgtgccctgcgcgaaaccgcgcggcaggaggatttccgtatttccgtcgccaccatgaccggagatatggatgtggatgaagccggaatcgtccgcaccgcaatggcggatggcgtcatcaacgccctgctgccgcatgtcatggaggaccacatatcccgccatggcatcatcccgaatggcgggatcgccgtggttgcgctcggcaaggcgggcgggcgggagatgatggccggctccgatctcgatctgatgatgatctatgatcatccggaagatatcggtgaaagtcagcccggcgacaatccgggcacgcgcccattgccacccagcgcctactacacacgggcggcacagagctttattgccaaactgaccgcacagggaccgggcggcccggcttttgctgtggatatgcgcctgcgcccttccggtaatcagggaccggtggctgtgtccctctcctccttccagcgttaccatcgggaaagcgcgtggacctgggaacggatggccctgacccgcgcccgtgtcatcgccggccctgaagccttgtgccagcgggtgagggaggcaatcgaaaccgctctgaaccgtcctgtccctgccgagacgatccgtgccgatgccgccgcaatgcgcgcgaggatcgtgcgggaacatcccaatcccggcccgtgggatatccgtacccggcccggtgggcagcaggaggtagagttcattgttcaggttctgcagttgattcacggtccggccaacccatcggtgcgtgccacctcaacgcgtgacgctgtcggacagctgcatcaggccggttttctgtccgcagaagatagggaattgttgatccacgccgaccatctgggccgcggtgttcaaggtctgctgcggatcacgctgggccggacggcgcgggacagactgccagcggcatcggccgaggcgctggtggaggctctggccgagccgggagtcaccgatgaagatacactgagggaccgtctcgatgatatcagccagcgggtgcgggcggcgttcatccgccatatcggcgatattcccgtgcccgggcagagtcgatgactgatgactaaagagaatgacttttccgatccaggcaccctgtgccatgcaggcgcatgacagtcgaacactctgacagggagattcccgccatgagcactcttgccgaaggtgataccgccccggacttcacccttcccgccagccgcgaccgcacggccagcctttcctcactgcggggcaaaccggtcgtggtctatttctatcccaaggccgatacgtcgggttgcaccaaggaagcctgcgcctttcaggaggccctgcccgcgctgggaaaaagcggcctgaccgtcatcggcatatcgcgtgacaagatgaaggccattgatgccttcgccgacaaatacgcgctcgatttcccgctggcctccgatgagaacggcacggtttcagaggcgtacggaacgtggatcgaaaaatccatgtatggacgcagctatatgggtctggatcgcgccactttcctgatcgacgcggagggacacatcgcccgcatctggcgcaaggtgaaagtcaccggccatgtcaaacaggtgacggcggcagcggcagagctttgaccggcctcgccaacaccgaatggtgcatggcgtaggtaaggtagaacaccagcgcaaccgcgatccagcccgcaaagaaagccagtgtgacggatggcagcagcacgatcagatagagacagcacaccacgctgagcagtggcacccacggatataacggaacacgataacagcagggcagatcgccatggcgacgccgcaggacgatcagccctgccgagacggtcagaaatgcgatcagcgttcccatgctggtcagattggcgagcatatcaagcggaaacatcgcagccagagccgcaaccgccgctgccacgatccatgtattgaacagggggacatggcggcccggatcgacatgatgaaacaccggcggcatcagaccgtcacggctcatcacgaacagaatgcgggtctggccatatatcgtcaccagcgtcacactgaaaatcgacaccagggcaccgatgcataacaacatggaaggccaaacggagccggtcacctgttccagtatcacggccagtccggcttcctgaccggcaaaccttgtccatggttgcgcgccgatcgccgccacagcgacgaccatatacacaagcgagacgatgcccagacacaacagaatagcgcgcggcaaagtgggacccggatccttcacctcctcggccgcggtgcagatcgtatcgatgccgacataggagaaaaacactgtcgcggcagcactgccgacaccgctgagacccaaaggcatgaacggggtcagatgctgcacccgaaaggcacagagtgcgatccccgcaaacaacaacagaaccagcagcttcacgcccaccagaacggcgttgaccgtgctggattccgcaacaccacgtgacagcagaccagcacagagcatgaccagcacaagcgcaggcaggttgatatagcccccactgcccggtgccgcggtcatcgcatgcggcaatgtcaggccaattgtgtcgcccagaaactggttcagatactgcgcccagcccaccgcaatggcggaggccgccacgccatattccagcagcagacaggcccccaccagaaaagccgcgacctctcccatcgttgcataggtgtaggaataggaggaaccggcctccggtatggtggaggcgacttcggcatagcaaagcgccgtcagcgctgctgtcagcccggcgattacaaaggccagtatcgtccccggccccgctttcggtaccgctgtcgccagagccacaaaaattccggtgccgatggttgaaccgacacccatcatcgccagacgccacagaccaatcgtgcgcgacagcctggccttacccgcgtctgacgacacctcaccaccggcaagggcaatattccggcatctcagaacagcctggagccaggatgctttatccgccattctttcgggcaaccttccactgttggcgtgagacgaaccagcggcgccatgagacggcagcaatcatcaggcaggcaagccccgccacttcccaagccggacgcgggccaagtgtaatcgtcatgcgccatgccgtcgccagatcgggcggccagtttgcacttagcacaagatgccagttcaaaccccgcaccagcccataccatgcggcttcaagcagggccgtagccggaatggctgccaaggacagaataataacgccccacaagcctcgatgctgacgcggccataaacgccatgccataagtgcacaaaatataccgctccagacagcctcctgcgagatgtcgatcttcgcctgaataaggccatgcatcagcgccagtatgaccagcacatacacggcacgatgcagttttttccaccgccgccccagcctgcgcatccatgaatccgtggatgtcaccgccagcacgacaagcccgcacagcgccaccaacccaataagcaggtaaaaatggctgccaatttcggagcagatcagccagaggcgtccattctcatacactccatacagcgccagatgcaggagcgcataacacgccgttcccaccccgatcatgcgccgcacgatcaacaggcggggccatgatagagcctcccgcaagggagtgatcgccagcgagaccagcaggaagcggatcgtccaccgccccgtctcatgcagagccgccttcaacggctcggcccccaattcctgataaaggccgctcttcagcagatgggctgccggatacatcaggaacaggaaagccatcaggcgcagcaaagaaaaacgcccggcacggtcatgccatggcacccagccctgtcggggcatgcgttccgtcacggagccgccttcagcgcctccggggtggtgtgcgcataggaagcagggatcttgaataaatccgcgtcaagcttctccgtcgagacagaaaccgcctgtgccacgatttgctccccgatccgcacctgtaacaacatgccatcactggtcatgcacatggcggcaggggccgtcttcggtgttgcggtcttgccatccgccgtgacgacccactccgtgcagggcaggccgtcgacaacgcgcgatccggctttttcatattgcatctccggcgtggcagctccggcaagaggctcaatttccggcattttcgacttgccgacgacctgcggtctcgggtccgacgcctcgatatccagcactccgtggcggagcggatcgaccagcgcgatatgcatatcggcccgattgatcagcatataaagcccgccctgcggcggatcgatccgctgtatctggcgggaggccagccagcgcacacgctccgtcgtcatggccccgtcatgctgtatgcgataggtgatgtcagtatcatgtgcgcattgcagcactggctgctcacccgcctgcgcgcaggctgccagcaggccaagcgccacaaacagcgccagaaaagtgccgtatttcatcgcccgatcaaattcctcattgtcttcatggcgccacccatctgcaacgccccctgtccattcccggagagcagaccctgcaccatacccggcggcaaatccattttctgatacccgtccggaatcctgaataaagtctgcggctgcggggcatatttcacgctggttgcatgcaggctgccggtgcgaccctctgtatctgttccctcaccgctgagcaggataccatcatcactgaggcagatcgttccctgtccctgccgggacgtgacatgccacaaagtgcaggcaatgccggcaatccggctggtcccggtgcgggtgaaattctcggtcggggagagcaccagcgcactgaccggcgtgctggaaatggcactggtgacgtagatattgatctggttcagcaccaaggtcgcacgatcttgccgcggatcaagcagcaaaaagccgggttgccggtcagcctcaatccgtgcctccccaactgtgcttgaatagaacagcctgccctgacggggccgcccggtttcaccggctttcgcaccggtcagggtataaaccacggacacatctttctgcggcaccagatgggcgggctgatcggcaaaggcggggtgactggagaatgacacaccagccagcagtgccagtgcacttagacgctgcgccctcatccgatgccgcggcatgatgtcatgggccatgatcattcctttccttgcctgccaattccctgaacgcatgaaccaacaaagcgtgtggcggagtcgcgatccagtctgcccggatatccacgcaagccgccagtcgctgcctgtatgcctcacgtgggatttccatggcaccgaactgtgtcagatgcgtggtgacaaactgcgtatccagcagccggaacccgcccagccgcaaacgggccaccagatgtgtcagcgcaaccttcgatgcatcacgcactgtgctgaacatgctttcaccgaagaacacagcgcccagcaccacaccatacagaccacccaccagctttccgtcctgccatgcctcgacagaatgggcatgaccgattcgatggagatcgatgaaaagccgcttgatttcagcgttgatccagctatccatgcgcccctgccgtggcaccgcacagccatggatcacggcaggaaagtcactgtcgatccgcacctcgaaccgctcgcccagaacagtgcgcaacaaacggcgcggcagatgaaacccgtccagtggcaggatgccgcgctcttcaggatcgagccagtaaagacgcgcaccgtctcgtgtttcggccatggggaacaggcctgcacgataggcctgtaatatcaactccggagtgatctcgaaggcgcgtcgcgacatgccttcctatccttccgcgttaccttacttggcagggccaccggaaggacagtctggaaaaaccatcctcccgctccagatcaagccgccggaatctgtcccgctacaaatttctccagccagtgaatggtgtattcaccggcctgaaattcgggatcagccagaacgcgctgatgcaattcagccgtcgtgctgatccccaccacggccatttcctccagcgcacggctcatgcgtgcaatggcttcaggacgggtgggagcatgaacgatcagcttggcaaccatgctgtcatagtaaggcggcaccacatagccgctgtacagcgcactatccacacgcacgcccaggccgcccggcgcatgaaatgcctcgatccggcccggtgtcggcataaaggtcaacggatcttccgcgttaatgcggcactcaatcgcatgaccccggaaacgaatatccgactgctcataaccgagaggctccccggccgcgatccgaatctgctcccgcaccagatcgatgccggtgatggcttccgtcaccggatgctcgacctgcaagcgggtgttcatctcgatgaaggcgaattgtccgtcctgatataaaaactccagcgtgcccgcattgcgatagccgagcttgcgcaggccggaggtcacgacctcgccaatccggtcacgttcttccgccgtcagggcgggagaaccggcctcttccagcaatttctgatgccggcgctgaagagagcagtcacgctcacccagatggaccacattgccatgcgaatcggccagaacctgcaattcgatatgacgcggtttatcgaggtatttttcgatatagacggcatcattgccgaaagcggcagcggcttcggtgcgggccagacgccatgcttcagccagttcgctctcatcatgcgcgactttcatgccgcgcccgccgccacctgccgccgccttgatcagaaccggatatttcacccgatccgccacggcgcgggcttcctccatatccgatacgacgcctgccgaacccggcaccagcggcacgttgagcgaggccatggcgtgcttggcctcgatcttgtcgcccatcatacggatatgggacgggctgggaccgatgaaggtcaggccatgcgcctcgaccatttcggcaaagtccgcgttttccgacaggaagccatagccgggatgaatcgcatcggcgccggtgatggtcgccgcccccagaatggccgccgtgttaagatagctgtcacgagcagcgggcgggccgatacagacgctctcatccgccagacggacatgcatcgcatcggcatccgcggtggaatgcacggcaacggtcggaatgccaagttcacggcaggcgcgctgaattctcagcgcgatttcaccacgattggcgatcaggattttgtggaacatcccgccccggtcactcaatgatcacaagcggctcgccatactcgaccggcgcaccattgccgacgagaattttcgagaccgtgcccgctttcgcggccttgatctgattgaaagtcttcatcgcctcaatcaacaacagggtttgcccggcagtcaccggctgaccgacagagatgaaagaaggcgcgcccggttccgggcacagataggcaataccgaccatggggctgagcaccgcaccgggatgtttcgcatcatccacggcggagacagcttcctgcgccacaggagccgcctgcacctgcgagaccggtgccgctgctaccgccggcgccgccagggcaggggcaccaccgatataggtgaccggggccggggtccgcgcaacacggatacggctttcgttatcgatgatctcgatttccgtcaggcctgtatccgcaaggattgtcgccagggtgcggatggcctccgcgtcgaacagaacgcggctcatgcgccctcttctccttcataagggtgaaaagcttgatcccgatcggaatgatcatcgggcagatcggtctgttcgtccagcaggtccgccatggcgcgcaacgccagggcatatccgcgcacgccgagaccacagataatgccgtcagccgcctggctgacgtaagaccggcggcggaacgtctcgcgccggtgaatattgctgatatgcacctccaccaccggcagatccaccgcaagcagcgcatccatcagggcaacagaagtatgggtatagccagccggattgatcacgatgccggcggcacggccacggcattcctgcacccaggaaatcagctcaccctcgccattggtctgcctgaaatcaacggcaagcccaagctcctccgccgtttcggcgcacagcgcctcgacatcatcaagcgtcacggagccatacatctccggctgacgcacgccgagcatattcagattcgggccgttcaggacggcaatcaaaggtctggtcatcagccgggcgttagcatgcgcagacgagaacgtccaatccgtttcccaccctgtttcacgaaaccagcctttcagcggttccggcttgcgccgcgtgaggcctctccccatagtccatgacatgtccgcccccagcacatccctttctgaaacgcctatgacggatggcgctttcatcaccgtcaatggtctgtcgcatgccctttcacgcccgaccactgttgcggcattgctggaagagatcgggctggaccgcgtcaaaatcgcggtagagcgcaatgaaagcatcgtaccgcgctcgctctatgaacagaccctgctggatgatggcgacgtgctggaaatcgttcatttcatcggcggcggctgagccggacaggcgcgtttgcgcggccctttgatcgggcgcgccactcaacacggaatcaggatatatcatgacgacggtttcaccgacacatgcctccggctttgccgcatcaggtgtggaggccggatgcgatgatcgctggagcgtagccgggcgacatttcacatcccgcctgatcgtcggcaccggtcgctacaaggatctgccggaaactgccgccgccattgccgcatcgggggccgagatcgtcaccgtcgccgtcagacgggtgaatctgtccgatccctccgcaccgatgctccaggattacgtcagcccgcgcgactatacctatctgcccaacaccgcaggctgccatacggcgaaagacgcggtgagaaccctgcgtctggcccgcgaggcaggcggatggaatctggtcaagcttgaagtgctgggcccacccccgcatctctatcccgatatggccgcaaccatggaagccgctgccgccctgattgaggatggattcgaggtcatggtctattgtgccgacgatcccgtcgccgcgaaacggctggaggaaatggggtgcgtggcgatcatgccgctcggcgcaccgatcggctccgggctgggattacagaatccggccatactgtccctgatcatcgaacaggcgaaagtgcccgtgctggtggatgcgggaatcggcaccgccagcgatgccgccgtggccatgcagatcggctgtgatgcggttttgctgaacagcgccattgcccatgccgggaatccggtgctgatggcacaggccatgaaacatgccgtgcaggcggggcgtctggcgcatctggccggacgtatgccccgccgaatgggggcggacccgtcctcccccctgaccgggctgatttcctgaacggtggaaaccagccggaccagttgtggagaggccgttattcggcctctgcatccgcctcacggatgtaaggctccaccttgccttgcagcttgatggtcatcgggtgacccttgcggtccagagccttgccgacgatcacacgcacccagccttcgctgacgcagtattcatcgacattgtttttctcttcgccattgaaccggatgccgacaccgcgttccagcaaaggggcgttgaaataggggctgtccggattggtggacagccggtcgggaagggtatcggccatgggaggcagctccatcatcatagatcaatccgcctcatagcggattgatccacatccccacaaatgatgccccggcactcacgactctgatcagtgcagcccgtaataagtggggtggccatgaaactgccccatatgcagatgtttcaggcaggctttgtaatctgcatgactcaatgtcttgacatcgcaatggtcaggctccggagccactgtattggcagccgcggaatccggggcagcagaaggcgtgggcgtaaccacattggccaccggcgctttctccggagggggaggtgtcggggcagcggacgtttcctttggcgcaggtgctgagcaggcagccaaaatcaatgtcagaacaatggaaacaaaatagcgcacgcttcattctccctttgcgcctgtttgcgcccgtaaacgttacggtaacgcttcagtcttgggaaggttcgcatcggcggctagtcaataaccccctgcgccatcatgacagcgggactttctgactggaaaaagggaaatggcggacccggcgcgattcgaacgcgcgaccttcgccttcggagggcgacactctatccagctgagctacgggtccagcgcgccctgaataccctgcgcggacgtcgaagacaaccttctctcagccccttatgccgcaaaacccggaaatgtcatctgccttgcgccgcacgcaaccgccctattgcctcgtggtctgctcctgacggcagtggcaggtcgcttcttccaccggcaatggccatcatccatgcgatgacatcttgcaggggaaggtctcgccgctgatcacggaacagcaggtgataagcatccgggtaataggccaggcgcacgttccgcttgtcttctctctcttctcttgaccccacccgtggtgccagagccgcccaggcggtgcgcatggcccggttcggcaccagttcgtcatgggcgccatagagaaacagggccggcccttttacatacggtgccgattccagcgcctgatccatcagatcgaccaccccgccaatcacatcgacgcgcgttttatgaatggtcaacggatcatgccccagccggagcagggcggttctgttatcgctcgccttgacccgcaccggtcctggaccaagccgtgccccgggaatcgtatgcagcgccaaccagagcgtgctgcgcagggcgatattcattttgctacgcccccacacagccggagcagagagaatatagccgtcaaccgccggagcatcaggcagtgttgcagtcagcatcagcaccgcgccccccatgctttcgcccatcgcaaaaatacgactgtgcggataacgctgacgcagctgacgcagcatggcggcggcatcctgcgccatagcctccccgcccgaccagtaaccgcgggagggcgatgcgccgaagccgcgctgatccggcgcgatcacggcaatacccgctgccgccagaacaggggcgggatactcccatgcatcacgggaatcgttcattccgtgcagggccagcaccactgcccagggaccatccttcggcatgtcggccggcatccatgcgcgatatggcaaggcggttccatctgccagcctgaacagaccggacgccggaaccagagcatttaaccgtgaaaaaggcacctgcatgaccgctttacccggttcattgacccccgtcatagagaccggaacccgtggagaccccggtagcataagccgggatgcacaggcgctgggaagcagtgacactcctatcaccaaccagcgcaatacacgggaaaaagaagtcaatggacggcctcggactggaaataaccagatgaacaggctccggagaaacggagacggttgaacgaaccgtccgcatggctatcatcccggccatgcctctgccagatgcccggcacaggcgaggctttacggaggatgcaccatgaccacacagcccacaaaccatgcctccgtctctgcggaacggggggagccaaccccggtggcgcctgccgggctgaatgctccggccagcgaaaccattctggtcgacagccatgtggtttcctgcgatggcgggaatgcgcctctggggcacccgcgcgtgtggctgcggatcgccgggcaacgggtcatgtgcccttattgctcccgcctctatgtgctgacggccgatgcccctgccgtagcagcccactgatgcccgatctgaccatttttccgtgagcacctccccgacgccggacgcagcgcttccggacagcacccatctgattctgatcgacggatcgggattcattttccgcgccttccacgccttgccgccgatgaccagaccggatggaacaccggtcaatgccgtcttcggctttaccaacatgctggcgcggtttctgaaagatcacgtcggcacgcatctggcggtgattttcgatgccgggcggaccactttccgcaatcggctctatccggcctacaaggcgcatcgtccggagccaccgccggagctgatcccgcaattcgcgctgatacgggaggctacggccgccttcggcgtccctgcgatcgaactggccgactgggaagcggatgacctgatcgcctcctatgcccgtgctgcggtcacacggggcgggcgtgtcaccatcgtctcctccgacaaggatctgatgcagctgatccagccgggcgtggagatgcaggatccgatcaaacaaaaaaccatcggccccgccgaggtgatggaaaaattcggcgtgacgccggagaaaatgatcgacgtgcaggcattgatgggggacagcgtcgataatgttccgggtgttcccgggattggccccaaaaccgctgcccagctgatcaatgagtatggcgatctcgacggtgttctggctgcgctggagacaatgaagcccagcaaacgccgggacaatctcgttgcccatgccgaggatgcgcggatttcccgtcaactggtggcactgagtcaggatgccccgctaccagtgccgatcaccgatctgagtgttcgtcagccggatgctgccgttctgcaggactggctgaatgcgcaggggttccgcagcaccgcggcaaggctcgggcttgagacaggcggcagcacttcccccgcctctcccgctgccagcagaactgcggctgccgcactggcagcagcctcccccctccccccttcctccgcgccgttcggcccttatgaaaccgtcacgaccgtcgaagcgctggagccatggctgacggaagcacggaaagccgggctgttcgccatggataccgaaaccgacgggctggatgcacaacaatgcaggcttgttggcatttcgctcgccattgcgccgggaaaggcctgctatatcccgctcgatcaccagactacgctggatcagccggtgcgccagccggccattgcggagattgccgctgcgctcaacccgattctggccgatccgacagttctgaaaatcttccagaacggcaagttcgatctggccgtgctgcgccgtcatcagatgccggtcatcgccccgatcgacgacaccatgctgatttcctatgctcaggaagccggtgcgcacgggcatggcatggacgagctttccgtcctgcatctgggacacagcccgatttcctatgatcaggtgaccggcaccgggcgtaaccgtctgcccttcccgcaagttcccatcgacaaggccaccgcctatgccgccgaggatgccgatgtcacgctgcgtctgtggcatgcgctgcggccccgcctgcgcgagactaaatccctgaccgtctatgagcagatggagcggccgttagtgccggtgctctgcgccatggaagcagccggcattcgggtcgatgaagccgaattacggcgtatgtcggcagatttcgccctgcgcatggcagacatggaaacggaaattcatcagttggcaggccgcccgttcaacctcgccagcccgaaacagctgggagaggtgctgttcgacgaaatcggcctgaccggcagcaagcgatccaaaaccggcgcatggggcacggatgcggccacgttgcaggcgattgcggatgaaagcggtcatgccctgcctgcccgtatcttggactggcgccaactggccaaactgaaatccacctatgccgatgcgctggtggaggatgtcaatccacggaccgggcgggttcatacctcgttccagatggcgatcaccaccacggggcgtctgtcctccaacgagccgaatctgcaaaatatcccgatccgcacggaggaaggcagccgcatccggcgggctttcatcgccgatcccggccatgtgctgatcagcgccgattacagccagatcgaactgcgtctgctggcgcatgtcgccgatattccgcagttgaaggacagcttcgccaacggcgaggatattcatgcccgcaccgccagcgaagtgttcggcgtgccgatgcagggcatggattccctgacccgcagacgggcgaaggcgatcaatttcggcattatttacggcatcagcgcctttggtctggcacggtcgctggccatttctccgggcgaggcgcgtcagtatatcgatgcttatttcgcccgctatcccggcatccgggactacatggaacggaccaaggaagaagcacgaatcaacggtttcgtggtcacacccttcggacgccgctgctgggtgccgggcattgccgaccgcaacccggcaaggcgcggttatgcggaacggcaggcgatcaatgccccgcttcagggtggcgccgcggatatcatcaaacgcgccatggtccggctgcctgccgtgctggctgacaacagttttcagacccgcatgctgcttcaggtgcatgacgaattgctgttcgaggccccggaggccgaagccgaagctgttgcccgtctggtcaccacgaccatgcaggatgctgcccggatttcagtgccgttggtggtggaaaccgggatcgggaccaactggggcgaggctcactgatagcacgccggtcaggcatatccctgcctgaccggaacaaacaccagcgtcttgcagattaccggagccttattcggaatcgaccagcacaagctcggcctgttcgagtccggtaatctccagccgttcttcctgcgtgatcgccagaccatcacgggcatcgacttgcacgccgttcacactgatccggccggttgctggcaccagatacagatgccgctccggatcggcatccagcatcagggtctgtccggcacctaccgttgccgccagcacgcgcgcattggcccggatcggcaaggcgtcatctcccgctatgccgctggcgaggatcgtaaaccggccttcccgctgctcccttggaaacgggcgctgcccccatgagggcgtgccaccttccgtggcaggctcgatccatatctggaacagccgggtcctgccgctctcccgattatgctcggagtgacggatccctgagccggcggacatgacctgcacatccccggcctcggtccttccatgattccccagcgaatcacgatgcgtgatcgccccctcccgcacataggtaatgatttccatattggcgtgaggatgcatgggaaaaccggaatccgccgcaatctcgtcatcgttccagacgcgcagcgcaccccagcccatccgggccgggtcatagtaatgcgcgaacgaaaaatgatgcgttgcgttcagccagccatgattggcgtggcccagcccggcaaatggccttttctcgatcatggtcctgctcctttatcagggggagagctttgcagcctccgtgatggagcagagatgaggcatgaggccgcctgggaaaagagcaggatcagaacgacactgtttctgttttgacaccagcaggccgcgatgctcgcagcctgtcggcgcaataatgattggcctgaattactggcctggctggcgcatcatcctgtactcttggggtacatcgaaataggccggggtaatattgctgtaggatactttcacagccgtcagactagccccgttctgggcacgttcatgcgcattcagcagcacgccatccgcagtcaggcagacgatgctgccttgtgcattcggctcagtcacatcgtaaactgtgcaaggctggcctgcgatcacctcggttccggtcttgttgaagcgggcatttttaggcggttcgaaagtcatgctctgcgccgcccccggaggcagcggcatgacagatttctgcccatcgatgaccatcaccccattgccggccttccggtcgataatgatgtaatccttcgaattcggcgtctcgatccgaagctttccggcagatgccagcaccgtcaccatagcctgatgccgggaaccatcaggatccaccgtatcatacagcacctgcacgtttttcgagggaatgacgagcggcgcggtctctgccgccagacaggcaccccctgccatgaaggacgccagcacaccggccatagccgtccatttcagtcctgacgccatcatatcatccaatccgcctgttatcccaccctacggcttgtcccatgtggacggaaccggggaaggtcacccgccatcatgacgcagaaagggtttatttcaagcggtccggcatgacaggcagcgcaccctcgggaatattgtcccgcagcagcccggcaagacgcccgtagccgtcgccgcgaggatcggacccgcgccagatcaggcagatccgacgggcagcggaatccgtcagaggagacagggacagcagaccgtgcaaatcctcccgtccccgtgcggcgagggcaggcagcagggaatatccctccccggccgcgatcatatgccgcagcatttccagactacaggcaaaccgctgtttctgcgtatgcgcggttctgcttccctgccgggcacagagcgacaatgcctgatcacgcagacaatgcccttcctccagcagcaacagcccatcaaccggcaatgcgtccagattgacatcgcgccggaatgccagcggatgaccggtcgggcaggccagcaggaaaggttcatccagaatcggctcggctacaattccgtccatcgggctaagccaggccagcaacccgatatcgagttttccaacgcgtagcgcatccagcagatcgcccgtcttcagctcctcgatctggagcgacaggcccggcaaacggcccagcacactccgcagcaccgagggcagatagtacggccccaaagtcgggatcacaccaagccgcagcgtaccggtcaggctgccctgttgtgactgcgccatttccagcaacagccgcgcctgctgcaaaatgccgcgcgcctgggagagaatcgcttccccctgctccgtggggcggacctgacgattgccacgatcgaacaaggtgacaccaagcagatcctcgagttttctgacctgttcgctcaaggcgggctgactgacgccgcattgctcggcggcacgcccgaaatgccgcaactcgctgacggcgacagcatattccagatcgcgcagcgacaacccagccaggttcatagggagcaccgaaacatcattaaggaaagaacgattttccttatacccgaacccgtggcagggtcacgccgaagccttagacctcgcggattggaaattgcagccatgcccgatacttcatacccttttccctcctctggcccctccggcagccccgttctgaccaccacagcgggcgcgccggttgcagataatcagaacagcgtgacggcgggcgctcgcggtccaattctgttgcaggattatcagctgatcgaaaaactcgcgcaccagaaccgcgaacgtattccggaacgcgtcgtgcacgccaaaggctcaggcgctttcggcacttttaccgtcacggcggatatttcacgttatacgcgcgccggcattttctcacgcattggcaaatccactgatgtgctgctgcgtttttccaccgttgccggtgagcgtggggctgcggatgcagagcgcgatgtacgcggatttgcgctgaaattctataccgatgaaggcaactgggatctggtcggcaataacacgccggtgtttttcatccgcgaccccatgaagttccccgattttatccgcacgcaaaagcgtcatccgcgcaccaatctgcgctcccccaccgcgatgtgggatttctggtcgctcagccctgaaagcctgcatcaggtggcaatcctgttcagcgatcgcggactgccgcaaggctatcgtttcatgaatggctatggcagccatacctacagcttctggaacgatgccggagagcgtttctgggtgaagttccacttcaaatccctccagggtatccgcacctggaccaatgaagaagccaatgaggtcattgcccaggatcgggaaagcgcccagcgcgacctgtacgaagcgattgaaaaaggcgatttcccgcgctggcgcgtttgcgtgcagatcatgccggaggcagaggccaacagcacgccctacaatcccttcgacctgacgaaagtctggccgcatgccgattatccgctgatcgatgtcggcgtgctggagctgaatcgcaatcccgcgcattatttcgcggagatcgagcaggcttcgttctcaccgtccaatatcgtacccggcatcggtttctcccccgacaaggtgttgcaggggcgtctgttcgcctatgccgatgctcatcgctaccgtgtcggcacccactacgaagccttgccggtgaatgccccgaaatgcccggttcatcactatcacgcggatggcgccatgcgcttcgacgcgccacagggaaccgatgcgtattacgagccgaactccttccatggtccggtgcaggatcgcacggctcaggaaccgccgctgcgtatttcgggtgatgccgaccgctacaatcatcgtgacggcaacgacgattatacccagcctgccgcgctgttccgcatgttcacggctgaacagaaggaacgcttctaccgcaacatcgccggcgccatgcagggtgttcccggcttcatcatcgcccgtcagctggagcatttccgccgcgccgatccggaatgggcggatggtgtcaagcgggcgctgggcgatgcgtatcaggaaccggaatctgcccccaccaatgccgaggcgcgcacctgaacagctttatttctagctcaccacgacaggcagcaatgcctgtccttatctccaccgcgtctgtctctgacaggcgcggtttttttatgcgcgggccaggcgtaccagttcctgccggacacccgatgcatcactcaccggcgctgaccagttcatccgcaacaccggttcggacatcgggtcatcaggggccagatcgcagccatcgcaatccaccgccaccatgcgccagcttgcagccttgccaccagcaccctgcgcaatccgcgccagcacgtcggcatgatccgcattacaatgtgcgatgatgtccgcctccgccgcaagcagtgccgtgaccgaggcttcgtcaggacacagcacagaacctggcaaacgcgtggcttttgcaaagccgcccaccagcatggcccccagcggctttaacctcaccaacgaaaaatcactgaatccagcatagggcgcagcataaggatgcacggccagaaaacgctgccgcaacgccggatcatccacgacctccgccaaccctgtgacggtgacacgcggtgcggtctgtggattgacggtctctgcctccccgctgaccatcagggcggcccgtttctccatccgcaaatgccgcatatgctccgacaggctggacaaaagcagcaggatcgacagatcagccgcgcaggcatgggtgacaagcgctgcataaggctgcccatcctgcacggtggccagtgtcgcctgccgggcagagcgcagcaggcaacgcgcctgccacgcaacctgtttcatgtcatgcgtatccagtgccataatcgattcttcctgccatgccgctctcagcggactgcaatcgtttacagtcgttcaaagcccaagaaacgggcaaagcccacgaaacgggatccaccatgacacagaccatcgccctcgtggatgatgaccgcaatatcctcacctccgtctccatgacgctggaggcggaaggatttcaggtccgcacctataccgacggagaaagcgcgttgcagggcctgacgacccggccagtggatctggcggtgctggacatcaagatgcctcgcatggacgggatggagctgctgcaacgtctgcgcgcgcgtaccgctttgccggttatcttcctgaccagcaaggatgaggaggtcgatcagttgatgggcctgcggctgggggcggatgattacatcaccaaacccttcagccagcgcctgctgatcgagcgtatccgcgctctgttgcgccggaacgatgccagccgtgcagacgggcaaggcacgacaggaggagggctgctgacccggggcgatctgaccctcgatgagagcaagcaccagtgcctgtggcatggtaaagatattcagctgacggtgacggaattcctgctggtcaaggcgctggccgcacgtcccggcgtggttaaatcccgtgaccagctgatcgatgctgcttatggcgaaaacatctacgtcgatgatcgcaccatcgacagccatgtcaaacgggtccgcaaaaaattccgcgctgtggatgatgatttcaaccagatcgaaactctctacggcatcggctatcgctataaggagcaataatttcaccggactattccgtttttccatccgggaaacgcattccggccacgtacgcgccgcaattccatgtcatggcgggcctcatgacgcataaccgtcccccttccgcaacgaaccggcgctatcgactgatctcaccgctgctgagacgcattctggtggtcaatgtcatgccgctggtgctgctggtggcggcattgctgtatctggatcagtaccagaacgggctgctgagcgccgaggtgctcaccttgcgggaacaggcgcgcatttttgccggtgcgcttggtgaagttgccattgatccgccgggcaagacaccgccgcatctctccgccgggattgcccggccactcttgcgccgactgaccgagccgacccccaatgcccgcgcccgtctctatgggcctgatggcagtctggtggccgacagtcaggccatgcgacacgatccgggcgaggatatcggcacagaaccggtcgccaacccgcatgagcggagcatgctgaccgatatggtcagcactttttacgactgggtgcagacccacttcccgcatgccggccactcccccatcatgaacacggatcgggatgaggcgcttgaaaccaggccacggtggcagtccgacacaggcaagggccaatccgctgcctttactccggccgattcagcattggaaatgcccgcctatatccgccgcacggcagattcccggttgttggtcacagtggcggaaccggttcagcacgataatcataccatcggcatcattcaggtgacacgggaagcacgcgaagtcgatgccagcctgtttgcaattcgggtctccattctggcgctgttcgggctggcgttggggttgacggtgatcatgtccggctatctggcgcggaccatcgcccgtcccatgcggagccttgcagtggcggccggacaaatgcgcgaggaacgagtacgcgggagctatctgccgcctgccctgctgcggcgcggcgatgaaatcggggaacttgcggaagctctgtccgagagcgccgtcgctttatgggcgcgtatggatgcgatcgagcgtttcgccgccgatgtggcacatgagatcaaaaacccgctttcctccatcaacagcgccatcgagacattgcgaagggtcgaggatccggctcaacacaaacggctgatgagcatcatcgcgcaggatgtagggcggctggaccgcctgatcaccgatatttccgatgccagccgcgttgatgccgaactgtcgcgccagccaacggaggaggtggatgtggcccccattctctccacccttgcagagattcatgaagcaacgcgggatgaggaggatggcgaccctgttctgaccgttcatatctccgatcagccgctggtggtacgcgcggtggaaacgcggctggtgcaggttctgcataatctgatcggcaatgcggtctcattcagcccacccgatggggtgatcacgctctccgcagggcgtaacgggccgttcatccagatcacagtcgaggatgagggaccgggtattcccgactcaaaactggaacacatctttgaccgcttttactccgagcggcctgagcgggagcagttcggcaagcattccgggctcggcctgtcgatcagccgacagattatcgaagccctgtcaggggagatcaacgccgacaatcgccgtgatgcggaaggcaaaatcatcggtgcccggttcagcatcaagctgcccggtacctgagccgggcagaatcagttccatcacggacggataacgctctgggccgaaccctgcggcaacccttgatccattttttgctcccggaccagttcctgggccggaacagccaccggctttttccaggggatggaatgataccatgcaatgatccggaccagcagtgccagcacagccatggccatgacattcaccacaatctggcggatgctccatggcgacacgccatccagagcggcggtcccaagctgcgccaacacaaccgtgcacagaaaaaccggcagtgaataggttccggctgtaatgaacgggcgcgcccagttgcggtgaagaaaggccggacgctttccgacaatgctcaccaccagccatgcgatagccagaaaatgcagatagatcaggggcggcagcacggtcttgttggtattcgccgtcacccattcggcgatggccgcgcccgtctccccggcatggctcaacaggccggtgcgggcgacgaaaccgaaaacaatcaggccaacggcaccgatgcggaacaggcccatgccccggtcacggaaaaccggcgggaccgacacccatccggctgtcagcgcataaccggtgaagaaaaccagctgccagctgaagggatcgaagaaccagtgacgcttcgtgctgggatcggcgggcaaattccagcccagcagcagggcgcctgcccacagcagaaccgatgccacaacaggcagccgccgatccagcttcgccagcaggaccgcaaccggcaccatcgccatgatcacgacataaaccggcagcacatccagatagcccggcacgtagctcagcatcacgatgcctcggaatgcctgcaccggatcgtcatacagatgatacagttcgaacagttcgacaaaattatagtgacgatggccggtcacatgggccagcagtcctggcaaagccgccaccgccatcaccaacccgagttgggccgcataaatctgccagacccgcagagacacacgtgccgttcccagcgcccatccagcccggcgataaacactgccgaaagcgtaggcacaggaggcacccgagacgaaaaagaaaatacaggccgcatcgctgaaaccgaaactggccggcatgagatgggagaagctgttgttccggatatggtcgatcaggatgatgaacagggatacgccccggaaaaaatcaatccgcagatcgcgctccttgcggacacgcacaggctgtatgaccggattggccacaccggaaaccgttccttgacaaaggggatcgctcataaccgcgccagatcctttcctctttctgccgtctgccgcagacggcagaaagatcagccgatcaggccagaccagacaaggcccgatctgccaacatggctgacccaacgagaataatcattgaacactaacccatgcgaacggttcgcacagcaaaaagaatttgaccaaacgtaacagaccatcccattgccctgccccggccaattgccctgtgccggcccattgccctgtgccgggatgtctacccctcgccaccgccatggggtaacccggacaattcctgcatgggatcgctacatccccaagggacaaaagacgtttagatgagggagcctgccggaatgggtctcaagatcatggggtcgaccgccctgctgaccgaagccacgcgcttctgccgtcgccgcgcgctgtgggtggtgctggcagccatggtgctggcgggactcagcctgacccatgccgcccatcatctgggggtcagcaccaatacggatgagctgtttgcgtcctcccttccatggcggcaacgtcaggtcgcctatgagaagaattttccacagaatcaggatctgctggtcgctgtggtcgatggctccattccggaggaagcagaagccacagccgatgcgcttacaaaggcactgtctgaagacaaggagcattttctgtctgtccagcagccaggagcgctgccttatttccagaaagaggggctgctgtttctcgaccagaaaagcctgtccagcctgctggaccagaccatcgacgcgcagccttttctggggcagctgacggcagatcccagcgcacgcggcctgttcgcagcgctttccctcgttgccatgggcgtctcccgcggggaggccaacctccagcccttcatgccggccctgcaaggtttcgatgatgcattgcgtcaggcggcagacggacatccgaaaccgctttcatgggagaacctgctggccggtccactggcgcaacaggcagggcaataccgcttcgtgctggcccagccgcggctggattacgacgcactggaacccggcggtgctgcaaccgccgtgctgagacacatcgccgccgggctggaattcgtccgcaccggccatgcccatgtgcgcatcaccggccctgtcgcgctggcggacgaagaattctccaccgtggcccacggcatggtggaaggcaccctcatcagcatcgccctgattacgctctggctgtttctggccctgcgcagctggcggctgatcctgccggtgctggccaccttgatgctcggcctgacactgacgatcgggtttgcctcagtggcggttggcaccctgaatctcgtctcggtcgcatttgcaatcctgttcgttgggatcgccgtcgatttcgccattcaatactgtgtgcgcttccgcgaagtgcggcacgaaatcgccgatccggccatttccctgcccgaaaccacacgccgggtcggcggacagattctggtggccgcggccgcgacagccgccgggtttctggcttttgttccgaccagcttcgaaggggtagccgagctcgggctgatcgccggggtcggtatggtgattgccttcctgtgtactatgactttcctgccagccatgctgagcctgttccgcccacgggcagaaggacgggaaatcggctttgccgttggaatgcctctcgaccgcaccctgctgcgctggcggcggcctgttctgctggtctttgccctgatcgccgtttccgggatcgccctgctgtcgcggctgacgttcgattccgatcccttgcacaccaaaaatccgaatacggaggccatgcggacgctctacggcatgatgggcgatccgatgaccaacccctattccgccgatattctggtcgcaaaccgggaacaggccgaagcgctcgccaaaaagctggaaaaactgccgaccgtcgccgaggttctgacactctcctctttcgtgcccgacaatcaggatgaaaaactggctctggtcgcggatgccgccagcctgctggggccgaccctgacccctcatacccccccctcctccgtgacgcccgaacagatcaggctggcaatcagtgcggcgctggggcagatccgcccggctttggccaaactgcccgccaatcatcctctggccgggatcgcggcagcgctcgaccggctgtctcatgcttccgatgagacgcttcttgccgccaatgcggccctcgtgcggtttctgccgatgcagcttgagcgtctgcgtacggccctgagcgccgagaaagtcagcgtcaaggatattcctcccgccttggcgaaagactggcagcttcctgacggacgggtgcgggtccaggccatgaccagccccaaagcctccgacagcgccgggctgcaccgtttcgccgccgaagttctggccgttgcccccgatgccagcggctccgccatcgtgattgtggaaacggctcaaaccatcgtgaccgcgttccgtcatgccgcaatgggagccatcgcagccatcatggtgatccttgcgctcgcgttgcgtcgggtgctggatgccgcactggtgatgtcggcgcttctgctctccgcgctgatgacagtcgtggtgatcagcctgctgcccatggcgctgaatttcgccaatattatcgccctgccgctgctgctgggcgtcggtgtctcgttcaacatctatttcgtgatgaactggcgggcaggggtcagcggttttctggcaaccgccacagcccgggctgtgattttctccgccctgaccaccgcgaccgccttcggatcactggccttgtcggagcatccgggcacagccagcatgggcaatttgctgatgatcagtctaggctgcacattggtggcctcgctgatctatatcccggcgctgctttccgggctgcgaaggcggggtcaggcctgagcgtggatcagacggcgcaaagcgcgtatatcatccggccgggtgcggcagcatccgccgacgatccgtgctccaagccggagccagcttctcgcctgctctgcccagtcatcggatcgcctgtgtccccaacaacgggtcaccagatcaaatggctccccggcattggggtagacgatcacaggcaggccaccacggcgcaaacagcggatcagggcaggcacgaggaccggatcggtacaattgatcccgatggcggccacgaaagggcaggatgccatagcctgcacacagagtctcaatggcgttccatcggcgatatgggccgcatcccgcacggaaaagctgacccatcccggcacactcaatgcctgaagcaaatccgcaaacgccagtgcctcatccaaatgcggcacggtttcacaggcgatgagatcggcgcctccggctgcaagcgcacgcatgcggggagcgtggaacgccagatactgtgagcgcgacagggcatagcgcccggtatattccgagccatcggcctggcacgccccatatggccccagcgagccggccaccagcggacgaatccggttgcggcgctgcgcagccggcagaccggcccagacgtcatcccggaccgaacaggccagtcgcgccgcatcggccaggaccgacatagcccgacctcgcgacaatcccctgcgctgcaaccccggcagactcagctgatagctggcggtttcgatacaatcggctccggcttccagataggcccgatgcaccgccgcaatcgccgccggattatccagcagcaggcgaccggaccagagcggatcatccagatgatacccggcacgttccagttccgtcgccaaggcgccatccagaagcagcggtcgggcctgccgaaagagagaagagatcaatgccatcacatcctcccatcatcggcgacatgcagactgtcagcggcgcaaggccctcgcttccgtcatttgccatcccagcagaatcggcacaccaaccagaagatcccgcgcccgccgcaccagagaaataccaatggcaatatccggtggcacaccgaacacactgccgagcgcaacataggcagcttcctgcacccccagcagtcccggcaccataaaagcccccgccaccagaccgtgcatcatgccctccaccgccaacgcatcgatgaacagcaattgcacgcccaacatatgcgccgtgagccaggttgcaacgccagaccccatccacgccagaaaatgccagccaatccccctcagcagggcaggcagattggcagagagctgggtcagctccatttccagacagtcaataccatcacccagagcaggagcagcgactctggaagccagcgccctcattatcggtccgaccccatggcgttgcacccacaccgcgccccatcctgccaaaccggccaccacaaccccggccacggccgggatcagcaaagtgcctgatgacgtgctggccagcaggatcgacaacccgagcaaggcaaaaatcaactgggccagaaactcacaggtgacatccacaatggtcgaggccgccgcgaccggccagcgcagcccccaaagcgtcgcggcgcgggcgccgagcaccagaccgccgatttgcgaaaagggcagacaggtactggcggcatccctcaccatcctgcaccagaccggcagccagaacgaaacattgcccggcagcatctgccgccatgcccgccccagcagcaggaaaatcggcacctgcaacaggcacagcaggcccagccctttccagccgatacggagcgtggcatccagcacctgatccagcccgaaccagccgatcaggcccgttgccagggcaagacccagcagggccgccaaaatcgaaatccgttgcaaacgctccgcccgcccaaaccagcccgccagaccagtctgcgggaaaaagaatggcgcccgtgctacacgaaagaacggtgaaactctacacccggcaagacggtgcagatatttctccagagagggcaaagcagcataattttgccccaatcgaaggtcggctgtagaagggcatccgcacgccagccgcacagcgtgttcacccttttcagcggcaaggatcacaagcggatgggcagacaggaatgaccagtccgggacgggccttcattaccggagcaaccggctttgtcggttcggccgtcgcgcgtgctttgctgcaacgaggctggcaggtcaggctgctgacccggcgcagctccgacacgcggaaccttgccggtctcaccgcggacattgtggagggtgatctgctgcagcccgaaagcatcacaccccatctgcacggctgtcaggccctgtttcatgtcgctgccgattaccgcatctgggtgccggaaccggaggccatgatgcgtgccaatgtcgatggtaccgtggctctgctgcgcgcggctcaggcagccggaattgagcgaatcgtctattgcagttccgtcgcggcgctgggcctgattggtgacggcaccccctccaccgaggatacgccgaacagcgaggccaagactgtcggcatctataagaaatcaaaatatcgggccgaacaggctgttctgcggctggtggcggaggaaggggtgagggcagtgatcgtcaatccctccacaccgatcgggccgcgtgacgtaaagccgacaccgaccgggcgcatgatccgggatgcagctttgggtaaaatgcctgcctatctcgataccggtctgaacgtcgtgcatgtggatgacgtcgcggaaggacatcttcttgccatggagcatggcgtgccgggcgaacgctatattctgggcggcaccgacatgcatctggcggatattctggccatggtggcgcgggagacaggacgcaaaccaccacgcatccggctgaatgaaaccttgctgtggccgctggcgatggccagcgagacactggcacgtctcaccggaatcgaaccgctggtcacgcgggatcatctgcgcatggcccgcaagaagatgtttttttcctccgccaaggcccgcaccgcgttcggctggtcgccccgcccggcagaggaggcgattcgtgatgccgtttcgtggttccgtcagaacgatcccgctttcatcagacagcggcccgtcaaaggaaccgccgcatgatctggctggccgccctgagcgcgatgatctggctctatctgctgttttttcacgggcaattctggcaggccgggccgatcctgcccctttcccctcgtccatccaccacacccgtcacggtggtcatcccggcaagggatgaggcggagagcatcgcacgctgcctgcgctccctcgctttgcaggatcatcgggcgttgcatgtcattctcgtcgacgatgccagcagtgacggcactggtgacatcgcccgcgccatcgccgccgagactttccccaaccggttgcccggctggcttcaggtgatcgcgggcaaaccgcgcccgaccggctggagcggcaaactctgggcagtccatcagggggttgccgccgcacgggatgatattctgctgctgaccgatgcggatatcgaacatgcaccgggtcatgtcgcctccctgcttgctcaggcagagagcaaagacctcgatatgacgagcgaaatggtggcgctgaacgtggaaagctggccggaacgggcgttggtgcctgccttcgtgttctttttccagatgctgtaccctttcgcgcgggtgaatgacccgctcagcgcaacagcggcggcggcaggcggaacggtgatgatccgtcgccgggcgctggaaaggatcggcggaatcgaaagcctgcgcggtgccttgatcgacgatgtgaccctggcgagcagggtcaaaaccggtggcccgatctggctgggtcattccgcgctggctcgctccatccgcccctatccgcatcccgccgatatatggcggatgattgcgcgcactgcgtttgtacagttgcgattctcctggaccctgctgctgctgacagtgctcggcatgctgatcgtctggattgcaccgcctgccctgacctttttcggccatggagtggcgcgctggctcgggcttgccgcctggctcggggccatggcgagctatctgccgaccttgaaacgctttggcctcagcccgctctgggcgctggcactgcctgcaatcgcgggtttttataccgccgccacgatcggctcggccatcgactacgcgaccgggcgcggagtccgctggaaaagccgcgcctatacggagcataccgcatgagcgcttccctgaccgaaaacaggccggtcgagatatggtccggcaaagatcagggggacgagaatttccccgtcagccgcatcgtgcgccgcaaatggcgaccgcatgtgaacgcctattatgctttcgcccgcaatgccgacgatattgccgatcatcccgatctgtcagccaatgagaaaatcagccggctggacctgatggaagccgttttgctcggccatgccgatcacggttcccccaccgccagccgcctgcgcgacagtctggccttaaccgggatcgatccgaggcatgccaccgatcttttagtggcctttcgtcgtgatgccatcaagcatcgctatgagagctgggatgaattgctggattactgccgttactcggccatgccggttggccgctatatgctcgatctgcatggcgagtccctgcagacatatccgtcttcggatgcgctctgtgcctctcttcaggtactgaaccatctgcaggattgcggaaaggatctggcgtctctggatcgctgctacctgcctgccgacattctggatgcccatggcgcccgcattgccgatctgcgccgctccagttgctcccccgccttgcggcaggtgctggatgatctgctcaatcgcaccgaacggctgaatgtcgaggcggctcccctctctggattgaccgcagaccgctggctgcgggtaaacgttgccatgatccaccggctggctgaacgtctggcgcagcggctgcggcatggcgatccgctggcgcgacgcgtgaagcttcgtggcatcgacatcgctttgagcctgtttcaaggattgcgcgccctatgaccgctttgagtgccgatgccgccgatctcgcccgtgtcgaggccctgacccgtgcctccggtacctcgttctatcagggaatgaaggtgctgcctgcggatcgccgtctggcaatgtatgcgatttatgccttctgccgcattgtggacgatatcgccgatgagcctgccccgatcgaggaaaaacgcgccgggctgaatgaatggcgcgcccgcatcaccgccctgtatcgtggagaagcggatgatcccgtcacccgcgtgctgttaccggcgatccggacattccgactacggcaggatgatttcctcgccgtgatcgatggaatgcagaccgatgccgaaacaaaggttgtcgcccccagctgggctgagcttgatctgtattgcgatcaggtggcttctgcggtcggccggctgtctgtcagggcttttggcgatgaatcagaagacgcggacagggttgcccatcatctgggccgcgccctgcaattgaccaatatcctgcgcgatcttcaggaagatgccgcacgcgggcggctttatttgccacgcgaatggctggtggaagccggtgttcccctcgatgcgagagccgccatggtctcaccggcgctggagggtgtttgccgccgggtcgtgcagattgccaggggccattatgctgatgctttcgcgttcatggcgcaatgcgaccagcgtgccatgcgtcccgcccggcttatggctgcgacgtatcgcgccatcctgaaccggctggaacaggccggatggactcctccccgccgggtcagcctccccgcatgggaaaaactctgggttcttctacggcatgggctgggttaacgtcttgatctgagccgagcggccacaaaagccacaaccgccacaatcagcagaaggccacccgccatgacgatccagtcatgggcgggaagatcagtccctggaatccagacccagccaaacaccagcccccagattgccagcacggccacaataccgacaggcagaaccaccgcgagatgagacaaggcactcccggtcgtgggagtaccagtcgtgccttcattatccgctcgcctgtttgcagccatgacatttctctcccgcttccgataccgctaacgcggggaaacatcgttcggatgcgagtcagtcggccagaaccgaaaagacatctccttccatcgatttcgcttcaatatgcgcacggtgccacagcgcgtagaacagcaggatccaggcggcaaatccctccctgcgcccatgtgcatggcggaacagactgaccacgcgatcagggcgggcgatggcctgaatacatctctgccgtgccaccagcggcccgagctcctgcccccgcgcagcgatccaggcggcaaccggcacggtaaagccctgcttggctgcaaaaggtcttgcctgagggctgtgccgctccagccagcgacggagaatgtatttgcctttgccatcctgaaccttcaaccggtccggcagacggaaagcagcggcggcaacgccgggatcgagcagcggagtgcgtccctccaccccatgagccatcagacagcgatccagcttcagcagcagatcatgcggcagccagtctgtcatgtcggtttcctgtgccgctgcaaggcgtgagcgcaacggagaaacatgactttcagcagccgcaattccgtcccgccagccgggtggaatggcatgcagtacatccagaccatcgaaatgccctttcgatcgcatgacccgcccgccacgccaccatgggcgcatcgcgctgcgataccgtccatagccgccgaacaactcgtctcctccctcaccggagaggacaaccttcacgtcctctcttgcccggcgcgccagaaaccaggtggggatgatcgcataatccgccgcgggatcgtccatgcaggccacgatctccggcagatgctgccagaccattgattgcgttaccgtcacggtacggtgccgtgcgcctgccgccgccgccaatgcagcagcatgctcacgctcatcagccgcgccgggcacgtcaaatccggccgtgaaagccaagaccgggctgtcattcagccgtgccatcaggctcagcaccgtggcgctgtcgatgcctcctgacagaaacatgccataaggcacatccgcacgctgatgcagtgccacgctttcttccagggcggcatccagacgcgccaatgcctcatcctccccgatctcctcggcggggccttcgggcagggcgctgatgcggcggcgatccagaatctgcccgtcgcggcagatcagcgtctcgcccggcaacacgcgctgaatacccggaaaaatcgtatctgctccggtggtgaactgaagctgaagcagctcgttacgctgggcatcggccacatcgcgtttgaccagaccggcgtcgagcagggccgagggttgggaggcaaaggccaccccccctgccagccgggccacgtaaagcggcttgatcccgaacggatcgcggctcaaagtgactgtacgtgcggcccgctcatggatcgcgatggcatacatgccgcgcagtctgacagcgtaatcaggcccctcccgcaaccagagatgcaagggcggctcgcaatcgctgccggtcgagaacgacacgtccggcatcgcttcacgcagcgcaagatcgttataaatctcgccattggccaccagggccgaggagccggcgaaaatcggctgatcgcccccttccggatcgacaatggccagacgggtatgcaccatcgccacccggccgatctgggtatggccgctgccatccggcccacgatggtgcaaggcggtggccagatcgcccaacagggaaggatcaggcgacgcctgcccggaagccatgataacgcccgcaataccgcacatcagcgtcctgccttttccggagccgcatggcgctgcaaccagtccagccagcgcgccagcaccggtgcctccgcataatcccgctcaaaccggcggcgcccggacgcagccagacgatgagcgagcgccgaatcctccagcacggtggcaatggcggaggccagcgcatcgacatcatcaacaggagaaagcagcccatcctcgcccgtctggatcagctcgcgcggaccgtcagcggcggttgcgacaaccgggcaagttgccgaccatccctcgatcaccacattcccgagcggctcatggcgggagggacagaccagcatgtcggccatggccagcaatgcgcccgtatcactgcgccagccgggcatgtacagccgatcctcgacccccattttgcgggccagatcggtcagggcctcccgctccggcccctccccggcgatcagggcgtggactccgggcagatggcgcagggcacagatcagggtatcgaaccccttgtttctgtgcagcctgcccaacgccagcaccagaggcacatggggaggaatcttcatctccgcccggtcagcagcggggatacggctgaaatcattggcgaaattcggcaggtaatgcacccgatcctccggccagccctgctgcaccatccaacgggtcaggcccaccgtattgccgatcagatgctgacagcggcggtaataaccaaggtcatagtaaccacccagccgccctgccagcgtccagtcaccagatggggcaaagcgcgcggcacggctcatccacgcaatggcgatctggggtgcaaaagcgcgtagctggctgcgcagcctcactccggtgcggatgtcgaataaaccgccgaacgccatctgtaccggcttcagccctgccttcatcaaacgggtggcccgcgccggttcagtgcggatgcagggcagaacctgcacaccagagcgatacaaggcaatactcagacgttcgaaaaacaattccgccccgccctgaggcgcgcctgccatgatctgggccacacgcatcatgcactctcccgcatcacgacacctgccatacccggtctgagccatccgggctgacgaagcagttcctctgccgcagtgacgactttatccactgtcagagcctccatcggcgcttcccctggagaaccatcggccatgaccgcagccgcgtggcgcccggcaggagcatattccgcggcaggagtcggaccgaacaggcccagagtggggatacccgatgctgccgaaagatgcatcagaccggaatcattaccaacaaacagcgcacaacgcgacaggcaggcagccgcttcgggcaggctcacggcaccggcgagatcaatcgcgcccggaatcgccgccaggaccggatgggcgagcgcccgttccttctcccccggcccagccagcacagcaatccgcaatgccggttgcccggcccgcatcctgccggccagcgctacgaagcgctcagcaggccagagcttgccatcccagttggctgtcggccccagcgccagcaccgggctaccttccgggatcaacgtggcggcgcgcgcttcatcctccggtccgaaccagaccaccggcgcaatcggcgtcctgatccccaatgctccggccagatgaatcagcctgtgtccaggacggcgaccgccacgcatgatgaaacgccgtcgcgccgggatcgtcagggagagcgccgagccacgcagatcaaccaccatatcccaccagcgtggcgcaacctgccgccataacgcgaaccaatgcccattccgcggacgtttttccacgatgatagtggcatcccggcgtggcatgcgcagaaacacaccctcagccgcggggccgcaggcgatggtaaaacgggcttccgggaaagcccggccgagataatcaagcaacgcggtagaaagcacggcatcgccgattcgcgtcgccgtgacgaaaagaatacgcatggcctccttttaacaccggatcagaccggctcgaccatatccgcatgaaaaatgctctcttgccctgcctcgcacggcacgccacatctgccgcatgacacaggaaaacgcctgctccgccctgctgccccaccgcgccgttctggccgtgaccggggaagatcgtgtgacattccttcaggggctggtctcgaacgatgtgactctgaccgcgcccggacaggccatctgggcggctatgctgacgccgcagggcaaatggatcgccgatttcttcatcttctccgatggacaacgcctgttgctggatgtcgaggccacacaggctgccatgctgatacagaagctcagccggttccgtctgcgtgcccgggtcgcgatcagtgcagaatctgatctgcacgtccatgccggatggggcagcgcacccatccctgccggttccgtctgcgtcgcccctgacccgaggctgcccgaagccggctggcgtgcccttacgggagccggaattctgccggagggggatgccgccgcctatgacacgcatcgtttgtcactcggcctgccggatggcagcgccgatctggaagcagagaaaaccgtgctgctggaagccgggtttgacgagctgaacggcatttcctggaccaaaggctgctatatgggacaggaactgacggcccgcacccgctatcgcggcctgctgaaacgcaggctggtgcccgtcacgggacatgcccccctgcccccccgagaaaccccgctgatgcaggatggcaaggaggtcgggaccatgcggtcctcccgcgggaagacaggccttgcgatcctgcggctcgaagcgctgcatgcgcctgttcaggctggagatcagagtctgacccctgcccccgcgccctggatgagactggctcagccggacggaacctgaaaagccgccgcaatcaggctgcgcgtataaggatcggcgggacgctcgaaaatcgccgccgtctccccttcctcgaccacaacgccgcgtcgcagaaccgcaacacggtgcgcaagggcgcgcacaacacgcaaatcatggctgataaacagatatcccatgccgtagcgggcctgtaatccgcgcagcagggtgacgatctgcgcctgcacggacatatccagagcactggtcggctcatccagcacgatgaagcgcggctgcaacaccaacgcacgggcaatggcgatacgctggcgctggccgccgctgaattcatgcggatagcgttccgccgcgtctttcggcaggccgacttcttccagcgcccgcgcaacccgtgcttcccgctctgtgcgtttctgatggggttcatgcacggccagaccttcaccgatgatctcccgcacactcatccggggggagagactgccgaacggatcctgaaacacgatctgcatatcgcgtcgcaacgggcgcaagctgcgttcccccaacccctgcagatcatgcccggcaaagcggatcaccccttccgaaggttgcagacgcagcagagcctgaccaatggtcgatttgcccgacccggattctccgaccagcccgagcgtttcaccttcccgcaccgtcagtgtcacgtcatctaccgccctgacctgcccggtaacacgccgcaacagaccgccacggatcgggaaatacactttcagattgcgcgccgatgccagtcccggcggtgaccccggcaagggagaggccgtccccgttggctccgcatccagcagcatcctggtgtagggatgggcaggggtggaaaatacatccttcaccgctccctgctcgacgatctctccatgccgcatgacgcagacacggtcggcgtggcggcgcacaacggtgaggtcatgggtgatcaacagcagacccagctgacgcgcccgtttctgctccgccagcagatcgaggatctgggcctgaatcgtgacatccagcgcagtggtcggctcatcggcaatcagcagagccggatcgttggccagcgccatcgcaatcatgacgcgctggcgttgcccccctgaaagctgatgcggaaaagcatgcagacgcgtttccgcatccgcgaaaccggcctgacgcagcagatgtgcgaccgccgccttatccggcttgcggccatgcagcgccagagcctcgcccacttgtcgcccgatccggtgaagcggattcaggctcgtcatcggctcctgaaagatcatcccggccacgccaccgcgcatctgccgcaagaccgccggggcggctccgatcatcggcacgccatccagcgcgatccggccggagcacagcgccccatccggcagaagttgcaggatcgacaacgcggtcagcgacttgccggagccggactctcctaccagcgccagtgtctcaccacgccgaaccgagaaagagacgcgcctgaccacctccctcgtcgcaaaccgcaccgatagatcggcaatctccagcagggtctgtgcgggggtgtcaggatgcgaatcgtgtgacggtctcattccgcctcctccatgcgggccgcctcctccatgcgggatgcggagaggggaggcgccggcaaggcaccgatatgcttgcgcggatcaaaagcatcccgcaccgcctcgcccatgaacacaagcagggtcaggatcgcgccgagcacgaaaaacgccgtcagaccaagccagggcgcgctgacattgtttttgccctgcaacaccagctctcccagcgagggcgacccgggcggcatgccgaaccccagaaaatccagactggccagcaccgtgacggagccggacagcgtgaaaggcagaaaggtcagcaccgccaccatcgcattgggcaggatatgacgcgccatgatccgcgcatcggacacaccaagcgcccgtgcggcgcgcacataatccagtgcccgtccgcgcaggaactccgcccgcaccacaccggtcagtgccatccagctgaacagcaaaaggaacaacagcaatatccagaaacccggctcgatgatgctgcccagaatgatcagcagataaagctgcggcatccccgaccagatttcgatgaaacgctggaacgccagatcgaccagaccgccataatatccctgcacagcgcctgccgcaatgccgacaaaactggaaaccaccgtcagggcaaagccgaacagaaccgacagacgaaacccgtaaatcacgttcgccagcacatcccgcgcacgatcatcggtgccaagccagttacggcgatccggtggcgtcggcgcagaggtcttcagatccttgatggtggtatcatagcgaaacggaatcagcggccagatggcccagccttttgcatggatggcccgcatgacctccggatcggtataatcggcttcggtcggcagaaaatcggacccgaacgtgtcctcattcagattttgcaacaccggtacataccaatgcccgtcgaaacgcagcagcaaagggcgatcattggcaacgaactccgcaaacaggcagatcgtgaacaggacggcaaaaatccatgtcgaccagtaaccccgccggttggaacggaatgccatccagcggcgctgcgcctgcgtcactggcacgtcgccgtttttcatcaggaacggccctcgaaatcaatgcgaggatcgaccgccgtgtacatcagatcaccgacaatctgcatcagcaacccgatcagcgtgaagatatacagcgtcccgaacatcaccggataatcacggcgaatagccgcatcgaagccgagcagacccagcccgtccagcgagaacacgatctcgatcagcagagcggaggaaaacaggatgctcacaaaggccgccggaaaaccggagacaatcagcagcatcgcattccgaaaaacatgcccgtacaacacgcgattttcactggcgccctttgcgcgggcggtcaggacatactgtttcctgatttcctcgataaagcagttccgcgtcagcagggtcagactggcaaaaccgcccaccaccagcgcgatcgtcggcaaaaccatatgccagccataatcgagcacccgactgacaaaactccagttttccgccccttcactggtgagaccacgcagcggaaaccactgtacgaacgagccgcccgcaaacagcaccgccagcaacacggcaaacagaaaaccgggaattgcgtatccaatcagtacaaccatagaggttaccacgtcgaaacgggttccctcacgcgtggccttggcgatcccgagcgggatcgagaccagatagaccagcaatgtggaccataatccaagcgagatactgaccggcaggcgtgtcatcaccagatgcagcacgctctgcccacgaaaaaaactctgcccgaaatcgaattgcagatagcctttcagcatcagccagaagcgcgtcaaaggcggtttgtcgaaaccgaacatgcctttgatatcctgcaacagatgcggatcaagcccggcatcgccacgataacggccggcaaggcttgtcgattgtgcgacctccgcgccaccgccggtcaaccggcccatcgcaccacccccaccatggcctttcagttcggcaatcacctgttccaccggtccgccaggcgcgaactgcacgacagcgaagttgatcgcgataataccgaacagcgtcggcagaaccagcaacagacgccgcaagatatagccggtcatgcgtcgatcagccttttgcgggggacacagcccaccatgaatccagcgcaaatccactgcgcaccggtttgtcgacatgcgcgaagcggttccagtatgcaacgttcatggtcgccgccgtccagttcggcatgatataccaaccccacagcagcacccgatccaacgcacggcaggccgtaatctggctggcgcgatcaggcgcggtgatgactttggcaaccagcgcatccaccaccgggctggagacacccatcagattgttgctgcccttttccttcgcactggcactgctccagaaaccgatctgctcgttgcccgggctgtcggattccggaaactgcatcaacgccatgtcgaagttgaactcttcctgcaaatgctgcgcctgcgccgggtccacactacggatacgcgcgtcgatcccgagtttggcgagagactgcgtataaggcagcagtacccgctcgaaaggcggattatccagcaaaatctcgaaagacaattgctgcccgccggcatcgaccagcttgccctccctgaccgtccagccggcctctttcaacaaggtaaggcagtggcgcaggacatcgcgattattgccggagccatccgtcaccggaagcgtatatggctccgtgaacagacgcggcgggagctgagtccggaacggttccagcagagccagctcctccttcgacggcagtccggaggacgcgcattccgtgaaggtgtaataggatttcagccgctgataacggccataaaacagatttttgttcgcccactcgaaatcgaaggcacagacgatggcctcgcggacacgcgggtcactgaacttgctcaggcgcgtattcatcccgaacccgaccatgccgaatggcaggttccagggcagttgttcccgcttgatccgaccctccttcaccgccggaaaatcatagccggtggcccattggcgggcgatattttcgacccggatatccacctgtccggccttgaatgcttcaaacgcgatggtcggatcgcgaaaaaattccgtgcgcatgcgatcgaaattataaagtccccgccctgtcggcaggttggcggcccaccagtccttcacccgctccagcgtcagactgcggccgaaatccactttcccgacctgatacggtccggagccgagcggcggctccgtcaggggttgggtgaagtcgcgcttttcccaccaatgtttcggcaataccgaaagctgtccgatgatcagcggtaactcacggttctgatcggtgcggaaatgaaacaccacacggtggggaccctgtgcttccgctttctcgacatcggcatagtaggcacgctgttgcggacggccatgcttcatcagcgtctcgaacgtccaggccacgtcctccgccgtcagcttatgtccgtcatggaaacacgcctccggcctcagctcgaacgcgaccgagcggcgatccgccgcgatctcgatcacctgtgcgagatgggcatagccggtttcaggctcatccgccgtgctgaccagcaacgtatcccacaccgcaccgaccggaccggcaacgccgcgcagaatgaacgggttgagactgtcgaaactgcctatttccgcctgcacaatctcgccgcccttgggagcatcgggattggcataggggaagttcttgaaatccgccggcagttgcggcgctcccaccgtggtcacggcatgcgtgcgcaccacgcccggcggcaggtcacgcagaaactgcgcccccgcccgacgcatggtgccgggcatcaggaacagggccggagagatggctccggcagtcaggccagtggtcaggccggtggtcaataaactgcggcggcgcatggcatcggttccttatttcgtacgcatgccggaagaagattcggacagggctgcaacggcctgcggcagcagggccggatcgcccaccgccagcgtacggcccgagccgtgctcggagagaggttcaccggaccagcaggtcatgcgcccacccgccccctccaccaccggcagcagggcagcccagtcccagactttcagatccgcttcggccacgatgtcgatctgccccagcgccagcagcccatacgcataacaatcgccgccccagctcacccggcgggcatggcgggcgaaagattgccagcggggcaggtcattgccgaacatctccgggctggtggcggaaagctcggcatcttccagccgggcgcagggtctgatgccgacctgccccccgaaagaaccggtgaaacgtgtgggatgcacgacatcatccgaggtcagggcacgttcgccgatccagcgttctccggtgaccggctggtcaatcaggcccagcacgggttcgccgcgccacatcagcccgatcagcgtgccgaaagtcggtcgaccggtgataaaggcgcgggtgccgtcgataggatcgagcacccagcggaaatcggcctctggacgttccagcccgtattcctcgcccagaatgccgtgatcgggaaaagcatcggcaatcagccgccgcatcacctcctccgccttgcggtcggcgatggtgaccggggactggtcggatttcagcgccgcatccagccgggtacgaaacagcggcctgatcacggaggccgctttatcggcggcggcctcggcaacggcaatcagacggtcacgcagagaacggtcgaggggagaactcatcgggcactcacggttgcccggactgccgtatggaagccggcggcagaccggaaatgacgcgcagataggctatgatgtcagctctttcccgatcatccttcaccccggcaaacgacatacgggtaccgggagcaaaagcggacggccggaaaagccaggcattgagggagtccgtatcccattgtccgtgcatctctttcaaggcatgggaatagtgaaaaccgggaaccgacgcacgttcccgccctatcacgccgcgcaagggcggcgccacggtgcgggcatcgggcgatcctgtcaaagcgtgacaacggtgacaatgccgttcggcggccacctcgcccttcgccggatcagcgctggccatcagcaaggcgatcgagggcaccggaaccggggtttcatccccccacatggccggcaacaggcaccatccggcgagcgtaagcgctgccgcgccgaacgccactgcccagatcatgaccgatttcatacctgtcccacctcgtacaaacccgttcttccccccaacgggtcattcccagcgccccgcttctggcttaaaggcctgctttctgtctaacacggataatcgcatcgtcgcaggccatctggtcatgatcatggcgacgcgtcaggatcgaccgcatgacccctctcatcgtcattcccagccgcatgggatcgagccgcctgcccggcaaacctctcgccgatctcaacgggcgcccgatgatcctgcatgtgctggaccgggcgatggaggccgggatcgggccggtggctgtcgcctgcgcagaagaagaaatcgccgccgccgtgcgcgccgcagggggaaccgccatcctgaccgatccggacctgcccgccgggaccgaccgtgtgcatgcggcacttggcgtgctcgatccggagatgcgatataatgcggtggtcaatcttcagggcgatctgcccaccatcccgccggacatgatcagcacggtgctgaagcctctgcgcagcccgactttcgacatcgctacgctggtggcggaaatcaccactgaggaagagcggacctcccccgccgtggtcaaggccgtctgcgcttttcccgatccgtccggcaccgttgctccggcactgtatttctcccgtgcggcggtcccatcaggaccgggatcgctctggcatcatatcggcatttatgcctatcggcgtaccgcgctggaccggtttgtctccctgcctgaaagcccgctggaaaaacgcgagaagctggaacagctgcgtgcgttggaagcaggcatgcggattggctgcgcccgcgtcgagcacgcgcccttcggcgtcgatacgccggacgacctggaacgcgcccgcgcggtgctccgcacctggtcatcctccgtcacggagccttcggcatgaaccctttcccccctgcaccacctgccgcgtcctatcgcggtccgatcgcgtttcaagggcaacccggtgcctattccgacctcgcctgccgtgccgcctatccgcatctgaacaccttgccctgcccgactttcgaagccgtgatcgaggccgtccgcgacggacgggccgatctggccatgctgccttgcgagaacacattggccggccgggtgccggatattcactccctgttgcctgccagcgggctgttcatcgtcggcgagcatttccagcgcgtggagcatgccctgctggccccacatggcgcgacgctggaaacgctgaaacgggcccgatcccacgcagtggcactgggtcaggtccgtaacatcctgcgcgatctggggcttgaagccgtcgtggaagccgataccgcaggcgctgcaaagctggttgccgaactggggggtaccgaggatgccgccatcgcctcccccctcgccgccgaaatttacggcctgaatatcctgcgccggaatgtcgaggatgcagcccataatacgacccgcttttacgtcgtctcgaccgccgccgcgccgccagagccggaacgcagcgataccatgaccacctttgtctttcgcgtgcgcaacatcccggccgcgctctacaaggcgctgggagggttcgctaccaacggtatcaatctgatcaagctggaaagctatatgctggatggtgccttcaccgctacacagttcctgtgcgatgtgatcggtcatcccgaacagccgccgctccgccgggcgcttgaagaacttggttttttcagccgggaagtgaaaatcctcggcgtctatccctccgccccccagcgtgggatcaccgaaccagccgaataagccggaaactcagacagttcccagccaacgtagcagaggctgccacagcacagcctctgccgagcggcccgccgtcatgccgatatggcccgcctccatccggtgcagcaacgcaccagggataagctgtgccagcttcagggcgctggcgggcggcacaatccggtcccgggatggaacagccacaaaagccggacagtgcaaggcggcgggatcaaccacatgccctgccactttccatccgccttgtgccggcagattgtcgcaataccagccattcaccacctcctgagccaccggggccgcaagggagatcccgtcattgagccagtcctccagcgccacgaaatggtcggcacgcggatgatcctgcggcaggcgaccaaaagcacggtatttatccgcaaccgcaaacggctcaatcaacgcaaacataatctggagaatatccaccggcagacagccgtactgtttcagtattccccccagaacaggctgcaacgcagcactcagacgctgatgctccggcccggccgcatggaaatcccagggagtggccaacagtgcaagcgcccgcaccgcctccggacggcgcagagacgcagcgagagccaacaggccccccatacaatatccagccatgaccacagcctgatccgtcagatcggcaatagcctgcacagcgcgatccagacggcccgcaatatagtcggtcagaccgaaatgctgttcagtttcccccggcccgccccattccagcagaaagacgcgatacccggcctgagccagccgatccatcagggaataacccggtgccagatcgagtacatagccgcgattgatcaaactggggaccagcaaaacaggcggcaaatggccggaacccggcgcagggtgccgcagaaccgtgcttcccccctcccgccagatcacctgtctcggcggagcatggcgataataaggatgccggcgatacgccgctacacccgcgatcagagccgcatcacgctgaagagactcggtccagaccgcttgctccaacagtggagaaaattcagtttttcccgccgctctcccgtgatgaagcctttcgaccacgaggttttgcagcagcttttccgccatctccgccgcctgcggcgttttccaggcgggccagccgcttttccagctctgcaaccctgccaaggagaaaccggagcgcatcatcgcgagggtcagatgcaggccgagcggccgtgggccgctgcggtgcatggggcgcggctgctccggcctgtctgccggatcgggactgttgtgatccactttcttctccgcccgcctgtcccggctcctgctgatagccacgctcctgcgaggctttcagagcagcctgcatggtttccatcgactgtgctgccatggccgaccaattctgcgccagagcctgccatgcagacaaagagtccggatcactggcacgtgccgataattcgctctgccacagatcgacccagtcacgggcaaaatcagcggtggatgtcgaatcggacgtcgtcccggatccgcttccttccgtcgacggtcctgcccccgtgtcgtttcccgccatgaatcacccatttcttccaatgaggaaagatcgtgcttgccacaatgtgacagatgcgagaataccggccagcgatgcttcttgtttcgctcaggatttaaaaccggtcatcacggctcctcccggctgcgctataagcacagcatatacttctggccccgctgacgccctcccggtaacgtcgatgcaggccccgcagagcagagtatgtccatgcccaacccgcgtcccgcttcttcccgtgctgctggacgcccgtccaggtccgtcaaaaacgcctctatgcatcacgtggcgcaggcgaatggggaagcagcaccggaccaggatgattcccaggatgattcccatggggccccgccacccgtcattatcaagaaatacgccaaccgccgcctctataataccgagacatcctgttacatcacgcttgaaaatctggccgacatggtccgcacggggcgcgaattctccgtcttcgatgccaaaagcggcgaagacatcacaagaagcgttctgacccagattatcgtcgacgaagaaaacaaggggcgggccatgctgcctaccaccttcctccggcagttgatcgggttttatggggatagcctgcaatccattgtgccccgctaccttgaggaagccatgagcacctttgcccatcagcaacagcagatgcgcagtgcagtacaacacactatgggcagctttttcccgttcgcttccagcagtactctggaagaagtcagccgtcagaatatggccatgattgaaaaagccatgagtcttttcaatccattctataaaggaccggagactccggtctcagaaaaacaggatgagcgtttctctgccgatcaagagatcattcaactaaaagaagaaataaaagctctcaaagatcaactaaagaaagcacaaagcaattttaaataacgattataaggtgactacctttattgaatgacaaaattcacaagaacgtgattgtattaatggagaacacttatcaatttattgtctttgttacgctcgttttgatcgatctggttgcaagccatcccacctgaactcttctctgaacccctcccagatattgaagggtcaaatccggcagtgtccgacaggaattgaaacatgcagtcttctactaatcatatcgcacaggatgcagaacacctgccccagccgaacccggcatatcctgttgctgatgaaggaagcattcttgctgtaacctcgcgaaccgcttcaggcggtcgcgccgcagccagggccagtgatgcagacaggcatgtgggcaatcgcatcagggagcgcagggtcatgctcgggctgtcccagcagcagctggcccagatgattggcgtgacctatcagcaagcccataaatatgagcgcgggctgaaccgcatttcagcgggtcggctttatcagatatcgcatgtgctgaatgtgccgatttcctggttctttgatggctttgctactgaaagcaaaacagccgatctgacgacgcggcagcgcatgtgcctcgaacttgcacgcaactttgcagcgatcgacaacgagaagcatcaggaagccctcagccagatggcacgggcattggccgcacagtccgtggccaataaaatggcacaggatggttacgccacggctctggaagaatcacgcgaagaagttgcctgacggcgtcaatactctggcatcgccgagtggcgcgtcagaaactacccacccgctctgaccatcttccatcgcttctgatagccacatctttgcgtcacagaggcagatgaattttctcatctgatccggccctcaggcaggcaacaccctgaaggatgttattccgtccttgagcagacggataacatccggggccgcaagagcaaggcagcccgccgtaggctgataatcctgctgcgcgacatgcagaaaaatggcagagcctctgcctttttcaactggttgatcattccatcccaacacaccgataatatcgtagagatcatcctgacgccataattcttcatgactggctgaaaacggtcgggttatccggcaattatattgtggatgcgccggatcgtcacaccagccatcagacggggcgattggctccagcgggcaagcacaaaccggtattgtcagacgatcagccctgtaaaacacccgacggagaggaaggatgccgaccggcgtagctccgtccccttcctgcttgcaggtcgtaacgcctgctcgtcccagcgcaactcgaagaaccgtattccgatacatcagccgtccatccggacttatgattgcttccatatagtttgccgtattgttttccatttaaaccaatgcgccattcaaaaaaacaatggttactaaaattgtcagcacctttgaaagatgatatgctttttagttacaactgaaaatttcatttttgccctcctatatcaatgcatgaaaaattccttcacaacatttatgtgacccaaaaatatctatcacaatgtctatgattttagtttccatcattacgatgacattttgactttacctgccagccgtaacatatcactctctacaggcctgcctcgattggagacaacccgtatgccacacacacgccctatcctggtcgttgatgacgatacaatgctacgggaaaccctgtctgatcagctgtcggtcgacggggagttcgtcgctatcccggccatcaacggaaaagaggcagacgattttctcagcgataacatctctcgctttgatgccattattctggatgtcggcctgccggatggggacgggcgggatctgtgcgtgcgctggcggcgcatgggcgtcaaggtgccaattatcatcctgactggttccgacgaagaacatgatgtcgtacgcgggcttgaggcaggggcaaatgattatatcgccaagcctttccgcatggccgaattgctggcccgggtccgcaatcagctgcggagctacgaaaacagcgaggatgcagcgttcaaaatcggtccctacatcttcaagcccgccgcaaaactgctggaaaccgaacagaacaagcgcattcgactgaccgagaaagaagcctccattctgaaatttctctaccgtgccggaaccaaggccgtagcgcgggaggtgctgctgaacgaggtatggggctacaacgccgccgtcaccacgcatacgctggagacccatatctatcgcctgcggcagaaaatcgagcaggatccttccagcgcgcaactcctgaccactgaaggagggggataccggctgcttccctgaagcgcccctccctctgcccacacgagggaggattggcgtcccggataggcccgcggcagattatggtaagggccttacagcgacaaagtcacgctgacgggtacatgatcagaagtacgctcccaatctcgggcctctttcaaggttgtatggccttgcagtgaagaaaccagatcagggctgacccacacatggtccagcctccgcccccgatcagacgcacgccagtcccggttccggtatgaccaccacgtataatgcttgcggtccgacggcacgaaatggcgtattgcatcaacgaagccggtttccagccattgtctcatccgggtggtctccggcggcgtatggctgaccacattcagcagctgcttgtggctccagacatcatgctccagcggagcaatattgaggtcaccgaccagcacggtgcgggtaaaaggagactgcgccgcgaaataggccgtggcttcctccacgaaagccaacttatgcgcgaatttcgggttgatagccgggtcgggctcatccccgcctgccgggacatagaaattatgcagcgccacgggacctgacggcactgccagcgacaccgccatatgacggcagtcgcctttggcgcaccagtccggcgccgcctcatccaccgtgaaaggaatccgggaaagaatggcaaccccgttatatcctttcatcccgcgataggcgacatgggcataaccgtgatgctccgccgccctgccggggaacagatctgccgggaacaaggggtcaggcaccttggtttcctgaaggcacagcacatccggatcaagctcggccagcactttctccagcaagggcagacgcagacgcagggaattgatgttccaggtcgcaacacgcacacgcatgagtgccatttcctcagacgatgcgattgcgcagggggatcaggccagacaccgatgcattcaggacatccccgcgcgacagggcggaaaccccatccggtgtaccagtcatgatcagatcaccagctgcaagggtgaccagacgcgacagggccgagatgatttcactgactgaccagatcatgtcgctcagccgcccgcgctgacgctcggtgccattgaccgtcagcacgatatccccatccgactctccattgggcaacccgccccccaccaccggcgtgatcggtccgatgggggcggagtggtcgaaccccttcgccatatcccacggacgccccgcatcacgcgccgcgaactggagatcgcgccgcgtcagatccagcccgaccgcatagccgaacacatgggacagtgcagcctcgaccggaatatcgcgtccgccggaatgcagcgccacgaccagctcaacctcatgatgcagcaaggcggtcgcaggaggataaggaatatccgcatcccccggcaccaccgcatcagccggtttggagaagaaaaatggcggctcgcgcgccggatcactccccatttcacgcgcatgagcagcatagttcctgccgacacaaaatactcttcggacgggaaaaccccttccatccgtcacgggcacaatcacgggagtcgggggaggaaaaacgctctgcattcatcctgcttatcaaaacccgccagaaacaccagcgctgttcccggcacactccccgcatgcaggccccatgcagacggattttattcagccgcgctggctagtccatccgaacggccggctgccttgccggtgatcccccgatggcgagcctccaccgccgcaccaaaatcctcgaaaatacgatgcgacaatggatcggtcagataatcgaattcaggatgccactgcacgcccaccacaaacccagtgcaatccactgcccggacagcctcgatcacaccatcaggcgcatgcgcatcggcacgcagaggcggagccagccggtcgatgccctgattatgcagagagttcacagcaaaagaggccgagtcagacaaacggtgcagccagccatcggtcacggcggtgaccatatgcgccttgccattgcgcagggaggattgcggcacgatcggagtggaatgatccagataacccggcatatcctgcaaaacctgatgcaggctgccgcccagagcaacattcagttcctgaaagccgcggcagatagccagaatcggcacgccgcaggccacagcggcccggatcaatggcaatgtcaccgcatcacgccgcacatcttccggcgttccctccgcatgcggcgcaccgccatattgaccgggatgcacgttggatcggctaccggtaaaaataatgccatccagccggctcagcagggcggagagatcggcgcggtctccattcgccgggatcagcaccggcacagcccggatcacatcatcggtcacctgtacatatgtatccgacgcagcatggttgggtgtcgaaaaagccccgaacggcttcgtgcaacaggaaatgccaataagcggtttcatgatcccttcacatttaggcgatcattgcggcaaaatgaaggaatacatgccatgccgggtcagcctggaacaccggtgctggtcgaatattcaaaatgtagtgcctgatcgggatgcacgatcggatggatggcatgcgccgccatcgcggcttcgctgaatccctgtaaaatcagtttcagcttgcccggataggtggccacatctccgatagcgaaaatacccggcacattggtctcgcaacgcgacggatcgatcgtgatatgatgacgttccagcgccagcccccactccgcaatgggccccagatccatcgacagaccgaagaaaggcagcaggcaatcagcctccagacggcgtatctcgccatccagcgtcgcaacttcaacgacggacaacaccccctctgcaccctgaagaccatgcagttgataagggaccaccagctctacctcccccgctgccgcagcttgctccagttgcgcaagcgattccggggcggcacggaatttggcgcgccggtgcaccacgaaaatccgggctgcaatcccacgtaaggccagtgcccagtccaccgcgctgtcaccgccacccgcaatcacgacggagcgcccccgaaaatcctcccggcgacgcacataatactgaacggcaccggaagcctcgaacgcttccagcccatccagcggcggacggttcggtccgaatgcacccgcgccggccgcgagcaccacggcacgtgcgcacaccgtatcgccggcactggtcgtcagcgtgaaatcgccctgtgttccggtcagtgtctccacccggcgggacagcaggcggggcatgtcgaaaggggcaatctgccgttccagcgccgtgatcagatcgccaccggaaatcgccggatgggcgggaatgtcatagatcggcttttctggatacagggccgcgcactggccaccgacctcctgcaacgcgtcgatcagcacggcgcgtaaccgcagcatccccagttcgaaagcagcaaataatccggctggccccgcgccgataatagcgacatcggtgtcgattatccggggctgggtcgaagaagcagggggggccaggtcgatctgtgtcatgggcgggaccataagacggccacgaaaatgcgacaattgcctattccgactcccgatgcccacattcccaaaaagcgccgcgccggttacatgcgaggttgatccgggcctgttgcattgctccggatgaggcatagtaagacgcatgtccctgaccacctcttcttcatccatgctggtgctgaccgatcaggaagcgacggaggctctgggccgccagatcgccgatacgctgcatcccggtgatgtcatcctgctggaaggctctctcggcgccggaaaaagcacgctggtccgtgccttgctgcgccatatggcgggcgatccggccatggaagtgccaagccccacctatacgctggtgcaaggctacgatacgccacgtggagccgtggcccatctggatctatggcgtctggacgggcctgatgcgctgcatgaactgggatgggacgccttgctgaaagacattgtcatcgtcgaatggcctgaccggttggaagatttgcgtccgccgcaggcgctgaccatccggctggaaaccgtgcccgacaacgatggcgcgcgccatgcccatctgtccggttggcctgcggatcgcctgtcccgatgagtaccccatccgccgatacagcgatgcgcgaggataccatcacccgttttctggccgagcatggctgtgcggattttcagcgaacgccactggccggggatgcaagcttccgccgctactggcggctgcgtgacgaaacaggcgctacgctggtgctgatggatgcgccacctccccacgaagccgtggagccatttctgcgcattgcctctgccatggaaggtacgggtctgtccgttcctcatatcgaggccgccaatgtcgaggccgggctggtcctgctggaagatctgggcgatgcgctctatcgtactcttctggatgacagcaacgcggatgcgttcggggaagccgccgccagcgcgctgaccgtgctgcaccgtatgcccatgccaccggatccgctgcgctgggatggcgcggccatgcgggatgcaaccagcgacacgtttctgggctggtggtggcccgccacgttcggagaaacgccttccgcccgcgtcatcgccgcgctgcatgcggctctggatgaaacgctgtctattttggccgcctctcctcccgttccggtgcatcgtgatttcgagggtggcaacctgctctggctgccacaacgagatggcttccgccgcaccggcatcatcgattttcaggatctcggggccgggcatggcgcctatgatctggtctccctgacccaggatgcacgccgggagatgccggatggtttcgcggaacagcagatcgcacgctatgccacagcactcggcctgagcctcggcccaaccggtccggactctctgcccgcagcctgtgcggtctgcgcggcgcaacgccatatgcggcatgccgggctatgggtgcggctggcacaacgggatggcaagactggttacctgacgcatggaccacgctcctggcgtcggctgctgcatgcgctgacacatccggccaatcaggcgctgatggatttcttcaacgatcacgtgccggcctcccggcgcggtaacccggcgcttttgttgccggaacagacaggctctgccagggattaaagaccagaattatgacgatacgacacgcaatgctgctggcggctggccttggcacccgcatgcgccccctgacagacaccaccgccaagccgctggtgccgctggccggacggaccttgctggaccacgcgctcgatcgcctgttcgaggccggggtggagcatgtggtggtcaacacccactggaaaggcgatctggtcgcagcccatatcgctgcccgtcacgatccgcgcatcgtggtccgggccgaggaaaccctgctcgacacggggggagccatcgtcgccgcactgaaagacgggctgctggatcaggccgagccgttctacgtcgtcaatggcgatgcgttctggctcaacggccccatcccgatgctcgaccggctggctgaagcctggacgcaatggggtagcgctgacgcgatggacgcgctgctgctggtacatcggacattccagatttccgccgaagtgggcgcgggcgatttcgtactggacccgctgggccatgtccgccgccgtaaggaaatggaaatcgtcccctatctgttcgcaggggtgcagatcgcatccgcccgcctgttcgccgatgcgccggagggaccattcagcaccaacctgctgtgggaccgcgccatcgaggcggaaaggctgcgggccatggtgcatgacgggctgtggttccacctgtccactccggaagatctggaggtcgcagaacagaaactctacgcggcggaaaccggcgaaacgcgttaggcagcaccatgcgcatcacctccatcccgccggactggccgtttctcgacactgtcgcgtctgcctggctggggaagggtgagcaaagcccgcttgatacggctgatggcatcatcctgctgccgacacggcgcgctgcgcgggcgctggccgatgcgtttctgcgtatctccaatggccgcccgttgctgttgccacgtatcacggccctcggcgcgctggacgaaacaccgctggccctgcatggcgcactggatctgccgcccgccgtggacacgccccgtcgtctggcggagctgacacggctgattctggcattaccagacccggccctgtcggcggataatgcatggatgctggccagagaactggccaaactcctggacgaagccgcccgcgccgggattgatcttgcaacgtccctgcccgatgcggtcgatccatctttcgcagcgcactggcagacgactctgacctttcttcagatcgtgacccgtgcctggccggactggctggcggaggaaggtctgaccgatccggcagcgcggcaggccgccctgctgcggattcaggcgacgcactggcaggatcatccgcctgcgacacgtctctgggcggcggggatttccggcgcggccccggccgaagcgatgctgctgaaaaccatcgccagactgaagcagggcctggtgatcctgcccggcctcgacatgaccatgccggaggaagcatggggcatgctggaggcctctcatccacaggcggggatgcgcgacctgctggccatgatggatgcaaggcgggatgatgtagcaccatggggattgacgcccccgccttcccgccctgctgatcgctcccgtctgctgcatcaggcgctgcttcctgccgaagccctgacgctctggcgcgaaaccacgccgccttcctccgaatccgtgttccgtctggaagcggaagatgaacagcaggaggccgtcgccatcgcgctgatcctgcgggatgcgctggagacaccgggacggagggccgcgctgatcacgccggatcgcgggctggcggtgagagtgtcaaccgagttggcccggttcggcgtcatcgccgatgacagcgccggcgaaccgcttgccgaaacaccccctgccctctttctgcgcctgctggcggaaacggtgcggagcggtttctctccggtctcgttgctatccctgctgaaacatcccatgacagcgctgggcatggaccgtctgatgacgctgcatgcggcgcgcgggctggaacagcacgccctgcgcggcccgcgtcctccgccgggcctgtccgggctgcgtgcggtcctcgaagccggaaaaacggaagccgccgctctgatcgaccggctggaacaggttctgcatcccctgatcgacctcgtagcacaggaaaagcttgcgccccatgactacctgcgcgccttgctgaccgccggggaagccgtggccgccagcgatactcactccggcgccgagcgtctgtgggcgttggaggaaggggaggcgctggccgtcctgctggcggagacgctgcccgccctgacggtgctgccgccgcaaccgcccgatacgctgccgggcctgttcgacgcggtactggaaggcattgccgtccgcagccgccgtgccctgcgccgcttcggcgagaacgatgccgaacatccgcgcctgtttatctggggcctgctggaggcacagcttcaacatgtggatgtggctgtgctgggtggtctgagcgagggggtatggccccccgccacggatcccggcccatggatgagccgcccgatgcgcagccgtgtcgggctgccgagcgccgagcgaatcatcggtcaggcggcccatgatttcgtgcaggcagtatgcagcgcctccgtggcgatcctgtcctgccccgcccggcgggaaggtgcgcctgtcgtcacagcacgctggctggcacggatcgacgctctgctgaagggacatgggaaacatctgccgacccaccccgccaccgcctgggccggaatactggatcaaccggaacggcctgccccggtcaggccgcctcgcccctgcccaccccgcaggtcacgtcctcgcagcctgagtgtgacggaaataggacgctggctgagcgatccttatcgagtctatgcggagcgtatcctgaaattgaaaccgcttgatccgctggaacaggatactgatgccgccgatttcggcatgatcgtgcatgatggcatgcagtgttttctggaaaatgccgcccggcaatggcccgatggggacctgccggccgccctgcgcacggcattccgggtcgcgctggaccgccacaatcctcgccctgccctgcgaagctggtggctgccgcgtctcgaccggatcgcagcctgggtggcaacccgggagcagcgggatacgaaaatccataccgaaacctccggcatctggcatttatcggctttcccgggcggccccttcacgctgaaaggccgggccgaccggatcgagatcaggcaggacggcagtatccgtctgctcgattacaaaaccggcacggttccctctgcaccggcgattctgagcggagaggctccgcaactgccgctggaagccgcgatgatgaaggcgggggccttcccggatgtaccggcacaatatccgtccgaactggtgtactggcggctcagtggcggccgtgtcgccggcgaggaaatcattctcggcaggaaagcccccgccgcatgggccgaagaacaggcgcaactggcggccgagaagctgcgcgatctggtcatgcgctatgacgatccggattttccctatctggcacaaccttttgcccccggccatgcgcccatggatgcttatgcgcatctggcccgcgtgccggaatgggcggatggtgacgagtcatgagcgccgcgttttctccccgcgatgaagcggaacgcaatcagcgcgatgcctccgaccccatcgtttccgcttttgtcagtgcctctgccgggtcgggcaagaccaagctgctgacagaccggctgctgcgcctgatgctctccggcgcccatccggggcggattcaatgcctcaccttcaccaaggccggtgcggcggaaatggcgatccgtctgcggtcaagactgggcgcatgggtgacgatgagcgatgcggcgctcgatcaggcgctggcggcgctggccttcacgccggacgatgcagccaggctgagggcgcgcgctctgtttgcgcaggtgctggatctgcccggcggcatgcggatcgagacgatccatgctttctgccagtctctgctgcggcgctttccgctggaagccgcactgagtccccacttcaaaatgatcgaaccggctgagcaggaagtcacccgccaggaagcgcaggagacgatgctggcagcgacggcggatcatgcctccctgtccctgctctccggccagatcagccttcagacattcggcatgctctccgctggattgcatatcgaaccggaccgcctgaaccggctgaccccatctctggctgggctggaagccgcccaacgccgggcgctgggcgtgccgggcagtcagggggaagaagcgttgctggccaccgccgtcgagtggaccgccatcggcaaagtccgtgaggcagcgcgggatgcgttcgagaacggatcaaacaccgtgcgcgaaagagcaggacagatgctcgcctggctgtccctgtcgcctgccgaacgtcaaacacgctgggaggaatgggccagcctgttcctgaccgccaaaggggagccatgcagcccgaaaaccctgttcaacgaaaacaaggccaatcgcggcaccagcgccgatacctcccgggagactctggttgatgagtcgcatcggatcgtctcaatccgtcagaccctgcatgcgatcaggcttgcctccctctccgctgccctgacccggctggcgatcccggtggccgaggcctacgcaaaggacaaggcacggcgcgggctggttgatttctccgatctgatcgggcgcaccagcgcattgctgagagaacccggcgctgcctgggtgctgtacaagctggatggcggcatcgaccatctgctgctggatgaagtgcaggataccgctccggaacagtgggagattgccggaaccctgacggcggagtttttcgccggtctcgatgatcgcgccgaacagggcaaaccccggactgtctttgcggtgggcgatccgaaacagtcgatctactcgtttcagggggccgacccgcaggctttccggcactggcgcggcatcatggcgcaccgtgtgcagcagatcggctatgaatggcgcgaccgtcccctgacggtctcgttccgctccaccgccccggtgctggccttgaccgatgcggtattcgccgatccgctggcccgtcagggtgtgatcgaaccagaagaaaccctgcgccacctgcctgaccgcgccgaggatgcgggcacagtggaaatctgggagccagtgcagaccccggaaaccccaacccgccccgcatggcagcctgccgaggagtacggcacccacaccaccgccgccagcctgctggcgggccggctcgcggactggatcgccagccggatcggccagacactgccgagtgaaaaccgtccgatccatgcgggagattatctgatcctgctgcgccggcgcaaacctttcgcccctctgctggaacgggcactgaagctgcggggcgtgccggtggcggggctggaccggctgcccctgaccagccagcctgccgtggccgatctgctggccctgtgcgacacgctgctgctgcctgatgacgatatggcgctggcctgtctgctcaccagcccgctgggcggcctgagcgacgactccctgatggaactggcgctgggccgtcgggacacattgtggggtacgctgagaaaacgccggaaagaacgcacggcgtgggatcaggccgccagttttctcgaagatatgctcgggcaggtggattacaccacgccccatgccctgctcagcgccgcactggtgcggcatcgcgggcgggcacgcctgttcgcgcgtctgggcgcggaagcctccgagccgatcgacgagctgctgaatgccgcgatgcgctatgcgcagcttcatccaccctcattacagggtttcgtccactggctgcgccgctccgcgccggaggtcaaacgcgaaatgtcatcaggcggccaggccgtccgtatcatgacggtgcatggctcgaagggtctggaagcccctatcgtcatcctgcccgatactgtctccaccccccgtacggagaacagcattctctggacggaggatcctgaaaccggcctgtcggtaccgctgtggaaacccaatcaggattttcagtgcgacagcttcgccgtactggaggcaaaggaacaggctgcccgacaggaggaatacaatcgacttctctatgtcgcgctgacccgtgccagagaccggctgctggtgtgcggctggctggggaaggaaaacaagccgcccccggatgaaagctggtacgccgccatccggcgcgggatggaacgactgccaaacgccgaaaccgtcgggacagatcatggcgaggtaatccgcctgacctccccgcaacagcgtgccgcacagcaggcacgcaccgacatctctacccccgttcaagccccacccgcatggatggggcaggctccggactggcagcctgccccccgtcctgcggagcctgtgcgccccgagccgctcgcaccaagccgccccgacaatgccgatctgggccccgtgcctgccgccgactcaccgctgatcgccgaccgacgcgcacggttccggcgcggacaggtgattcatcaactgctgcaacatctgcccctgttgcctgccaaggaacgtgaggccgccatgaagcggttcctcttacagacgctgccttcggaagccgatcatgtggcaaagcagatcagcgctattctggatcatccccgccttgccgcattgttcggcgctgacgggcggggtgaagtcccactgaccggagtcatcggcccggatgacaaaccacaggtcatcggcggcatcgtggaccgtctggcggtgttgccggagcgtatcctgatcgcggattacaagacgaaccggcacccccctgcgagcatctcggagacaccggtgctgtatctgcggcagatggcagcctaccgtgcggtactgtcctcaatctatccggaccgggatgttctatgcgcattgatatggacggaaaccggtcggatcgacacactgccatcagagttactggacccgcatgcacccggcgtcgctatgcctgcgtttgatcaaaaggcttgatcaaaccgggtgcctgccccacttgcctgttcaactgcccatcaacaaacaggatcccgtctgataaggctgccacgggatcaatgatcgaaaagagactgcccatgagcgagcatacgaaacccgtcacggatgccaccttcgaaaccgatgtgctgggtgcatccgggccggtgctggtggatttctgggccgagtggtgcggcccgtgccgtatgatcgctccggcattggaagaagtcgccgcagagaataccggcaggttgacagtcgccaaggtgaatatcgacgaaaaccccgacagccccaatcgctatggcgtcaccggcattccgaccctgattctgttcaaggacggtcagccgatcgctaaacaagtcggcgccctgccgaaaagcgcactgaaacagtgggtcagcgggaatatctgatccgtatgacagggccgggcgttcagcccggcccggttcttatcaacctgtggaaatcaggccagcccctgatccagcttcaggatttcacccgccagatacagactgccgcaaatcaggatgcggcccggtatactccctgcctccgcctgcttcaggatcgccgccatggcctgccgcacggtcggaccaggaatcgccttgccgcccgaagcgctgacaattgcctccaccggcagcgccagatactgacccggctcggcaatggcccagacggtgtcggcctccggcaggaccgaggccagaaactgcccggcatcttttgcctgtttcatgccgacaatcacatgggccggacgatctttccagccgcgcagatgacccgccagcatcacgccagcccccggattatggccgccatccagccatagctcccagccatccggtaaatcctttgccaacagaccggtcagacgctgcatccgcgcaggccattccgcccgcgccaacccttccgcccgccatgacaacgggagagcggtttttgccgctgcacgcatcgccgcaacggcaatcccggcattgtctaactggtgctcacccggcagcgcagggagcggcagatcaaccacgccatccggatcgctatagcgcaagccgtccccacgcctggcgatatgccagtcacgatcacgggccagcagagaaacaccctgtttcgcagcctcccgatccagcacttccagcacgtccggcagttgcaggccggtcacgcctggcgcaccggatttaagaatgccggctttctccgctgcaatgcccctgatgtcgtcgcccagatattcacgatggtcgatcgaaatcgaggcaatcgcactgaccaccggcgtcacgacattggtggcatcgaagcggccgccaagcccgacctccaccacacacagatccgctggaacgcggctgaacaacagcagagcgaccgccgtgatgacctcgaaaacggtgattggagcgccggcattgacgcgctccacctcctccagagcctcgaccagaaccggctcggacaccagctctccggccagacggatacgctcgttgaactggacgagatggggagaaatataaacgtgcacacgctgccccgccgcctcggccagcgcacggagaaaagcgcaggtgctgcctttgccattggtcccggctacatgcacgaccggcggcagcgaccgctccggatggcccagcttctccagcagggcttcgagccgacccagcgacaggtcgatcatcttcggatgcaaaccgtgcagccgctcgatcaccgcttcggtgcgacctttactcatgccttcggcctcaatggaatggattgctggcgacggatggcctgatcaggcatccgccgtgcgggcaggctgcttcgcctctgtgagagaggctacgctttccaccttcggcagggtcaccccctccgtcagcaaggcgatcacgcgggacagggtcgcgcgcatatccgcccgacgcaccaccatatcgacgatcccgtgttccagcaggaattcagcacgctggaagccttccggcagtttttcgcgggtcgtatcctcaatgacgcgcgcacctgcaaagccgatcagggctttcggctcggcaatctgaatgtcaccgagcatggcaaaactggcggtcacgccgccagtggtggggtcggtcagtacgacaatgaacggcagcccggcttccttcaccatgcgcgtggcgatggtggtgcggggcatctgcatcaggctgattgccgcttcctgcatgcgggcaccgcctgaagcggtgaaaataatgaacggcgctttctgcaacaccgccagctgagcggctgccacaatgccctcgccgaccgccgcccccatggagccacccatgaactcgaacgccatggccgcgacaactgctttctgaccctcgatcgtgccatgggccacgacgatggcgtcatcgagatgcgtcttttcccgcgcatcacgcagacgatcggtgtagcgtttggaatcgcggaaacgcagcggatcctgtggcgctttcggcagctcgatccgtgtatagccctcatccagcgtccatttcagacgctccagcgcggtaccgcgcatgtgatggtcacaatgggtgcagacgcgctgattcttttccagatctctggcaaagatcatctgctgacaggcagggcactgtacccagagattgtccggcacatccctgcgccccagcagggtgcggattttcggacgcacatattcggtcaaccagctcatatcaggctcctcgggcggagaggcgggcgctgcgcacagcctcggccagttggcggacctgatccagcaccgcaggcacggtgcgatcagtggcgcggccatcatccagcgtttcagccagcgtatcgatcagcgcagaagcaacgatggcggcatctccctgccgcaccgcctccgcggcctgcgccggattgcggataccaaaaccgatcgcaaccggcaggtcggtcacgcgccgcaaacgcggcatattctgcgccagctgctccgcactcgcggtgacggtgccggtgatgccggtgatactgacgtaatagacgaaaccggatgagccgttcagcacatgcggcagacgtgcgtcatccgtggtcggcgcgaccagcctgatcacatccagcccgttcgcggtggcgaaaggcaggatcaggtccgcctcctcggtcggcagatcgacgataatcaacccatccaccccgaccgcggcggcatcgacgcagaaccgctcatggccgtaggtttcaatcgggttaagataccccatcagaatgatcggcgtatccttatcctgctgccggaaggtctcgaccatcgccagagttttggcgagtgtggcacccgcctccagcgcacgccgtccggcgcgctggatggtcggaccatccgccatcgggtcggtgaacggcacaccgatctcgatcagatcggcgcctgctgccggcaggccatgcaacaatgtctggctggtttcagcatcagggtcacccgcctcgataaacgggatcagcgcaccgcgtccctcacgcttcagcgccgcgaaacgcgtctggatacggctcacagcttgacccccagatgctcggcaacggtgaagatatccttatccccccggcccgacagattgaccacaatggttttgtccttccccagcgtcggggcaagcttgcggacatacgccaaagcatggctcggttccagcgcgggaataatgccttccgtgcgggtcagaagctggaacgcacccagcgcctcctgatcggtggccgagacatattcgacccggccggtttcatgcagccatgcatgctccggcccgatgcctggataatcgaggcctgcggaaatcgaatggccttccagaatttgcccttccgcatcctgcaacagataggttcggttcccgtgcagcacgccggggcgaccacccgtcaggctggcggcatgttcaccggtttcaacgccgtgtcctccggcctcgaccccgatcagccgcacggatggatcgtccaggaacggatgaaacaggcccatcgcgttggagccgccgccgatacaggccgtcgccacatccggcaaacgtccggtctccgccagcatctgggcgcgggtttcctcaccgatgatgttctggaaatcgcgcaccatcgccggatacggatgcggcccggcgaccgtgccaatcaggtaatacgtatccgacacattggcgacccagtcgcgcaaagcctcgttcatcgcatccttgagcgtcgccgcaccggaggttaccgccttgacctccgcccccagcagacgcatgcggaacacgttgggcttctgccgttcaacatcgaccgcgcccatatagatggtgcaaggcagaccgaacagcgcacagaccgtcgccgtcgccacgccatgctggcccgcccccgtctcggcgatgatacgggtcttgcccatacgacgggcgatcaggatctggccaagacagttattcaccttatggctgccggtatggttcagctcctcccgcttcagccatacctgcgcaccgcccagctcctccgtcaggcgcttggcgaaccagagcgggctgggacggcccacgtaatttttcagcagcaggtcgagttccgcgttgaacgccgcatcattccgcgccgcccgccatgccttttccacctccaggatcagaggcatcagcgtttccgccacaaagcggccgccaaacggaccaaaccgcccatgatcgtccggaccggagcgataggagttcggaagggaactggctatggacacgatggctatactcgccggctgggatgcatttcagagccgcgccatattgtcatacagcgcggagtaatctgccgctcttaaagcagaacggcgctcacgcaaatcaggagatcgcccctgaagacgctttatggccgttttatgacccatttcaacgcttcggctcaacccggcgataagtgggatactgcggctcccacatcaggtcatccactcgggcacgcagggtttcttcatcacatggctcggcctgaccatcccgcatggcgcacagtccgaccgcgacggccacatgccgggacacgtcgcgcattttggccagatgcggcaataagggcagagcaggatcggtgcgggccggagacatctccgccaatgcccgggctgccgcaaggaacatggcatccgtcacatgctcggcgcgagaggcaatagcgcccagcccgacgccggggaaaatataggaattattggtctggtcgaccatgatggtgcgaccattgatctgcaccgggtcgaacgggctgcccgtgccgataatcgcctgcccatcggtccaggccagcagatcggctggtgtcgcctccgcattggctgtcggattggagagggggaaaatcaccgggcgggcaacatgctgcgccatttcgcggatagcggcctcggtaaacaggccgggttgaccggacacaccgatcaaggtggtcggatgcgcgttgcgaattaccgcttccagccccggtttttcccgatcatcccaatggctcagcacatcggcgggaacggcgaattcctgctggaaggcagccagatcattatcgccttcccgcagcaaaccatcgcgatccaccagaaagaagcggcgatgggcttcgtgctccggcaccccttcctcgatcatcgcctgacgcagcatccgtgcaataccgacacctgctgaaccggccccgaccacgacgatgcgctggtctttcatcggcacaccggcgacggaggccgccgccatcagggtaccgaccgtcacggaggccgtgccctgaatgtcgtcgttgaaggtgcagagctggtcacgatatttcgtcagcagccgccccgcattgggacgggcgaaatcctcccattgcagcagaacatgcggccagcggcgctgcaccgcgcctacgaaagtatcaatgaacgaatcatacgcctcgccccggatacgctcatgccgccagccgatatacagcggatcgtcatgacgttccttgttatccgtaccggtatccagcaggatcggaagcgtcgcccagggcggaatccccccgcaggccgtgtagagcgccagcttcccgatcgggatacccatgccgcctgcaccctgatcgccaagcccgagaatacgctcgccatcactgaccacgatcacctgtacatgatcgaaacgcggatgggacaaaatctcgtcgatctgctcctgatgcggcggtgacagaaacaatccgcgcggcttgcggaacaggcgggagaaattctgacagcccagcccgacggtcggcgtatagacgaccggcatcatctcttcgaggttacgggacaacagcgcgtaaaacagcgtttcgttggtatcctgcaaatcccgcagaaaaatatagcggttgatcggggatttaagctccctgaaggctgtcagacggcggttgacctgttcatccagattaccgacatgcggcggcaacaggccatgcagatggaaggcggtccgttcatcctcggaaaacgccattcccttgttcagcaacggatcggaaagaagctcatatccggtgcgggaaacctccaccacatgctcgccagcggcattgggaagttccgttcctggtgtcgtacccatctgatccgtccgttcaatggccgacccctgcgcgggttatcggctcaggcgttacgcactgcagagaggaaggagcggatcagcgccggatccttgcgtccacgtgactgttcgacccctgacgaaacgtcgacaataggcgcacctgtccggcgcaccgcatcagcgaccgtatccggggtcaacccacccgcgaggatccacgcaaaggatggcgcaaaatccgcaaggatcgaccaatcgaaagcctgtccgtttccacccggcagagcagcgtcgggcctcggcttagcatccagcagcagggcatccacacccccggaatcgcgtggcagatcatccgctgccgcaattcccacagaccgccagacgggtaaggcaagccgttcgcgcaactggagggcacgcgccacagggacatcatgaagctggatgatatcgagcggcagctcacgcaggaccgcctcgatctctccatcacgcggattgacgaacagccctactttccgcagaggctgggcaatgggagccgcgagggaagccgcctcctgcgccgtcacagcccgtggagagggcggaaagaatacgaatccaagataatcagcgccccccgcgatggaagccgcgaccgatgctgcgctgttcaatccgcagattttaacctgagcgaccatgatgcttcaaagccccgcaatatccgccgcaatggaagaggcaaccgccgccggatcagccgcctgcgtaatgggacgaccgaccacgatataatccgccccggcctgaatggcggcacgcggggtcatggtgcgggactgatcgctcgcttcgcttcccaccggacggatgccgggtacgaccagtaaaggctccggccccagttccgccctgagcagggctgcttcatgcgcgctgcacaccagcccgtccgcccccgccgctacagccagctttgccagtctgagaacctgccgcgccggatcttccgcaaaaccgatcgcggcaacggcctccgcatccagacttgtcagaatggtaacagccaaaatcctggtccggtccgccgcatctcctgtcgcattccgcgccgcagcaaccattgccgagcctccacccgcatgaacggtcagcaaagcgggcttcagcggcaagaccgaacgcaccccggccgcgaccgtgttgggaatatcgtgcagcttcagatccagaaaaatcggtccctcaaaccccgtcatgccctgtggaccattggccaggtaatattccaaccccagcttgctcatcccgctatacggcgcgaaagcctgattccatgcgcgtgcggtggcggggtccggtgtatcgagggaaacaatgacacgccgcgagggaagagaaccggcgggcgcgatacgatcagacgacatgacgtgactgtctttatgaaataaaatgggccgaccgtatcacaggacaggccaggttactgaatggcaggcaaaggagcactggctgtgacaggagtggagagaacggcctcctgacggcgcagggtctcgcgcagggtttcaagctgttcttccagcgccttgacctgggcttccgcccgacgggcacggcggcgctgtcccagtgcagagaaccaggtcagcaagccaccggcaataaaagcgatcgccatcgcactgagcacggcaatggaaaacggcagatcagccccgtaatcggtcggccataagccgatatgaaccgtggtggtgttcgagagcgtgaacagcaccagcaggatcagaaacggcaaggcgatcaacagacgcatcagttttttcccgtcacgcggtgactctcgcgaaagtcagaagcaggatgctctcagcctccggaagcggcgtcggcagacccgccattcttgcgggtaccgttattcacccgctcccgcagttcttttccggccttgaagaaagggacaaccttttcatcgacggaaacggtttctccggtgcgcgggttgcgccccacccgggcatcccgtcgcttgatcgtaaaagcgccgaaaccacgcagctccaccctggcaccacgggcaagagcattggaaatctcatcaaaaatcgtggagacgatggtttccacatcgcgttccgtcagatgcggattatcggccttcagactcgcgatcagttccgatttggtcatgtcagctttcccctgcccggttggagataccgaatcccgccagcaggtccggaccgatcaccgcattaaagccgaggctgccagagcgcccaagctccgtcaatgctaacaccttgagataacttgctttctacaaaattttccagactgcccagccatccgccgaaccagtgcttacgcagaccatccgactcatgaagcggcctgaccggcaggtcctccggaacatggcgttctttcgccagccagacccgcgcgtcatgctcaccaccgatctgatcgaccagcccgagcgccagcgcctgccgcccggtataagggcgcccatctgccaaggcacgcacatgttccggcgtcatatgccgcccctgagcaaccatggtcacgaactggtcgtacatatcgttgacgatcccctgaagcatctgcctcccttccggggaaagcggcgcggtcaggctcggctgatctttcatcgggccggagacaatggtgttggacccgacccccagttttccaagcaggccggacagttcggctgattgcatcagcacaccgatggagcccgtcaacgtcgcctgacgcgcgaaaatccgtgccgatggcgccgcgatcatataaccggcggaggccgcaacactctccatagtcgtcaccagcggcttgcgcgctgccagctgtgccagcgcatcatgcagggcctcaccccccgcgacggtgccaccgggactgttgatctccagcaacaccgccttgaccgaagaatcatctgccgcatggctgatcgcctccagcaaggggcggtcataggtgatgataccgctgatcctgatccgggtgagatgcggccccgataccaccgcatgcgataccctcaccagcgccagcgcccccagcaccagcaggccaatcgtcacgagccgccatagcagcaaacgccgcttcagatgatggcggtctatcagccagtcctgatcgggggcagcagacgggcgggaagcaaggtcagatgtcataaccgccaaaatggcgaaatcatcgcgccggcaaaaggggagtacagccgttttcagaacaaaaaagccggaggcgtaacccccggctttcaagttgcgtcctgacccgttaaggtcaggacgatgtatccatgatagccgaagccaatcaggcgtcggtttgcaggttccggcgacggatcgcggcacccaggatatcgcccagggacgcaccgctgtcggaggagccgaactcggcgatcgccgccttgtcttcctcgacttccttgcccttgatggtgagctggagcttgcgggcggcgcggtcaaccgcggtcaccttcgcatccaccttctcaccgaccgcgaagcggtcagggcgctggtcggccttgtcacgggacagttccgcacggcggatgaagccggacagaacgtcgcccaccttcacttcgatgccgttggcctgcacagccgtcaccacgcaggtaacgacatcaccgcgatggaccgcatccagctgaccggcggcgggatcttcatgcatctgcttgatgccgagggagatacgctctttctccacatccacatccagcacgcgggcgcgcacgacctgacccttctcgtaggcggccatagcggtttcgctctgatcgtcccaggagatgtcggacatgtgaaccatgccgtcgatatcggcggtgatgccgatgaacagaccgaattcggtgatgttccggatctcgccttccagctcggacccgaccgggtgctgttccaggaactgctcccacgggttgccctgcacctgcttcaggcccagggagatgcggcgcttggagctgtccacatccagcacgaccacgtcgacttcctgcgaggtcgcgacgatcttgcccggatggacgttcttcttcgtccaggacatttcgctgacatgcaccaggccttcgacgcccggttccagttccacgaaggcaccgtaatcggtgatgttggtcacgcgtccgctgtatttcgcgcccggcggatacttcgccgccacaccttcccacggatcggcctcaagctgcttcatgcccaggctgatacgctgcgtgtcggaattgaagcggatcacctgcaccttcacggtctggccgatctgcagggcctcgctcgggtgattgatgcgcttccaggcgatgtccgtgacatgcaggaggccatcgacgccacccagatccacgaacgcgccgtaatcggtaatattcttcaccacgccatccaggatcatgccttccttcaggccctggatcagctcgctgcgctgctcggcgcgagtctcttccagcaccgcacggcggctgaccacgatgttaccgcgcgcgcggtccatcttcaggatctggaacggctgcggggtgcccatcagcggaccgacatcacgcacagggcggatatcgacctggctgcccggcaggaacgcgaccgcgccgccgagatcaacggtgaagccacccttcacgcgaccatagatcgtgccctgaacgcgctgggcgctttcaaaagccttttccagagtggtccatgcttcctcgcggcgagccttctcgcgcgacaggacgatggaaccgtcacggtcctcgtaacgctcgacatacagctcgacgacatcgccgggcttcacgtcgggcttctgacccggagggccgaattctttcagggcgacgcggccttcagacttcaggcccacatcgacgatcacgaattcggggtcgatgcgcagcacgcggccgctgacgacggagccatcaaagccgctgtcacggcccagggtctcgtcgagcagggcggcgaaatcctcgtcaccctgttgttggatagcagtggcggaagatgccatgtgggaaaactatgtccttgaactgacagcccggaggctatcaaggaaggcgctacaccgccgggcgcgggttacgcgccggggatcacggcttgccggaccttacatcacgcgatcatcgcgcgtcccggtttccgcggcgggacaggtcgggccatggcggaaatcagccggcaacaacgcccactgatgcccgtaagtcaaggaaattccgcctccgctgccccgcctgccatgcagaggagacagccggttttatcgcggccacttccggcggacgatctgctccgcccgttgaaatgcctgatcggcgtccagatgggtggtgtccagcacctccgcatcctctgccggacgcaagggtgcaacatcgcgggccgcatcccgttcgtcccttgcctgcatctcggcccgcagtgcctgttcttccaccgctacgccccggttgcgcaactccagcaggcgacgttgcaggcgcgcttcggcgctggcggtgacgaacagcttcaccggcgcatccgggcacacgaccgtgccgatatcgcgcccgtccagcaccgcgccttcccgtgccgcgaaatcacgctggaaatccagcagtgcggcccgtacagccggatcggcagcaaccagactggcggcacggtctacctccggcaccctcagatcgctgcgctgcactgtctccggcaccagaaccgataccgcccacgccgcatcggcagggctgcccggatcaccgcccgcatccagcaccagccgccccaccgcgcgatagagcagacctgtatccagatgcggcagcccgaaagccgatgccagccgacgcgccagcgtgcccttgcctgccgcagccggaccatcgaccgcgatgatcaggcgcatgagaaatccgcccccagcccggtcatcagcgtggcgaaaccggggaaagacgtgtcgatgaaggccgcgtcatccgccgtcaccggcgcctgcgtggtcaggcccagcaccagcgccgacatggccagccgatgatccatatacgtggtgaccaggccgccccccggcggcggaccgccgcagccgatgacgatcagatcatcgccctcaatctcaacctgcacgccattcaccgacagcagcgccgccgtcgccgccagccggtcactctccttgacccgcagctctgccagcccgcgcatgcgtgtggtgccggaggcgaccgctgcggcaaccgagagaatggggaattcgtcgatcatgctcggtgcacgctccggcggcacctccacaccatgcagggtggaggcccggacggtgatatcgccgaccggctcccccccctcgatccggcgattggcgatggtcagcgcagcccccatctccaccagcgtatcgaacagcccggtgcgcagcggattgaggcctaccccggccagagtgatctccgaccccggcaccagcaaggccgccaccagcggaaaagccgccgaggatgggtcggcaggcaccacgatatcggcagcccgcaattccggttgcccctgcaggcgaacgatgcggcctgcaccgtccccggtcggctccacctgcacagtcgccccgaaatggcgcagcatattttcgctgtgatcacgggtggcatgcggttcttccaccactgtctccccccgtgcattcagcccggccagcagaatggccgacttcacctgggcagaggcgaccggcaggcgataatgcagcggcagagcctcccccgtgccacgcaccgccatcggcaacctgccgccggagcgggtgtgaaaaccggccccgcaagccgcaagcggatcggtcacccggcgcatggggcgtttgcgcaggctggcatcgcccgtcatcaccgcaaacagatcatggctggccagcacgcctgtcagcagtcgcgccgccgtgcccgaattgcccatgtccagtacatccgcaggctcggtcaggccgccaatgccacgaccggcgacgcgccatgaaccgggcgcatcccgcaccacctcggcccccaacgcccgcatggcggcggccgtgcgcagcacgtcctccccctccagcaggccggatatacgcgtctccccgaccgccagcgcaccgatcatcaatgcgcgatggctgatggatttgtccccgggaacatggaccggatgatcagcccgcaacccggcggcaggacggcggctgatgacggggcgagaggccccttcgctgtgattttcgctcatccctgcgcgatagcatgacagaacggtttgacagaagggcgaagcggtggcatggggcgcgccctgtcctgcgcgtcagccgaatttttatccctccccacgatcacgaggccgcatttcccatggtaaaacccgaacttggcaccaagcgggtctgcgtttcatgcggaacccgtttctacgatctgctgaaatcccccgccatctgcccgaaatgcggcgctgaacagccgctggaccagccccgcccccgccgcgtgccgggtgtgctgctggatgacaaacccaagaagatcggggttgttgacgatgccgatacagatgccgtcgatgccgacgacactgacgaggatgtgctggaggatacctccgacctcgaagacggcgacgatgacaccatcgaggtggaagtcgagaccgacggcaacgatgacgagcactgatcagcgcccgatccgataaattcaacatgaaaaaagggggccttccggccccctttttgataagccgactgtcaaaatatcagccttcagccttttgtttcagtgcagtgaggcccgcatcatacaccccggtcacggctgtgatcgcatcctcgtctccttgtccagcgggcggcgtgccgagcggcgacaggcgggtgaaaaatccctgccacacgattcgcgccccggccccgaccgcctcgaccgtgatggtcgaacggtagtcgcccgcaggcacgatctgcgtattttccacatccggtgtgaatttgtagctgtagctgcggccagccgcatcataggccgtcaacgcttccgtaattttagggccaccgagatccagcacccggatcgaaccgggagtgttaccccggtcggcactgctggacttcaccagcggcagccaagtgatatccccgaattccgagatgatggcccacaccgcgtctggcggagcagcaatatcgatctttttcgtgagcgtgagtggctttggcccggtctgacccccttcccctgcaggggcgtagacggcagatgggaacagttcgttcattgactctgtcctgtgtctggttatccctcgccggaagacaccgctccggcgcgctgcgtagcaggccattgatcgccgtcgaagacaatatcgcgccgctccctatcttccgaaccggagcggtctctgtttttctgccatcaggatgccgtaatagggcgcatatgcgttaaaaaatggaatggaagccacggcttcgccaaaatgaggagaggatataatgtcccgccagccgctcttgctatccctggccctgctcgctgccactgcgctatgcgcttgtaccgtctctccaccggaaggaccgagtattgccgccctgcccggcaaggggaaaacgctggagcagttccagaatgacgatatgacatgccgctattacgcctctcagcggaacggttttgtctccccacaaaaaggcgccgccaacagtgccgtcggcacggccgccattggcacggcactgggagcagcgaccggtgccttgattggcgtggccgcaggcaatgccggtatgggggctgcgatcggcgcgggcgcaggccttgcaggcggtggtctgctcggcagttcgaatgcgcggcaatcatcggcctcgctacagcagaattacgacatgaattacgggcaatgcatgattgcccgcgggaatactttcccgccccagccgaggatgcagatggcacccgcctatacttattgaacaggatcagagggaatacagggggccattcagatcagccccctgacgatcagaaccagagacgcagaccaaacaggaaccgcacgctgtccgcagcctgtccctgctgctgctggaatgtcccggtgcgcccgaaggccccctgatacaccacccccagatacggggcgaaggttctggcaaattcgtatcgcagcctgatcccggtctccagattcgacaccccggcccccagcccccgtgcggggtcggattgaccataccagttcgtctccagacgaggctggaggatcagccgattggtgagcagaaggtcgtaggaagcctccacccgcgccgcgactcggccatctgtccccagataggcggtggcctccagatcgaaaaaatacagggtcagtccctgcaccccgaaagccgcccattggcgcgtcggcccattatcaaggtcgatccgccatccggcctgccagtcgaaataggtcgagaacgggcgatcatacagcacctcatgccgtgcatcctgaaaaccgccgcctttaccgaccgtgccttccgatttcagccagagcttgttctcatccgtaccgagccaagcctctccctcataggtaaaaacctgattcgtaccggccatacgatgttcagcctgctccagcagggcatggagataaacctgatcatccatcgccggcatcgggccacccggcaggtagacggggccgtccttgcccgtagcctgcatttccatccccgccccggctgccgttccaccggtgagcagaatcagtgacagcaacagcactgcatgagggatacgcctcaggccgttcatgacaccaccacggtgcggaacatacccagttccatatggtagagcagatggcaatgaaacgcccacagacccggcgtatcggcatcaacacaggtggtcagcctctcacccggcttgaccagaatggtgtgtttgaagggacgatccgcgccggttccgttctccagttcactccacaaaccatggaggtggatcggatgctccatcatcgtatcgttgatcaggatgaagcggacacgctcccccagccgcagacggatcgaaggtgcatgagaaaatttctggccgttaaagccccagatatagcgctccatattgccggtcagatgcaacaggatctcccgatccggctcccgccccggcggggccggtcgcgcggctctcagatcggtgtagcgcaggacgcggcgtccgttatcgtccagcccactgcctgcctcatggagtcgcgataccggcatcggggcaaggctgccaacccccagttctccgacctgcggtgtccggtagaccgtcacgggcaccggatgcggcccggtctgtttcaggggagccggaagagagggtgcggtattcccgggcacgctgaccggcgcggcatggtctgcatgcatggcgccatcatggacggaacccccatgatgcatcggcatgtgatgcatgggcatgtccggcatatccatgccgtccatctcctccataccttccatcccctccatgctgtgcgcatgatgatgggccggagcagaagacgcgggagaggacacagcctccggcggcggatgagccataccgtccgtgccgggattctccgcatcgtgggccgccatgccgtggtgctccattcctgcacccatatcccccatgtccatgtggttcatgtccatgtcgcccatgcccatatccttcatggtgcgcagcgggcgagggtccattggcggcaccaacccgtccatatcgggatgcggtgcgagggtgccacgcgcgtagccggtccggtcctgactctgtgcgaaaatcgtataagccgcgttaccgggttggatcagcacatcataggtctcggccacgccgatgcggaactcatcgaccatgaccgggcgcaccgcattaccgtccgcctccaccacggtcatgaccagacccggaatccggatgtcgaaatttgtcattgatgcagcgttgatgaagcgcagacgcacccgttcacccggcctgaacagcccgtgccaatggtcatccaccgcccggccattgagcagatacgcataggcattgccgctgacatccgagatatccgtcggccccatccgcatctttccccaggcgagccgatccgacacagcctgatgcaagcccttctggcgtgcatcagcgataaaggtgcccagcgtgcgctgacggaaattataggcatcgctctggaatttcagcgtgctgacaatgctctcgggggccagatcggaccagtcattcaacatgacgacatagtcgcggtcataatccggcaccgcgccatgcggcgcgataatcaacgcgccgtacaggccggtcgcctcctgaaagccggaatgaccatggtaccagtacgtgccggactgcttcagcggaaagcgatacgtaaacgtctctcccgccggaatccccccgaagctcagcccaggcacaccatccatggaggcagggacacgcaggccatgccagtgaatggaggtcggctcatccagtgtattggtgacggcgatggcaacctcgtccccctcccgcatacgcagtaccggacccggcagggaagcattcaccaatgtcgccgacgcatgtcttccgccacggcgaacggaatagcgggctacgttcagggcaaagcggctgccacgcagctccggcataccctcggcagttgcttccggtgcaggcgcaggcgcggcgcatcctcctgccgctgctgtcagaagcgcagcaccgcaggcacgcagcacgcgccgacgatccggccgaataaggccggaaccttcagtattcctcatgatcttatggtcgctctgtcagaactacttacacggcccagccggtttattccgccagatgcagcggatcagacaggcctcacccgaacggtcagcccgctttcaagcgggtataaagcggcctgagcgaggtggaaaaggttccggcatgggggatgctccatacccgtgatacggaatggaagctacgaaacggaccaaccagacgcgcactgaatccgccagtgccggcgcatccggcaccatggcccccacacaacacaccacaccatcacaggatggtgcggcaggatggccatggcagggtgcaggatgctgcccgatcatcagcggtgccgtgatgacgtcatcgtcacccgcagcaatatcagccatcgacatagtcatgacatgggcggcctccatcgcccgcacctgcagtggcaggctgcaggcgatcaacgccgtcagcagaaatgtcagaacacatcgcatgtcgggcaatattgtaaccaccctcgctcaagcacgcaatcaaatgggatcgtgcactgatagagcataaaaactatgttcagggttcaatggaccagttccatctggctcttcagatactggtggacggagggcgatgcatacggaagataaagcgcccttacctgatagatgccccattccatatccctcatcggaagcgccttgctaccgcggtgcatgatcagaaaggacatccagtaagacatgatgatgcagacattggcagccagcgcctccagctcggcatcttcaataatcagatgccccacctgacgcatatgctgaagaacatgcatggcaacctgctctccttcacgattcatggtcctgagtcttaaggccagatccggaatctggttcaggatgacagggccatcccgaaacagaaaccggtatcgccagatcaaccagaaccatgatctcaaatagtcactatacagctcgatcggatgaagcatgttcgaacctgaccgggtagtaactttatcagggctggtcgagacaagtcgcgtcatatgatgatggaaaatgtcatataacgttgttaccagaatttgctttgtatgaaagtgatagtataaatttccttcattaatattgcagactgcagcaagatgagatgtcgtcattgcatcgacaccttctatattcaaaatatctaacgcagttttcagaatttttaactttgtttttcccttgactacagtctgcgtcatcatttccaagccgttccaggagaaattattcataaaactaatatctcccggcaatgcatggacgctgatgaaaccccattcgcagtacagttgcggggccaaaaggatcgtgaaaacagataatcacaatcccgttctcgtgtatttaacgcaccccgaaacagacaaagcagatcttttttccacttatcataaaaacaaaaaaggcaaacctgcattttcatgcagatttgccaaaattttctataaaattgtttttactaaagcgtggttttattttcaaccagaacgcgaattttgatcagtcctcgctgactctgtccggacggcggctggcgaccagcggtcccagcatcggcccatgaagcgctgatccccgaccggagagcgatggattggtcatgaaataatgatgtgctgacacaggtttacgtcccgccacggttttggcaggcacccggtgccatgcccctgaaggcttcagctcccatgactgggccgtgtccttcagattgatgaccataatctgatccagtacctgcgcatgtacggtcgggttataaatcggcaccagcgtttccacgcgccagtccatgttgcgggccatccagtcggcgctgctgatgaacactttcgcatgccgacttggtaaggcatggccgttcccgaacacgcagatgcgactgtgttccagaaagcgtccgacaatagacttgacgcggatattctcggacaatcccggcacaccgggccgcaggcaacagataccgcggatcacggccatgatcttcacgcccgcattgctggcctcataaagtttgtcgatcagcacggcatcaacaaggctgttcattttcagccagatcgtgccgggccgtccgccctgcacatggttgatctcttcctgaatcaactccatcagcgtgtcgcgggtagtcagcgggctgaatgccagagcctccatcttcgcaggacgggcatagccggtcatatagttgaaaagccgggccgcatcccgtgtcagggctggatcgctggtgaaaaagctgagatcggtataaatccgcgccgtgatcggatgataattcccggtgccgaaatgcgcgtagctgcgcatggaattgccttcccgccgcacgacaaggctgagcttggcatgggttttgagctcggcaaatccgaacacaacctgcacaccggccgcctccatggtccgggcgagacggatattcgcctcctcatcgaagcgcgcgcgcaattcgaccatcgcggtcacggatttaccgccttctgcggcttcaatcagcgccttgacgatcgggctgtcgcggctggtgcggtacagggtctgcttgatcgcgacggtggccggatcgctggcagcctgccgcaggaactggaccaccacgtcgaaactctcaaacgggtgatgaacgatgatatccttggctcggatcgcagcgaaacaatccccgccgaaatcgcggatacgctccggaaaacgcggcgtatagggcggaaacaacagatcggcccgatcatccacgatcaactgccggacatcggacaccgccagaataccatcgagcaccgatgcctcgtccggggagacatcgagttcatcaatcaccatctctcgcagtggaagcggcgtctccccgctcagggtcaggtcgatgaccacgccccggcgacggcgcttcagtgcgctctcgtaggagcgcacaagatcctcggcttcttcctcaaattccacatcggtatcgcggatcagccgaaacatgccctgcccatccacatggaaccccgggaacaggcggtcgaggaacagggtcagcagatcttccagcatcaggaagcggatacggggatcgggtttttcctcccccctgccatcagccgcagcagagcgcgccggcagccgaatgaaacggtctgtctgggtcggcaggggaatcaggccacgcatgccctgaccgtccgcatcccgcaccagatgcaggaccatgaccaggcccatattcggaatgaacggaaacggatgtgccggatcaactgcaagcggcgtcagaacagggaaaacccgctccatgaaccagttggccagaaaccgcatatcggcttcgtcaaacagggtttccgccatcgctgccgcggcattgccatgggaaggcagtttcaggacatcgatcccggcctcccccagcaaattccgcaacgtgttccagcaagcctgctggtcattgaacaattgccgggaccgggtacgaatctccgccaactgctgggagggggagcgtccatccggcgacagctccgccagaccagcttttgcctgcccgatcagaccggcaacccggaccgagaagaactcgtcaatattggaagcgctgatggacaggaagcgcacgcgctccagcaagggatgcaggggattatcggcttcctccagcacacgctggttgaaatccagccatgacagctcccggttgatgaaacggtcggggctgtccggcacgatcggtgccacccccgtctctgattgagtggcaatacggggggagagatcagggtgtgcgtccatggccgccgttttagaggagcgccgggggattcgataagatttcgtctgcgtctgacgcgaaactgtcacggcaagcctcatcaccatccgattcacacagtccgttcaggatgcgcgccgccagtatttttgtcaccctgcccccctccgccaatgcggcacggtcgagccttgcggccacttcccgcacagcccaggcggtgcgcggcagccgcaatagcagccaggattgcaggctgggcggcacactcaactggcgctcggtcagcagacgctccagcaacgcacggagcagcgcgtcatccgggggtagaattccgaccgatgatgtcgcccgtaagcgggaggcaagatcaggcaaggtcacgcgccagcgcgccggaggcagccgggacgccagcaatatcggcacgcccgcctcggcggcggcattgatcagatgcagcaaggccgcttcatccggggtcgcatccgcatcatcgaccgcaaccggcgccaaaggtgcccgtggcaatccacgcagggaaggaccgggccgccgctcggcctcctgtaaatcggcccagatactcagtaaatgggtcttgccggtgccctcgtcaccgaacagaccgaggcggccttgcggccactccgacgtgcgggccagccaggcccgcgccgcccggttggagggggcttccagaaaattcgagggccgataggccggctcgtaagcaaagggaaggccaagctgcaaggccgcactcatggtgcaacccccaccgtcaccgccctggtcggaatcaacgagcgcattacgcccccggcggctccagatagagcggactggccagatagcgccgcagccagaaacgcgacagcaccccgatgacggccgccatgggaaccgcgagcaagacacccagaaagccgaacgccgctccacccgcgaacagggcgaaaatcacccacacggcatgcagctcgaccctgtcacccagaaaacgggggtaaatcacgtaattttccaaaatctgaccggcgaggaaaacgcctgccaccagagccacccggttccagtcgtggaactgcgccatggcaagcgcaaaggatcccgcaccccccaacaccgtcccgacataggggataaaggaaaggattccggtggcaagccccagcagcaggcccagatcaagccccacgaaagacagccccaccgcatagaacacaccaagcatcaggcagcacagagcctgcccgcgcagccatgccgacaggatacggttgatctcccgcgcctgcgcccttaccacgcccgcataacggcgggggagccataaatccacccgcgccacggccttgggccagtcacgcagaaggtaaaacgccacgaccggcgtcaccaccagaacggtcaatacgttgaacagtgcgaaaccgccgccgattacccggctcagcgcccgtccgaacacagtgagcaggcttccggcctgcactgacaccacatcctgaagcttcgcatcgacaaaacccggtcccagcctctcctgcaccctgccgagccagtcgattgcggtatcgcgcaccagcgcgacataggcaggcagacgagacagcagaatgccgagctgggccacgatcagcggatacagcaacagggcgaacagcaacccgagcaggatcatggccgcgatcagcagacctgccgccacgccacgcggcaatcccagccgctccaatcgtcccgccagaggatcaagaaaataggcgatcccgccagccatcacgaaaggcagcagaatcgaagcaaacagatgcagggtcagccatacagcaaacagcacaccgccgatcagggccacacgctgcatgcgcgtggcgccgtgccgggcgggcggtgaaggatcagcacgcagggaagtgaccggcacagaagtctcctctgccaccctatggagtgaagtcagatcctccatcgtcgtcgtgacctcgccggaatcgcctgtcatccagcctatgctccatggttgccagcacccgactcccggattgttgccgcagggatgatccaaccacccctttattcggtgtctgcttatggcagcatagctgctttcaacaccggacacatgcggtcaacgcggatggcaggccatccagacataagccgccccgcttgccagcgtactgagcgcaaccagaaccaccagaatggtatttgtggccgccaccagactggcctccggtggggcgaaggccgctgttgccagcagaaaagcgacaagaatgatctgtaaggtcgtattcagcttggaaacatagagcgggctgatcgcgacgtcctgcccgattgtggtcagcaccacgatgccaccaaggatcaggatatcgcggaacacgacgagaatggccagccagtccggcagcaagcctacgatggacagcatcacatacataccgaccagcaaggccttgtccgccaccggatcaagcgccgcccccaccacggtcgggccgcgacgccgggccagccagccatcaatcgcatccgacaggccggcagccacgaacagccagaatgccgctgcgaaatcgtgccgcagcaccagccataccgcgaacggcacggcacagagccgcccgaaggtgatgatgttgggcagggtaaacagggcatgatccgggggcggaagcatgtttccgccatggtccggggtatgctgatcgggggggaaactgccttcaggcatggaaaacgatcagcaaaagaaaaatgccctcatcacaccgcatggctccgcgccatatgtcaccgttgcgcacgccacgcggctatggtttctgtccactcgcaccaaacgtcccgacgcagtccgcgatcttcccgcgttgcgcgggaagccgcccgagaggacaagccatgagcagcatgacataccgggatgcaggcgtcgacatcgacgctggcgatgccctggtcgaagccatcaagccgctggcccgcgccaccagccgttccggcgtgatgggcggactgggcgggttcggagcactcttcgacctgaaagccgccggattcaaggacccggttctggtcagcacgacggatggcgtcggcaccaagctgcgcgtcgccatcgaggcgggacgtcacgagaccgtcggcatcgatctggtggccatgtgcgtgaacgatctggtggtgcagggggcggagccgctgttcttcctcgattatttcgcaaccggcaaattgtcggtggaggcggcccggaccgttctcgcgggaatcgcagaaggctgccgtcaggcgggcagtgcgctggtcggtggcgaaaccgcggaaatgccgggcatgtatgccgatggcgattacgatctggccggcttctcggtcggcgcggcagagcgggaggcactgctgcccgcgggtgttgccgccggtgataccgtgctcggtctggccagcagcggggtccattccaatggttattctctggtgcggcgggttgtggaagcctccggactggcctgggatgcgccctgcccctttgccgaaggcaggacgctggcggaggctctgctgaccccgacccggatctacgtctcctccgtgctggccctgcatcgcgcgggcctgctgaaagcagccgcccatatcacgggcggcggtctgccgggcaatgtgcatcgggttctgccgggcggcctgcatgccgtgatcgacaccgccgcatggccccgcccaccagtgttcaactggctggctacgcagggcaatgtcgcggaagatgaaatgctgcgcgttttcaattgcggcatcggcatgatcgtcgtcacatccgatccggatgctgccaccgcactgctgagcgaagcgggcgaaaccgtctatcgcctcggccgtatcgatacgaaggaaggcgcggcctccacccccgatctgctcgccatcccagaatgacgcggatcgcgatttttatcagcggccggggcagcaatatgcgctccctggtctctgctgcccgcgcgcccggttttccgggacaggtggtgctggtcctgtccaacgatcctgctgccgccgggctggacttcgcccgtaaagccgggatcgaggcgctgtgcgtcgatcaccgccccttcggcaaggaccggcaggcgcatgaacaggccatcgacgaagccctgcacgcccggggaatcgaactgatctgtctggccggttatatgcgcctgttgacgccctgtctggtggatcgctggcaggggaagatgctgaacatccatcccagcctgctgcccgcttttcccggcctgcacacgcatcgccgcgcactggaaacgggggtcaagctgcatggctgcaccgtgcatctggtcacgcagatcatggatgaggggccgatccttgcccaggccgccgtaccggtactgccggacgataccgaggacgctctggcagaccgggtcctggcccaggaacacgttctgtatcccatggccctgcggaactggctggaacaggaccggaaagccgctcctgcggatgccgtgctgctcaatcccgtgccgtcagcctgacgtcacgcgtgcagtcaggctcttgcagtcaggcaacagcaattctagaaacacgatcagtcatagccgatcaaacaaaactggccctcccaaaggccagccttgcaagggggacgtcatgtcgcagccttcagccacttatgcccgggcgccgatcaccagcgtcgacgacctgctggccgaccgcaagcgcgtttatgcgcatttcgtgacgggtgccaaggtcgggatcgctgcggtcgccatcattctggcgctaatgggcatcttcctcacctgagcgtttgtcagggattcatcccatcaaaaaggccggtgccgccttctgcgcggaccggcctttttttagtgcccccgtccattcccgcccggcaccaaagcacagggcgggaacatgcggcgaagcgtgatcaggcgacgatttcgctgcctgcgaagaaataggcgatctcgatcgccgcgttctcggcactgtcggaaccatgcacggagttggcttcgatgctctcggcgaactgggcgcgaatggtgccggcatcggccttcttcggatcggtggcacccatcagctcgcggttgcgggccacggcgttctcgccttccagcacctgcaccacaaccgggccggagatcatgaagctgaccagatcgttgaagaacgggcgttcgcgatgcacgccatagaacgcctcggcctgggcctgggacagctgaacgcgcttctgggcgacgatgcgcaggccgttctcctcaaacaccgcattgatgcggccggtcaggttccgacgggtcgcgtcgggcttaatgatggaaaacgtacgctcgatcgccatgatgatctgcccctgggtcagatagaacaagaagatgaaatccggccaaaccaccgggctttcctgacgcgggccatagccgcaagccgcaagccttgcaacccgtgccccggcaactctcccccgctggcaaccctcctccgccagccatacccccctatgacggggtatggcttgccctcagccccgcctgaccggataagcgcatcctatgagccttctgatcatcgactccctcacccttcgcatgggcggccgcgtcctgttcgatcatgccagcctgaccgtagaggccggaaggcgtatcgggctggtcggccggaatggagcaggcaaatccaccctgctgcggactattgccggtgatctgatgccggatggcggcagcatccgcctgtcctcccgcgccagaatgggcgtggtgtcgcaggaagcgccggacggtcctgccggtctggtggagaccgtgctggcatcagataccgagcgtacgaaattgctggcggaatccgaaaccgccccgccggagcgtctggccgatatccatgatcgtctgctggccatcggcgcggagtccgccccggcccgcgccgctgccattctggccgggctgggcttcgatgcggaggcacagtctcgccctgtttcctccttttccggcggctggcggatgcgcgtggcgctggcctccgcgctgtttctgcaacccgacctgctgctgctggacgagccgaccaaccatctggatctggaagcgacactgtggctggaaaactggctgctgaaattctccggcgcggcgctgatcgtctcccatgatcgcgggctgctggaccgggcggtgcatgccatcgcccatctcgatcgtggtggcctctccctgacccccggcggctatagcgagttcgtccgcatccgcacggagcagatggagcaacaggcccgcgccgccgaaagaatcgccgcccaacgcgcccatatgcaggctttcgtcgaccggttccgcgcacaggccaccaaggcaaggcaggctcaatcccggctcaaggcgctggaaaaactgccgcagatcgaaagcgtgatcgaggaaacgccgatccgcttcgattttccggagcctgcccggcttgcccctcccatcctgacgctggagcgggtctgtgccggctatggcgataagcgcattctaaacagtatcaatctgcgcgtggatatggatgaccgcattgccttgctgggggccaacggcaatggcaaatccaccctcgccaagctgctggccatgcgcctgcctcccttggaaggcgacgtcaaacacagcgccaaactccgcgtcggttatttcgcccagcatcaggcggaagaactggtcctgtccgacacgccggtcgatcacatggcgcgcgccctgccccgcgccctgccgcctcaactgcgggcgcatctggcccgattcggtctggatgcggatcgcgccgaaacacaggtcggcaaactgtcaggcggcgagaaggcgcgcctgctgctggctctggccacccgcgacgcgccgcaaatgctgattctggacgaacccaccaaccatctggatatcgatgcccgtgacgccctgaccagggcattggcggattttcagggcgcagtgctgctgatcacccatgatcccgatctggtagagttgatcgccgaccggctctggctggtggcagacggaaccgtcagacagttcgacggatcgatggatgattaccgcacctatctggccgagcgcgcccgtccggtggtgaaggcggaggcttcctcccgcaaggatgagcggcgtgaacgggccgaggcccgcgccgcgaatgcaccactgcgcaaaaaggccagagatgcagaggcgctgatcgcgaaattgaccactgagcgcacgaaaatagaggaaaaactggctgatccggcgatctatgccgagtcgcgcgtggcggaagtcaccgccgccaatgcccgtctggccgcgatcgccaaagaaatcgactctgccgaagccatctggctggacgcagaggaagcactggccgccgcagaaggctgaaacaaaaagaaaaggcggccttcctcccggaaagccgccccttcagaccctgttgaccaccgggtggatcagaccttttcgacctgcccgtattccagctccaccggcgtcgagcgaccgaagatggagacgctgaccttcacgcggcccttttcctcgtccacttcctccaccacgccgttgaagctggtaaagggaccatccgccacgcgaatctgctcgccgacctcgaacagcacggcgggacgggggcgttccaccccttcctgagcctgccgcaggatacggtccgcctcggcctccgaaatcggggaggggcgggttctgctgccgaggaagcctgtgacgcgcggtgtatcgcgcaccagatgccaggtgtcgtcggtcagctccatcttcaccagcacatagccggggaaaaatttgcgctcggcattgaccttctggccacggcgaagttcgaccacttcctccgacggcaccagaatttcgtcaaaatgatcgatcaggccgttctgaacggcggtttcccggatctgctgggcgatcttcttttcaaaaccggaatagacgtggaccacgtaccaacgcttggccatcggaaacctctcaacccccgctcgcgaatgtcagactgataccgagtccggcaagctgatcgatcacgaaaaaaaacgccgccgccagggtcgccattgcgaacaccagaccggtcgtcaccagcgtctccttacgggagggccaggtaaccttcgacacctcgctgcgcacatcgcgcaggaatttcgccggactggtcgccacgcttggtttgctcctcaggaacgccgcagaattacgggtcaataccatgctgctgctggcaggggtggagggtctcgaacccccagcctccggttttggagaccggcgctctagccaattgagctacacccctgcatcgcacgcaggcaccgcatgtggcgaccggacaagcccggccaccccgtgcggggcagacgcgctagacacaatgacagcgcccttatgtcaagggcctagttgataaaacagccgtctttatccgccgcaaagcgcgtcatccgcacggatttgcatcgaaaccgcgccatcagcgcaacccggccatcccgtggtttcaggtcaggcccgtggtttcaggtcaagattgtacaggcaccctcatccgcacggctgaccagacttcggaaattgccgaacaattctcttccagtgccgtatgcgctggtggacagatcatcccgcaccggctcccgcgccatgaacgacacggggtcttccagcacctccaaccggccatgcacggcatccagccgcaggcggtcaccatcgcggatcagggcgatcggtccctccgccgccgcttcaggggtgacatggatcgcggcgggcactttgccggatgcgcccgacagccgcccatcggtcaccagcgccacgcgatgaccacgatcctgcaacacgcccaaggcaggcatcagcttatgcagttccggcataccattggcgcgcggcccctgaaaccgcaccaccacgatgacatcacgatccagggccccatttttgaacgcctgctgcatggcttcctgcgtgtggaacaccatggcgggtgcctcaatcacgtaacgctccggatgtaccgccgaggtcttgatcaccgctcgccccaacggcccttccagcacgcgcaggccacccgtctgcgcgaacggctcctccaccccgcgcagcacggcgggatcgccgctgacctgcgggccatcctgccatgtgactgtgccggtctccggattcagccatggctccgccacgtagtgccgcaggccccgaccccagaccgtctccacatcttcatgcagcaatccgccccgcaacagggtggagatcaggaacgccatgccgccggccgcgtggaaatggttcacatcggcctgtccgttcggataaacccggcacaataacggcacgatttcagccagatcggacaaatcatcccaggtgaggataatgcccgccgcccgcgccatcgccagcagatgaatcgtatgattggtagagccgcctgttgcatgcagcccgacaattccgttgacgaacacacgctcatccagcatccgcccgagcggtgtccagttgtcgccatcggccgtcagggccagcgcccgcgtgaccgcctcccgcgtcagcccgtcccgcagcttcgtgccgggattgacgaaggaagcaccgggcaaatgcagccccatgatctccatcagcatctggttggtattggccgtgccataaaaagtgcaggtgccgggaccgtgatacgattcactctccgagaccagcagcgcatcacgccccaccttgccctcggcataaagctgccgcacacgggccttttcactgttgggaagccccgtggtcatcggacctgccggaatgaacaccaccggcagatgaccaaaggacaacgccccgatcagcaggcccggcacgatcttgtcacacacccccagacacaccgccgcatcgaaggtctggtgcgacagcgcaatcgccgtggaaagcgcgatcacgtcgcgagaaaacagggatagctccatcccgtcctccccctgcgtcacaccatcacacatggccggcacgcctcccgccacctgagctgtcgctccggcaatccgtgcagcctcacggatcaggtcgggataggtctcgtaaggctgatgcgccgacagcatgtcattatacgccgtcacgataccgagattaggtgcttgcccctgcgtcatcacctgcttgtcggtatgggtgcaggccgcataagcatgagccagattggcacagcccattttttggcgaggccgtttccgcgccgcatcggcaagacggtccagataggcccgacgggtctcacggctccgttcgacaatgcgctcagtgatctccagcagacgcggatgcggggtgccaatttgcatattttatgctccctgcccgcccgggtttctcaacgcactgacacgggccgcgctgcgtgacgctttcgcggtgatcgcatcccacgccccggcctcgatctcggccggcgtggccagccatgagccgccgatggccaccacattgggcagcgacagccatgcctcgatcccgtcctcggaaatgccaccggtggggcagaaacgtgcctccgggaatggaccacccagcgccttgagcgtcgccatcccgcccggctcggcaggaaacagcttggcagcgctgaagccgcgctcgatacaggccatcagctccgacgcggtgcggataccggggacaaaggggaggtcggtctctgccgccgcatccagcagaaccggcgtcgcaccggggctgaacgcaaagcgcaatcccagtttacgagccgtttccagctcggcaggggtggtgacggtgccgagacctaccaccgcctccggcacttcctgcgcgatcacacgggcggcatcgaggcccgctttcgttcgcaaggtgacctccagcatcctgatcccacccgccaccagagcacgggccagcggaaccgcatccgccacatttccaatcatcagcaccggaataatcccggctgtctgcatcagggatgcaggcgtttcctgtgtcatgttttcttcccctccagaaatacccatgccaaagtccggtttcatgcggctggcggatcctctcctcgacaggccatgcaaggatcatgctgcccccgcacgcatcccccatttgcatctcctggcaccttcgcccgatcctgctggaatcatcccacgccgacccgcatcagcctgcccccctcctgccgcaaccaggccgtcgcctgcgcacgatagggggtcagttgtacacaaagcgcccagaaatcagcgctgtgattcatatgtttcagatgggcggtctcatggcccgccacataatcctgaacatagggcggtgccatgatcagccgccagctataagcgatgctgccatccggcgcacaactgccccagcgcgacactgtatccttgatggaaacgcgacgcggcttcaacccggcagcagccgccttggccaacgtcaaagtcgagaaacgcttctgtgcctcccgccgcagccaatcctgcacacggcgcttcagaaacgcgggatcaccgctgacatgcagcgtttcgccctccagccgcaccacgccacgcgcctgcccgtcatggcagatgaccacctccctgccattgaacggtattgtcgcgccgttctgaaataaaagaggcggcggcagcatcgccagtttttcttccacccactccgcatggcgatagagcagttccagaccggccttacggccgacacggcccggcaaggtcagcaccgcatggccgcgccgtgcatcaatacgcagactgatccgccgcgcccgtacattgcggcgccataagacaggcacaggcaagccgcccggcagagtttccgtcacgataatggccgcagaggaagcatccaaccgctccggtgccgccaccgggccagccggtttcgtccgaaacagcggcagcctcatgactcatcggccgtcttgcctgccggctcctgccgggggcggcgtggacggggaaaacgaccgggccaggagacgatgtaatcctccagcggcccggcctcccgctcatcaatcgcgcggccacgtactgaaatgcccgcctgatgcaccgtctccggatcgccggagaccagaggatgccaccagggcagatccttgccgttgagcacaatccgataggcacagctcggcggcagccagtcgatctccgcgaccagagcgggggtcaggctgatgcagtccggcaccttgcgaaatcgggtggcatagctggtgcaacggcagctttgtgtatccagcagacggcaggatacattggtgaaagccagttcctccgtctcctcatccctcagcttatgcaggcagcagcgcccgcaaccatcacacaagctttcccattcctcacgggtcagctcggtcaggtgtttggttttccagaaaggaagggcctcagtcataaaaccagtgataaagccttccagcccgcaccggtagccaaaagaagctgatctccgctatctgtccccatgcatcctcccgggcatgccttattttatcagcgcggcgggggcagggtctgctgctgaaccggtgccagtctggtagggccgcccgttaccggggcaggcgcataggctggctcctgcgtctgggtcggctgcccggccgcaacaggcgcggcggctgcctgacctggcgtgccatagcgcgcaaggatggtgcgcagcgggtcggcgccgggattattgacctgcatctggatcacaatctgccgggcggccagagcctgtccgtaataggcgcggttggcatccgtatcggtggtcaggaaagtcccgttcagcgcgacgcttccgaacagaccacgggatttggagaacccgataatatccgcccgcaatgcggcagtcacatcaccctctacccccgctccgaacgtcgccacggacagggaggcatcgccgccgaacttgaactgcttgtccatgatcgcgctcaaggccttgtcattcatgatcatgagcatgatctggctgtcctgaatcccgatctgaagcccgaagctgacgctggacatcgaaaagaaagccggggcagaccatgatccggccccatcacgcgccgacaggacgcagcttgcgccggccccgccgaaaataaaggccgcccggaaggattgcgggcagatcatcaccgcccgcgcccgtttcagtgtgttgatgcgatcactggaatgagccggccccagcatgtcctgcaccgtcagcgttgcacggtcgacaatcgcctgctgctcggactgcgcgtgcgcttcagcggacaaaccaagggaagccatacccagaaacaccgcaagcacatagcgtaacatcaagcaatctccgcatcttaagagacgaaattgcagcagtttcgcatctttttggcaaggttgggccgaatctccacccaccttcctgcctttttcaaccagcgccgtcatgggaatggtaaaaccacacatggccgaaagggacagaggttcgtttaaaatatgatggtatcgtgtgcagtaataattccaagagcgagaaatctgttttaatctggctgcaatgaaccttttattctccgtcgggcggcacgttgttgccgatgcaggcaaccatgccagacagtatccccatgcctgatccgcagcggtcctttctgcgacgtgcgcacgccgccatgcgggacgactggtccggcagcaccggttctgcgcccgctgttccgaccctgcccggactgccgaaattccatcaggccagcctgctggtagtcggcgatgtcatgatggatgaatacatcagtggaccgatgcgggatggcttgcaggaaccgtccctgcgcgtactgcgcgctgatgaggaaatggccgttccgggaggagccggcactgtgctgcgctgcctgaccgcgcttggggccgctgtcgcctttgtgtcgctggtcggtgatgaccagaccggctccgacctcaccgggctggtcggcagccaacccggtgtagagccctggctgctggttgagggcggccgtatcacaacccgcaaaacccgctatatggcggatggtcagcaaattctgcgcgttgatcgtgaaatccgcgaggatattcaggatcggctgagtgacaggcttctacggattgcccgcgatgccatggccgcaacctcgattaccgtactggccgattacgggaacggcctgctgtccggtccggtgatttccggtatttcgctggctgcccgcgcggcaggccgtccgctggtggtcgcccccagccttggccgctctgtgctgtttgccggggctgatattatcgtccccggcagacgcgaattatctcatgccaccgggctggcctgcgaaacgcccgagcaggtcgaaattgccgcagccgaattgcgggcacggttcgggcatcgtgccgttatggccctgcgacaggatggcggcctgactttggcagatgaatccggaacccggacccttgacaccattgcgggggaaaaagcccgcctgtctggcgtgacagaagccgtcgtggcaaccgtcagtgcggcgctggccgctggctgcgccatcgaacgcgcagcggaacttggcaatatcgccgccggtctgactgccacacgcctccgtcccaccaccgtgccgcaacctgccgagctggccgctgccatagcctgacgcggaaccccgctattccaccagatgggccgccatgagagaggagcgcaaatcagggtccagtgcggctgccagtctgccagcagccagacgcgcataggtcaatgtcagactgcggcgccgggccggcgccatggccctgccttcctgtgcagggcggatgatttccgcaccatggctgtcagccacgatgatcccgacatcgtccggcagcaaagaaagcggaaaatcgagatcgaccgcaaaaaacagggcatccgcataagcgtgatactctcgccacttgcgatccgtcatgaaatcgcggctgccggacttgatttcaatacagacaaagctgccgtcaccgcgcagggccagaatatcggcccgacggccattgggtagcggaacctcatgcagggcggcccaaccaagcatagcgcaaagccgtcccaactgacgacgaatatgcgcggcccgtaaaggaaagcttaactccaccctgccaaaatatcccccttccctgatggagagaagagggtttttcttttgttcctcaccccgaaggaccgcccgctttacccgatgcggctgatcagagcctgtgtcagttccctggttttggcggttccccccagatcaggggtacggatgccatcctccagggtcgtgatacggatggcattacgcaacctggttgccagatcagtcttgccgacatggtccagcatcatagccgccgccagcatcagcgccagcggattggcgattcctttaccggcgatgtcgggggccgagccatggaccgcttcgaaaatcgctgcctgcttgccgatatttccgcccggggcaagaccaagcccaccgatcagcccggcaatcagatcagacagaatatcgccgaacagattggttgtgacgatgacatcgaagcgaccgggatcgagtaccaactgcatcgcgcaggcatcgacgattctttcctcgaaagcgatacggccctcatattccttggcgatttccttgcctgcctccagaaagataccggtcagcgccttcaggatattcgccttgtggaccagcgtgaccttcttgcggccattctgcatcgcgtattcaaaggcgtagcgaataatccggtgacagcccgtgcgggtgttgaagcccgcacacatcgctacggcatgggggtcgtcaccaatcggcatataatgctcgaacgcggcatagaaaccatcgagattctcgcggatcagggtgatatcgacattctcgaaccgtccacccgggatcagggtcagcgcagggcgaacattggcgaacagttcgaattccttgcggagctgcacgttgaccgagcggtatccaccgcccgtgggagtcgtcagcggacctttaagcgccagcttgttatgatgaatactctggatcgtttcacggggcagcggatcacccacccgggcgatagccgccataccggcatattgagagtcccattcaaacggagaaccgagagcgtccagcacgctgacgacagactcgacaatctcgggaccaatgccatcgcccggaatgagggtggccgggattttggtagtctggctcattcgcctgctctcctgcacgtccgtgacgggcgattgtaccagaaggcatgcaaaggggaatgaccgggaggtaatctaggccgtctcttcctccaacacgctcaaatcctgcgtgtgctccggccctttcaaggcgaagattgcggaaaacagggtcgatgccgcaatattcaaaatcaacgcatagaccgccgcatagcccggaatcgtccagctacccagatgtaatccgtatgtggcgcccttgaagccggtttccgccaccatccatgtgcctgatacgattcccacagcccatccggccagcaaaggccaggaacggaagaaacgactgtaaagccccagaaagatcgggggtgccgtctgaatgatccagaccccacccagcagttgcaactggatcgcgtaatctttcggcatgaaaatgatgaacaccagcgcaccaagcttcaccagcatggaaacgaatttcgcgatccctgcttcctcggcatcggtgcaattgggacgcaggaactcccgccagacattgcgggtgaaaatggccgccgtcgcgatagacatgatcgctgccggcaccaatgccccgatggcaatggccgcaaacgccacgccgacaaaccaggagggaaaggatgccttgaacagctccggcaccgaaagctggggtgaaacagtcagtccgacagcaatcgccatgaaaccgagcaaagccaacagtgccagcgtaaaggaataggccggcaggattgccgcattgcgccggatagcatccggactgctggcactgagcaccccggtcagagagtgcggatacaggaacaaggcgatcgccgaaccgagcgccagagtggcgtaaacactccagtctcccagagagtccgggcccggcgttgccagcagcagtttctgcgacgggatatgcgcgaaaatctgcccgaacccacccagatgcatcggcacgataatcgcggctgcaaagactgtgatgtagatcagcagatccttgaccactgcaatcatcgccggggcacgcaggcccgatgtatatgtgaaagcggccaggatcagaaacgcgatgatcaatggcatatcgccccacaagccagtgccgtgaaaaccgagcgcaccgatcacgacctccataccgacaagctgaagcgcgatataaggcatagtggccaacaagccggttatcgcgaccgccagagacagccatcgattaccgaaacgtccccgcacaaaatcagcagcggtggtgtagccctgtcgatgcgccaccgtccaaagccgtgggaataccagataaaggatcgggtagatcagaatagtgtagggaatggcgaaaaagcccatcgcgcccttgccatacatgaaggccgggaccgcgatgaaagtataggccgtatagagatcaccccccagcagaaaccaggttacgaaggttccgaaacgcctcccccccaggctccattcatggagttgattgagatcccccgcccgccagcgggccgcggcaaatcccagcagtgtcacgaatatgaacaggcctatgaaaatgcctgtcgcaacccaatccatcttacggcatctttctcagtgatcagccttatgatcggctacgtgctcggcacgatatacgatggccgccaaaatcgcggtgatgaacacccaagccgtctgataccagtaaaaaaacggcaccccaccaagggatggctcgatccggttgtaaaacggaaccgccagcatggcgacaaagggcagcaaaaacagaagacgaacaggatgcgcacgatgccgaacaggcttgctcgacggagtgagggcagaaggcttggtcattgatcaggcagccttagccaagctctgcgtctgcccgcccgcgtccttgccaacaggctgccgaaggaaatgcttgcggcggcgctgcatcaaagcccatgccagtttggtcgacaaggtggataaccgcccatgcggcatcagccccactgacttgaataccattccggtggcccgctgaatgtgatgataacgataatagcccatcgcctgactcatataagcggcaatacagcgctcatgactatagggggtgttctcggcctcgtttccgcagtgataagcgaaggccaattcatcatcctcgctctcaccaatgcgcccggcggcaatgcgcaggcggctcagaaagccgatcttctcccgatccagataacgccgcatatggtcatagaacaatttgaaatggcgatattcgtccgccgcaatcagcttacagatatgcttcagaaccggttcctctgtcgcatcgccgagcgcagtgtaataggaggaggttcccgtctccaccatgcatcgggcgatcagctcaccggtgcgggaaccacggattgaggcatttgcactgagatcaatctggtagccagccttatagcgggcgaaggcagcctcataattccaatccgggtcggcgaggctggcccattttcccagcgcatccccgtgctgaacctcttccaccgcccagcgatccgccgccccggaaaagtccggatcatcccggaacacaccgttcagatacacagcgtagtcagttccattgcgctcgaccattgccgcggccttgaccagcggcacaatcgccggatcaaccagagccgggtcgaaatccgaccagggcacgtcttcaatacgccaatgcttcatggagatatccgctcaactcgctttgccgtcagtgtttcttcaacaacgcgcagcagaccgaaattatagccgcccctgcccggtgcaatggtcattcggcaaatacgatcaccacctgtggcatgaaggccgcaccaccggcgcgacaccacagcataaaaagacaagaaagccccggccaaatggccgaggctttctaaacgccatgtgtgccaacaccaaggttgatcgctcagtgtctggcagcctcaaccatggcccgcgccgcctgtatggactccatggctgcatccaaggccgtgatatcaagcttatcgaccgtggcataagccgcttccgcatccgccaaacgcttttcggcctcagttgctgaaatctcggcgaccggccgcgcctgatcggccagaaccgtgcaacgctctggcgtgatctccgcgaacccgcccgcgacataaagccggtcggtcacctggccattctggtaaagccggatggtgccgccctgaagcagcacgatcatcggggcatggccgggcagtacgcccagctcaccctccgcagccgggatcacgaccatgtccacggatctggacaggagacgcttttccgggctgacgatttcaaggctggtctgggccatgggatcaggccttcgccttcagcgcctcggccttcttgcgggcatcctcgatggtgccaaccatcaggaatgccgcttccggcagatcgtcatgcttgccttcgacgatttccttgaaggagcggaccgtatcttcgatgcttacgaacacgccgggggaacccgtgaagacttccgccacatggaagggctgggacatgaagcgctcgatcttacgggcacgggccacggtgagcttgtcttcttcagacagttcatccatgcccagaatggcgatgatgtcctgcagtgacttgtaggtctgcagaatacgctgcacatcgcgcgccactttgtagtgttcctcacccacgatacgcggatcgagggagcgggaggtggagtccagaggatccactgccgggtaaatacccttttcggagatcgcgcggttcagcacggtcgtcgcgtcaagatgggcgaaggaggtcgcaggcgccgggtcggtcaggtcgtcggcgggaacataaatggcctgcaccgaggtgatcgaccccttcttggtggaggtaatgcgttcctgcagcgcgcccatatcggtcgccagggtcggctgataacccacggcggaaggaatacgacccagcagcgcggacacttcggcgccggcctgcgtgaagcggaaaatgttgtccacgaagaacagcacgtcctggccttcttcatcacggaaatattccgcgatggacagaccggacagcgccacgcgcgcacgggcacccggcggctcgttcatctggccatagaccagcgccaccttggagccttcggtggtgttctcaccgagcttgatgacgcccgcatcaatcatttcgtgatacaggtcattgccttcacgggtgcgttcacccaccccggcaaagaccgacacgccaccatgcgccttggcgatattattgatcagttcctggatcagcacggtcttgccgacgcctgcaccaccgaacagaccgatcttgccgcctttcagataaggggcgagcagatcgaccaccttgatgcccgtaacgaggatctcggcggaggctgcctgctcttcaaaagacggggcttcacggtggatggagtaggtcttcttggcatcgaccggaccacgctcgtcaatcggctcgccgatgacgttcaggatacggccgagcgtgcccgggcctaccggcaccgtgatcggacgaccaaggtcttcgacttcggcgccacgcaccagaccatcggtgctgtccatggcgatggcacggactgtgcgctcgccaagttcctgtgcgacttcaagaatcagggtgcgatcaccgatccgggtctgcagcgcattctggatgaaaggcagttcgccatcgaactgcacgtcaaccacggcgcccagaatctgggtgacccgcccgacattgttgcttgccatctgcggctctcctctttcgcggatcggctacagcgcttcggcgccggagatgatctcgatcagttcacgtgtaatattggcttggcgcgtgcggttataggtcaaagacagacgcttgatcatgtcaccggcattgcgggtggcattatccatcgctgtcatccgcgccgcatgttcgcccgcagcgctttccagaatcgcacgatagatctgaatggccagattctgcggcagcagcttggccagcagggtttcttcgtccggctcgaactcatacaccgccttggcaccgttgctggatgcacctgcatcagccggagccgcctgcggtacctgcgccggaataagctgtgtttcgccgggagtctggctgatcacggagttgaagtgattatagaccagcgtgcagacatcgaattcacccgcatccagccgcgccgtaatctgctgcgagagggccagcgcatccgcaaaagcgagcactttcttccctgccagcgaggtttcaggcagcagacgggtctccagatcacgacgcaaatagtcacgcgccttgcggccgacggtaagaattttcaccgtcttgccttcggattccagcctgttggccagcgtgcgggcagcacggcccacattggtgttgaacgcaccggccagaccacggtcagcagaaatgaccaccagcaggtggaccttatcctgaccggttccaaccagaatgcggggggcagaagggctgcccgccacgttatcggccagcgccgccagcatgcgctgcatcagctcggcataggggcgcgcggcctctgctgcctgctgagcacgtcgcagcttggacgcggccaccattttcatggcgctggtgatcttttgcgtcgatttgacgctggtgatccgtccccgaagcgccttcaggctcgccatgtcctgggcttcccttcgatcagacggtgaagtttttgacgaagccttcgaggaagctgcgcagcttcgcctcggtttcgctcttgacttcacggtcgttgcggatggcgtccagaatgtccttctgcgcaccacgcagctcagccaccagacggcgctcgaactccacgaccttgtcggtcggaatagcgtcgagatatcccttcacaccggcaaagatcaccgcaacctgcaattccaccggatacggtgtgaactgcggctgcttcagcagctcggtcagacgggcgccgcgggccagaagcttctgggtggaggcatcaagatcggaagcaaactgggcgaatgccgccatttcgcgatactgggccagttccagcttgatggagccggcaacctgcttcatcgccttgatctgggccgaagacccgacgcgggagacggacagaccgacattcaccgccgggcggatgcccttgaagaacagttcggtctcaaggaagatctgaccatcggtgatggagatcacgttggtcgggatgtaggcggacacgtcaccggcctgtgtttcgatcaccggcagggccgtcagagaacccgcgccatgcgcatcgttcatcttcgcggcacgttccagcagacgggaatgcaggtagaacacgtcacccggataggcttcacgtcccggcggacgacgcagcagcagggacatctggcgataagcgacagcctgcttggacagatcgtcataagcgatcacggcatgcatcgcgttgtcgcggaagaattcgcccatggcgcagccggtatacggggccaggaactgcatcggagccggatcggaagcggtggcggcgacgacgatggagtattccatcgcgccctgctcttccagcgtgcgcacgatctgcgcgacggtggaacgcttctgaccaaccgcgacatagatgcaatagagcttcttgctctcatccgtgccctggttgatcggcttctgattgataaaggtgtcgagaatgacggtggtcttgccggtctggcggtcaccgatcaccaattcgcgctggccacgtccgatggggatgagcgcgtcaaccgacttcaggccggtctgcatcggctcatgcaccgatttgcggggaatgatgcccggggccttcacctcgacgcgggtgcgggtcacatccgtcagcggacccttgccgtcgatgggattgcccagcgcgtcaaccacgcggcccagcagaccacggccaaccggcacgtccacgatttcgcgggtacgggcgacggtgtcgccttcgcggatctggcggtcatcgccgaagatcacgacgccgacattgtcattttccaggttcagggccatgcccttcaacccggcggaggggaattccaccagctcaccggccatcacgttctgcaggccatagacgcgggcgataccatcgccgacgctcagaacctggcccgtttcggccacattcgcttcgctatcgaaggaagcaatctgagatttaaggatttccgagatctcggcaggacggatgtccatcaggcggctcccttcatggcgtactgcaggcgctgcagccgggatttcaggcttgtgtcatacaggcgcgtaccgatccgcacgaccagaccacccagaaggctggggtccacgtgcttttcgatgcgcacattgccgtaaccggcttcgatcaggctggcgcggagctgatgctcctgcacctcggtcagttcatgggccgattcgaccacggccacggcctcaccacgcttctctgccaccagcaccgcgaaggcgctgataatggagcgcagtgagccgaggcggcggttattggccaccgtaccgacaaaattgcgttcgatgcgggtaaaaccctgccggtcgagcacggccagaacggcatcccgagcacggttgacatcgacaagaggactgccgagcaggctgcgcagatcggcgctttcgtcgatcagccgcccaagggcctcgatccgggcgataacgccatccagatcgccgctgtccccggcataagaataaagtgcggaggcataacgcttcgccaagccggacacagcggtgccggacacatgcttcgcttcccgctgcgggatgccggttacggccgcgccgctttcatttgcgccattcgaggccacggtctcgctttctcgctggtgttcctctggaaccggacccaacctcccggctccggcggtggccgtctagcatgcagataacacccgtgcaacagacatgaccggaatgatcgtgctctgaatgacggttttacgaccgaaaaatgccctgtcatgccctgaattttgtcaccacgcacgggccaacaagaaaaaagtcagtctttataacccgttacagaaacgacacgggatcgacatcaatttcaatgcgtgctccacggggcacagtcatttcctgaagccaccggcgcaggatgggttggaccgcaatcgtccgacgggtccgcagcagcaaacggcgacgatgacgcccgcgcagcacggcgagcggcgccggagctggccccagaacccatataccgtcaccatccggtgcattgcgcgcaaggtccagcgcgagccggtcggctgtggccgcatcgtcggcactgacgatcagggccgccagcctgccatggggcggccagtaccctatgcgccgaatctccgattctccctccatgaacgctgcgaaatcattgttgagaagcgcctgaatggccggatgatccggattccagctttgcagaaaaacatgcccgggcgcctctgcccgtccggcccgcccggcaacctgatgcagcaactggacggtgcgttccgaggcacgcagatcgccgccgccaagcccgagatcggcatccaccaccccgacacaggtcagatggggaaaattccagcctttcgcgacaatctgtgtaccgatcagcagatcaacctcccgcgccgccacccgcccggctgcctcggccgccgcggctggcccgggcaaagtgtcactggccatgaccagcacccttgcccccgggaataacgtggcggcttcctcggtgattcgttccacacccggaccgatcgcggtcagagcatgttcggcgccacaggacgggcaggataggtgcaccggctcctcatgcccgcaatgatgacagatgagctgacggcgcaaacggtgttccaccagccaggccgtgcaatgcgggcactgcatccgcgtcccgcaggcccggcagagagtaagaggggcgtaaccgcgccggttcaggaacagcatggcttgctccccccgctcaaacgcctgcctgatcgccgtcaccagaggcggggacaggaaatgattgcgctccggcggatgggagcgcagatcgattgccgtgaccgaaggcaaccgcgccaccccatgccgcgcccgcaggctcaggcggcgatagcgccccgactcgacattcgccagagtctccagactcggcgttgccgaaaccagcagagaggccgcctgctcgaaccgcgcgcgcaccaccgccatatcccgcgcatgatagatgatgccatcctcctgcttgaaggcggtttcatgctcctcatccaccaccaccagccccagattggagaagggcaaaaacagggcggagcgcgcgcccaccaccaccttcgcctctccggatgtcactgcccgccagcactgacggcgcgtcaggctgctgagatcggaatgccagatggcaggctccacaccgaaacggcgacggaaacggtccagccactgggtggaaagcgctatttccggcagcagaatcagggtctgccgaccgcaggtgagagcctcggcaatggcttccagataaacctcggtcttgccggagccagtcaccccctccagcaacgtcaccgagaaagtgtgcgccctgaccgcttcccgcagagactccgcaacctctgcctgatccgccgagagatccggcactgtgaaggcagactccggcactccatagcggctcggccggaccatcggcacctgttccagcaaaccctgcgagaccatgttcctcagcacggcactgctgatctcaggcaaatgctcccgcacggcctgtgacgtcatgggggtgccatccgcgagcagggccatcacctgccgtctcgcctcggtcagcctgatcccctccggcggggaggctaccagttgcaaccctgttacggcccgttccggacgcagcgcgttgatcctcagcgccatcgccatcacctcaccggggggagacagcgtatagcctgcgacccaatcgatgaaacgacgcagaggggcaggcaaaggcggcgcgtccagcaccgccagtagcggcttcagacgatgatcagggacatgcctgccagagccagcggatgattgtgtggaagccgccccggcaggaggggttgcctcatcccagaccacgcccacttcttcccgccgattgagcggcaccaacacgatatcacccggctgcggcgccagatccggcgggaccgcataatcaaacgggcccggaaatggatagggcaacatgacctgtaaacgtctcttccggtcggcactgctcatcctgtaccatcgcacggcgtgacaacgctgaatatatgggtgttatctgtttgcagagacagcttaccggctgatggcgcatactgacggatggcagagccatccgatcctccttccttagcgaaagccaatggattctgattgcattgatgcttttcttcgtgctcatcctgactggctggcagggcgcccggacctgtacgccagcctgtcaccgccacgacgggtgcatggggatacgctcgccgatcacatgcaggcacgtattgatgccgagcgtgtccgttgtgaggtcgcctgcaatgcagcccgcgatatccttcaggccagccgtgcctctgcctgtctgacaacgcgtatccaacgctcggtcctggctctgttgcgggcatcagatgccatggactgtattcttcaggaactgcccagcctgctggggattgaatatacccgcctgtattatccgacttctcctgcccttctgactcccatggtctgcgaacgggcaggggttgagccaatggcccgcaccgccatgagtgccctgctgggagataaggatgtccagatccgcagcctgacaatccccgatctgacgctgcatcgggaaacagcccccctgatccggcaggatgcgctgctactgctgcctcgcacatcatcaccatccccctggctgatggtactggcggcgcggaacagggaggaactcgctgcccccaatgcccgtcaggcgctgcgctttcttgctgaggccacttcctccgccctggatcgggatagcgccatccagacagatcagcactgacaatgatggcagaacaggccagacgcgactggatcgactggctgcgggatgaaaagcgcgcagcccccctcacctgccgcgcctacggtgatgatgtcgccgcatttctgggctttctggccacgcatcaaggggccgagccagatatggcaatgcttggtcggctgggtctgtctgatttccgggcctggctggcttctgaggccgtgaagggagccggaaatgcgaccagagcacggcatctggcctcaatccgcagttttttccacttcctgcgccagcgccacgcccttgagaacagcgcgctgcccctgctgcgcaccccgaaggccaagcctcctttgcctcgggcgcttgatcagacccaggcattggcggcagcccgcgacatcggggaggccagcgaaaacccgttcacacaggcacgggataccgcgctgttcgcccttctctatggctgcggcttacgtctgggcgaggcgctgggcctgatggtgggggacagccaacacgacacactccgcatcacgggaaaaggggggcggcagcgcatggtgccggtcatcccctcggttcgaacatccctgtccgactggctgcggtttcatcctgtcccggaagcatccgctccgctttttgtcggtgtgcggggagcacggctcaatccaggcgttgcgcagagaaccctgcggcaattccgtaccctgtataacctgccggaacacgcaaccccgcatgccctgcggcacagctttgcaacacatcttctggcggccggggcagatttacgtgccattcaggatctgctgggccatgccagcctgtccactactcagcgctacacccaggtggatcaggcccagttactggccgtctggcagaaagcgcatccgcgggccggataagcccccttcaggaactctgaccggcattctgctcagtcatcatcctgtttgctgccttctttgctgccttcccccgatttctcatgcggatcgacaagggcaaacgaagcggacacagccagtaccttgcgcagttcagtcaccggaacattggccgtagcatccggagccgttgccatagcccgcatcatgggcataggcgcatgggagggagcgttgatgacctgatcgctgatcatcaaaggcgccccaattgtcataccaacaccagaggccattgctgccgcccgttcctttgcatcagccgccgccttgggcaaacactccctgatcgcggcctgccatgtcatatgggaaataccaggatcaatcgccccgacctcatcaatcctgtttttggctgccaaaggagcaacctcggccagacgggcgacactcgtggtcacgatatgcagcgcaccctgcgcacggtaattacgcaaaatgcgcttgccgtgatcataatcatattccggcgcaacagagaccccgctgccgctgagtttcacatccggcagattcaaagccttcacggcctccagaaacgcattgaaccgcttggtcgcatcacccaacacagcattcacatcactgccggaggcagcaacagtcacggaggtcgaggcctgatccggcgtcatcaccatggtacagcgcccggtcgccattacttgcggcggttttttatccgccagagcgggctgggccgccagaacaacaggaagcaatgccgcaacagggtacagatgtgctctcttgcgtagaaaagacgtcaaagtcttcatatcaacttgctccttcctaaaaacaaccaaagtaccgacctgctcgcggctcctcatgcagcgatggcacgatccatcgccagacgcatatcacggatggcctgccccagaccggcaaacacggcttcagcaatcagggcatggccgatattcaactccctcacccccggaagctgtgcgaccggcgtaacattatccaccgtcagaccgtgaccggcatggcattcaagcccgagatcacgcgccattgatgcagccccctgcaaacgtgccagctcatgggatgcatcagcctccaacgcataagccccggtatgcagttccacaaccggcgcacccagcgccaccgcagcacgaagctgccgcggatccggatcaatgaacagtgacacacggatgccggcatcacgcaacgcagcgattttcggcatcagcgagacgatgtgaccggctgcatccagcccaccttccgttgtcacttcctcacgccgctccggcaccagacagcaggcatggggacgcaggtgacgggcaatgccgaccatctcatccgtcgcagccatttccagattgagcggagcacggatcgccgccatcacctgtgtcagatcggcatcacggatatgacggcgatcttcccgcagatgcatggtgatcccgtctgccccggcctccaatgccagcagtgcggcacggaccgggtctggctccgtgccgccgcgcgcgttacggatcgtggccacgtgatcgatattgacgccaaggcgcaaagcatgggagccagggtcggtatcgggcatcgcgtgttctctccgtaacgatcagccgggatgaagcagcgttatagcagcctgctacgaacccgtcgccatctccgccgccagatgcagggcagccatcaggctgtcggcctcggcaatgccacgcccggcaatatcaaatgccgtgccgtgatccggcgaggtacgaatgatcggcaggcccaacgtgacattcaccccatgacgcatatccagtgtcttgagcggaatcagggcctgatcgtgatacatgcagagagccgcatcataattctggcgggcagtatcggtgaacattgtatccggcggataaggcccgaggattgtatggccttcctggcgcagacactccatggcaggcgcaatgatcgtctgctcttcttcccccatcgccccgctttctcccgcatgaggattaagaccggctatcgccagacggggggagggcaaaccaaaacggctcttgagatcatcaatggtaatccgggcggtctgcacgatcagatcggtcgtcagcatgtccagcgcccgccgcagggaaacatgcacagtgacaggaaccacgcgcagcagaggggatgccagcatcatcaccggcgtgcctccggtcagtgcgcccagaaactcggtatgaccgggaaaagcaaaaccactgccatacagcaccgccttgctgatcggattcgtgaccacagccgccgcctgcccggcctgcacatgccgtactgcctgctcaatagaggcaatcactgccggcgcattggcctgatcaggatgtcccggcatgacagaagcagcaagcgacaatggcagaaccggcagtgcatcggcaaaacagcctgccgcatcagcgggtttgtcaatcacgcacaatttctgcgtgccaaacaaagcgggatcgccgatcacatagaaaacagggccggtccgacgcaggcgctgccatgccgtctgcgtaatctccgggccgatcccggccgggtctcccatcgtcagcgcaagcggcaggaccattgtatgactctttatgatctgatcagcaaaaatcagatatgaatcgcacgaccatcaaccgccagagccgcttccttgaccgcttcgctcaggctgggatgagcatggcagatacgggcaacatcttcgctgctggcgccgaactccatggctgttgccagctcggcaatcagcgtgccggcatcaggcccgagaatatgcgcacccaaaagacgatccgttctggcatcagcgaggattttgacaaacccgtccgtatcgcccatcgcgcgggcacggccattcgcggtgaaggggaatttgccgactttataggcaattcctgcggctttcagttcttcctcggtcctgccaagcgaggcgacttccggccatgtataaacaacggcgggaatcacatcgtaattgacatgcccggcttgtccggcgagcatttccgccagcgccacgccttcatcctcagccttgtgcgccagcattggtccggcaatggcatcgccgatggcgtagagaccatcaatattggtggcaaaatgcgcatccgtccgcacacgaccgcgctcatcacgcacgacaccaatgtcatccaacccaagcccgtccagataaggccgacgcccgatcgccaccagcacgatatcggcctgtagcgtgtcagtctcaccgcctttggccggttccagtgtcagggtcacgccaccctcatccacctgcgcaccggtcactttggtgccgaggcggaaggccagaccctgcttttccagaatccgctggaaggctttggcaacttcctgatccatacccggcacgatgcgatcgagatactcgatcaccgtgacctcagcccccagcctgcgccagacgctgccgagttcaagaccgatcacaccaccgccaatcaccaccagatgcttcggcaccgcaggcagggacaacgcgccggtcgaggtaacaatcctcacctcatccaccggaacccccggcagtggcacgctttcgctgccggtggcgatcacgatatgccgggcgtcataactctggccgccgacctcaaccttgccgggcgcgctgatgctggcggcccctttcagccaggtgaccccgttcttgcggaacaggaattcgatacccttcacgttggcggagacgacttctgccttccgtgcctgcatccgatccagatcaagggcaacgtctttcgcctgaatgccgtgctccgcgaactgatgcagcagggcgtgataattctcgctcgactgcaacagcgccttggagggaatacagccgatattcagacatgtgccgcccagcgtctcgcgcttttcaacgcaggccactttcagcccaagctgcgccgcacgcaccgcacagacatagccacccggaccagcgccgatgacgatcagatcgaatgcatcgctcatgtcacaacaatcctacagacccagcagcagacggcgcggatcctcgatcccttccttgacccggaccaggaagctgaccgcctccttgccatcaacgatccggtgatcataggacagcgccagatacatcatcggcctgatctcgatttttccatcgaccaccacagggcgatcctgaatcttgtgcatgccgagaataccggattgaggcggattcaaaatcggcgtggacatcagggagccatacacgccaccattcgtgatgctgaacgtaccgccggtcagttcgtccagtttcagcgccccatcccgggcgcgtttgccgaaatcggccacgcgctgctcaatctgcgcgaaatccaggctgtccgcatcccgcagcaccggcacaacgagaccgttggagccgcctaccgcaatccccatatgaacaaagttcttgtagacgacctcatcaccgtcaatctccgcgttgacggccggaaattccttcagcgcgctgacgcaggcacgcacgaagaaagacatgaagcccagccgcacaccggaatgcttcttctcgaaaagatccttgtattccttgcgcagtgccatcaccgccgacatatccacctcattgaaggtggtcagcattgcggccgtgttctgcgcttccttcagacgctgagcgatcgtgcggcgcaggcgggtcattttcacccgttcctcacgcgccgcatcctcggctaccacgggagcacgctgggctgaaaccggcgcagacggtgctgccgcaggacggctgaggaaatccagcacatctcccttggtgatacgtccatccttgccgctgccggaacccagcgcagaggcatcaacatggttttccgtcagcattttctgcgccgcaggcaagggagcagggccgttttcacggatgctgggatcgctgaccgcaggcgggtgcgcagcaatatcagccggaggcgtcgccggacgagaaacggggccggacgggcgtggcggcggattgataccgcttttcggattggccgcagcctccgtcttcaccggctcttcctttgctggcgcaggagcagacggggccgggcgggaggcggcatccccttccccatccccctctgcgcccagttcacccagcacggcacccaccgacacctcctccccctctgccgcgaactgggccgacagcacgccagcggcaggcgcattcacctcgaccgtgaccttgtcggtttccagctccacaaccgcttcgtcggcggccacggcgtctccagcctttttcagccatttcgcgacaacagcggtggtgacgctttcgccaagagaaggaaccttgatatccgtcggcatgcctgtctgatccttgtcaaaaacgggtgcggcagcatcgcccacaaggggcatgttacaggggcgcattacagggcgcgtgtcggttaatccggatagccgatcacatcataggaaaaaagcggaagcgccgatgacggatgaagattttttacccgtcatcaggctttcgtcatcgtcaggagatcagccccagcgcctcacgcaccagcctgtcctgctgagcctgatgcaccttggccagcccggtcgcagggctggctgcctcggcccgcccaacataggagggacgggtcgccttgccgccgatgctgttcagcaccgcttcgatcttgcgatcgacgaaagtccaggcaccgttattggcggcttcttcctgacaccagatcacatccgcattgctgtagcagcttatgacgcgggagaggctgtttttggggaatggataaagctgctccagacggatgatggcaatgtcatcgatcccggcttcacgacgctgggccagcagatcgtaatagactttgccggagcacatcaccacgcggcgcactttctccggcgcaaccagcgtatcgatttcagggatcacggtctggaacgccgtatcgccggtcatctccgccaggctggagaccgccagcttgtgccgcagcagtgatttcggcgtcatgatcaccagcggcttgcggaaattccgcttcaactgacgacgtagagcgtggaagtaattcgccggggtggtcagattacacaccgccatgttccgctcggcacagagctgaagataacgttccagacgggcagaggaatgttccggcccctgcccttccatgccgtgtggcaataacaaggtcagacccgacatgcgcagccatttcgtttcgccgctcgccaggaactgatcaatgatgacctgcgcaccgttggcgaaatcaccgaactgcgcttcccacaacaccagcgtgcgtggatcggcaagagtatagccatattcgaagcccagcacaccggcttccgaaagtagcgaattatagatctcgatccgtgcctgctgcggggcgatattgttcagcggcacatattcgttctggttttcctgatcgatcagaaccgcatgccgatggctgaacgtgccacgctggcagtcctcgcctgaaagacgaacccgatgcccttccagcagcagggagccaaaggcgagtgcctcgccggtggcccagtcgatcccctcgccgctctcgatcattttctgttttgcttcgagttgacgggcaattttcggattgactgcaaagccttccgggatatggctcaacgcatcgccgaccagttccagggtttcatgcggcagggcggttgcttcatcaacgcgatcatctttcgcgacatcctgctgcatgccggcccagtggccttccagccagtccgccttgttgggcacataggatttcgcggtgctgaaagcctgttccagagtatcgttaaaagaatcccacatccgacggccttcatcggcagaaacgacaccccgctccgccagggcttccgcatacagagtacgggtggtcttgcgggcgcggatggcattatacatcagcggctgtgtgaaggcgggctcgtcggtttcgttatgtccgtggcggcgataacagacgatatccagcacggtatcgacaccgaactccatccggaaatccgtgaccatacgggcacagaaagcaaccgcctccggatcatccgcattgacgtgcagtatcggtgactgaatggctttcgcgacatcggtacaataaagtccggaataggcatgtgccggaacagtggtaaatccgatctggttattgaccaccacatgcaccgtgccaccagtgcggtagccaatgagctggctcatcgccaaagtctcatagaccagtccctgaccggcgaaagcggcatcaccatgcatcaggatgcccatcacggaacgccgctgtctggtatcccccgccatatcctgccgggcgcgtaccttgccgacgaccaccggatcaacggcttccagatgggacgggttgggctgcaaggacagatgcaccgtgtgaccggcgctctcgatatcggcagacgtcccgagatgatatttcacatcccccgatccctgcacgtcgtcgggtttcgaggctgcccctgcaaattcgctgaacacctgcgtgtaaggtttgcgcacaatgttgacgagcgtattcaagcggccgcgatgcggcatgccgatcgcgatttcattcacgccctgtgcagctgcattggcaatgatcgcatgcagggcgggaatcattgactcgcccccttccagaccaaaccgcttggtgccgacatatttcttctgacagaagacttcgaaaccttcagcttccgtcaattgctgcaacagagtacggcgatcctgatcggtaatggtacggcgccagtatcctccctcaatcctgcgctggatccagcttttctggcgcggatcctgaatatgcatgaactcgacgccgatcgggccgcaataggagcggcgcagaatatcgacaatttcccgcacggtcgcagtttcacgccccagcaggccatcgatgaagaccgggtgatcaagatcggtttcggtaaaaccatagctgcgtggatcgagttccgggtgcggagcaggcacctgtaaccccagcgggtccagcctcgcctccagatggccgcgcacacgataggcgcggatcatcatcagggcacgaatactgtccagcgtggcagcccgcacgctgtcacgcggagattcttccgtgatcgtgctggtggatgcttccgtgacagattctgccgcagcactgccttcatagaccgaggcaaccttgtgtgggcggggtgcccatgaagcaccctccgtctcggccagaacagcccgttcctcatcacccagggcttcgaacaggcgcgcaaagcttggatcaacagaaccgggatcagaggcccatcgcgcatacatatccgcaatgaaagctgcatttgcgccgctgaaggcagaagccaacacatccacgccagccatggattactctttccatttcaacaaaccgatccccctgatcggcttatgacttgatcaatttatatgatgacatttatccggcgtcgttcaggcgcagagaaaggacagcattgtccaatacgcatgcggcgcggcgcgccgcaaaaaagtccttatcgcttcaaggctttcagcattgtctcccccagggttgagggactttgcgctatatgcacgcctgccgcgcgcaaggcgttatactttgcctccgccgtatcccggccgccgctgatcaccgccccggcatggcccatgcgtcgaccagggggagcactgctgccggcgataaagccgaccaccggcttatccgcaccgctggcgatcagatactcggccgcgtgaatttcgctctgcccaccgatttcaccgatcatgacgatggcctcggtctcggggtctttgaggaacatctccagcacctcgatgaaatccgttcccttgaccggatcaccgccaataccgacacaggtgctctgacccagccccgccgccgtggtctgcgccaccgcctcataggtcaacgtcccggagcggctgacaatgccgatgcggccgcgcttgtggatatggcccggcatgataccgatcttgcacgctcccggcgtaataacacccgggcaattggggccgatcaaccgcgtatgcgtgccctccagtgcacggcgcacgcgcaccatatccagcaccggaataccctcggtaatgcagacgaccagaggcatgcccgcatcaatggcctccagaatggcatccgccgcatgcgggggcggcacatagatcaccgaggcatccgccccggtgcgctcccgcgcctccatcaccgtgtcgaacaccggcagatcgagatggcgggagccgcctttacccggcgtcaccccacctacgacctgagtgccataggcaatggcctgttccgtgtgaaacgtgccctgcgcaccggtcagcccctgcaccagcaggcgtgtatgcgatccaatgagaatggacatcagcctgcctccgccacagccgcgacaatcttgcgtgcggcatcgtccagatcatccgccgccacaatcgacaggccggactggttcaggatcgcccttccctgctcgacattggtgccttccagtcgcaccaccagcggtacggacaggctgacctcccgcgccgcggcgaccacgccttccgcaatcacgtcgcaacgcatgataccgccgaaaatattgatcaggatgccttcgacattcggatcggccagaatgatcttgaaagccgccgccacacgctccttggtcgcaccgccgccgacatcaaggaaattggcgggctttgcgccgtacagccggatgatatccatcgtcgccatggccagaccggcgccattgaccatgcagccgatcgtgccatccagcgcgatgtagctcagcttgtggcgtgcggcttccagctctttcgggtcttcctctgccggatcgcgcaggcgttccagctccgggtggcgataaagggcgttgtcgtcgaaaatcactttggcatccaacgccagcatgtccccgcctttggtgacgaccagcgggttgatttccaccactgcgcagtcgagcgcgatataggccttgtaaagcgccttcaccatccggccgaacgaggccagttgcatcccgctcaagcccagccggaacgcaatccgccttgcatgaaactcggacagacccatcgcgggatcaactgttacccgcacgatccgctccggtcgcgaggcggcgacctcctcgatatccatgccgccctcggctgaagcgacaatggtgacgcgggatgtatcgcggtcgaccagcagggagaggtacaactcccgctcgatctcgcaaccggcctcgatatagacacgatggacgcgtcgcccggcagcgccggtctgcttcgtcaccagaatctggccgagcatcgctgccgcatgctcgccagcttcctcgaccgaagccgccaggcgcacaccgccgcggccggactggctgtgcagaaaatgccccgctccgcgcccgcccgcatggatctgtgccttgaccacatagcgtggccccggcagccgccgtgctgcttctctcgcctcgtccggggtccaggccacatggccttccagcaccgggatgccaaactccttcaggagttccttggcctggtattcatgaatgttcacagatgcagctgcctatccggaaaacaggaacggccccatccgggttcaatccggaggagggccgtctttcataacaggaggataacatgcttgccgcatgtcgttgcctttcggcaatgcggattacgaaaccctgatcagccgatcagtttccgggaggctgcaatcagctccttcactgaatcacaggatttgtcgaaggcggcctgttcctgctcattcagggagatttcgaccacgcgctctaccccgccagcgccgatgaccacaggcacgccgacatacagaccgtcaatgccatactggccggacagatgcgcggcgcagggcatcacccgcttcttgtccttcagataggattccgtcatcgcgatggcggaggccgcaggcgcatagaaagcactgcctttttccagcagcttgacgatctcgccgccaccattggccgtacggctgacgatggcgtcgattttttcctgcgtggtccagcccatgcggatcagatccggcactggaataccggcgacggtagagtaacgaatcagcggtaccatcgtatcgccgtggccgccaagcacgaaggccgtcacatcttcgaccgaaacattgaattcatgcgccaggaacagacggaaacgggcgctgtcgaggacaccagccataccgaccaccttgtgcgggggcaggccgctcttctgctgcatcacccagaccatcgcatcgagcggattggtgatgacaatcacgaacgcatcgggggcatgcgtccggataccctcggccacctgagcaatcacttcggcatttttagcgaccagatcgtcacgggacatgcccggcatccgtgggaaaccggcggttacaatcacgacatccgctccggcaatcgcggcatagtcggagccgccgaccatggtgctgtcaaatccgtccaccggggcggactgcatgatgtccaacgcctttccggcggcgacaccaccgaaaacgtcgaacagaacaacatcgcccaattccttgagaccaatcagatgggccagcgttccgccaatatgaccggcaccgatcaaggcaattttgttgcgagccatagggtctccttccgagggcaatggaaaacggcccgtctcgtgccgctatgccagacaactgcccgggagccgtccggcacaagctgggtatcctgttttgccgcattgcggcaagaaacccggctacccgctccgtttatgccagaccctcgttttgataaaggcttcatactgacccataaaaaaaatttatgatcagggaatgcaagcggtctcgacgtaatcctcactctgcatttcctccagccgggaggccgtgcgacgaaaagcctcagccccctccccggcctgatacagcgcatccggctgggccgcagcagaggcaatgagtttgacccggtgatcatacagcgcgtcaatcaacgtgatgaaacgtctggccgcatcatgattgtcaggggaaagacatggcacaccatccagcaccaaaacttcaaaatgcgtagcgatggccagataatcgccgggtccaagattggtgttgcacagatggtcgaaatcggcccttgccaccccgttggcagccaacggaatggtcagcgtccgtccggatacggataaggagacagggccagccggcaccccatcactcagttccgcaaaggcgcggtccagggcggcatcggcccgtgcatcggcagggacatgccagcgtggcgtaacgcgcagtcgatcccgccgccagtcacgcgccccgttcagcgtgaccagatccagcttctgccggatcagggcgatgaagggcaggaatgcatcgcgtcccggcttgcccgcaaacagattgtcaggctccgtattcgatgtcgccacaatcaccacgccgcgcgcaaacagtgcctcaaacagacggcccagcagcatggcgtcggcaatatcgttcacctgaaactcatcgaagcacagcagaatactctcggcggcgatactgtctgccaaaggcgggattggatcagcgccacccgggttgtccatgcgccagcgatgtacgcgggcatgggcatcctgcatgaaccgatgaaaatgcacgcgtttcttgcgcgtcagcccgactgcaccgtggaacagatccatcaacatggatttgccccgcccgacatcccccaccatgtataccccacgtggcggttctgcgccctgcgcctgagcacccagcagacggctcagccagcctttccgggcgggggcgggggatggctcataaccttgcagggcctgccataaggcttgcaatttctccgccaccgccaattgcccctgatcagccgtaatgatcccggcctcggcacgggcgcgataggcgggcagcgggccaaggctcaaatcatcaccggtcatggacggctcctcttgatcaacaaagcttgatcaacaaagcgtgatcaaggcagccgatcaccgctttattcgttgacgttgcagaattgcatcaccggatctcccggagaaaagcgatgaaacatcttctgctgacaggcttgctgatagcctcccttgcaccctctgcacaggcagggactccgctggaattgtccgttcacgtgggtttctccgcggcatggccctatcgcagtacctgcatcaggtctgacggggacaccacccctccacaagccacaccggaagcaatcgctttggtaaaccatgcctgcatgcgaccggtgctggacgcacagccgctttccaccatgagcctcgacaaacccaagcgtcttctgcggacctgaccggagccggagagaggatttcccaataccgccggcatgctaggaatacagtggagaaaacgggggcccgctttaatgtctccgccacgtttcctgcccggtatgcgggtcagggtttgggagcaacgaaaagcattatggaactgaactacactgcactggatgaaacccctgtttcatcagacccgttcaaccacgtgctggtccggaattttgtgcccggccctgttctttcccgattaattccggagctaccgctgctggaaaaaggggggtcttttcccgccgaagccctgcggctgggaccgatcggcaaagaccttttcacagaactctccggccatcgtctgaaggccgcgatcgcacggaaattttccctcgatctggaggatgccgcaaccatggtcacactacgcggctggtctcgggaaaaagacggacgcattcactgcgacagtgtcgccaagcgggtgacgattttgctgtatctgaatcccgaaacagaagcctgggccaagcaggaaggctgcctgcgtttgctgcgtagcccggacgatatcgagaactatgccgtcgaggttccgccggtgaatggcacactgctggttttccccaacggccccaccacatggcacggccaccgacagttcgtggggcgacgctatgtagtgcagttgaactatatggccgacgataaggcggcacgctctgaactacgccgccaccgtttctccgcgttggtcaaacggctgaccagagccgcctgataacgtcatgcggcatcgtcacagggccggctaccagcaaaacccggccctgtgcggcaacaggcatcagtcttcctgaatcatactctgacgctttgtctccggcatcatgatgtaaacgaccaatgacagcatgatcatcatggtcacataccagaagaaataaggctcatggccgttctgcttgaaccagagcgcgacatattctgcggtgccgccaaagatcgtattggccagcgcataaggcagcgccacacccagagcacggatatgcgccgggaacagctccgccttcaccagcgcattgatagaggtatagccagacacgatcagcaatgccgccagcgacaacagaaacgcgggcagcatatcatcggtggtggcaagagcgctgaaaatcggaatggtgaatgcagttccgagcagaccgaacccgatcatcagcggcttgcggccgatccggtcggacaacgcaccgtacaaaggctgtaacagcatatagatgaacagggccagagccgtgatgcgcgtactttccggacggctgaagccagcagaattgaccagaaatttctgcagataaatcgtataggtgtagaaagcgaccgtgccacccgccgtcagcgccatcaccatgaaggcctgtttgggataaaaacggaacagcgccagcccgctggaacggcgaggctcagcctgatcacggtgtgctttggtgaaagcttccgtctccgccagtccgcgccggatgtaatagactgccagcgccagcacgccaccaatcgcaaacggaatacgccagccccattgctccagcgtctgctcactcatgaatgcctgcagaatcagttgcaccgccaacgcggtcaactggccgcccaccagcgtgacgtattgaaagctggtgtaaaatcccctgtgatcccgcccggccatctcactgagataggtagcgctggcaccgtattccccaccgacactgacgccctgaatcaggcgggccaatatcagcaggccgggcgcagccagaccgatctgatgataggagggagcgactgcaatgatcagcgagccaaggcacatcagcgttactgacaatgccagacccgctttgcggccgtggcgatccgtataggttcccataatccaggccccgatcgggcgcatcagaaacccaaccgcgaaaatcgccgccgcgctcagaagctgggcagtatggtcttccgaggggaaaaaagatttggcgaaataaaccgtgaacgccgaataggcataccaatcataccattcgacgagattcccggcagaaccaccgagaatggacttcaacctgcgtttgcgttcctgagaatctgtattccaggccataatcttggtacttccccacaatactggcgagtcttgatggccgccatttcagtattcagcccgccagaccgcatgccagtcagactggataattgtcgcccgtcattcccgacggagcaccttgtccgtcaaaaaactggataatccgcctgcaacgaaatcccgcttgagtgcgacctcgtcgtaatcgtgctttacccaatccagaaaattctgctttccctctgcctcccttgcatatcgaacaaagaatgcatccagaatcccggtgcgggagcggttgaaatgcccgaaccgccatgacagctgccgcaaggcctgtgccgcagtaccaccggtcagaacaatagccagtcccgatgccagaccagcccgatccgcccccgatttacagtgcatcagggcgggatattcgatctgctgcaggatagaggcaaagcgcaggatacggtcccgatgcggtgcaccccggctttcgaacgccatatcgacatgagccatccccagccgctgtgccgcatcgcgcgacaacgcgtcagagccgcattgccggtggccacgcagattgatcagagtgcgaatgccatgccgcctgacggcagcggccaaacgaccgggcgtagggtggttggagcggtaaaggccgggcagaacctcagcccagttatcccagacgagcctgaaaacggcatgatcgacgaagaggctgtcagcccatgcacggcggcgcgtcgcggggctggaaagatcaccagtaaacatgccgccttatagcggcacggcggaacggagggaaatgcccaccgttccgtaacgttccatcccggaaaagtccgctcaggcctgacgttcagccagcagcttcttgatctcgccgatcgccttggcgggggttcaggcctttcgggcaggtctgcgcacagttcatgatggtgtggcagcgatacagcttgaacggatcttccagcgcatccagacgctcaccggtcgcctcgtcacggctgtcggcaatccagcgatacgcggccagcagcgtggccggacccagatagcggtcgccattccaccagtagctggggcaggacgtggtgcagcagaagcacaggatgcattcccacatgccatccagttcggccctttcttcccggctctggcgacgctcggcatcgggcggcgggggcgtatcggatttcagccacggctcgatgctgcgcaactgcgcataggcctgcgtcaggtcagggatcagatcgcgcaccaccgccatatgcggcagcggattgacgttgcaggcccccttcacatcctcgatcggcttcagacaggccagcgtattgccaccatcgatgttcatggcgcaggagccgcagatgccctcacggcaggaacggcggaaagcgagggtcgtatcgacctcgttcttgatcttgatcagcgcatccagaaccatcggcccgcactgatccagatcgatctcgtaggtatcgaccaccggattattcccgtcatccgggttccagcgataaatcttgaattccttgacccgcgtcgcacccgcaggcgccttgaacgtgcggcctttgccaattttgctgtttttgggcagcgcgaattcgaccattgtccgtatcctccctgctctcagtacacgcgcttcttgggcgggaagaccgagacctcgttggtcagggtctgcattttcacggggcgatagcccagatgcacatcgccactcgcgtccacccaggacagggtgtgcttcatccagtcctgatcgttgcgatccggataatcgtcatgcgcatgggcgccacggctttccggacgggcctcggcgctgaccatggtggcggccgcgttgcccatcaaattgtccagctccagcgcttccaccagatcggtgttccagatcaggctgcgatcggtgacggagacatccgacaggccgccccacaccgtcttcatcttcttcacgccctcggtcaggctggcgctgttgcggaacacggcggcatgacgctgcatcgtgcgctgcaattcggcgcgcagatccgccacgcgggaaccaccactggcatgacgacgggaatcgaggcgatccagcgcggcctctcccgcacgcgcgggcagcggtgcgtgctgcgcgcccggcttgacgatctctgccgcgcgatgcgctgcggcacgaccaaacaccaccagatcgagcagggaattggtgccgagacggttcgcaccatgcacggacacgcaggccgcctcacccaccgccatcaggcccggcaccaccgcatcgggatcgtccgccgtcggacgcaacacttcggcgcgataattcgtgggaatgccgcccatattgtagtgaacggtcggcagaaccggaatcggttccttcgtcacatccacaccggcaaacaccttggcggtttcggaaatgccgggcaggcgctcggcgaggatctcggctccgagatgctccagatgcagcaggatgtgatccttgttcggaccgacaccccgcccttcattgatttcgatggtcatggagcggctgaccacgtcccgactcgccagatctttcgcagtcggcgcatagcgttccatgaagcgctcaccggctgcattggtcaggtagccgccttcaccgcgcgcgccctccgtaatcaggcatccggcgggaaaaataccggtcggatggaattgcacgaattccatatcctgagtcggcagcccggcgcgcagcaccatgccgccaccatcaccggtacaggtatgggcagaggtacaggactggtaggcgcgtccgtaaccgcccgtcgccagcaccaccatatgcgcccggaagcggtgcatggtgccgtcttccagattccaggcgatgacgccgcggcaggcaccttcctcgtccatgatcaggtcgagcgcgaaatactcgacgaagaattcgcaatgatgcttcaggctctgctgatacagcgtgtgcagcatcgcatggccggtccggtcggctgcggcgcaggcgcgctgtaccggctccttgccgtaatcccgcatatggccgccgaagggacgctgatagatacgcccatcctcggtgcggctgaacggcacgccgaaatgttcaagctcgtaaatcgccggaatagcctcgcggcacatatattcgatggcgtcctgatccccgagccagtcggagcctttcaccgtgtcgtacatatgccagcgccagtcatcgggcgtgatattgcccaacgccgcactgatgccgccctgcgccgccacagtatggctgcgggtcgggaacaccttggtgacacaggcggttttcagcccggcggcacccatacccagagtcgcgcgcaggccggcgccgccggcgccgacgacaacgacatcgtaagtgtgatcgacgattctgtaagcgccggtggagggagacgttatcgcgttcattcttgaccgatccgctggggcattcgagccggtgtccgaccgtagggaggaatgccggaaaacccggcaggcgagaaaaaatctggcggtgtggccgccagcgtcagagcgtcatcttcaggatggaaaccgcacaggccagaccgagcaggaagcagacggcctttgtcgcgagcaggctggcgattttcacggattccgtatgtacgtaatcctcgatgatgacctgtagaccgagctggacatggtggaaagtggcgaacaccaggctcagcagcagcacggcatggaccggatgaccaacccattgcgcgacctcggcccggctatgaccggtcaggtgcagcgcggcgaagatgaaccagagggtcagcggcaccagtgcaaccgaagtcacacgttccgcccaccagtgggtcaggccgtgtttcgcggaaccaaggccacgcgcacggcccagatggctgcgcatgacgcgaatacggggagatgattgagccatttttctgctcctgctgtactgatgccggttacagaaccacggcagcggcgatccagatcgccacggtaaacagggccgtcagccccagaacgatataggagcttctgttggcttcgtgcttatcgaagccatagcccgcatcccacaccagatgacggatgccgttgatgaaatggtacaccagcgccaccgtccagccgaacagcagcagcaacccgaaccctgagcgcatgaagccggacacgatgtcgtaagcatgatcggaggtcgcagccgccaccagccaccatgtcagcagcagggtgccaattgccgctgcaacaccggtcacccggtgaagaatcgaaagtgccatcgtgatgggccaacgatagacctgaagatggggtgacagcggacgatggatcagtcggccatcgctcgtccgtccaaccgccagagcctcatgtgtgtcagtcatggtaaggggcctgcctctgcgcactttaatttcacaaaaccagcgcgcttctttcatacttgtgcgccgcagcgcggtcaacgcgaaagaagcactaaaatgatccggacaaccctgatctgccggtatcaggatggcgtgccgtatcgcaggatcagacaccccaacgataacgggcggcccaaagccgcccgtttcattttggtcaccgcactctgagccgcttctgctggatcagaagctccgcaatctggaccgcattcaacgcggcccccttgcggagattgtcggacacacaccagaacgccaatccgttcggcaccgtgggatcctgccggatgcggctgacataaaccgcatcctcaccctgacattccagttgcgtgatgtagccaccatcctcccgatgatcgaccacagtaatgccgggcgcctccctcagcaccgcacgcgcctccgatgccgtcaccggcttttcaaattcgacatgcactgcctcgccatggccgatgaacaccggcacgcgcacgcaggtggcaaaaacggcgatatccggatcgagaatcttgcgggtctcaaccgccattttccactcttccttggtggcaccgtcatccatgaacttgtcgatatgcgggatgcagttgaaggcgatttccttggtgaactgctccggcttggtgggatcgttcacgaaaccggccttggtatggctgaacagctcgtccatcccttccttgccggcgccggagaccgactgataggtcgcaacggaaacgcgcttgacaccccagcgcgtatggagcggcttcagcgccacgaccatctggatggtcgagcagttcggattggcgatgataccgcgcttgatggaatcgagcgcctgcggattgacctccggcaccaccagcggaacatccggctccatacggaactggctggtattatcgaccacgatgcaaccagccgccgccgcacgcggggcatgcacggcagagacggaggcaccggggctgaacaggccgatatcccagccggtgaaatcgaacgtttccaggttccggaccttcagaaccttgtcttcaccaaaggaaatctcctgcccggctgagcggccggatgccagcgccgccacttccgagacagggaagtcacgctcggccagggttttcaaaatctcgcggcccactgcgcccgtcgcgccaactaccgctaccctgtaacccatgtcttttcgctccatcctgtgtcagcccgccatgcagcccaccaccacccgccgacacgaatgcgacggccagagcaggcttgccagagggggacagccatccagggggacagccatcaatagaaaatgcctatacgccagctgcctccggaacaagctcatcacctgctcccagccacgagcgcgaagaccatcagccgcgcaaggattgcagggcaatgcagttataacgttttcttatcgaacaacacttgtcgttttcccctcttctatcatgctatcatgacagcaggctttatctggaaatctctccggacttctcccataagcagcgtatgaggtgcgaaaaccctgacccatccgaattgaatctcgatctgctgctgctgctgaacgacgttgcccgtctgctccgcattgctgccgacaagcgtgcgcggctgcatgatatgacccgcgcccagtggatcatgctgctatggctggatcagatgcccggcatctcccagaaacagcttgccgagaaactcgaagttgaacccatcaccgtcgcccggctggtagatcggctggaacagcgcggcatggtggaacgccgtcccgatccgtcggaccggcgtatctggcggcttcacctgctgcctgccgcccacccgctgatctcggacatcaatgcaggacgtgccgaaattctgcagctggctacccgggagttggacccctctttgctggaaccaatgcaagccggccttatgcgcatgaagcatacgctctgttcagaactacgcccaagaaaacgtgatcaggatgatcaggatcggatacagggtcattctacctcatcagtgtcttcccctgaaggagaataacctgctttgtaatgtggatggttttcatccggccatggaaacggctaagacagcatcgtgccaactgatcttcccaatctgctgaccttatcgcgcattgccgccatccctctgatggtggcgctgattgcatttggcagccccggtggcgatctggccgcctgtatcattttctctgccgccgccatcaccgattatttcgacggtaaaatcgcccgcgaccgccgccagatttccgatctgggccggatgctggaccctattgccgataaattgctggtcggagcctccctgatgatgctggtcgggtatggccgggtcggcgatcatggcctgttccccgctatcgtcatcatgctgcgggaaatcctcgtcagtggtctgcgcgaatatctggccggactacaggtcagcctgccagtgacccggctggccaaatggaaaaccggtgtgcaaatgggcgcactcggcaccctgctggggggcgattctgcggcccatctcatcggcctcgggtttctacccgtgcagttgatcggggagattcagttatggatcgccgccggactgacattggtaacgggctgggattacctgatggccggattgcgccatgtttcccccccagccggcgtcgcaaaacccgaacatccctctcccacacccagtcgcacaccatgacgaccggaacttcaccaaattccgccatcgcgaagccgaaaattcttggcattgcaggctggtccggcagcggcaaaaccaccctcctcacatccctgattccgcttctgaacgcatccgggctacgtgtctccaccatcaaacatgcccatcatggctttgacctcgatcatccgggcaaggatagctggcggcacagggaagccggggcgcatgaggtcatgctgatgggtgaggcacgctgggccttgctgcatgaacctcgcgcagatgaggaggcgcccgatctggaccgtttggtacagcgcatggcgctggtagatgtcattctggtagagggtttccgcagttaccctcaccccaagatcgaggtctaccggcccgcaaccgggaaaccgcccctctggccggaccggcgtgacatcgtggcggttgcggcctcgccttttcccccggaaacgctggaaggcggcatccataaaccgtgttttctgccgctggatgatgtgcaggccgttgcaaactggacgattggctttctcagccgctatgtagccccggcttgatcgttccggttctgcgatccattgcaatatgattgctgttttgtcgtctctttccggttattccggttgctatcgttcaaggaagctcgtcatgcgtcgtctgaccttgctgggtatcatgctgtctctgtcaggctgcggcttcggtgattttctgtcggatacccacactttccgcagcaacccgaacgggccgatcggctccagcccgaacatgctgcgggtgcaagggcaacgtaccgtcaccacgccgctgaccaccgagccgggagatgtctggcccggtccgatcccgcccacccccaccttgtccgaccttcagaagcagcagaatagcgtcgcgcctgagctgggcggcgtacgacgcacacccaatatgccgcttggcacaggtgtcatgccgtctcccgcaccctataagccgatgccggaaggtaatggagccgtcaaaggcacggaaccgggcagtacgggcagaaatacagacgggcagatcatcgtcccgaatggaaacggcaccagtacggtgatcgagcctgacggaacggtccgcaccattccaacccccaaggacaagacacgctgacgtgttgctgcccgaggatatcgtttttttattgattgctcgacgtggaggctgatcggaacaccaatgaaggaggggctacatatcgtttatttcgcgtggcttcgcgaccggatcggtcgtaatgaggaacacgtgccgttacctccgggtgtcgcgaatgtcggtgggctgatcacctggctgcgtggacgcggcagggattacaaatcagcgctcgccactgaaaatcgcatccgctgtgccgtcaatcatgaggttgcggcgctcgacacgcccatctctccgggggatgaagtcgggtttttccccccgatcacaggcggataaccccttatgatccccccgctcccgcgtattgcggttcaggctgatccctttgatatgacaagggaatatgaagccctgatcgcaggacagcgccggatcgggggggttggcagctttgtcggcgtggtgcgcggtgaaagcgccgggcagagcgaacagttacagggcatgaccctggaacactatcccggcatgaccgaaaaacagatccaccgcattgccgaagaagccatccggcgctggtccctgctgggctgcaccattatccaccggatcggctacctccctgccggtgcccctatcgttctggtgatgaccgccgcaccgcaccgtgaggctgcgctgcaatcgacctcctttctgatcgactggctgaagaccaaagccccgttctggaaacaggagcatctggaagacggcaccacacgctgggtcgcagcaagggatgaggatgagatcgccgccgatcgctggaatatcgtcagcgcctcttgaccttccagtgctggaaccttccatttttcaagctgttccagatcagacagggccgtgatgccggtctgataagatccatctggcaagctccatctggcaaggaaagaaacggtcgatgaccccaaccaccattctcgcgatcaagggcatgacctgtgaaggctgtgtcaatgccgttcgccgcattctgctggctgtgccgggcgtttccgatgcctccgtaacccttgggcgggccgagatcagcggcggggaaaccgcaaggctgatggaagcggtacgcgatgcgggcttcggtgccgagattctcgcaacggagtaaccccgatgccggttgaaacgatgccatccggttccgcccggcaggagctggatatcaccggcatgacctgcgccagttgctccggccgtgtggagcgggcgctgcgcaatgtcgagggcgtcagccgggcggtggtttcccttatcagccatcgcgccctggtcgaaggctccgcccggatcgaaacactggtagcggccgtgacccgctccggctttaccgccaccccgctgacgggagagcgcgaacaggaagaacggatcgagcaacaggcacgcagggcgacccggcaggaagcgctgcgcgtgctgctctccgcgctgttgacggcgcctttgctgctgcccatgcttggagtgcctctacccgggctgctgatgctggtgctggcaggcatcgtccagatcggtttcggataccgtttctatatcgctgcatggcgaggcttgcgggccggagccggcaatatggaccagctggtcgccatcggcaccagcgctgcttttctttacagtgccatcgccgtgctgtgcggggacagtgaacacggctatttcgatgcctccgctgtcgtcatcagcctgatcctgttcgggcgctggctggaaagccgggcgcggcaggccaccggctctgccacgcgcgctctttcggccctccgccccgacaccgcacggctacagaatggcgatgaagaacgccttgttcccgcaagccacctgatgccggaagatatcgtgatcatccgccccggcgagcgcttcgccgccgatggaaaggttgtgtccggccaatccgatgcggatgaaagcctgctgaccggggaaagccatccggttcccaagcaccccggtgattccgtcatcggcggcgctatgaacggttccggtctgctgagggtgcgcgtcacagccaccgtcaatgatgggacactcgcgcgcgtgatttcgctggtgcgggaagcggaagccagccgtgccccggtacagcggctggtcgaccaggtcgccgctattttcgtacctggcgtggtgacaatcgccgtgctgacatttctggggtggtggatcatcggccatgacattgcgaacgggttccgcgctgccgtctccgtgctggtgatcgcctgcccctgtgcgctggggctggccacgcccgctgcccttattaccggcaccggaatcgctgccagacgcggtattctgatccgcgatgccgccagtctggagcgggcaggcagcattgataccgtggcactggataaaaccggcacgatcacggaaggcaagccggtgctgcatgagatcattctgctgccctccgccccgatcggcatggacaaagccacgatcctgcgtctggccgctgccgccgagtcgggcagtacccacccgctggcgcatgccgtccgtgaatcggccctgaccaagggaacaactctcccgatgccggatttccttcaggagcgtccgggggaaggcgtgatcgcccatgtctccggccatgaaatcgccatcggcaatgcggcgctgttcactcatctggacatccccgacagcccgcaagccatggccttggaacaggagacaccggccgccatcctgcgggttgccattgatcgcattcctgctgcgttgttactggtcgaggatacgcttcgccccggtgccgctgtcgccatccgccgcattcacgccaccggctgcacagtgatgctgctgaccggtgataccgaagcgtccggcctcaaggcggcaaagaccgcagggattgaactggtcgaaaccagattgcgccccgaagacaaggccgcccggatcgccgcatggcaagccaaaggccatgtcgttgccatggtcggcgacggcgtcaacgatgcaccgtctctggcgcaggccgatctcggaatcgccattggcaccggagccgatgcggcccgccatgcagccggcgttatcctgatgcgaccggagccgggcctgattgccgacgccatttcgctcagccgcgccacaaggcgtaaaatccggcagaatctgttctgggcctttatctataatgccatcggtctgccctttgcggctctgggcctgctcaaccccgtgatcgcgggagcggccatggccttctcgtcagtcagtgtggtggtcaatgcactgctgctgaaacgctggaacccctcctctccttaaactatcggaggatcatccccttgcctgacacaccggaaccggatcacacgcacgatcatcggggtggtcttgccatcggcgaggtctcacgcctgtccggcctgcctgcgaaaaccatccgttattacgagcaagccgggctgctgccccctccgtctcgcagcgataatcagtatcgccgctacaaccacgaggtgctggaacgcctgcgttttctgtcaaccgcacgtgggctgggctttccattgcaggagctgaaaatgctgatggccctgcgctcagacccgcatcgcgcgagtcgcgaggtcaaatcactggccctgaaacatattgagcgtctggagattgatattgctcggcttcagaccatgcgagacacgttgcagggactgactgccgcttgcgcgggcgatgactgccccgcctgcacaattctggatgcgctcaacagcgcaggtacccatacgcaaaacggtgcgggcaccaaagcacccgcaccgttctgtcagactgagccggaaaaccggaacaatcagtaagccagcagtgccaccagcgcgcggccattctcggtggtcagctcagccgggctcagcgtgccgtcatgatccgggtcggcctttttgaaataggcatcgaccagcttcagccattcggccttgtccagagaaccgtcatggtcgggatcgaaggcagccaaagccttcttgccgaggataccggtcagctcggacgcatccagcgtgccttcgtgatcagtgtccagagcgtcgaacttcgcttcagcggccttatgggcctcttccaggctgacagtgccgtcattgtcggggtcaaggcggctcatcaccaggctggtgtcatgcggggtcgcatcaacagcggccatggcaacatgggacaggccctgagaagccagaatggacagaccgaacgcggcggtcatcagaacagttttacgcattatgtgaactcctattgcactttctgcaataaataggccccataaatgcagaacatgcaagcggataatgcgcaaacctttcaaaaaggtcgcgcatacgacttatgcagcagcagaatgagtgagaaaaagcggacagacccgtcagcgcgtggggcgcggcggcgtatgagcgtaatcgtagaagccacggcctgttttacggcccagccacccggcttcgacatattttaccagcaacgggcaaggacgatatttactgtcggaaagaccgtcgtacaaaacctgcatgatggaaaggcaggtatcgaggccgataaaatccgccagttccagcggccccattctgtggctggcccccagccgcatggcagtgtcaattccgctgacagtggccacgccctcgtaaagcgcaaaaaccgcctcgttgatcatcggcaccagaatacggttgacgatgaaggccgggaaatcctcggccactgaaatggttttatccagtcgctgcgccagagcgctgacagcagcaaaggtccgatcatccgtcgcaatgccgcggatgatctccaccagcttcatcaccggcaccgggttcatgaaatgcagcccgatgaatttctccggccggtccgtactcgcccccaaccgggtgatcgaaatggaggacgtattggtggccagaatacaatccggcttcatatgaggcgccagaagcttgtagagcgcttttttggcttcttccttttcggtgatggcctcgaccaccagatcgcactcactgagccgatcataaccgaccgccgtgacgatacgcgtcagcgccgccgctttctgctgctctgttgttaatccagccttgatctgccgatccagattgacgcgaatcgtcgtcatggcacgatccagagcttccgctctgatatcggtcagtaccacctcgatccctgccagggcacagacatgagcaatgccgttgcccatcaaccccgcaccgaccacaccgatttttcggatgggataagatgtggcttcagaaagaggcaaaggctcgacgctcatgacgatatattcctgttgcggatcatgatgcctgccaatcgatgcaaaggggagcatggaccgacaagcgtatcatcgtcacgcagcaaggcacgattcaacacgggacgcaaagaggctttgatcagagtgctttttcaagggcgggaagcgcctcgaacaaatcgccgacataaccgtaatcggccacctgaaagatcggcgcatccggatctttgttgatggcgacgatgacccggctgtccttcatccccgccagatgctggatggcgccggagataccgaccgcgatatacagttccggcgcgacaatcttgccggtctgcccgacctgataatcattcggcgcgtaccctgcatccacagcggcgcgggatgcaccgaccgcagcattcagcttccgggcaacccggtccagcagcgcgaaattttcggcgctctgcattcccttgccgccggaaatcacgatccgggcggaaccgagttccggtcgttcgctggccgtcagcgcctccgacacgaagcgggagccgccttcgaccggcacggcggaagactgaacgatgtcggcagagccaccttcggagggaaccggttcgaaactggcagcccgcacggtgatgacctttacagggtctgccgaacgcacggttgccagcgcattaccggcatagatcggtcgcacgaaggtatcggaagattcaacgctgcaaatatcgctaatcggctgcacatccagcaacgccgccgcgcggggcagcacattcttgcccgtggcggaagccggcgcaaggatatgggaataatccggcgccaacgccaccagcagggccgccaacggctccgccagcgcatgggcataggaaggggcatcggcggtcacaacacgtgacacaccgggaatggcggcagcctgggcagcgacccccccgacatcctgcccggcgaccaggatatggaggtctccgcccagtttccgggcggcggcaatggcgctgcgggtcgcctgtttcagcgtgcgcccgtcatgttcagcaagaaccagtgcggtcatgattcagatcaccttcgcttcggtcttcagcttcgacaccagttcatcgacagagccgactttcactcctccctgacgcggcggcggttctgccacacgcaacacggtcagacgcggggatgcatcgaccccgagatcagccggagtcatggtctgtatcggcttctttttcgccttcataatgttcggaaggctggcatagcgcggctcattcagccgcagatccgccgtcacgacggccggcagggaaagctgcacggtctgcgcgccgccatcaatttcacgggtgacggtgatgccgccattttccaccgcaacagcgctggcaaacgtgccctgcggccagccgagcaatgccgccagcatctggccggtggcattcatgtcgtcatcaatggcctgcttacccatgacgaccagtccaggctgttcctgctgcaccagagcacggaggatcttggcgacgcccagtggctccaccgtctcttcaacctgtaccagaatgccacgatcagcacccatcgccataccggtgcgcagcgtatcctgtgcctgtgccggaccgacggaaacgacgacgatttcggtcgccacgcctttttccttcaggcgcacggcttcctcaaccgcgatttcatcgaacggattcatcgacatttttacaccggccgtttcaaccccggtgccatcggccctgacccgaacctgaacgttgtaatcgactacccgtttgaccgggacgaggatcttcatggcggttcccgctgcgtttgaatgtccggagccatgatgaggccatatcgaccgccaccatgccgagctgaccgcccggtgcataaaccggcaaccagacaaggcggcacggcattacttcccggaacggcgcactggatatgcaagcgggtcgcaaggctgtcaaaccgcttccgtgcagccctgttccggaaaaaccgcttcagtcccctcggcgccggatatcagcgccagacattgaaggccagcacacataacaggatcgcaatcccctgaaacaaaatacgatagcgcatcagcttgttggaacgctccggactgccgccggaaccgaccgagccgataccggccacaagcgttcccacaaccagagccatggagatgacaagcaggatcagggcgattgtatgcatccgaacctcttaccgcgactcggcctggctgcccatacaggacttgcatgaccatcgggaaataaacacatgcccttgacggcagcgttccactatgtgccagcacctgcccgatttttattgtgacccggcgtggacaccctgtcagcgccagacctgccgagtgcccgccatgttcgatgccctgacgatccagctgcgtgactccggatacgccttcgtccgttcagagcatgccacatccctgctatccgcctttaacgatggcaacagagccggactctccgactggacggcctttgccgatagctggaacaggctggccctcgatacctatatggccgatggaggccgttaccgccgtcggcgtcatgccgttttcaatattctgcccggccacgctgccgaacgcggtcaacatcagccgcattatcaggggctggaatataaccgcctgaatggcggtatcgagcgctggttcgaaccgatggaagaagcggtcgcgtccggccccaccatgacctgtatcctggctttctgccgcaccctgttcgaaagcctgatgccgcagacgggatggcatgttgaaacccaccagttccgcatcgaggccaccgcagatggcggcaagccgacaccggaagggctgcaccgggacggtgtggattacgtgctggtactgatggtgcggcgggacaacatcgccagcggtgaaacctcgatccatggcgatgacggaacgctgctaggcagtttcaccctgaccgaaccgctggacatggcgctggtgcatgaccggcgcgtctatcatggtgtaacggccgtgcaggcgattgaccctgccctgcctgcctatcgcgatgtgctggtcgtaaccttccgcagacgctgaaagcgcgccctcaacgcgccgccttctccgcatggcggagaatcagcagggccttacgcagacgcagaatacccccgcgcacatgcccctgatcacacagatgcctcccctgatcagccagttgcgttacgtcagaggggggagcgccgagcacgaaatgcgcttcctgtcgggccagcttatgctgcaactgctggcagtaatccagcgtgtcggaggtaatcagctgaggcgcatccgccagacagggggtcaccccacttcccagcaccgccacaagcagagcggaccccatgcaggcacagagacatgatggtatgcggctgttcataatcctatcatgcctcattccacatgaccgtggaatgggggcctgatgacaaggattttaaccttcctctaccgactgccgaacgaaacaaaaacggcgaggcccgaaggccccgccggatccgtttcagactgaccgagcagtgatcaggccgtgcgatcaccacctgcacccagcgccgcctgagccgcggccagccgtgccacaggcacgcggtaagggctgcaggagacgtaatccagaccaaccttttcgcagaacgagatcgaggacgggtcgcccccatgctcaccgcaaatgcccagcttcagaccatgcctggccgcacggcctttttttgcggcaatctcgatcagatagcccacgccttcctcatccagtgagatgaacgggtctttcggcaggatgcccgcctccacataatgcggcaggaacttgccggcatcgtcacgcgacagaccgaacacggtctgcgtcagatcgttggtgccgaagctgaagaaatccgcgctgtcggcaatcgtatcagccgacagggccgcacgcggcaactcgatcatcgtgccgatcgtataatccagcgtccggcccgcacgggaaaatacctccgccgcgaccttttcgatctgagcacgcacgatctcgatctcacgcttgatacccaccagcggcaccatcacttccggcaccggtgcattcccggtctcctcggcaatagcgagggcaccttcgaaaatagcccgtgcctgcatctcgtagatttccgggaaggaaataccgagacggcagccacgatgacccagcatcgggttggcttccgccagctcggcagcacggcggcgaatggtgtccagatcgacccccagcgcgacaccgacctcggccagatcttcctcattatgcggcaggaattcatgcagcggcggatcaagcagacggatcgtcaccggcaggccctgcatgatgcggaacagatcggtgaaatccttccgctggaacggcagcagcttctccagcgccagacggcggccacgctcatcggcagccatgatcatctgacggacggcaccaatacgctccggatcgaagaacatatgctccgtgcggcacagaccgatgccttccgccccgaatttacgggcggtttcggcatccagcggggtttcggcattggcccgcaccttcatgcggcgcgcgccatccgcccattccatcagcgtggcgaaatcaccggacaaagacggttcgatcatcgccaccgggccgacaaacacctcgcccgtcgcaccgtcgagggtcacaatttcaccctcgcggatggtaatgccgttggccgacaattcctgagtgccgtaatcgacctggataccgccggcaccggcgacacaggggcggcccatgccgcgtgccaccaccgccgcgtggctggtcataccgccgcgcgtggtgagaatacccttggcggcatgcataccgtggatatcttccggagaggtctcgatccggaccagaatcaccgcctcgcccttggcagcgcgcatttccgcttcgtcagcattgaacactaccgcaccgcaggcagcccccggactggccggcagaccacgggagaacaccgtgcgcggcgctttcgggtcaagcgtcggatgcagaagctggtccagcgaggccggattgacgcgcttgaccgcctcattccggtcgatcagaccttcattcgccatctccacggcaatgcgcagggatgctgcggcagtacgtttgccgctgcgggtctgcaacatatacagcgtgttccgctgcaccgtaaattcgatgtcctgcatgtccttgtaatgcttttccagcgtttcacggacctgacagagttcttcgtacgccttgggcagcgcttcttccatgctgcgctcaccgggcttggcgcgggccttcgacagcggctgcggcgtacggatgccggccaccacgtcctcgccctgcgcattcaccaggaactcgccgtagaaaatattctcgccggtagatggatcgcgggtgaaacacacgccggtggcgcaatcctcgcccatattgccgaacaccatcgcctgcacattcacggcggtgccccaatcggcagggatctcgtgcaggcggcgataggtaatggcgcgcgggttcatccagctgccgaacaccgcaccgatcgcgccccaaagctgttcctcaggatcctgtggaaagggtttgccggtctcggacagcaccatatccttgtaaccagccacgaccttgcgccagtcggcggcatcgagagccgtatcctcgatcacgttgcgatcgagcttgatgtgctcgatgatttcctcaaaccggtgatgatcgacacccagcacgacactgccgaacatctggatgaaacggcgatagctgtcccatgcgaaccggtcatccccggaagcccgtgccagcccctcgaccgtctgatcgttcaacccgagattcagcaccgtatccatcatgcccggcatggaaacccgcgcgccggaacgaacggagaccagcagcggattggtccggtcaccgaaggtcaggccgacggcctgttcgacccgctgcagcccttccttgacctgagctgccagatcgtcggggtaacgacgatcattccggtagaactcggtacacagctccgtggtgatggtgaagccggggggtaccggcaggccgatactggccatttccgcgagattggcacccttgccacccagaaggttgcgcatatccgcgcgtccttcattgcgaccagcaccaaaaccgtaaacccattgagtcatggatcaggctccttcagccttcgatacgggagaagtcggcgacacgattcatcgtgtcacgcaaacgggacaacaggcgcaaccggttacggcggagcgcaggctcctccgcattgacggtgacctgatcgaaaaacgcatccaggggaccacgcaggcgggccagggatgccatggcagtggcgtcatcttccgcgtccagcgcggccatgaccgctggttccgcttcctgcaacgcttcggccagcgcacgctcttccggcacctcaagcagggactcgtccggcgtgccctgatgaggtccatccttgcgatcctcaatgcgcagaatattcgcggcgcgcttgtaggcggctagaagatttgcgccatcttcactgaccaacaaggcagcaacggcatcggcacgggccagaagacggacgatatcgcctgctccttccgccgtatcatcggcatgcacagcaaacaccgccgccagcacatcatggcgcgccccttcggcgcggagctgcacgcgcagacgctcggccatgaacgccagcagatcggccaccggcgcttcatcggaggcaaaggcgaacagacggcccaacggcagccgcaacccgttctcacgaataatgcggatgatccccagcgccgcacgccgcagcgcgaacggatcgcccgagccggtcggagcctccccgatggaaaagaacatcgccagccggtcgatcttgtccgccagcgcgaccgcgatcgagaccggcgcatccggcaccggatcggacgggcctttcggcgcgtaatgatcccggatggcatcggcaatccacggcgattccccgtcatgcagcgcgtaatagcggcccatcacgccctgcagttccgggaattcccccaccatgccggtggtcagatcggccttcgccaatagcgccgccccatccgcatcgcgtgcatctgccccgaccagcggcgcgatttcccgcgccagccgccgcagacgcgccaccagagcggcctgactgccaagcttcgcgtgataggtcacacgctccagcacagccagccgggaggccagcggttccttccggtcctgatcccagaaatggcgggcatcggcaaagcgggcgcgcagcacacgctcattaccggccataatggcgcggccctgatcggtggcctcgatattggcgatgaaggcaaaataaggggccgctttaccttcggcatcccgcaaggcgaaataacgctggttgacccgcatggagacctgcatcacctccgcgggcagagacatgtactgatcgtcgatccggcccagcaaaggcaccggccattccaccagcccggccacctcatcgaccagcccgggatcatccaccacggtcaggccatgagcagcggcgacgcgggcgataccctccgccacgcggcggcggcgctcctcgatatccagcaccacatgccggccggccaatgccgcctgccattcggcaatgccacggaccttcacagcaccgggggacaggaagcgatgcccttccgtctcatcgccggagcgcaggccatgcccgtcatcatcgccctgagcgagcgaaaagggtaccactgcaccatccagctggcagagaatgcggcgcaacggacgaacccatgtgaacagactcgatcccccccaacgcatggatttcggccagggaaatttccacagcagcgccggaatcacctcggcaatcagcgctgccgcttcacggcccggactggacgtatcgagtacccagtaatcgccctcttcacgcagggctgaccgatcggcgccatacttgcgcaagaacccggccagagcctgctccggcgcaccgatccgcgggccacgctcattgccggagcgggcaggaacacctgcctccaccgtggcagtcagggcaagacgccgggggccgacatgccagcgcagatcacgcggcgacagatcagccagcgcctcgccggccagccgcaccagatcctcgccggccttgacctgcatacgggcggggatttcctcgctgaacaattccagcagtaattcgggcatcgggatcagtcctggatttcttgcaacacggtttcttcgggctgaatggctggctcgatgtcggtatgatcgaaatcccgccctttgtagagcagtctgtcactctcggtcttggcgagagcataggccaggcaatcaccgtaattcagccggtgcgcatgacggaatcggccgaaataacgccatgcgccacgcgccaccgtcgcctgttcggcactgaccggtacgatctcgatcccggcggcacggataaattcatcaaagcggagaccggcgaggcggccgcctttttcctcgaccatcatactcgcctccagccagttggcggccgacatgcggggacgctcggccgcgaccagcgcctccagatagcgtgggccatcaggctcccccagcacaatcgccagcaatgcggaggtatcgaggatcacagcggcaatccgccctcgccatacagcgcgctatgatcagaactgacccgaccacgcatatgagcgcggatatccgccgcaaggacagtcaggcgttgaagacgggacacatggtcacgcaggcgacgctcacgctccagacgttcccgaagcgcctccgtcaccgccatggtcatgctttcgccggtcaaggcagcaagctcggttgccagaacgtaggcatcctcacttttgatgttgagctgcgccatgatggtagacatcccgccgtttcaggtagacgctacttcacctcatctaccatcgtccagagggaatggtagaaaatttttcagccatggaagaaagtcggccattcagggctgaaacaccctaacctccacccgccagccacgcttcggcacagcttttcgccagactgcgcacacgggcgatataggcggcccgctccgtcacgctgatgacaccgcgcgcatccagcagattgaacagatggctggccttgatgcactggtcataggctggcaacgccaacccctggcccaccagcgccgcacattccttttccgcgtcgatgaaatggcgggacagcatctcggtattcgcatgctcgaaattatgcgcgctgtattcgcgctccgcccgcaggaacacgtcaccataagtgacgccctgcccgttgaagtcgagatcgtagacgttctcgacatcctgcacatacatggccagacgctccagcccgtatgtcatctcgaaactgggcagatcgaccggaatgccgccgacctgctggaaataggtgaactggccgacctccatcccgtcacaccagacttcccagcccagcccccatgcgccaagcgtcggactttcccagtcatcctcgacaaagcggatatcatgaagcgccgggtcgatcccgatggcgcgatagctgtccagcagcatggattgcgccgtctcggggctgggcttcataatcacctgatactggtaataatgctgaagccggttcggattttcgccataacgaccatcggtcgggcggcggctgggctgcacataagcggcgcgccagggcttgcggcccagcgagcgcagcgttgtggctggatgaaatgtgcctgcacccatctcgacgtcgtaaggctgcaagataacgcagcctgctttcgaccagaaagcatgcaggcggaggatcagatcctggaagctgggtttgtcaggcattgacgggcacggttccgagaagcgagaagccgcgcacgctataagctgtcgccgtcggcggcaatccgtaacaagtgaggatcaaccatgacccagaatgccgacgcgctgatccgcgcgtattacgaggctttcaacgccggtgatgaagccgctttcctggccctgctgaccgatgacgtggagcacgatatcagccagggcgacaaggaagtcggcaaggaagccttctcccgcttcctcgcccatatgaacaactgctaccgcgagcggatcgagctgctacgcgtgatgaccgaatcgaccggccggttcgcggcctccgaattcatcgtgcatggtgaatatttgaagacggatcccggcgtgccggaaggcaccgcgccggcccgtggccagcgttacacgctgcccgccggtgctttcttcaccatccgcgacggcaaggtggcccgcatttccaaccactacaatctcggtgagtggatccgtcaggtgaacgaaggctgatgcagcctgtcccgtcagggtggcgcttgtaccggctatcctgacgggggcgtcttgatcgccgcccgatgccgcgccatgtttcgtccagcaccctcatgccgagcattgaggggacatcgccaggagagcggccggatatgaacgaccaggaacgcgagatcatcacccgcttcatcgagcgggtcagcggcgcacagaccgcgccgggaacagcggtacagacgctgccccccgtcgatcgcgacgccgatgcgttgatcggccagcttttcacccgctatcccgaagcccgctaccggctgacccagaccgcctatgtgcaggattacgcattggccgaggccggtaaaaaaattcaggccctccaacagcaggttcagcaactgcaacaacagatgcaggcgcttcagcaacagagcggccagcctcgtggcggatttttcagcactctgtttggtggcggccaaccctccgcgcctcagcagccagccttccagcctccgccccagcagggttatccccagcagggctacgcccaacccggatatgcccaacctcccttccaacgcggcggaagtggattcctcggctcagccctgacgaccgccgcgggcgtggcgggcggtatggtggtcggcaatatgctgaccgggctgttctccggccacgagcatgccgatccgggtgccggattcggggccggtggtgacagcggcgtctggggcacgggtggcgatgcaggtggggcagcacccggcggtaatgactggggcaatcttcagaacgacacgggccctgatcagggcagctggggtgacagcggcgattcaggatggtccgattccggtggtggatgggacgatctttaaggccataccaggcaagaaagataaaatttcctgattgacgcgggtagaatcatttgtattgctcatggttctatccatccttcgcatcaggcagttctttcttcctatcggaaatcagtgctgccgcaggagcagcctgaagtgaattatcctgatctcgatctcgatctgctccgctgcttcgcctgcgtggcggcggaacggggctttaccgccgccggtcaggtgatgggtctgacgcaatccgccatcagcctcaaaatcaaacggctggaagacctgatcaatcgccgggttttcgaccgctccagccgtcacctcgccctgactccggatggggatatcctgctggcttacgcgcaccggctgttatccctgaatgatgaggccgtgcggcgtctggtggccagcccgatcaaagggcatttacggctgggcgtcgcggatcatttcctgccccatcatctcgcgcagattgtggggcgctttcaacgtacctatcccgccgtcaggctggaaatagaggtaggccgctgcgctgaactccgcaccgcctgtgatgaagggcgattcgatctggtgatcggcagacgccgtgccggtgacacgatggggatgcccatctggaccgaaaccatggtctgggtcgccgccaacgatttccggatgccggagcgggacaagcccctgcctttggcaaccctctcaacgggatgcatgttccgggaacgggcactggatgtcttgtcccgcgcccgtattccacatgagctgcgctatacctcaaccagcctgttgggcatcattgcctttgcgcaggaagggctgtgcattattcccattggtcgctccaatgtcccaagcgggctgaaagagatcgactcgcttcctgtcctcggaaattccgagattgccgtatttggtgatatctctgacgagaatctcgaactggcgcagcctctgattgacctgttccgggacgaccttggctcgggccgtaaaagcagcacctcaccctgagactttactttacgcgtctctccgcgcatccgtgtgcgcgtgtcacattcaatctgttcatcacccatgttccatattgtcggcgggggtctggccggactgtccgcagcccttgacctcgccgagggcggtcaacgtgtcacgctgtatgaatcaagtcgtcaggcaggcggccgctgccgctcctatttcgacaaggagcttgggtgcaggatcgacaatggcaaccatctcctgctgtccggcaaccgggcggcgcatggtttcctgcaacggatcggcgcgagtgacagtctcagcgggccggggaaacccctgtttccctttgccgatctcaccgatggatcattctggagcgtgcagccaggtcttggccgcctgccgctatggctgctgaagcgtcaagcccgtgtcgcgggcacaaaggcacgagactatctctccctgctgcgcatcctgcgggcgaagaaagaagcaacagtgcaggatctggccctgccggaacctctgtttcggcggttgctggagcctcttgcggtgtctgcgctgaatacccgcccgcatgaagccagtgccagcctgttcggagccatcatccacgaaaccctcgctgaaggagggtccgcctgtattcccgccattccgcgggaaggcatgtcggaaagtttcgttgatcccgcgctgagccgtctgtccgccttgggggcggaaatccggttgggccaccgcatcgcatccctcactatcgagaacgggcgcgtcgccacgctgggggatatcaggctgggaccggccgacaaggtcatcctcgctgttccggcctgggtggctgccgatttgctgcctggtctgaccgtgccggatcagcatgaagccatcatcaatctgcatttccgcacgccacacgcttcctccacacatcccgatttcatccaggcgggcttcattggcgtggtcggcggcacggcagaatggattttccgacggcccgaggtgctctccgtcaccatcagcgccgccaatcatctgttggacgatccggacgtaccagagcgcgtctgggacgacatccggcgcgccaccggtcagcagggacagatgcccaaactccgcattgtacgggaaaaacgagccactttccttgcctcccccgcacagaatgcccgacgccctcaagccgacttcatgttgcaatgcggcatcaccaatctggctctcgcaggggactggaccgcaaccggcttgcctgcaacaatcgaaggtgcgatcaggtccggttcgatagctgtcaaaatgctactaccgggctgaaccaatgccaaaagacatccctgccgatctggcttctgaagccatctctggcgatatgctggaacaggccgtgctgcgcgccagcatggctctgcaccggaaacagcagacggacgggcattgggttttcgagctggaggccgatgccaccattccggcggaatatgtgctgctcgaacattttctggatcggatcgacgacgatctggagcgcaagatcggcgtctatctgcggcgaattcagggcgaccatggcggctggccgctgtttcacgaaggtgctttcaacctttccgccagcgtcaaggcgtactacgcactgaaagcgattggggacgatccggatgcgccgcatatgcgccgcgcccgcgaagccatcctggccgcaggcggggcagagcgcagcaatgtcttcacccgcattcaactggcgctgttcgggcagattccctggcgcggcgtaccggtcatgccggctgagctgatgatcgcgcccaaatggtttcccatcaacatgtggaaagtcagctactggtcgcgcaccgtgatcgcaccgctgctggtactgatggaccgcaagccgaaagcacgcaatccgcgcaacgtgcatgtgcgggagctgttcctgcatgatcccgaccggatcagggactggatccgtggtccattccgctccggctggggacattttttcaaatatctggacagcgtgctgcgtgttgtggagccggtggcgctgaagcccatgcgcccgcgcagcatccgtctggccgtggatttcgtgcgggagcgcctgaatggtgaggacgggctgggcgcaatttatcccgccatggcgaatagcgtgatgatgtacgatgtgctgggctacagccccgatcatccggaggccgcgattgcatgggaaagcgtccgcaagctgctggtcatcaaggaggatgaggcctattgccagccctgcctctcccccatctgggataccggcctgtcgggccatgccatggccgaagctgagggcgctgtttccccgggtgtggcagccgcctgcgactggctgcggaaccgtcagatcaccgatgtggtcggcgactgggctgaaatccgtcccggtgtccagccaggtggctgggccttccagtacaataatgcccattacccggatgtggacgataccgcggtcgtggccatgctgctgcaccggcagggtgacccggcccatgaggagagcatccggaaagcacgtgagtggatcatcgggctgcaatgccgcgacggcggctggggggcgttcgatgccgataatgacaaggattatctgaaccacatccccttcgccgatcatggtgcgttgctggatccgccgaccgccgatgtgacggcacgctgtatctccttcctcgcccagctgggtaatccggaagacaaacccgtgatcgaccgtgccatggcctggctgcgcaaggagcaggaggccgatggaagctggttcggccgctggggcaccaactatatctacggcacatggtccgtattgtgcgccatgaatgttgccggcatgccgcatgatgaccccgccatccggcgcgcggtcaattttttggtggcaacacagcgcgaggatggcggctggggcgaggatgaggaaacctatgacccagcctcaggcgcgcagcccggtcgttacaaggaaagcacccccagccagaccgcctgggcgctgattggtctcatggccgccggggaagccgaacatgaggcgacacggcgcggcattgcctatttgcaggccacacagaagccggatggggaatgggatgaagcggcctatacggcggttggcttcccgcgggtcttctacctgaaatatcacggttacagacagtttttcccgttgatggcactgtcccggtataaaaatctccgtagcagcaatatgaaaaaagtttcgttcggattctgatttataaagctttcgtttccgcgatgatgcgcttattcagtcagacgtcacaataagattacccattattcttcttatgatacgctatgttttataacagggcttgaagaagggtctttttcctgaacgtcatcgagggcacctcatccatttccggtctgaaccagcaagcatccaatgaagcagccatcaagccggatccggaagaactggcacctgggtggcatgaaggctgcgcaggcattgccagactggccgcactggcgtgcgatgcagagtgtgcggtgctctatatcaacgccgcccccggtcagtccgcgtttctggacattcatgacgcaggacaggggaagttgccttttcttcctcccacctctctttctgcactggcaaaggcctttatggcaggcgaggaaccggtcatccatatccgggatcaagcgctgccaacggaggtgatccggcctgtttttttcgccgctcaccccattataacgccttctggacgtaagcagggcgcattatgcgtcctggggatgacagcccggacgctctcccccgcacagaccgatcggctgctggcccttgcccggctggccggcatgcagagcgatccccccgatgatcaatccaacgatcaatccgaccagaacgggcatgtccctgcgcagagcgactttctggaactgctgggcacgtctccggattgtatgaaaattctgacgacagacggaaggctgctgttcatcagcaatgccggcctcaaggctctgggcatcgccgatccttcccatgtcattggcaaatcctggccgcatttatgggacgaacctgtgcgctcccaggccttggcggccgttgcgaaagcgcgatcaggagggatcggccgtctggaaggaaccaccaccaacagccagggggaatcctcacattgggacataatcatcacacccctgctcgatcaaaagggccgcataacgcgcctgatggccgtctcccgcgacattaccgaagcacgggaggcccagcaggcccttcaatacagtgaagcccgtttccggatgatgacggaaagcctgccacagatcatctggatgaccgatcaacagggagatattttatacgtcagcgagaaatgggagcatttcagcggtcggtcgccccggcatcttcttcagaaaggccgctggatgagtctcgtccatccgcatgaccgacagactctccgcaccgcctgggcggcggcaaggcaggaaggcagcctgaaatgtgaataccgcatgcgtcatcgcagtgggggctatcgctggtttctgctcacggcacaaccggaacccgatcccgccacgggggaaccgcttcgctggttcggcagctgcacggatatcgatgtggagcgaaacatccgggaggccctcgccgcccgcagccagggactggaacaggaaatcgcccaccatgtgcaggaactggaacgcatctggtgcctgtcccgcgatcttctggccatcctccggtacgatggccgcattctgagcatcaatccggcctggcaagccatattggggtgggacaacgtcaaggatatcgaaaatcccatcgatatcttgtgtcacccggatgatctggcggaagtcgaacgctcaatggaacagatgcggcaagggcagacagtcgtcagccaacctgtccgtattcttcatgtcgatggcagctaccgatggatttcatggaatgctgtaccgtttgacgggttgatctatgcaaccggacgcgatgttacagatctcatctcagccgaagaacaccgcaaggaactggaagcacagctgcaccagtcacaaaaaatggaagcggtcgggcaactgaccggtgggattgcgcatgacttcaataatttgctgacagccctccgcggcagtctggaactgatacagaccaatctggatcgcggacgcctgcaatccctgccacgctatattgccaccgcccatcaagcggtggagcgaggggcatccctgacccaccgtcttctggctttctcacggcgtcagaccttgtcaccatgcatacttgatccggcaagcctgatgaccggcatggctgaactgatcaaaagtatttgtggcccctccattcaggttcagaccagttttcagtcaatgcctgcattgattcaatgtgatcccaatcaactggaaaacggattgctgaatctggtgatcaatgcacgcgatgccatgccgcagggtggaaccctgatcatagagacaggcatcatacagataccggatcgacatgtcagcgaagtaaacgaaacatggcttgacagcgcgctttccaatttccaacccggtgattacgtggtcatcgccgtgcaggataccggtataggaatgactgaggatgtcatgaggcgtgctttcgatccgttcttcacgacaaaaccgattggtcagggaaccggacttggcctgtcgatgatttacggtttcatcaaacagacgggcggccatatacgactgaaatcatctctcggatcaggaacaacaatccgtctttattttccctgttatcatggtgatctttccactgcccaccataccggacagatgacaggtttttttgcatccacctccacttcatcctctcatccagccagtggtacaattatggttgtggatgatgaagaggcgatccgccatttgatcaaggaaacccttcaggatcagggatacaaaatcctgttggccgatcatgccgcagcagcactgaggctgctgaaaaacactttgcagaatggacacaggattgacggtctgattacggatatcggcctgcccggcagcatgaacggccgggagctggcagcagaagccctgtcacttattcctgacctgcctgtccttttgatgacgggatatgactgtacccctcacgctgcagacaggctgagcacatatgtacaggaaaatctggatattctggccaagccgttcagtatggatatgctgttgaaaaaactaagctcagtactggagccatcttttcagcagcggacaaatcgaccgacttttaacaactgaagtttttcaggatttttatgatcaagaagattacgccgctgctgattacccatagcggaaaattccattgcgatgaggtgttcgcctacgccgtattgcgttttgctctcggtctttccagatcgggtgaggaccatgtgcttctacgcacccgcaagccggagctgatcgaaaccggcgatatcgtttttgatgtcgggctgatctcggatccttccaataaccggtttgatcatcatcagatcggtgcacctacgcgggaggatggcacgcctttttcctctgccgggctggtctggcagatatatggggaacgtgccgtcgcctccctgctcgcaccgcaggatgctgccttcgcccctgccatcgccacggctctggatggaaaattggtgaagcgcattgacgaaatcgacaatggtgtttcggcttcaggcccggttgttcgtaactctcttgatcttgcagcgctcgtcggcgatttcaacccgccctgggacagccccgatgccaacggccccacggccggagatgacgccttccagcatgcgaccgccatggtggccggtgtactggcacgccaggtcgatatccagcgctccaagcttcaggctgaggcactggtcctggcggcgcatgcggcggctgatgataaacgcctgctggtgctggagaccggcatgccatggaaaaatgtcgtgttcagccacgatcttccggtattactggcggtctcccctgcctccaatggcaactggatggtcgataccgtgccgccagaacccggctcctttgcccaacgcctgcctttgccggaaagctgggccggcctacagggtgctgatctcgcggccgtcagcggtgtggccgatgccgtcttcgtgcatgtgcgccgctttgtaggcggtgccaaaacccgtgaaggggctattgcgctggctcacaaggctttggcgcaggcaggctgaccgggctgccgaaaaaaggggagccgaagctccccttgatctgcatccgctcaggactcagcaatccagtgtctgctgccgttcccaatcggtgagatgatacatgtattcatcccattcccgctgccgcagcttgacgtaactgtccaccacatcaggaccgaatgccgcacggatgacttccgaacctttcagggctcgcaacgcatccagcagattgcccggcagcctgcgcacattgtcgagcttcgcggcatcccgatacatgtcgatatccaacggctctccgggatcgcctttcgtctcgatcccgtacaatccagcggccagaatagcggcaggcagcaaatagggattggccgcattatcaggcaatctgatttccatccgtccgcctgccggcacacgaatcatgtgagtacggttgtcaccggcataggtcaccgtattcggcgcccaggtcgaacctgacaggccaggcggcgcaataatccgcttgaaggaattgaccgtcggattggtaatcgcacatagcgcatcagaacattccatcaggccggagataaaatgataccccagcgcagacagaccaagcccgcgtgaatcggctggatcgtccagaagattactctccccgttccacagcgacatatgcatatggcagccgcttccggtacggttcaggaacggtttcggcatgaaggtcgcgcgcagaccgtgcttttccgcaatcgtacgcaccatatatttaaagaaagtagtacggtcagccgttatcagagcatcagcataattccagttcatttcaaactggccgtttccgtcctcatgatcgttctgatatggtccccagcccagcgccgtcatgtaatcgcatatctcgctgatcacatcataacggcgcatcaaagcgccctgatcataacaaggtttgctggaagtatcgagtgtatcgccaatagatgtgcccgatggatccagcaggaaaaactcaggctccacaccggttttcagtgtaattcctttttccgcagcatcctgtttcattttcttcagaacgttgcgtggcccctgtggcagaatcttgccgcccatatgcaaatcggccgccagccaaccgacttccggtttccatggaagctggatcaggctgtccggatcaggcaccgcattcacgtcaggatgagcaggcgtcaaatcaagccagcttgcaaaccccgcgaaacccgcgcctgatttgaccatgccatcaatggccgctgctggtaccagctttgcacggttagtaccaaaaagatctacataggatatgaggaaatagcgaatacccctttttttcgcttcctctgacaagatggtcgccattggcgttttcctctccaggacggcctgcttcatgcggctgtcaatgcacccgggcccgttaccaatgatgatttcacgcccgcttcatgcagacagcaaacgggactatgaaagatggcagcgggcgacatgatcaaccctgtaatcggcgtttcccggctgttttataccggttatgattttgttatggctggcacatcgaactgtgccagccattttatctgtcttggtgtctcagcccggctgaagcccgggaatccagttcgtgccagccagcggaacccgtgccatcgcagcagcctccatggtcagggcaacgagatcttccggttccagattatgcacatggctcttgccgcaagcccgggcaatcgtctgtgcttccagcgtcaggacagaaagatagttggcaatacgccgaccgcccaataccgggtcaagccgcgccgacagaaccggatcctgcgtggtaataccggccgggtcacgcccttcatgccagtcatcataagcccccgccgtcgtaccgagcttggcatattcttcttccagcgcaggatcattgtcacccagcgcaatcagcgcaccggttccaaccgccaccgcatcagcaccgagtgccagcgccttcgccacatccgcccccatgcgaataccgccggagacgatcagctgcaccttgcgatgcatgcccagatcctgcaacgcctgcaccgccggacgaatagcagcgagaatggggaggccgacattttcgatgaacacttcctgtgtcgccgccgtgccgccctgcataccatccagcaccacgacatctgcaccagctttcacagccaatgccgtatcgtaatacggacgggacgccccaacctttacgtaaatcggtttttcccaaccggtgatttcgcgcagttccagaatcttgatttccagatcatccgggccggtccagtcgggatgacgacaggccgaacgctgatcaattccgggaggcaggcagcgcatcttcgcaacgcgctcagtaattttctggccaagcagcataccgccaccacccggtttggcaccctgaccaatcacaatctcgatcgcatcggcgcgccgcagatcatcgggattcatgccatagcggctgggcagatactgatagaccagcgtctggctatgtccccgctcctcctgtgtcatgccaccatcacccgtggtggtggaagtgccgacggttgtcgcaccccgtcccaaggcttccttcgccgcaccggacagcgcgccaaagctcatacccgcgatggtgacaggaattttcagatgaatcggctttttggcatatcgcgtgccaagccacacatccgtaccgcatttctcgcgatacccttccagcggatagcggctgatggaagcaccaacaaacagcagatcatcgaaatgcggaacccggcgcttcgcgccaccaccacgtatgtcgtagatgccggttgcggcggcacgacgaatctggccaatcgtatattcatcgaatgtcgaggacgcacgcggcggcgtccacagggcgtcatcctgtctgggcggggatgcggtcatgtcagtaagctcccgcgttatcgagatggaaattataaagtcggcgtgccgatccatagcgacggaattcagcaggatcgacctgaccttccagtccggcacgcctgaacaggtcgaataattcctgcttgtgctcgtcacgcatttctttttcgatacagtccgtgccaaggcttttcactgatccgcgcacgaacagacgcgcctcatacaggctgtcgcccaacgcctctccggcatcaccgaatacgaccaggcgaccggcctgtcccataaaggcgctcatatggccgatgctgccaccgacaacaatctccacacctttcatggaaataccgcagcgggacgatgcattaccgtcgatgcgcagaatgccgccccatgctgttgcgcccgccgaagccgaggcgtcaccctttacatgcacaaagccggacagcatgttttccgctacacctacgccgacattgccgttgacaacgacatgagcctgcttgttcatacccgcacagtaatatccggcgttaccgtcaatctctacagagacgggtgcatccagaccaacggcaatggcatgcgcaccttccggattaacaaccgtccagtgactttcattggtgttttcatgcagcgcatgcaatgcgccgttcagatcgcgcaagggcgtggtagccagatcaaaggacggcatcactgatgctcccagaaatagacggtcgctggttccggttcccacacgcgggcctgcttgatgcccggcagcccggcaagagcacgatactccgatccgaatgcgacatactgatcggtttccgccatcacggccggcttacaggccaccggatcacgcagaaccgcaaagccgttttcagtgccgacaacaaatgtgaagaacccgtcaagatcattcagagatgatttcagcgcatccccgagcgacagaccctgccgcatacgcaggctgagataacccgccgccacttccgagtcattctcggtcgtgatgcgaatgccttcgcgcttcagcatacgacgcagaccggcatggttcgacagggaaccgttatgcaccagacattgatccatcccggtcgaaaagggatgcgcaccacaggtcgttacggcggattctgttgccatacgggtatggccgaccgcatgggtgccggtcatatcgccgatgccgaagcgctgcgcgacactgcggggcagaccgacttccttatacagttcgatccggtgtccttgtgcgaacacatccacacctggaacatcgtgtaaccagagcgcggctgcctctccgtacgccgcgggaacgataaacaccgcatgcgtatcgtggcggcgcacatccagcgccacgttcagcgcatcacgcatctgcgtggccagagcggcgaaatcatatccatcctcggcccggagagaaaatttcaccgtctccgtactgccgccaccatagatcgcgattccggcgctgtccgggccacgatcggtcatggtgcccagcatatcggctgtcatccgccccagaagcggttgaagccccttatcctttaaaaaaagcccgacaatgccacacatctttccatccacccggcttcatcctgtcaaggatgaaacagcatggcggataaaatgtcaactcatatgaaaataaatatcatcagaagaaattatggccagttatatccggcttaatgcgtcaccacctcatcaggcagcagcccccacatcgtggagcggcgcagatagccgcgataagatttcacctgcacctgacaccactcggatttggcttcacagttctgtatccgccccaccacaccgggtttcagaatggcgacggctgaggattcttcatcagcccggcggcgcagtgtgacaggagtctgtccgatggtcaggaaagtgcggcggccggtgagcgtcgcctgatgcacccagcccttgacgccttcctgatcctgcaccagacgccagacctgaaattcacgcacgatctcaaccggcagttcgcggcgtttataaacccactcgatcggataacgcgtatccggcccaacgcgcatattgacctcatcggcccgcaacgcggcaaaacgcgggatcggcagaccggtggctgatcctttgttcggatcgggtggcggcggtttgggtttggcgttcttgtcctctggcgcaggggccgttgccgtagcggcagcacctgtcgcggctccggccgccgcagccgcggcggcagctttggggacatgcttgccggtcgcatgggcattggcagaaggtgacgctttggccttatccccagcagcaccatgatgcggcggagacaccaccggcgttttatgtgtcgtcgccttgttatgatggctggaggagttgtgcttcaccgccggactggtctgcgcataggcagtctcacccgcacccagcacagaaccggcgcataaggccgccagcaatacatcccgcgcagaccgcttcagaacggggagagcaaaattcatcaaacggctgtgcatgcagtctccgttcatatcgacacgatctggcagccctggctggcctccagaaatccggcaattccgccaatccgcaccccgggcaatacatcctgcggcatgagatcagccattttcagtcccgcttcgcacaggatcatcgggatgtcgaataacgacagcgcgtcccgcaattcctccaatcccgccacgcctttcgcacaagcatcctgatcgcggctcgccccttccagagcactccagtcccgcatgagtgcagggcaggcggccgcgctggcaaagatcaccaccttccgccccagcgccgccgcacccgcggcaaggctgaacccgaaatgcacccgtgcgtaatcgccggagagcaggatcaagccgagaccctgcttctgccgcgcttcatccacggccatgcagccctccgcaggacgggcaatgagggtcacgcggcaggcgtattgtgcggaaacgaccggccagagcctcccagatcaacaaccggcccgacaggctctcccccatgccacaaagttccttgatgacctctgtcgcctgcaaactgccgagaacaccggtgacggcaccgagaatcccggcctccgcacagctcggcactgctccacgcggagggatctccggcgtcaggcagcgatagcacgggccttccggatcgagatgcgggcgaaacgtggaaagctgaccttcgaaacgcagcaccgcggcagaaacaagagtacgccggacatgcaacgccgcatccgccacgataaaacgggtctggaaattgtcgctgccatcgcagaccagatcataggcgctgatcaacgaagccgcattcgattcgtcgagacggccgacatgcgtttcaatccggatctccggattgatcgcctctgccgcctgacgggccgaatcgactttcagcatgccgatccgatcggtactgtgcgcgatctggcgttgcaggttggagagttcgacccggtcatcgtcaatcacaccgatcgtaccgacccccgccgccgccagatacagcagcaggggcgatcccagcccgccagccccgacaaccagcacgcgggccgctttcaagcgcccctgccctgtcgcccccatttcaggcagcaggatgtgccgcgaatagcgatggatttccggttcagtcagatcaatcgtcataatgcttatcataggcactgcaatcgggcagagggagagcatgatcgagacaaaaccgattcccggcctcgccctgccccgccacgaccatgcgctggtgctgttttccggcgggcaggattccaccacctgcctcgcctgggcgctggagcgcttcgcccatgtggagacgatcggcttcacctacggccagcgccacagtgtggaaatggaatgccggggcagggtgcggcaagtgctcgcgcacatgagcggccgttccggtgcagattggggcagccgactgggtgatgatcatgtgctggatctgggcaatgctctgcaccatgtcggacagagtgccttgaccgggcgctcaccgatcgagattggtcagggcggtttgccgaccagcttcgtgccgggccgcaacctgattttcctgacctatgccgccgctctgggctggcggcgcggactgcgacggatggtggggggtatgtgcgaaacggattactccggctatcctgattgccgcgacgatacgatcaaggccatgcaactggcgctgaataccggcatggaggcgcatttcgtgctggaaacaccgctgatgtggctgaccaaggccgagacatgggccttggcggactcactgggcggaccagcccttgtcgccctgatcgaggaagaaacccatacctgctatctgggggatcgcagccagcgccatccatggggttatgggtgcggggaatgcccggcctgctcgctgagagcggaaggctggcgcgaatggcagacggcttcttctgcctgatcccccccatccggccgggttgccagccagatcatgatggccattgccggcaaggctgacagcgtacacgcggcatagaaaccgtgccagcctaaccaaaccgccagaaatccggacgcacccgccaccgtattcaacggcagggcggacagtgaagacagcagagcatattgcgttgcgctatgccggggtgtgcacagaccggacaaataggacaggaaagacgcgctggccagaccaccgacaaaggcctccaccgccactgtaccgaccaaagccatccggctgccctgcgcatagccaagcgccagatagatcaggatcgccagggtctggatacatccggtcaggaccagtgcccgcatggtgcccatacgctgctgaagccagcctcccgccgccacgcccgccagaccggcgaacagggaaggcgtattggcaaaagccacatccgccttctgataccccatcgcccggtaataaggaggcaacatctttcctgccagcgcctcccccagatggaacagcgtcacgaagcatagcgccgcgatgctgtaaggcttgcgcagcatgtccgccagcggcgctttcatggcatgcagacgccgctgccagccggtttccagcgtgacggtctcggggatagacgggatcgccggttccgtcgccagcagcgtcaccaccatgccaagcgcactcagcgcacccacggcaagcagggccacatgccagcccgcgagactggccagcccgatcaccccggcattgccgatcagcagcgccatgcgatagccccagacatagccagccagagccggcccctgcccgcgacgaccgaaagtctcgatccgccatgcatcaatgacgatatcctggctggcagaaaaaaacgccatggaggcagccagaccgatggtgaggaaaggcgtcgcatggggatcggtcatggccatggcgaggatgctggttgtcagcaccgcctgcacgaacaacagccatccacgccgacgccccagacgtcgcaatggtccaggcgggtgaacataatccgctaccggcgaccagagaaatttgagcgaataggccagcgtgatcagcgaagacaggccgatcgcctgcaaggacagaccgctatcgctcatccactggcccagcgtgaagtggcacagcgggaatggcagaccgcttgcaagaccgtacagaccgatcaaccagaggcgacgatccgtcagggaaatcgtggcagcgccgggcgcgcctgccgcatcatcaggagggggcaatccggtcatccctgcgtcatgccctgcctggaagaacacggcaagacgcgggaccatcctccaccaatccagacgccgtacagcaaaacgccggccccggtacaggaccggacccggcgtcgcctgtcaggagaagcgcgaattactgcgcagcagccggagcagcggcgtcagaagacttcgcggccttgctgtgatgaccagcgtgcttggcgtggtgcttcttgccatggcccttcgccggagcggcgtcggtggtggtggcaggagcagtagccgcaggtgccgcggcggccggagcagcggtttcggcggactgagcgaaagcaggggcggcaaaagcgaaaccagccagcagagtggcggtcaggatcacatggcgctgaatggtcatgtctgtctccatagaaaactggaaagaacgaaacatgcggtacacccggtgggagcatatgaagccgacgcgtccctcaccgagactgaccgtccgcaccgcacagcctgtaggttaagcacacaagttttgttccggctatgggaggaagcttaacaggaagatgaaattatggttagaaatgcctgcaaaaccagcagaaaaacaaatttctgttacattttcgtagtacggtcacaacaaaacacccgccctggttagggcgggtgttcttggccaaatgatgacaaattggacaggtggcgtgacctgatcaggccgcatcacccgagcgctgggcttttttgcgctcattcggatcaagatggcgcttgcgcagacgcacggcactcggcgtcacctcgaccagttcatcatcctcaatataggcaatggcctgttccaggctcatcttgcgcggcggaaccagcagcagagcctcgtccttgccggcagcacggatgttggtcagcttcttttccttgatcggattcacatccagatcgttctcacgggaatgctcgcctatgatcatgccgacatagactttctcgccgggatcgacgaacagcacgccacgatcctgtagcgcgaacagcgcatactgcacggcctcgccatcggaattggaaatcagcgagccattgcggcggccttccagcgtacccttgtaagggccatagccggagaacagccggttcatgattccggtgccacgcgtatcggtcaggaattcaccatgataaccgatcaggccacggctggggatcaggaaggtcagacgaacctttccaccaccggagggacgcatctcgcgcagttcgcccttgcgacgggacatcttctcgaccacgacgccggaataaggctcgtccacatcgaccagcacttcttccatcggctcctcgcgaccattctcggtctcccggaacaacacgcggggacggccgatcgcgagttcgaagccttcgcggcgcatggtctcgatcaacacaccgagctgaagttcaccacggcccgcgacctcgaacgcatcgctttccgagctttcagaaatgcgaatcgcgatattaccttcggcctcacgcatcagacggtcacgaatctggcgggaggtcaccttcttgccttcgcggcccgccagaggaccatcattgacgcggaaggtcatcgccagtgtcggcggatcaaccgggatcgccaccagcggcgcttccagttccggcgcaccgatggtttccggcaccgtcgtatcggacagaccggcaatggcgatgatgtcgcctgcctcggcttcttccaccggcacacgatccagaccgcggaagctcatcagcttcgtcaggcgaccggtttccaccaccgagccatcagcgcggagcgccttgaccggcatgttcagcttcgcgcggccctgctcgacacgaccggtcaggatacggcccaggaagttgtcgtattccagaatcgacgcgaccatggcgaagggcgcttccttgtccagctgcggcgcagccacatgacgcaggatcaggtcgaacatcgggttcaggttttcccgcgcgccttccagagactcgtcagcccagccctgacggcccgacgcatacagaaccgggaaatcgagctgcttttcatccgcgtcgagagaggcgaacagatcgaacacctcgttcagcacttcatccgggcgggcgtcgccacgatcaaccttgttcaccacgacgatgggacgcaggccgcgggccagcgccttgccgaccacgaacttggtctggggcagcacgctttccgcggcatcgaccagcaccagcgcgccatccaccatgttcaggatacgctcgacctcaccgccgaaatcggcgtggcccggggtgtcgacgatgttgatgcggacatcgttccacatcacgctggtgcatttcgcgaggatggtgatcccccgctcccgctccagatcattgctgtccatggcgcgttcagcgacctgctggttctcacggaaggcgccggactgcttcaacagctgatcgacgagggtggtcttgccatggtcgacgtgcgcgataatggcgatattacggatgtccatgcataatccgaggctgagcgcagccgatggagccgcgcggcggcaaggcagagggccatccccttccgcgtttcagcagaagaaaagaactggccacccaccagacctgttgcgttgcggcgcacagataaaggcttgtcccgccggttgcgagacaaaaagccgcatagctccccttcccgacgtttttttcatcccgccggcgcattcaggtcactgccgcccatcacggatgccgggtggaaagcacctgtaatgcggcgtcgacctggacccttgctccggcaaaatccttttgggccagtgccgtcagggctgagttgatcgtctggatcaccggcgattgatccaccggatgcgtatcagtcgccagcacggaacgatcgagcagacgggtttgggcgcgctccatcgattcctgtgccagtccactctgcttctgttgcagcgccttcagcgccacccgcaggagagcaacaggcccgttcgcatcctccggcaccggcaggctgggcgcaatggtcgaacgggtattggccggatcaatattgctggccttgtcggagcgcggcagggaactgccggtgccgatcacgttccccggacgggcgccgtcaggcgtgctgctatccgcatgcgcgcgctgaaccgatcccagcagcagcatggcggccaccagcgccgcagcaccggcggaacggttatgagacagtcgatcttggatatgttcgtgcatggcctcgttccccatttcatcggcgccccctctggcgggccgctccaggtcacaatccagaaacgtattcagtttgccgacacgattatagcgcaaccatgtccggattctgaacgtttcgtatgatgtatgggtttataaatagggggtgacgatgctcaagctggcgctgtttttccttgtggtttcgctgattgcgggcctgttcggatttaccgggatctcggcggcctccgccgggattgccaaaatcctgttcgttatcttcctgatcgtgttcgtggtgctgctggtcatggcattggccgccggaaaagccattctatagcgatctttccacattcaggcgaaacaacggctctctgccccaaccggcagggagcctttttcgtggccgcctccatcagggtcccaacacatccaccgccaccgatttgatcagggccagtacatgtcgaccgggttcaagaccaagccgttgaatcgcatcccgagtcacccgggccagcaaatggccaccgggcaaagccagcctcaccaatgcttcctgtgtcgttccggccttgccctggagatgggccggctgccagtcggtcatcacaacgggcagaatattgtgcaggctgatatgaccgggtgactccgtcgccacgatcacatcggcggccggtatccttacccgcaagcccgttcccggcttcagggcctgtaacggcaccaacacttcggtcccggcacaggacaggatggtcaagccacgatcgggcatatggccggataccaccgcttccagaaccgcaccggcctcatggccgaaaccgccggacaatgccggatcggatgaaatatggcccagcgatccgctcgcccgtacccggcccgtttccagcagcaccacatcatccgccagatacgccatctcctgcagagcatgcgtcacgtacagcatcggcaatcctgctgctttcaaacggcgcaggaccggcagaatgtcctgcttgcgcgcctgatccagactcgccagcggctcatccatcaccagcatatggggacgggacaacaacgcccgaccaatcgccacacgctgacgctcgccgcccgacaaggtcgcgggacgacgcttcagcagagcaccgatcccgagcatggtcatgatttcttcccgcgacaggggaaaatctcccgacaggggaaaatctccgggcggggcacgccgcgcgccgtattcgagattgcccagcaccgagagatgcgggaacaggcgagcatcctgaaaaacgactccgatccggcgtcgttccggcggcaagtcatgcagatcaaggccaccgacacgcagatgcagatggtcgggccgcatcagaccggccaccgccatggcaatggtcgactttcccgccccggaaggcccgaacaggacagtgcatcctctgcctgcaaaacagacgtcgatttctgttccgggaaaccggtgattcagccggacctccagcgcggccgatgacatcagcttcccgaccaccgccgcatccggcggtttacatattccgccagccccagtccgcccagcgccagcagcagcgacaacagcgagaggcgcgccgcagtcgcgtccccctctggcgactgcaaggcgctgtagatcgccagcggtaaagtctgggtctggccgggaatattcgccgcaaaggtgatcaccgctccgaactccccaaggcaggccgcataggcggtgatggccccgctcaataatccgggggctgccagcggcaaaatcaccgtcacgaaccggtcccatgctccggcccccaaggaacgggcggcctgttccagacccggatcaaccgcttccagtgactgacggatagcccggaccagaatgggcaatgtcataaccgcgcaggccaggctggcacccgccggagtaaaagcaagccggatgccgaaccagtgatgcaaaaggctcccgaccggtccctgcacgccgaataccaccagcagcaaccagccggtgaccaccggaggcaaaaccagcggcacatgcaccagcagatccagcatcgtacggccgggaaaccgccagcgcgccaatgccgtcgccagcagcagcgcaaccggcaaccccatgcataatgcccgcgccgccaccgacaaggtcagccgcagcgccacccattcatcaccggagagcgggaacggccagatcatgcccaccgcatctgcgtaacagcgataccggtctcaaagcccccgaaagccataacgggcaaaaatcgccagcgcctgctctccgcgcaaccagttccatacggcttgcacggccggtgtgttgccgttggcaagaacagccattggatagatgatcggatcatgggttttcgccggaaatgtcgccgcaaccgttacgccctgagccgctgacacatcggtcgcatagacgatcccggccgcagcctcaccccgcgccaccagttgcaacgccccccgcacatcctccgccaccgccagttgatccgccacactatcccacaatcccagactggtcagagcctgacgggcataaatgccggccggcacatgggatggatcccccaccgccagccgcccatctccaagcagggccttcagggcctctttccgggtgagatcaaccgcctgtgccttcgcgcccggaaccaccagcaccagcgtattggccagaagatcaacccgcgtattgcgggcaagcaggtttttagccgccagcgcatccatccatttctcatcggcggagatgaaaatattggcaggcgcacctttctcgatctgccttgcaagagtggaggaggatgcaaaagacagggtcagaccggtctctgcctcccgtcggaggaccacatcggcctctttcagcgcgtcggtcagacttgccgctgcgaaaaccgtcacgggtgcattctctgccgacgcccgcgatgatttcaggatcatcggccagagggcggcactcatgagcagaccagtccccaggcaacggcgtgatatgagcatcatacgcttcccatcgttatgaccgtgtcaaatatatcgccttgtcattgctgctgccagccgacaagaatacctgccttaacgcttgccagccccggacatttccgcgcctgccgtacgcgccatacccaaagctgtcggggcagccaacaaggcaatcgcgccgatcagcagaaaagcgaccgaaaaatccgcaagacccggttgagtacggccatgaatggccatagccatttccagtgctcccgccccggctgatacgccgattgtcagggaaagctgctggatcgttgaatacaggctggtcgcggcactcatccggcccggcccgacctcggcataggcaagtgcattataggcggtgaattgcaatgaccgcagaaaccctgccggaaccagcaagccatagaccagcaccagcggccaggaaggtcgcaacgccgccaccaacgccaccagcaccgccgagccaatcccgttccagaacagtgtatcgcgaaaaccccactgccgcagcgcccgcgccgccaccgctttcatcgccagagcccccacggcactggccagcgtaatggccccgcttttcaggggtgtcatctcgaaacccacctgaagcatcagcggaagcaggaatggaaaagcacccgctgaaatcctgaataaagtgccggagatcactgaaacccggaatgtcggcagacgcagcaagcccggatccaacaccggcctctgtctgccgcgcgcatggcaaagataaacgacggcacaaagcaggcccgccatggccagcaacaacgtcacccatggcggcaccacaccccgccccaccgtttccatactcgccatcagcaatgccactgcaccaccggacagtatcagaccgcgcgcatcgaacgggccgggatcaggggcgcgtacatccggcacatgcagcgtcaccatgaggataccgagcaggccaaccggaatgttgatatcgaacacccatggccaggaggcatattgcacgatcagcccgccgagcggcggccccaccaccggtccgaccaaagccgggatcgtcacccatgccatggcattgaccaattgttgcttgggaacggtacgcagcaacaccaaccgcccgaccggcaccatcatcgcaccccccagcccctgcaggacacgggaagcaaccagcataccgagcgtggtggaatacccgcacagcactgagccaagcgtaaaaattccgattgccgcgcgaaacacattgcgggccccgaaccggtccgccacccaaccggaagcagggataaaaaccgcaaggctcaacagataggccgtcagggccatgctcatatgaaccaccggtacaccaaattgccgcgccatggcgggcagagcggtagcaatcacggtgccatcgacattctgcatgaacagcgcacaggcaacgatcatcgccgtcacgcggctggacgtcgtcaccacccggtccccgctacccgcatcattgcgggccccattgcgggccccattgcgggcgctgtcttcagtcatcctcacgcggggtacggcggaccagcacctcacgtttgccgacatgattggcggggccgacgatgccttctttctccatctgctcgatcagcttcgctgcacggttatagccgatggacagatgacgctggatgaagctggtgctggccttgccttcccgcgccaccagcgcaacggcctgatcgaacagacctttctccccgtcgcccgccccgcccatgccgggaatcatggagccgccatcctcgtcactaccctcggtgacttcctcgacataatgaggctcgccctgcgcacgcaggaaatcgaccaccttctctacctcaccatccgaaacaaacgggccatgcgtgcgcagaatgcgtcccccacctgccatgtagagcatgtcgccctgacccagaagctgctccgcgccctgctctcccagaatggtgcggctgtcgaacttgctgatcacctggaaggaaatacgggtcgggaaattggccttgatggtgcccgtgataacatccacggacgggcgctgtgtcgccatgatgacatgaataccggcagcgcgggccatctgcgccagacgctgcactgcggcctcgatctccttgcccgcgaccatcatcagatcggccatttcatcgatcaccacgacgatgaatggcagcggctccagcgccagctgctgctcctcgaaagtcgggcggcctgtttcggggtcgaagccggtctgtacccggcgggtcacgacctccccccgcgcacgggcttcagccacacgttcattatagccggtgacgttacgcacgctgagctggctcatcgagcgatagcggcgctccatttcccgcacgacccatttcagcgccgtcaccgccttggccggttcggtcaccacgggcgacatcagatgcgggatgccatcatacaccgacagttccagcattttcggatcgatcaggatcaggcggcattgatccggggacaggcgatacagcagcgacaggatcatcgcattgacgccgaccgacttgccggaccccgtcgtgccggcaatcagcagatgcggcatgcgggccagatcggccaccactggcgcaccgccaatatccttgccgagcgccagtgccagacggcccggatggcgcatcgcctcatccgcgccgagcaattcggcgaggtacaccgtctcccgtttatcgttaggcacctcgatcccgatgacgtttcgccccggcaccgtggcgatacgcaccgcgagcaccgacaggctgcgggcgacatcctccgccaggccgatcacgcgagcactgcggatgccgggggccggttccagctcatacaacgtcaccaccggaccggggcggatatcgcggatcgctccctgcaccccgtattcgcccagcaccgtttccagcaaccgggcattttcctgcaacacctcgtcactcggccggctaccgccacgggggggaggctgcgtcagcaggtcgagcggcggcaactgccagcccggctcttcttccacaacctgccgtgctgaacgaccataagaggcagcactctgcgctgacagggacgatgcccgcgcaggcacagccaccgtgatgcgcggatcaggtctgatccgcggcggtgcaggcaccccgaccgcttcggagggcggtgctgcctgaatctgccgctcgtcaaagtcttcatcggggaaatagggatcgtccccatcatcccgcatggcaccatcgacaggcccactcccggatggcgtgcgttcctgcgccttctggcgggcacgggcagtgcgggaggaacggttttcctcccgcaccccctgttccatcaccgtcatatcatagcggagatgcccctccgcatcgtcctcatcatccaccagccggaccgcacgctgtttcagccgccccagcaatccgccaccccgaccgaacagaccgcgtgaacgagacatggcgggaccgatatggtcaccataaaccgatgacagggacgccgctccacgccctgcagcccgccactcccccgcagaaaggccaaacgccagaaagaccagcaggatggccaggccaagccctgccacccagatcaatccatcccccagcggtcccagcactgcatgtccggcctggagcgaagcaccggccagcagatcgccgctcaatccgcccgggccggcggaacttggccagttccgatgcaaggcaggaaccagttgtcccacagccgccaccacggcagacacaaccggcatggcgacaagcagactgccgaaccgcaagatcacactgcccagtccgcgatgggacgaaatccgccatgcccagatcagcatcgccagcaccggcaggatcgccgccaccccaaatccctgcaacaacacatccgccagcatggccccggcacggcctgccagattggttggctcctgcccggttgcggtatcgaaggaaggatcgtgcgggttataggttaccagcgcgatcagcagtgccaaagcaacaaggcccagcaccaatccccccatctccgccatacggcgatgggcaagtgctttcagggcgggggacaggaaacgttttgcctgcctctgacgtggcgaggtcacgacggccatctggtctccactgttcagcaaatgtttcaaccttacccgataagtccctgatcagcaaaggcccataccgcatctatccataccgtgatgacatgtgtgagtggaaagcagccgcttcgcacatgttatcgaaccggtccatcatcagaaacgttcgctccggactttcgcggggttgcgagcggcagacagcatcccaactaccaacatgattgccccatcaggtccccagcaggggcgcaggcatttttttcatgatccggaaggatttttatctatgtcgtccacaacccttttctctgctggccagattggtgccataccggttgcaaaccgcgttgccatggctcccctgacacgcgcccgtgcaggcatggacggggtgcatacgccactcgcaatcgcttactatcgccaacgcgcctccgccggtttgatcatcagcgaagccaccaatatttcgcggcagggacgcggttatgccttcacgcccgggatatataccgatgcccatgtcgccgcctggcgtccggttgtcgatgccgtgcatgaagcaggggggcgtatcgttttgcagctatggcatgtcggacgaatttcccacaccagcctgcaggaaaacggacaaccccctgtcgcgccttccgccattcaggccgggcagacgacattcaccgaatctggtccagcccgtccctccatgccccgtgcgctgcatatcgatgaaattcccggcatcatcgatgattatcgcaatgctgcacgccgtgccaaagacgccggctttgatggcgtggaagtgcattccgccaattgctatctgctggaacaattcatccgcgacagcaccaatcatcgcgacgacgcctatggtggctcgatcgaaaacagaacccgcctgtctttcgaagtcacacaggccgttgccgaaatatggggtgcagaccgcgtcggcatccgtctgtctcccatgacacattccgcaggagatactccgctcgacagcacgccggcggaaacatacggatttctggcagagcggctcggcacgttgggtctggcctacctgcactgcatcgaaggcaatacgcgtgagacaaatgccaaagatgctttcgactatcagtctctgcatcgtgcgttcgggggggcctatatcgccaacaacagttatgatcgcgatctggcactggatgcagttgcatccgggcgggccgacatggtggcattcgggcgcccctttatcgccaatcctgatctggtggaacggctccatcgcaatacaccgctcgccacagcctctcaggacgttttctacggtggcggcgcagaaggatacacggatttcccggccatgaccggtaccggagactgacggagcagcctcatactctttttgagtcttagttccgggctttttcttccttgaccggattgtccattcccagcggcaatccggttctttggagtaaacgggtttcaatcttcggatcgttgaaggtcacgttctgccaaccaccacccagcgccttgtaaagctggatcgtattacggatacggtcgagtttgctgatggcaacagcatcttctgcggccagtgcagaacgctgcgcatccagtaccctcatatagccggtcaaaccgtgttcatagagagtccgggactgagcaagtgccttctggctctgggcctgcgcctccagcagatttttatcccgctcctgtgctgtggagaaattgaccagcgcatcctcgacctcacgcagcgcgatcagcaccgactcctcatacgtgatccgcgccgcttcagcttcggcctgggctgccgtcaggcgggcatgacgacggccgccgtcaaacaaaggctgtgcaatgccgacacccatcatccaggtcatactcgccgcactgaacaactggtgcagtgtcgagctcatcggctgcaccacaatcgggatcatgaaacgcggataaagctgtgcctttgcaacacccacctgggcaagggccattgcgtagtcccgctccacccgcctgagatcagggcgatcagcgattacctgcgccggcagcagaaccggcaaggcaggcggcaccggcagaacaggggtaggttgcaacagctcggcctccagcgtgccgccgggaggcttgccaatcagcacaccgatcgcatgcgcagccatggcaatcatcgcatgcaaaggtggctcggttgccttgatcgtctccagctccgcccgggcctgtgacagatcgagggttgagcgtatcccctgaccgacctctttggataccagatcaacaatatgctgtgcggtaacttcgtttttccgcacgatctccagccggagctgactggcccgcaacactgcatactggcttgccagctcggaaatcaggctgaccaatatggcacgtctgccctccaccagcgcatcggcactggcattggcagcctccaccatccgtcttgtacctccgaaaatatccagctcccaactggaatcgaaagtcgtatcccagtaacggtacgcaatctgcggcaggccaggccattgcatcgtacctgaatatccacgactttgcttggtagcactgagattgatctggggataccaaccagccaccgcattttcccgctccgcacgggccatgatgatgcgttgctgggcaatggccagactcagattgttgccaatagcatcatcaaccagccgatccagcaccggatcatcaaatgagcgccaccattctgccaggctgatacgatcccgcgatgtcgcgtgctcgtgcttttccgtccagtcaggcgggatatcggtttttggttttctgaaatcaggaccgactgtgcaagcagaaaaaaatactgcaaggctcaggggaaaaacgactgatctcacagacgatcttccaaccactgaacggcacgtccggcagcactgtagtcctgatcagcctcattgccgagtgccacagagcaggtcataccagctgccagcgtaattgatttcggaaccttatcaatgtgaatcctgaccggaatacgttgcgccagacggacccaggtgaacacggggtccacatccggcaaaccaagattatccagggactgattcttgtcgttgatgccacgaccaatactgtcgacgtgaccggaaagaagctctgaatatcccatcagcttgatacgcgcaggatcaccagccttgatatgatggagctttgtttcttcaaaatagccataaatatagaagctgtcggcatcaatcattgcgagcaaagcatggcccgccgttgcataatccccaacccgcagctgaagattcgtcacatagccattgaccggcgcatacagaaccgaccgctcaagattgagctttgcaacatccagatcggcttttgctttttccactgctgctgctgatacggcggccgtggtacggaactgttcctgttcttcaggggaaacaatccctgtcaggccctgccgcctttttacatccgcctgattgttccgataccgcgcctgagcactgtccagcgcagcctgagcttgcgcgatggccagacggaaacggatcgggtcgagttcgaacagcacatcacccttatgcacaaactgattgtctctgacggcgaccctggtcacatatcccggcacttcgggacctacggaaacgacataagcgcgaacacgcccatcgcgtgtccagggtgccagcatgtagacatgccacagcatcgcgcccagccatagtgccacaccgaccattacaagcgtgatcataatgcgaacggcgtatttcagaaatcgcatgatcaggacttaatcctatgcgtaaagaacaagcagggacaggatcgacacatacaccgccagctcaaaaagcggtgggtgccagatgaattgcaacagccccgtcaatcgccagaaactgcgcaggatcgcaaacagcaccagtgccatcacgccgtaaacactaatgggggccaccagaacaccccagatattgacttcatgaatcatgactgtgaaacttgcctgcccccttccagcaaaagcaaatgaagctcggccagagaggccgcagtccggagcaactgcggatcatgcacaccggctgctaccacctccctgcatgcatggtcagcaaactcggcagcacgctgcggctgacgacgcaggacggccagcagcctttgcacggcaggacgggcggaaaccggaacaatgccatgctcgatagcatgcctgatcttgaatatctccctccctgtcagcaccagtgcagccgatccccggcctatccgccgccgctccggtcctgcgggaggtaaccgggcggaaatgcgcatcagtttctggtattgcggatattcccatgtcaggttggaggccggcatttttttacgggcagcatccgatactcctctccatagggacagggtagccagccgaatggacatctcgaaactgggcggcaccaaaatcataaaggctatattggccgccagagcaccaataatgctgctgaagacagaattcagaaatcctgtcaggttataatgaatgggattggcaatcgggctcagcacggcataaaacagcatgatcgacattgcgagcgcgggatttcgtccgcttgcctgcatatagccacataatatcactatgggcatataggccatcagcagcagtggaaatccgtccatatgcaccagaatgccatagaccagcacgaatgacaggacactggcgatcaacgtaccttgcaggaacgctttcatcatccccgagggattatcacccgttgccgccagagcaacgataatcgcggtcatcacgattgcgctgcccccgctgggccattcggtatagatccagaataatcccaacaattcagcagccagaaacgcccgcaatccactgcgcagagcagtcacatgatcacgccacagcggtagcctgacccggcgaattttctgcacccgcggatcggcaagccgtgccatcatccgcaactgccgtgcagcgtcatcaagaagattgaccagcccgagcgatttcagacactgcgtatgattggcaaagtgccgcagctccacatgcatgtgggaggatgcggcaaccaggtgtcgcagctcctgaacattgtctggtatgtgctgaatcagatttgacaatatccggcgcaaacgggctgcagcctctgcggtctgcggatcagccgacaatgcctgcaacctctccccgatccgcatgctgcttgccgtcacggatgtcatgagaccgaatagctgccggaacgcattggcgcgacgggcaacctcactgctctccgccgccccgaactcgaccgcctgatcgtaggaggcaatgcggaacagcaggcgacgacgcgtatctaaaatcttttcttcagaggccccatccctgaccatcgtcagtaattccgacagatcccgcagggactgcatggaatctgcttgaagcttattctcagaagtagccggctgaagcagcatcgtcaccaatgcactgcatacaatccccagtgacaccacggacagccggtccaacgcgacactgaaaatcgtatccggatgggccagcacgtcgccgaagcctatcaaggcgatggtatatcctgccagcgccgcactataagcacgaaaatagcgcagaaggttggagatatagctgcaacatcccgtccagacagcaaaagccgacagatacagcaaaggcgactgcacaaacagcgcaaccgccatgatactcgctacacagccaaggatcgtccccagaaaacgccacaggcttttggaaagaatggccccccgcatcgggcttgcgacaatgatcgtcgtgacaagggcagaagaaggattctgaagctgtagaaaataggcgcaatacagggcaagcgatccactcagggccagcctcagcgcataaaaaaaggccgctgatctcagaaaccccggcagccaggctcccatgtcaaacccatcctgaccggctgtatgcgatgctaccggcatgaccgtctcagccctctgtcacttgcgggagaccggccgccacatcccacatcctgtcttctgtcaaaacctgttccagatcagaaagggtctttatgcaggcagtcaactgctctggctctatcagcgccatcagggcctggtcggtcctgcaacagatgatcaggacctgatccaggacgcgccttccctccgccgtcatgcgcaggagtttggatcggcgatctgccggatcttcatagcgttcgatcagggattgcccttccaacagatcgagcaagcgcaccagagaggggctttctatatccagcatgcgtgcgagttcgacctgacgtaccccatccccggcccggcccagataaaagagcgggcgccagcttgcttcggtcagtccgaaatggcttacattccgcgtgatctcacgccgccacgcagtggtgacacgatgcatcaggcggcagaattctccgggtggaatatccatggcagttcattagaatactattttttagaaggctatgaatattataatctactgaccacaaaaaaagggggaagctgaagcttcccccggaaagtcgacatgatgaacgaggtttaaagacggtcagcccagacgttcgccatgcagcgtgacatcgagaccttcgacttcctcttcctgcgttacgcgcaggccgatgacgacatcaatgatcttgagcaggatgaaagtcatcacgccgctccagaccagagtgatgccaaccgccttggcctgaatgatcagctgcggaatccccccgactacaccggcgggagaggcatcggtcgcagaaagcggaccgtaagcgaaaataccggtcagcagagcgccggtaataccgccgataccatggacgccccaggcatcaagactgtcatcatagccgagcatgtgcttcaggctggtcgcaccccagaagcagatggcaccggcgatcagaccgatcagcacagccggtccaggcagcacgaaaccggctgccggggtgatagcgaccagaccagccacggcaccggaaagtgcacccagcacggtcggtttgccacggaccatccattccaccacgatccagccaatcgccgcaccggcagcacccagctgggtagcgacagccgccatcgccgcacgaccaccggcactgccggcagaaccggcattgaagccgaaccagcccacccacagcagggaggcaccgatcagagcataggacaggtcatgcggtgacatatcatcccggccatagccataacgcttgccgagcacgagggcacagaccagaccggccaccccggcattgatatgcacgactgtgccgccggcgaagtcagcggcccccataccggccagccagccattcgacgcccagacccagtgtgcgacggggctgtagacgatcagcgaccacaggacgatgaacaccagataggcgctgaacttcatacgatcagcaaacgcaccggcgatcagcgccggcgtgatgatcgcgaaggtcatctggaagaacatgaaaagagattccgggatcgtcatgcccgccataggcgcatcactgcccttgacgatatggtcggcaatgccgttcagcaggaagcgggacatgtcgccgacataggcattgcccgtcccgaaagcgaggctgtagccagccaccatccatacgatggacagtacagcggccgcggaaaaggcctgcatcatcgtcgccagaatgttcttcttgcgcaccatgccggcatagaacaggccaaggccgggaacggtcatcatcagcacgatcacactgctgatcagcatccacgcggtatcaccgctgtcgatcttcggcgtatcggcccaggcgggcatggccgcgaaaagcggcagcgccgcagcggcagcacccagccccagcttgcggctccccatcttgcggcttggtaaccgcgcctgtgcccggcagttttccgggcaaggaagatcagctttcattctttggtgtcccccaatgaaacacatacgctgcgcatgtacgggctcagcattctttgcatccccgccacgtggcgctttttgaccgttcccggccttcagtgatgtgacgaaacggctttacagcgcgtccgcatccagttccccggtgcggatgcgaacggcgcgttcgatatcgagaacaaaaatcttgccgtcaccgatcttaccggtattcgccgctttcatgatggcttcgaccacctgctcggcaaggctggccggaacagcaacctcaatctttaccttcggcagaaaactgacgtgatattctgccccacgatagatttcagtctggcctttctgacggccaaatcccttgacctccgtcacggtcagcccctgcacacccagcggcgtcagtgcttcccgcacatcgtcaagcttgaagggcttgataacagccacaatcagcttcatcccggtgctctccttccctttggcggaacgccattgcaatttgcggggcgtgtcccacacgggcaggccccgtgatgcacaacgcaccgcatgcgaaatctgtataatcaaaaaccgtgccgggacgtttcatccctgcatttaccgacggatgaacctataataatcagagaactgcaacagactgcccattttgtacgcaattcaagaccctgatcgctcgttttacgaacgatccggtttgaacgggaaacgatatatctgatggtccacgcactgcctgacatcccgccttcttctgaaaacactttgctggaagccgatctctgcatcgtaggggcgggtccggtgggtgggactctcgcctgtcggctggcggctgcggggctgcgtgttgcgatcatcgataaggcatccttgccgcccatggagcatccggccttcgatggcagggcctatgcgattgctgccggggtcaggaattttctggctgaggcaggcctttgggatcttctgccggatatgccctgccccattcacggcattcgtgtatcggatggcaaggttggacgcccggcctcaccgctgcatctgcatttcgaccatgcggagacgggacaggacagtaccagcgatcaggctttcggctggatggtggaagcccgcgccctgcgccgtgcgctgaatcagcggctgcatgatgacccgtcgattcatttgtttgcccctgccgactatgacatacagcgcatggaagaaggtgtgatcatccatatccaccagcacggccaaacgcccgtgcagcttcgctgtgccctggtcatcgccgcggaaggacgacaaagtccgctgcggaaggaagccggtatccgggtcacgaagctgggatatgaccagatcggcatggtctgcgccgtggcacatgagcatccgcacaacaacattgctctggagcattttctgcccggtggccccttcgcccaactgccgatgaccggtattcccggttctccccatatttcggccatcgtctggaccgaacggggcgccgttgcacagcgtctcgccacattggacgatgcgcgttacacgaaagaattacagcgccggctgggtgatcatctgggggagatcaggttgctgggccgccgctggagctatccgctcagcgcgctgcatgcacatcgctattatgatacacgcctgctgctggtgggcgacgccgctcacggtattcatccgattgccgggcagggcctgaatctcggtttccgggatgcgatgacactggccgatctgttgatcgaggcgcatcacaccgggcaggatatggggaatacgcgactgctcaccacctatcaggcggcacggcgccccgccaatctcgccatgctgctggcgaccgacgcgctggaccggctgttcagcaccgatcgccgttctgtcagactggcacgtgatctcgggattgcggcggtacatcgcctgcgcccgctgaagcaatttttcatgcgtcaggcgatgggataagcacccagccgaacagccggcaagccttcaggaggaacgcagagcctccagctcctgccgcagttcagcgacacagcgttccaactcctcaatccgctgctccattcgtgtacggagctggctgcgtggtccctgaaccgtgaaccaggagcggcccccactcatggccgcctccccacagacgcggggggacaaggcctccgagctggtcgtgggcgcaggaaccgccgaagcggcgcgggcacgctcggctgtgcggtccgtcacatgtcttgaacggcccgggcgaccagatggcacagtcgtcatcgcttatcctcccttcccgtctgcattggagacggatcgaattattttcgcttgtggcgcgtttgggaagagattttttcatcctcacccataaaatctttctgaaaatttctttatggaaccataacaggaaataaatacctcttatggggaggctacttttgcgccgttctgcggccaaaaacggtcacaggccatgttttttcaacagcttgtgacgaagccgcatttacaggaaggttgcggcgaccgagactgtccctgtccggagaggtttaaaacccgttatccatgtctgccatcgcatatgtctgaacgtcatcccatcatttccgtcaccggctcctccggtgctggcacgacctccgtgcgcaatattttcgaccatattttccgtcgggaaggcattcacgcggcctatgtcgagggggatgcgttccaccgttacgacagggatgaaatgaagcggcaggcagaccgcgccatgcgccagggcaacccgcatttcagccatttcggcccggacgctaacctgctgaaacagcttgaaaacctgtttcaccaatatggtacgaccgggacagggcagacccggcactatattcatgatttcgatgaggccgcccagttcggccagccccccggcacatttacggaatgggagccactgccggaagacaccgatctgctgttctatgaagggctgcatggcgcgctggtgtcggatggcgtcaatacagctgcccccgccgacctcaagatcggcgttgtaccggttatcaatctggaatggatccagaaaattcaccgcgaccgctcggcccggaaatattccaccgaccaggtcatggagacgatcctgcgacgcatgccggattacgtgcattatatctgcccgcaattcacgcacacggacatcaactttcagcgggtaccaacagtcgatacctccaacccgttcatcgcccgcgccattccaagcgccgatgaatccatcgtggtcattcggttccgcgacccgcgcggaatcgactttccctatttattgtcgatgatcgcaggcagctccatgtcgcgggccaattccatcaccattcccggcaccaagctggaactggcgatgcagttgattctgacaccgatcatcctgcaactggtggatcggggtcgacaggcgcgttaaggccgattcctgcaacaggggattgcactcaatgccgcaaagctgttgaaaagggctgcctgtttcaaagccggagcaaccgccatttcatccgtgtccgatatcgaaccgatcatcgatctacaaaaggaactggaaagcgccggggtgagggaggtgctggaggcgctcgatcatgaaatgatcgggctggcgccggtgaaaagtcgcctgcgggaaatctgtgctctgctgctggtcgataacgttcgtcgccgccacggattgatgagcgaagcaccgagcctgaacatggcgtttaccggcaaccccggcaccggcaaaaccaccgtcgccgcccgcatggcgggcgtgctttatcgtctgggtttcaccagccgcgaccgtctggtcagcgtgacaccggatgatctgctgtcagacacgattggtcagaccgcccagagaaccaaggatgccatcgcccgtgcatcgggtggggtcctgctgatcgaccaggcgcatttcttgctgcggggtgataacgggttcggacaggaagcgctggaaatcctgttacaggtcatggagcgcccggaagccgatgtggtgttcatcctgaccggatacaccagagaaatgcagcatctgtattccagcatggcgggcatccgcagccgtatcgcccatcatatcgaattccccgattataatgaggaagaattactggacatcgccgaagcaatgctgatgcgccagaattaccgtttcagcgacagcggacgggaggccatgatccgcttcatcgctcaacgacggacagaaccgttcttcggcaacggccgcaccatccgtaacgcgctggatatcgcccgtctgcggcaagccaaccgtctggttgccattggcgggcaggtcactccagcccagcttcagacccttgaagccccggacgtgctgggggaacggctgtttgcccatcctgcgccttccctctccggatccgataacagggcctgagaacgcttcccttccttccagccgccggacccataaccatgacgaccacttcttccgagatcatcatcgctccctcgatcctgtccgccgatttcgcccggctcggggccgaggtgagcgatgtcatcgatgcaggtgccgactggattcatgtggatgtgatggacgggcatttcgtgccgaacatcacgatcggccccgcggtggtgcaggcattgcggccattgaccgatcgcgtgctggatacacatctgatgatcacccccgcggatccgtatctggaagcctttgccaaggcaggctccgacatcatcaccatccatgccgaagccggtccgcatgtggatcgttcgctggcccatatccgccagctcggcaagcaggccggggttgcgatctgccccggcacaccggaaagcgccattgaatacgtgctggaccggctagacctgattctggtgatgacagtcgaacccggcttcgggggacagagcttcatcccggccatggtcgagaaaatccgccgcgtccgcgccatgatcggcaaccgcccgatccggctggaggttgatggtggcatcacccccgatacgatccgcgcctgtgttgaggccggtgccgacaccttcgtggccggatcggcggtattcaagggcaaccgcgatgcgtatgaaaacgccatcaccgccttgcggaccaacgcacggggctgatccgcgcagcgttactccatccgccagaccgggtctttcagccggtcgataaaggcttcatgggccgccagcgttgcctcatccggcataatcggacgcggcacacgactggccgaatgttcatattccgccacagcggccgcacgctcggcctccgtcagccccagcccgcgctgacggcctccggtcagttctatgtagacctccgccagcagcttgcagtcgagcaacgcgttatgggtggtgcgctgggacaggtcgatgctgaagcgacggcagagcgcatccagactgttcggcatgcccggaaaacgggcttttgccatgaccagcgtatcaatcatccgggcaggatcgagcttcggtttccccaaccgcgcaaattccgcgttcagaaagttgaagtcgaacggtgcattatgcgcaatcaaaggatcacgaccgaaaaaagccagcagatcctccacgatatcagcgaacagaggctttccccgcagcatctccgccgtaaagccatgcacccgcgtcgcttcctccggcacgtcacggcacggatcgaccagggtatggaaagtgttaccggtcggcagatcattgaacagttccagcgcggcgatttccaggatgcgatccccggtgagagggtcgaacccggtcgtctccgtatcgaacagaacggaacggctcatgtcctgtttccttcaatcatgcgctttcatctttctcaggacagatagcaactggcgacgggtttcatggcgattcagcccggtacgaatgacatgatcagcgcgtcggcgacgctcctgatccggcatctgacgccgcagcaaggcccgcacttcctccgcactcatggcacaccgcgcccggatgcgggcaatttgcacaggggggggcgctgtgaccacgatcaccgcatcacatagccgatcccatccggcttcgaacagcaggggcacatccagcaccacgtgccgtttctgccgccgccgcgcctgatgcagaaagttgcgtgcctgcctcatcagcagcggatgcatgatcgcttccagtactgaaagcgcatccggagaggtcgaaacgatccgccgcaatacaggccggtccagcacccatcgggcatgaccggcggcactatcctgccgtactgcctgaggaaaccgggcggcaatcgccggcagggcggcgcctcccgctgcctgaagccgatgcacggcagcatccgcatcgaaaaccggtattcccatgcggcgcatcatacaggcagcagtcgatttcccggcccccataccgccggtcagtcctatcaccgtcatgcccgttggcatgcccattggcatatcagcaggcttcctcatcagcctagccggccagcaccgccgtgcggagcgcatcatcgacctccggttccacgccgaaccaggaccggaaacccggcctcgcctgatgcagcagcatgcccagcccctcagcgacaggcaatccacgcaaacgggccgcatgcagcaagggcgtttccagcggcgtataaacgatatccgcaacggccagcccgtccggcgcgcgtgacagatcaatctccagcgccggatgtccctccatacccgccgcggtggtattcaccaccagcgcatgctctttcagcacgtcttcccgtcgggaccacggcacggcagaaacattgggcagcaacgccgcaagttctgccgccgcctcatcacggcgggcgcagagcgtcactggcacccatgcactcagggccgcggcaatcccgcgtgccgcacccccggcaccgaacagcagcaccggcccggcggacggatcgataccgtgatcccgcacattggcgatgaacccgtccccgtccgtattacggccgataatacgctcattctcgaacaccagcgtattgaccgcaccggccagaagcgcctgatcttccacctcatcacacagtgcaagcgccgcctgcttgtgaggaatagtgacattggccccgcgaaaaccacaggcaaccaacccccgcaccgcggtttcaaaccgctccggcggcacggccagcggtacataggctccgtcaatgcgatagcgcgccagccagtgaccatgcagtttcggcgaccggctgtgctggaccggccagccgatcacaccggccagacgggcagctccgctcaggccggagcagagaggggctgaaacaatcgaggatgtcattccgtcagaaaccatgcctgccgaccgctttcaagcaacaggttttgcagaggtctgcgcattgttccgtaccagctttccggtttccggcatgccgaaacgtaccagcgccgcaccggcggcaccagccagtgatagcacaagaaaggctgccgacaggccaaaccggtcagaaaccgctcccgccattgtggtgctgatcgtagcaccgacccctccggccagccccaccattccaacgctgagattaaaccgccccgatccataggtgatatccgccacgatcaacggcatcagcacaccgaacacggcggcactcaccccgtccagcatctgaagtggcacgataaaccagtcatggctgatcccggcgaataacagggcgcggatgggcagtgccagaaatccgatcagcaggacagtccgacgaccgatccggtccgccgcccgtccaacccaaggggaaaacagcgccactacgatctgcggtaccacgatacaggccgcaatgatcagactggcatcagggccactgcgctccgtcgccgcaccgccgaccagcggtaacaaggcagcattggaaagctgaaacaaagccgagcaagcggcgaaaatcagcaaccgcctgtccgtgaacagcaccctcaacggcacaccggttttcttttgggcagcctgtgctccattctcatggtcccgggcgggacggatcatcaaaagggagaacaaggcaggcagggtcagcaatgccgtcaggatgaacacggcgcgattagagatataggtgccaatcagccccatcgcccccgctgccagcccgttaccgatcgacccccagcgggcattgcgcccgaaccgctcgccgatccgcgatgcaggcaccagcgccagcgacattgccgcaatcgcaggcaccagcatacaggtggcaaaaccatgcagcacctcggccagcataatcggcaagcgtccgggaaaaaacgcgaacaacaaggcgcaaaaggtcattgcgatggtcggcaggaaggcagccagccgtttctgcggcatggcatccaccgcccatccccccggcaactggctgagcatcgaggcaaaggtaccgacactcaatgccagcccgatatcagtctgggtccagcgatgggatgctagatacacggcgacgaacggtccgaacccggtctggagattggccacgaaaaaaacaaacagatccaggccgatccggctgcgccgatctgccggagaggatgctccggcaacctccctgttctcggagatatgctgaaaaaccgtcaaaagatgctgctcttgatcgttcagggatgatcagctgcatcgcccgtagcaggcggtggggccgcaggcgatgtctggccggaaccatcggaaggatgcccatcctgagggggagacacgtcattttggccggatgaatgatctttctgtgcagcaggcgggacggtttcactgggcgtcagcaccgccccaccttcaccatccttgtattccggggcggacttcagctcatccgtcgtcatcttcaacacgatgctgcgctgcggattatccggcgaaaaggcaagctgcttccattcaatggcaatccgccggtctcccacccccagaaatccgccgacatcaatcagagctgcgacaggcacgcctttcgcgtcgacaatcacatccgccatacggccaatacttttgccatccgtgtcgtgcacctcctgccccaatacgccctgcgccactttcgcgggcacatgccgggtcggcgctttcggcatcacaagggcctccggcgcagggggcaccggctctacaggagataacaccagcgccttcggctgctcgggctgggaatcgggacgcggccacggagcagagggcgaatcaacctgaccggaacccggctgagctgtggcagcgggtgcgggtgtcgcatccggcgtcgtctccgcccggacggggccggcctgccacagcagcaccatcacccccatgatcgcagctttcaaacccttcatcccaccctcggacgacctcaattgacgataccggcctgtgcgccttgccgatcgcttttatctgttgaagcagggtctggcccggatcgcaaatccagcccgctgccataacccgctgccatcagcacgggtttgttgcctccgacaacgctatccaagtgccagacgcaacccgagcgccaccgacagcatcgcaggcatcaccaccagccccacccgcagaaaggcgccgaatgtgacttcctccccctcgcgccggattgcgttgagccaaagcagactggccagggaaccggtgatcgccagactcggcccaagatcgcccccgatcagcaatgcatcggagatcagctgtggcggctgagcctgcaatgccgccgtaccagcgatcagtccggcgggcagattgttggtgacgttgctgatcagggccagcaacacagatgagatcatggccgtcgccgatgtattcgcctgtgctccacggcataacagatcagcgatcgctgcgacggctccgatatgacccaaggcctgcaccagtacaaacagcccggcgaccagcagaatggcactccatgagacatgcttcagaaaagacaggggcgatgtgccggtgatggcggaaaccagacccatgcttgccaatcccgcgatcagggtcggcagccccagcggcagatcaagcgccgagaccgtcaccagcccgaaagccgtcaggatcagggcgcataaagccgtccgcccgccggtcgataaaggctcctgcgggacattgctttcactttcagcctcggccagcgtgcggcggaaaataatatataacccgccatatcctgccagcacggcccccagagccggcagaccgaaagaagccagccagaccgacaataacggcattgcgccattgaaaaacaccagattggcgggattggaaatcggcagcacgaagctcgccgcgttggccaccgtgacacagcagaacaacagaggcaacggcctggcgcccgcccgctttgccaccgcataaacggcgggcgtcatcaccaccgccgtcgcatcgttggagagaaaagtcgtcacgatcacaccggcgccatacaccagagcaaacaacctgactggtgatccacgggcatgattgacggcgttgacggcgatccagtcgaacaccccttcccgccgcgccacttccgacagcagcatcatcccgatcagaaacccgtaaacatccgcccccctgatcacgcccttccccacctcagacagtggcagcagacccgtaacggcgaggatacatgcccccagcaaggcccagactgcctccggcaggcggaacggtcgcacaacgatccctgcggtcactgcaacgcacaggaccagcgtagcccaaacagaaccgttcatcacaggtgccgggtttcaggcatcagcagggcgtacaggacaaagcccagtccagccacaccagccagcgagaaaaacgccacggaataaccggctttgacgataatcagccccgccacaccggcactcagggcagcaccaatgccctgtgccgtcgccacggcgccctggctgatattgaaccgcccggttcccttcgtcagatcggctaccaccaccgggaacaaggccccgaatatcccggcgcccaccccatccagcaattgcacccccaatagccaccatggattacctgaaagcggatacagcatcccacgcagcgccagaataccgaatgccaacagaaagatcgggcgcgtgccgatacgatcgacaaaccgccccaccagcatcgccaccggcaccatcaccatctgggcggcaacaatacaggctgccgccagagaggtcgccatatcctttccgacctcccgcatcagaagctgactgaccgaggtaagcatggccgcattggccagatggaacaaaaacaccagcacggcaaaggtcatcaggccaggatgatccgccagaatccgccataggcctggcgatgcctgatccttcagagcggccccatccattccattggcttcccccccgttggccagatcattgtctatatgccggttatcaatcctcagcaccgttaccagtccggcaatggccagtaggcccatcagccagaacaccacgaccgggccgtaatgccacgccagaagcccggcaattgccgccgagactgcattcccgagatgattgaaagactcgttacgcccgatccgcctggcaaacccatccgttcccaccagacccagcgtcatcgccgcaataacaggggcgaaaatcgcccccgccacggcggccatagattgggtcagcgtcaccagcggcaaaccggacataaagggcagcagcaaagtgctgagcgttaccagcaagatcgcgacagccagcaggcggggtttgtttcgactgcgatcaaccagtgctccggcaggggtttgcgcaaccagcccgacaacaccactgatggtcagcaccagcccgacactggactcgtcccagcgcccgtccctgcccgaagccgacaacaggtacacggcaaggtaaggccccagaccatcccgcacatcagcaagaaaaaaattcaacttgtcgagaagagcagattctccctgcttttgtcgactgtcagaggggggctgaccatctgacaagactggactaaccgctatcgtcccgctcattgcgtccatatccaaaaccaatccaccgcctcactcccccactcataccggaagcgcaaacgtctgactgagtatctggatacactcattgttcggatttttttgcgtctgcccgcaattcaagcacccgattcaactccgcacccagcaaaatcgcgtaaataacggaccagaaccatatcatggtgccgacaaccgcgcttaacggcccataagtggcatcataaagcgccagccgggcaatatacaggctcaccagcagagaaacgatgacaaacagcaaggatgcaaccaccgaccctgccgtcatccagcgccatgtcaccttcctccgacaggggccataccgataaagcagagatatcgagaacagcagaaacagcagcagcaggcctatgcctcctgttctggtcagatactccctatatcctgacatgccggtaaaggagagaatggcaggcagtgccaccagaaaagccaatgagacagcccccgccagcagcgctgccagtgtcattagcaatccgatcacctggacacgcaggaacgagcggctttctttttcctcatacgcaatgttcagggcagacatcatggctttgatgccggtcgaggacgaccagaatgcaaagcccccactgaacagagcaccaaaaccaagtgtcttccgaggttgagcaacaagccagtcgatccggttttcaaccagctcaaaggcaccagggggcaatagttctggcagatgatcaagttgcggcctgatcgtggcgggatcgagcaacagaccatacacaaaaatcaacatggtcatggtcgggaacaatgccagcgtggcataaaatgcgcagccagccgcgatcagcgacatctggtcaccaatcattttgcgccctgttccaatcataacagtgcgccagtcactccagaaagcacgaggcggtcttgtcacctggccacttccattcccaccacatgatccagagtgctgccggatagcagatttctggatcttttatgtatatccttcctcccaaaaaatcacacggcatcacccccacctgccaggcaacagtcgtggtggctgatcataaccaagatgggttggaaattttcgtgaaacaaaatataaaataaaagaaaatacaaaaatttcttttagattttataaaataaaatagaattttctcattttaatattgaattttaaggtgccgtcaggctgcagcttcttctttttgctctgcaaccagacgatagccctgctttctgacagaaaaaattgccagaccagaatgaacggctgacagtttctgtcgcaaacggcaaacattgacccgcaccaaagtaggatcacgtaccgtggtattagggctgagatgtctcatgatcaatgcaatggagcaggcatcacctgcgttctgcgcaagtatatgcagcaatgagaattcctgcggcgtcagagtaaggtattcctgtccaaccctggctgtacgacgctgcacatccagcagaacctgcccgacctgtaattcccggtgcaaagtccaccggctgggaactttcatacgcaccatgatgcgtgcttgaagctccttcgcgattacatccttcggaaagacctcatcagccccttccgtcagacaccttactcttacctcaacatctcccacacccagcacaataatgggaattgtctcgtctatgagtcgtacctgacctactgcaacatccggaggcaaagataaaccagccccctcaatgataaccagattacaatcattatcctgaaggttcttgaccagctctggagaatcctgtgttgaagaaatatcccacctgcccccaggcatgctgttaagcaattcattgaccaaattgcttacatgtccaaggacaagcgctttcattgcaacaatctcgccagagtaagaagtcattgtccggacccaaactaaatattaatcacaattttagagtcatcagagagaacagagcgttttttcagaatatctctggctgaaatactctccagccagtgccagatcacaggttccggatcattaagtgcatgaaagggctgcatgctggtcgaaaagtgcggattaaagaacggatcatgacttaacacctccccccacctttccagcatgatttgggtttccttgaaaaatctgcgctcctgagctgggcgcacatcatcccctcggctcagggactcatggtgctctgcaaaaaattcaggggtgtagataattgtatatccggccgcccttaatctcaggcagagatcaatatcattaaacgcaacagccaactttgattcatcaaaacagccaatttcatgaaatgccttggcccttaccagcataccggctgctgtcacggccgacatttcctgtgtaaaattggcccttcctccatatccaccttcatcgccaggtaagccggtatgcacatgcccagccaccccacctatacccaatataacgccgccgtgttgaatggtgccattcggataaacaaattttccaccaactgccccgacccgaggatcaacctctgcctctgcaacaagacgatatagccaatcagaagtaaggacaaataaatcgttgtttaaaaatacataatagtctgcaggataagaagcacaggcaatattattgagaagagaataattaaacggtatttcttgtcggattattttaatattggaatgtgctgcgacataatcctgcaaaagcgacatattcggatcggtagaccaattatcaaccaacacaatctgataattggtataatgagttttttcgataatatttttgatacaattcagtgtaacgtcaatctgatccttgaaaggaatgacaatactgacactcgggctgttattcgtttcccaatcaattttgtaaagtgtcattccatatctggttgacacatctgccttaagaccgcggcgctccagatgccgcgacacacattgaagcccggcttcaatcgcatatggctttgcaccgatatcgcccgcagttgaaccgggtgtaatacgccaatggtacagaatttcaggaacatggaatacttccgatggttccagacgttccgcaatccgcaacagcatgtcatggtcctgcgcaccatcgaactgcttgttgaaaggacctgcactattgatgacatcccgctgcacaagaacgaaatgacagatatagtttacctcaagtaaaagacgatagttccagtccggcttgaaggccggatctctgaaaaacccgctatcgtcaattttatcttcgtcgctgtaaagcagtttcgcaccagtggcctctgcggcggcaatcatgatatccagtgcgctggcctcaagaagatcatcatggtcaagaaatgcgatccagctgccattcgcagctttgaggcccagattactggcttcgctgataccactgttctttcgagtggtcagatgcttgatacgggaatcagcctgcgcaaactgttgcagcagattctttaaatttgcttcttcgctgcaatcatcaatcagtatcagttcccagttctgatatgtctgcgcgatgacagactcgacagccagagcaaaatcagacaggcgcggtttgtagacaggacaaattatactgaccagttgagcagttttacgccgtgaatccagacggatcatcgaagaatcattaagagccttcgtatattttcttgcccaggtatcataatcatcaatattatatcgatacgttggcagcagatcttcaatctgggttcgtaatgccgtcagctgacggtgcaaagttgcaaccatatcagatatttcgacaatacttgcttcctgcttatcggtcagaatagacgtcacatatggactgccatccagctcgatattttccggcattttaaaaaaacggaatgtctgactgaatggtttggcaactggaaagacaggcctgtattcgaaaccacagcgtggatccgcactgagcgcacgtccgacatcactgcgataacgattggcacgcagcagagcgactgtctgtccctcacattccacgcgcagctgggaattaccaacgaattgtttcggatcttccgctgtattttccaaaatccagccccggaaagcaccacgctgataaccatcaatggaacttctaaattcgggaacccaactcatctgaaaagaaacagaagcgttcagtacattattcgacaaaagcgggacggagatccctccttctgtcatcatttcaaaataatgagtttctccgtctctaaaacggccagggacactaatcgtgaagccgaccagtgcgtgagggaaacccgcagcagaaacgtcgggacgcgattcatcacaggtaatacgctgtatttcctgcccatccaaaacaataatagccttcaatgaagaattcggggcggccggatcatgagcccacccctttacaaggcccccttcaatagaatctataatacagcacagattattcttgatcataaaatcttgctttttgatatggttgtattacgattttctttgcagcgaaccaagttcaaggcgcatttgttcaaaaacacttttccagtcgccacaatctgactgacgaaacagacgcgcagtcggataccaaggggatgtatcccgaccaatcaaccatctccactcagcgatatgaggtaatatcaaccataaaggtacaccgatcgcaccagccagatgcgccaccgaggtgtcgatactaatgaccagatccaacccggccataatcgccatggtatcttcaaagcttttgacttcgagactgagatgcaccacaggcgcaaccccataaaattcacccacctgcgactgcgatggccccttctgcaaaattacaaaggcaacatcagggcagttagcaagagcctcgaattccttcagctgtacagaacgcttccagtcatttttatgtgttggtcggccagcccatacaatgccaattcttttgaaacgacggggcagtattttatccagctttgccgaccaggctgcttttttttcctcatcgacatacagatagggaacacgatctggaatattatcaagcgtgatatcaaaaatacgtggcagtcctgtaataggtagccacgccttatagtcaccggtgtcattccagttaacgaaacaacgtgcttccgggcatatcatttgcaacagaggcttgagctccggactgcaccctacagatactttcgagcacctttccagaacacggggaatgagccgaccaaactggatggcatcaccgaatccctgatctgcgaccagtaaaagtgtctcatccgcttcgagcttcgatccatcccattgaggtttatctgtataaggaatagggggtgccgcatcaggaatacggaatctccattcgtattcttcccatccttccctgaactctccattctgaagcagggcttcagaaaggccgaaatgggcacctgccatatcaggcacaattgacaatgccgctcgaaagctcctctgcgcctctgcatttagcccggcatccatttccacaatcgccagattatgaagtgcttcgccatctcccggattcagttcgactgcccgccgggcggttaccagcgcctcatccagctttccgcagagccggtagaattcgcatatattgcgaatataaagaggggtattaaccccgcagagaatggactgctccgcataagccaatgcttgctgcatatctccttttttataggaaataacagccatcagatgcagggcatccgcatggtgcggatgctgcttcagaattgtctgcaaaaggctttcggccctgtcaatccgcccggcttcatcatgccggattgcagcctcgaaaatctcggcaacgcccagcgaaacctgatctggcgctatggataaatcagacattggcatttgcagtgctgggttcgctcacgacggcctcaaaccctcttgcctggatcagggtggaaaggattttagaggcttccgcaagatgagcagaaaatggctcatatcccatgatcggaggcagagtaaggggatgctgtcggccgtagacaggttcgaagctgacgaaattagtgatccgctcacaagccatggattggttctgcagcagatccgaaattttgaccggcagatatttcaggacgaaattgctgcgcatatgttcagcaatgtctgacattgcttttacatattcagccgcaccttcaatcgtcccatcatattccagcaacaccggcgtgctggaagcaaatttccgcaccgcagaagacagagggtgatcaataagatgaatgatcggcgcatatgggaaaagaagagcgatcaggccgatttgtgtttcatcaaggggatcaatattcacgatccaattgctcttgtcctgtccctgtgcctggactgagcggaaatggtcctgcagcttttccctgagcgttctcaggcttgaaacacgatcagccatccagagatcagccaaggcctccggataggcatacggcgatgccaccatttccggcagacgctctatcaggctggagagcagcggccccaatgcaatggtgggcgcagaaatagttgaggcaatccattttccgaacggagctgttatttgagaagaagctccgacaacaaagatcggctgtataccgccgtcgaattctttcgcagcagcactgatcaatccaagtttggttgcggtaaagaagcttttaagacgctcgacataaccacccaacccgacaggcccgacccccagcggcgcatccggagcacgcccaccttcctgccatgctgcaaaagcgtcttcataacgacccaacccgtaaagaatgttaccgcgctccttccactcaaagaagctgcgggtgatatcttccccgggaagggcattcacaatatccagagcctgggccgcaagaccgagttcattgagaacagccgcatattgaacggccagaaagcggttttcgcctgctttttcatacgcctgggacaggatgtcccgagctttttccagtcgtccagcttttctttccagcagggcatgaccgatgacagtctgcggaacatcaggagcaaggctgagagattgctcataggaactggcagcttcctcaaaacgcccctgcaacgtcagattccatgcgaggttggccagaatgatcgcatcaggctggtcgatcatggcgatcgtatgccgatagcatgcctcccccccgatcaattcacctgcttcactcaggatcatccccagcacattatgagcgtcagcaagagtgggatccgcacggatcgccatgcgtgcaacccgctccgcatctttcagttcacggacttccatatgcagcctggccagctgtgtcagctgaacggccagattaggattggccttcaccagacgtgaaagcagcgccttggcagcgctatgattattctgcgccagacggatctggcttaacattaacagcgcatccgggtcataaggggacaaatccagaacggccaggctgagctcttcagcaacggcggcattgcctattttaaatgcctgacgtgcccgctcggtcgtgggggccagataaaccgcgctattggctgccaccattgaaaccggctcaaccaaacaacagcggactgcgcgcaacccactaccacaatggcacataacagaaggatcaatcgacatagcaatacctcaaaaaaataaaatcttcatcgtgtttgtttatgtagaattttttgcgaatacacccaaccgttttaaaactataaatttatttatttttataattatagtaattatttaaaacgaggaaaaattatttactttgacatataatatcctggcaggaaaatgaccacagtacgatggttttagggttaacctgtaaccgcatttgatattccgattaaaggaaacataatagcttttgcaaccttaaattgaattttgttaggtaaattgatttttatcataattaattatatttgttactttaatcacattttttaaaattaggtttttattccatcaacaataactttatctgaaaaaagcctgacaaaatattatttaaatagataaaatttttatatttgtaggaaaatagttttaaaatcgataaccaacaaaatctaaaaaaattggccctgctgaataattttatattccttcgggatcgacacagggccatcaaaggcttttaacgaacgacttcccgctcccctcgaatatgccgcgcagcccgctcaagcccggccgcaattgatccacgggtgccgacattatcttcccgggcaccctgcgccagcacacgtcccagatcagcgaggcattccccgatctcacggacggccagacggagataatcgtcctgaagatgggggggtaagggttcaagggtcagttcgggggatgacgccatgattttgcactcctggtgagggatcggttgaagtcagaatcatacagggttcacgcttggcggaaactgttcttagagtttagggcttctgtttttcctgaagcccgtacccttggaaacgagcgcgggtttctgccagttctcgcggagaaagcagaaccggtcccccaatctgaaggctgtgccagtattgcctggccagcgtttccagttccacccccagccacaatgcctgacgcagatcagtgccacagaccaccatgccatgattggccagcaggcaggccttgcgcccctccagtgcggatagggccagatcagccaattctgccgtgccgaacgtggcatagggagcacaccgtatatcgtcgccgccgaagcatgtgatcatataatgacagggtggaatagaccgtcgcgccatagccagcgcggtgcagaacaccggatgcgcatgcaggacggccccgacttccggccgtgagcacaggatgccatgatggaaacgccattctgtcgatggcttgcaggggccctcccacccgccactgtcatcatccagcggcatggaagcgaccatatcgggcgtcatttcgtcataaggaatcgcggagggagaaatcagcatccggtttccccaacgcaggctgatattcccggccgttccctgattgattcccagagacgtcatggttcggcacgcctccaccagcgcgcgccgggctgaggattcctcatccattccgcatgctcctgccaccctgttatcgggtcacgatgctgacgacagcgcggctgtttgcacccggcagacaaaccacgcgatcacctacccgctggaaggtcagatcgacgaagctgtcccccagttgcaaacgcttcaggtgcaggacatcaagaccatagggcagagtgggccggtccaccgtaatttccctcttccagccattgatccgcagcccgagacaagcctgcaacatcatgaacaccgatcccgccgcccaggcctggggcaggcaggccaccggatagctgatgggcgcttctccggggctgcgggggaaaccacagtacaattccggcagccgcattcccagatgaacggcagattcgaacatatcgcgcgtgatgtgggaaacaacgtcacgttcgccataagaggccatcccggccacacacaacgccgtatcatgcggccagaccgaaccattgtgataggacatgggattatatcgcggcgccgtcgtgccgagggtgcggataccccagccgctgttaaaagaaggcgaggacagcaagcgggtcagccgggccgcccgctcgggcgatggaacccccgtgtacagcagatgcccggcattggaggccggaacccggcacaactccccattcccatccaaagcgatgccgtagcagccgagatcctccatccagaatttgtcttcaatggctgcccgcagacgggtcgccttggtgcgccagcgcacggcgtcctcggtcagaccacgccgttcgctcaggctggcaagggcgagataggcggcatgcacatagccctgcacctccaccaatgccaccggcccctgggggaatttggcatcagccccgaacacgctgtcgaaactgtctttccagccctgattggccagtccgctttcctcaccgcgggcatagtccaggaacccgtcgccattggaatctcccggcccttcaacccaggcaatggccgccatcagcgcgggccacaaagtgtcgatcagcgccatatctccggtccgatcggcataggaacctgccagcaccacgaacaggggcgtggtatcgacaccgccataatactgaccaaacggtatttccttgagcgcggtcatctctccatgccgcatctcgtgcacgatcttgcccggcgcggaatcctgaaaactggatgtctctgttgcctgatggctggccagaaaagtcagcacaccccgcgccatgcccggatcaagccaaagtctttgcagggaagtaatgactgcatcacgtccgaatggcgtcgagaaccatggaattccggcataaggataggggccggtcggcaaatcggtcgtcagcaacgccagatcggcggcagaccgatcaatccattggcggtacatgcgactgggcgtatcgatttcggcggcgcgacggcgcttcgcccgcatggcccaacgcgcacgtgcagccgctttgcgaaacctttcccgcgagggggaagcatcggcctgcggaccgatttccataaaaagctcaatccgcccttcccgctccagatgaaagagaaacgccgccagccccggttccagcctggcgggaggaatcgagaaactgatcagcgtcacccggttgatcttatccaggccctgataggcgaaacgcatcataccatgattgatttccggcggcatcacacgcccgcgggagacgcgctgtaatccacgcacctcgaacatatcgcggaaatcggcggcaaaacgcagttcgattggaaccgtggcgggcgtttgcccgaaattgaccagcgtgattcgctcgtacagacaatgattccacagaaaccggcggcgctccaccagaatgaccccttccggcagggactgcccacccagtggcggcagaggccggttggtcatattggtggtggcatagacattgtcatagctgaccgcagccccgagcaaggaaggagagcgatccccgatcatcagacggaagcgcgacagaacacgggtatcgttgtcgaaaaacccgtcatcgtcgccatgcatgtcgcccatctggtccgccaccagaaagcagtcgccatgtttcagcgccagttgacggctgatcccttttgcgccgccgccttcctcttcgctttcatgggaaggatgcgccggccacggatctgtctccggcaggtcggtcaggggcgggaaagcggggtcggtattgggggaatcggtcatgggaaggcagtgtcctcaaccatcgcaggagggtcaggacaccgcgagacgatatatttcgcaaccctgtgagcaggaattcagcccgtccccgtgcttttcagtccccgtgcttttcagtctggtgcaggctcaaaacgcaaagcaagcccgttcatgcagtaacgcaggccggtaggacgcggcccatcggggaaaacatggccgagatgcccgttacactgactgcaatggacttcggtgcgaaccatgccgtggctggtatccgtcgtggtggccaccgcgccctcccgcggctggaaaaagctgggccagccagagccgctgtcatatttcgccgcggcatcgaacagcacctgcccgcaaccggcacaggcatacaggccgggccgcttttcatcattgagcgggctggtacccggccgttccgtaccatgctggcgcaggatacgatattgttccggggttaacgtgtcctgccagcggtcatcgccacatgacggtgcatgattgccacagccgcagccagtgttgtgatcggccattctgcctgtctcctccccttcagactctcatgagacaccccctatcggggtgctctaaaggatgccatgcaatatgggaggccttgccccacaggcaaagcctgttcgtatccctagacaagctggtgattccagcgataacacgcgccacctgacgggatgaccggatcaatccgccatccacacgccgatccgcccggagagatgacttgagccagcccccgacctcccccgcttcttcggcccgctccggcggtctgctgcggtttttaacctgcggcagtgtggatgatggcaaatcgacgctgatcgggcgtcttttgcatgatacacgcagcgttccgccggatcagatcgagacgatggtgcgcgacagcatccggcgcgggcgctcggcggatgatcctgattactccctgttgctggacgggctgctggccgagcgtgagcagggcatcaccatcgacgtagcctaccggtttttctcgaccgctcgtcgtcatttcatcgtcgccgatactcccggccacgagcaatacacccggaacatggcgaccggggcctccaccgcgcaggttgccgtgatgctgtgtgatgcacggcgcgggctgcgtgtacagacacggcgccatgccaccatcgcttccctgctcgggattcgtcacgtcgtgctggcggtcaacaagatcgatctggtcggctatgatcaggagcgtttccgcgagcttgaaaacgagttccgcaccttcgccgaccgcctgaatttcagggatgtcgtggcgatccctctctctgcccgtgctggcgacaacatcaccggcccgagcgaaaacacgccctggtacaccggtccggccctgatcgagtatctggaaaccgtcgagatcgagccggaagaaaccacccatccgttccgcatgccggtgcagatcgttctccgcccgcagggtggcggacgttgcttcggcggcacccttgccagcggcgtgctgcgccccggtgatcagatcaccaacgtcaccggcggagcctccagccgggtggcccggatcgccaccatgagcggcgatctttccgaagcccgcaccggtgatgccgttgccgtttttctggaagacgaaatcgacgcctcacgcggcgatgtactcagcgctgctgattccatcccccccagtgccgatcggctggaagccgatctggtctggatgcaggaagccccgctactgcccggcgctgcttttctggtgaaaatcggcacactgactttgggcgggcgcgtcgctgcgatccgtgcaaagatcgatgtggacacgctggaagaagaacccggcgagcgcctgttgcaaaacgaggtcgcaaagatcgaactggttcttgatcggcccgtaccattcgaatcctatgacgtcacccgccatctgggcggcttcatcctgatcgaccgcatcacaaatgcaacagcgggagccggaatggtccgggccgccgccgccacggaaggcgcggtctggcatcgtcataccgtggatacggcggcccggtcctcattgaagggacacagcgctgccgttctgtggttcaccggtctgtccggcgccgggaaatccaccgtcgccaatctggtggaacagaagctgctgacccaggggtgccacacctatctgctggatggcgacaatctgcggcacgggctgaacaaggatctctccttctcccagagcgatcggcgcgagaatatccgccgtatcgctgaggtagcacgtctgttccatgattcagggctgatcgtgctggtttccgctatctccccctatgccgccgatcgcgcggcggcacgggcactggtgccggaaggcgcgtttgtcgaggtcttcgtggatgcaccgatcgacgaatgcgcccgccgcgatccgaaagggctgtatgcacgggccaaggcaggggaaatcaccggcttcaccggaatcgacgctccttatgaaacgccggaaaacccggaggttcatctggaagctttcggcaaggacccggagcttctggccgagcaggtcgtcagccacctgcgggatagcgggctgctccgctgacgggcggggagcaccctgatcaggcagcctccccccgccaccagcgggccgatggtcatgccgcaatccggtttcgccatcacgatagccgtacccggctggctgatctgcatcaggcagcccctcttcgcgtgctgatgcccatgccggaaccggatgaagctccggtcgcagctctggtcaacatcgctggcgggctggccggaggcgaccggctctctttcacaatgacgctggatgcgcaggcccgcgccacgctctgcacagcagcggcagagaaagtctaccgctcgctcggcccggataccgacatcagcaacatcttgactgccggaccggaagcggcgctggagtggctgccgcaggaaacgatcctgttcaacggggccagactgcgccgccggatgaatgtttcgctggccaccgatgcccgattattggctaccgaaacgatcattttcgggcggaccgcgcatcaggaaacatttctgaatggccatttctccgatcactggcggctatggcgggatggcaaactgctctgggcggacaatttccgtcttccggacccgcctgcacgcgtgctggaccatccgttcggactgaaccgtcatccggccatggccacaatcgtgctggcagccacggatgccgccgcctatcgggatctgttacgtgaaaaatggcaggacgagaccggcaagggcgtcactgtgccgcgtcccggtcttctactgggccgtctgatcggctctgccacagccgtcagacagggggtggaagaggcaatgatcatactgcgcacccacgcgatgcatgggccggcccggctccctcgcctctggctgagctgatccggctggaccacaaccagcggcaccgcccataattcatccctcatccccaacgaccgcacacaggccacgccgatgcatctgactccccgcgaaaaagacaagctgctgatcgccatggcagcgcaggttgccagacgccgtctggaacgcggcgtgaagctgaaccaccccgaagccatcgccctgatcaccgatttcgtcgtggaaggcgcacgcgatggccgcagcgtggcggaactgatgcgcgatggtggcaccgtcctgacgcgcgaacaggtgatggaaggtgtgccggagatgattcacgacgtgcaggtggaagcaaccttccctgacggcacaaaactggtcaccgtacacaatcccatccgttgagcggcaaggacacgccacgatgataccaggtgaagttttttccgcccccggcgagatcattctgaatgatggcctgcccgtgacgacactggtggtcgccaataccggcgaccgtccggttcagatcggcagccattatcatttcgccgaagccaatccgttgcttcagttcgaccgggaagcggcgcgtggacagaggctggatattcccgccgggaccgcgatccgcttcgagccggggcagagtcgggaggttcctctgatcccctatcgcggggcacgaattgtgcatggtttccggaacgaaaccggagaagccctctgatggcccgcctttcccgcgccgcctatgccggcatgtatggtcctaccaccggggaccgcctgcgtctggctgataccgatctgatcatcgaggtggagcgcgacctgaccacctatggcgaggaggtcaaattcggcggtggcaaggttatccgtgacggcatgggccagtcgcagatgatcaacgctgccggtgcgatggatacggtcattaccaatgccctgatcgtcgatcattggggcatcgtgaaggcggatgtcgggctgaaagcgggtcgtatcgccgcgatcggcaaagccggcaatcccgacacccagcccggtgtggatatcgtgatcggccccggcacggagatcatcgccggagaggggcgcatcctcaccgcgggcgggatcgacgtgcacatccatttcatctgcccgcagcagatcgaggaagcgctgtccgcaggcatgaccaccctgttcggcggcggcaccggtccagcacacggcacactggccaccaccgtaacacccggcccctttcatctgcaccggatgctgaaagcggccgaaggatttccgatcaatctcggttttctcggcaaaggcaatgccaccctccccgccgccctggaagagcagatcttggcgggggccgcagggctgaaactgcatgaagattggggctccacccctgccgcaattgacaactgcctgtctgtcgccgatgcgctggatgttcaggttgccttgcactcggatacgctgaacgaggcgggcttcgtggaaagcaccatcgccgcgctacgtggacgcaccattcaggctttccacaccgaaggcgcaggcgggggtcacgcgccggatattctgcaactggtgggggaagccaacgtgctgcccagctccaccaaccccaccatgccctatacagtgaacacggctgacgagcatctggatatgctgatggtctgccaccaccttgatgcccgcattcccgaggacgtcgccttcgcagaaagccgcatccggcgtgaaaccatcgccgccgaggatattctgcacgatctgggtgccatttcgatcctcagctccgacagtcaggcgatgggacgggtaggagaagtcatcatccgcacctggcagaccgcgcataagatgaagcagcaacgcggccgcctgcccggtgagacgggcgataacgacaatctgcgggtgcggcgctacatcgcgaaatacaccatcaatcccgcgcttgcgcaggggatcgccgatcatgtcggcagcgtggcagttggcctgtttgccgatcttgtgctgtggtcgccagcgtttttcggcgtcaaacccgatatggtgctgaagaacggtaccatcgtgatggccccgatgggcgatcccaatgcctcgatccccaccccacaaccggtacattaccggcctatgttcggcgcttacggagcagcgctgccggaatgcggcctgatttttgtctccggggcttctctgacacacggtctggcggagaagctgcaaagccgtcgcgccctgctgccggtgaagaacacccggtccggcctgtcgaaacgggatatggtgctgaatgattactgtccgcatatcgaagtcgacccggaaacctatgaagtcagggccgatggtgaattgctgatctgtgagccggcggagatattaccgatggcgcaacggtattttctgttctgactacccatgctgttgcaggaattgatccataatgaccgaaatcgtgcctgtcgcccgtcacctccgccgcagcggcgaatggaatgcctcccacgccgatgacagcgtaagactggattatgatgaccggcatcgccgccgcaggctctacaccaccgaacaaggccgccggattctgctcgatctgatcgaagcaaccgtcctgcgggatggtgacgctatccaggtcgaggatggcacattgatcgcggtgagggccgcaccggaacctctgatcgagatcaccgcgcatggtccggacgaattgtcacggctggcctggcatctcggtaaccgtcatcttccagcccagatcagcgagaaccggattctgatccgtgatgatcatgtgattgtcgccatgctgcgtggactgggtgcacatgtgcgttccgtgaccatgccattcgatcccgaaggcggggcctatggcgagcataaccggcatcacgcgcatgcccatggtcacccacatgatcatgaacacgatcacgatcacggtcatactcacacgcatgattgacgactttgcccccacctcctccactggcgatgccgcgctgtaccggctgctgagctggctgtctccagcctatccggtcggggcctatacttacagccatggacttgaaaccgccgtggaggatggtctggtgcatcatcggcagagcctcgccgattatgtcgccaccgtgctgcatgacggggcggcagcgattgatggtccgttactcgccgcttcatggcgggcagcgcaggcagaagatcatgcacggctcgatgaacttgctgttctgggggctgcatggcgcagcagcgcggaaaccgcactggaaacatccgcacaggggcgggccttttgcgatgtaacgcaggcggcatggcccgattcacgctttgccgctttctgcgcccgtcatgatgaaagcatcgtccatcccgtcgccttcggagttgccagttgctggcaggggattccgctgcgggccgctttgttcgggtatctgtccgcctttgccgccaatctggtctctgccggtgtcaggctgattccgctgggccaaacggacgggcagcgggcacaggccgcgttgctggatgatcttcagcgcgccaccgatcacgggctgaacacagcactggaagacgcaggctcggccgtaccgatgctcgatctgttctccatccgtcacgaaacacaatatacgaggctgttccgatcatgaccgcccattctccttccgaccgcttcgcgcatggcccgttccgggtggggatcggcggcccggttggctccggtaagactgcactcacagaccgtctttgcaaaaccttgcgtgattcctacaatattgctgtcatcaccaatgatatctacacacgggaagacgcggaatttctgacacggtccggtgccctcgcgcctgaacggatcgtaggtgtggagacaggcggctgcccgcacaccgccattcgtgaagatgcctccatcaacctcgccgcggtgcgtgatctgagccagcgtttccccggcctcgatatcctgttcatcgagagcggcggcgataatcttgcggccactttctcacccgaactggctgatctcacgctgtatgtcatcgacgtctcggccggcgataaaatcccccgcaaaggtggccccggcatcacgcgatccgatctgctggtcatcaacaagatcgatctcgcccctctggtgggggccgatctgggtgtcatggaccgcgatgctcgcaagatgcgtggaacgcgcccgttcctgttcaccaatctgaaagatcagcagggtgtgcaggaaatcgctgatttcatcctgcaaagtggtgggtttgttactccggataccatctgattcgaggtgatcttctccaaaaccgcaagatcggtcgcgcgcgccatgactgtgcgcgtccagaatggtgccttcacgggggagcagccatgaaggtaccacttcaacactatcatagccgtatgcagagagtgctcgattacattgaccaccatctcgacgatgagctgagcgtcgaaatactgagcaatatagcggctttttcaaaatatcattttcaccggcaattcacagcgctgtttggcctgtccgttcacaattatattcagctcagtcgcttgaagcgggcttctttccgactggcctatcgcaatgccgagcggattaccaatattgcgctggatgccggttacgatgcaccggatgccttcgtcagagccttccggaaacagttcggacaatccccttccaccttcaggacagatccggactggcaacaattgctggaaacatttgaaccactcgaccaggccagaagcagatgcatacagctacgtttcacaatagaagatatcaccatccgtgaaacggacccgataccggttgccatcatgacgcatcgcggcaatccggcgacgattggagcaacgattcaacgtttcatcgcatggcgcaaggcaaccgggctgacaccacgaatcagcccgactttcaacatctttcactccgacccacacacaacatcaccagaggaatactggcttgatctgtgcgtcggcaccaatagaagaagggaagcaaacggcgaaaacattgagcaaggcatcatccccggtggacggtgcgccgtcctgcgcatcacggggcagagcgacaatctggaacaggctgccgcttatctttatcgtgtatggttaccgatcagcaatgaaacaccgggagattttccgctgtactgtcagcgtatcaccctgttccccgatgtcgcggagcatcaggccgtcaccgacttgttcctgccactccaataaatcagcgccgcacaatggggtcagccgttaaaacagcccctcctcagcctcttctgttccggcttctcccgtagcaagcagacgctcagcttcctccggttccctcccctcgacaccgcgcaaggtgcgggcgacggcccgcgtgcggacacgggcactttcaatcgtgttgctgaaggtaccagcctgtttggccagacgctccagcaccttatccatgcgctccatctcggttttggttgcacccagcaacgttctgatctgatcggccttctgttccagcgccagcgtgacatggccgagatggatggtgcgcagcaaagccggaaacacactcggcccgagcaccagcacacgatgcaggcgtcccacctcgtcgatcaggccgggaacacgagcgatttccgcatacagcgcatccgtcggcacatacagcacggcaaattccaccgtacgtggcggcagcacatatttcgtcgcgatcttgcgcgcctcatccttgatgcgacgagtcaaaccggccactgccattcgctctgcctctacatctcctgcctccgaggcggcaagcaggcgttcgtaatcctccaccgggaatttggcatcgatcggcaggtaaaccggtcgatcccctttcatcggcatgatgacagcgaattccaccacctcatcactatcatcacgcaggcgtttattggtttcataactgccgggcggaaggacatcgtccagcatggcgcgcacctgcgcctccccccagccgccacgggtcttcacattgctgaacaggcgcttgatgtcgccgatctgcgccgtgactgcctgcacatcgctcatcgccttttggactgcggtgaactggtcaatgacgcgggcgaaactctccgtcatctgcttttcaacagccgcatgaagctgctcgttcaccgccgtgcggatttccgccaatctggcctcgctgctttcacgcagccggtccagcccctctctcagcgccgtgtgcagatcaccgatggcgcggccctgcgcatcccgcaacgcccccagagacccggtgacatcctggcgcagcgcgccggtcgcggtgccaacctccgagaaaatacgccccatggcttccgtgttcgcctcacgcaatgccgccgacaaggcgcgttccatatccagcagatgccgacgcatcgcttccgtctcatcacggccccgcgcatcggactgctccatcgccgccgccagacgtgacggcagggacagaaggatccacacaaccgccagcaaggccagagcggataaagccagtgccagcatatccatcatccgtgcttaatcctttgaagagcgctgcccatacgatattggactggtctcatgtccaaagattcgcactctccgcagtttgcgacaagcagcagccagcatcccccttccgaaacgcctgatggcgtatccccctggatccaatgggttctgtccgtctgtgtcgcgtgcacagtcggggcaatctattacaatcaaccgatgctcggggcgatcagcgtgcaattccccggtcatccggtggccatcggaatgattccgaccgcaacccagctcggctatgcgctgggtttactgttgctggtcccgctgggcgatatgctgccccggcgcggtctgatcctgatccagacactcgcagctgcgctggccctgatcctggccggaatggtacaaagtgccgcagggcttgcggctgtttccgtactggtcggattgggtgcttcggttactcaacagattgtgccgctggcggccgcgctggctgccccctctcgccgcggcgccgccgtaggaatggtgatgagcggattgttctgcggcattctgctcagccgtaccctgtccggctgggtcaccgatatggtcggctggcgcgctgctttcggggccggagccgtgctggatcttctggcggctgtcgctctggcgattatgctgccttctctgccaccggtcacgcgcacccgctatggcgcactgctgctgtcgctcggtacgttatggcggcaggaaccggtactgcgacacgcaacctttatccagatcggacagttcgctgcattcagtatattctggtccattctggcattgcgactggaacaacctccttttgaactgggagcgggcgcagccggattgttcggtatcctcggcattgccggtattctgatcgcccctgtgaccggacgcctggccgatcggcgaggaccggagctgatgatcgggctgggcctgattctggtactggcaagctggggcgtattctgcgccgtgccaggcatcgccggacttgccgccggcgtcgtgctgctggatctgggcgtgcaggcaacccagatctccaatcagcatcgtatttatgcactccgcccggatgcacgtgcgcgtatcaacacgatctatatgggcctgatgtttctgggtggggcagccggatcaatgctggccagtctcgtatggcatcaagggggctggacgccgctgtgcctgctgggggctaccgtcactgtgcttgcaataagcgtgcatgtaacggcaaccagacagcaaagccgaccataaacgttccggtagcccgcagcgccgcccttattccttattgggcggcatgttccttcgcggcgacctcaagagcatcggtgcgccagccgctgcgcaccccccaatggctgaagaccagcgaaatcgccgccacgatcgccatatcccacccatagggcagataatcatgccctccgaacttgtcactccctgcccatgacaaagccgccataaccggcagatacagaatgaaccatcgtgcggccctcacatcatctctggccccggtccaaccgtttttggtctggtaatagaaataaatcggcagggctgcgaccagcaacacgataatatagccggtcagcggccagcgcgcccagtacagtagcagggaagcacacataaaagcgaagtggccgatcacattaattcccggcacacgcactggccgtttcatgtcggacgctgtacggcgcaaactcatcgcacagatcggaatcatgacatagctgatgactgttgccacagagatcgctgctgccaactctccccaaccacgaaagaaatacaggaagataaaggaaacaccgaggttaaaccacaatgctccccgaggaatcccgtagatgggatgcacggcacccagcacatccggtgccgtaccattgcgctgcatgccatgaaccatacgcgtggtactggccatataggtgatgccggtaccgctcgggctgacaaatgcatccagatataaaagaagcgccagccagttcagattaagggccagcgccagctgcgcaaacggtgagttgaacgttacatgcgcccatccgtctacgattctggccggatcgacaacacccagataggcaacctgaagcagtacataaattgcccccgccagcagcacggaaccgaccactgcaaaggggacactgcgcgccggattacgggcttctcctaccagattcaaagggctttgaaatccgttgaaggcgaagatgatgcctgatgtggcaatggcggtcagcacgcccgccagcccataaggcagcataccgtccgctgaagtggcaccgctcacattgccgggatgaaacgaggatgccatcaacgcccccgccgttacagccggaatgatgatcttgaacacggtaatgactgaattgctacgcgcgaacaacttcacgccccagtaattcagcagaaaataaacgacaaccaaccctgctgccagcagctgcgcaaatccgctcagctccccgttcaccatcagatgctgtgcccatggatagggccatgaactcatatattgaaccgaggcttcggcctcgataggaatcacgctgacgatggaaatccagttggcccaggcggtaaaaaatccaagcagggaaccgtggctgtaccgtgcataccgcaccataccgccggattcaggcatcatcgtaccaagctccgcccccagcagggcgaaaagcagcacgattcccattcccatcaaccaggcaaaaatggctcccggccctgccagattggcggccctcgcggccccgaacaaccaacccgagccgataatggagccaaggccggtaaacatcagtgcccagggaccaacatcccgttttaactgcccggccatcagcgtataacagctttcaagggacgttcctttttttctttttaaaaggtccagcaacttcaatcatcatcggatgaatggtggttacatcagcacattccgtctctgctgtaagcctcaattttcttatcaggctcttaaataatcatcagggttggagcgcgaacagaaccactgatcgcgctgtgacagcataaacctgtccaatccgataggcacgggttttggcaccttccggctgactggtatcgaatgtcagttcccatcgccgtgccccggcacaaggtggtaaatgaaagggtacctcctcatgatgggcgttgtaaatcaccagcagcgtggtgtccgttccggcccgtctgacaccactggcctgtgctcgcccgtccatgagcatgccgaaacaccgtgtgccgttttcccaatcggcaggttccatcgtgtcgccactggcagcgatccaggtgacatcctgaacaccgagttcctcatcataggcacccgtcagaaaacgtccgcgtcgcaggatggggaaccgctcccgcaaggaaatcagcgtccgcacaaaggctatcagggtatgaccatccgcatcgatgtcccagtcgacccatgaaatctcgttatcctgacaataggcattgttattgccttgctgcgtgcgtccgaactcgtcgcccgccagcagcatcggcgttcccttcgcaaggaacagcgtcgccataagattcctcttctgccgctcccgcaatgcacagagcgccggatcgtcgctcggcccttccactccacaattccaggagcggttatgagaatggccgtccttgttatcctcgccattcgcctcattatgcttgtcgttgtaggtgacgacatcttgcatggtgaacccgtcatgggcagtgacgaaattcacactcgcccatggcttgcggccacgacggttataaatatcggccgaagcgcatagccgcgcagccatggcggaggctgtttcctcccctttccagaaaccgcgtaccgtatcgcgaaaccggtcgttccactcggcccagccgggcggaaaaccaccgacctggtagccgcccggccccagatcccacggctccgccaccagtttcacgcgggagagaacaggatcctgccggcagctgtccagaaagccgcctccttcatcgaatccatatgcttcacgggcaagaatagttgcgaggtcgaagcggaaaccatcaacatgcatttcctccacccaatagcgaaggctgtcagtcaccatctgcaacacccggggatgagacagattcagcgtgtttccggtgccggtatcgttgatataataacgtggatcaggggccagccggtaatagctggcattgtcaataccgcggaaagaaagggtcgggccccgctcatttccttcggcggtgtggttatagacaacatccagaatcacttcgagaccggcatcatgcagatgcgcaaccatctccttgaactccgccactgcaccggtggcggaataacgcggatggggtgcgaaaaagctgatcgtgttgtagccccagtaattggaaaggttctgttcgatcaggaaacgatcatttatgaagtaatgaaccggcagaaactcgatggaggtcacaccgagcgatctgatatgcttcaccacttccttcaccgacataccggcgaacgtgcctcgcaaaggctccggcaccatgggatgacgcatggtgtagccgcgcaggtgggtttcgtagaaaaccgttttttcccatggcacgctggggggatgatctctcccccaggtgaaagcggaatcgatcacccggcatttcggcatgaatcgtgcgctatcacgcgtatcaaatgaaagatcttccttctcatcgccgatgatatagccgtggcaggcatcatcccagtgcagatcgcccaccatcgccttggcataaggatcaagcagcagtttgtgtggattgaaccggtgcccgacctccggcgcatagggaccgtgtacacgataggcatagacctgcccgggccgggcatccggcaaatagccgtgccagacctcatcggtatattctggcaattcaatccgctgtaactcccgcatgcccgaagaatcgaacagacagagctcgacttttgtcgcattggcggaaaacagcgcgaaattaacgcccagcccatcccaggttgctcccagtggatagggcagaccctcactgatgcgcgttctcatgattgcaatcagacctcgacgatggggttcggcaacagggaagctatgctgccccagttagggggcttcagaacagggtcatccagcctttgatcatgccggaaggggatatgggtggggagaaaataccgatacaaccgcgaaacacagcttattctgccagcagggaaggcctcatcagcccggacaaagccggcagaatcgtttgcagatcacgctcggccctgcacaccagatagagaccctccagccttccctgcccgccggagagcggcaacccgtccttatccagtggcacagcctgaagccccagatcagcataaagctgaagataggtctccccgacaccccataaagcagtctcccgcccttcctgactcgccagatcacggagatgccacacggcagagacacggtctgcctctggccctgtggggtcacccagaccgagaagaagcgatccgacgcgacagaacggaatccccgcatgcgctgcctcccccagaacgacaccatcagccttgggaatgctgagcccgttcatacgggcgcaacgcatccgccattcgggcgtccatggttgaaaggtcacatgcgccggacgaatcagtccccatatggccgcaagccctgcgagtaccgccccggccacactggcacggatcgcattgggcacatccgccgacaggacaacgctccaccaggatgcccctgccagtccgctcacatgccgctcgaaccctgccagcatcagcaggcaaatcaccagggcaaaaagcggtaccaccgtttcggcctgcatccggtcacggagagaacgggcctggcggtaaaacgcctccctgaagggagccagcagcagcccggtcagaatcaggacagctgaaacccacagcccttccccccgcaccagcgagaccgcagccccgctgagcagcagcagaatggtcattccccacgccagacgcacacgctgcgccagaccaaccgccatgaccagcagaccggttccgagcagggaagggaaaaacatctctgcctccctcgctgcatcgaacgcatcaataccgagccaggacagatcaggattgggatcgacgaaattgaggccaagcaacagggaaccactcagagccacagccccggttgcagccccgacagccagatcaggcgcgctccagcgtgatggagccggcaatgcgtcctgttcctgatccgctggcggaatggatttacggccgcgcagcagaatctcgttccctgcaaacaaagcgccggatacgaaaagcgggatgatgtaataatacagacggaaaaccagaatcgcactgacgatctgcggcgggggcagccagcctgacaacccgatcagaatggcgctgtcgaatacgcccagtcctcctggaagattggccgccagcccggctgtgtaggatgacagatagacaccgagaaaacgcagataggtcagcccctccgcttccggcagcaacgcatagaaaatagccgctgtcactgccacatccgccgttgcaagcagaacctgtaacaccgccatccgtgcgcccggcagtgatatctcatggccgaacatccggaaggtaccgaacatgcgcgccagagtcacatagcctgcgactacagcccacatgaccacaccaagcagatgcatcccccatcccggcagccactggccgaagaacggaacggattccggctcccacagcaggatcgccccgcccagcaccatgccgcccaacccgaaggtcaggctgcaaaaggcgatgacctttccaatctggaccggtgtcaggccccagtgcgcatacagcctatatcgcacagcagcgccggaaaccgccgcaaaccccagattatgcgccagtgaataggcacagaaagacgccagagagaccttccagtagctgacccgccgtccggcataaatcgtgccgagcctgtcgtacaaagtcagcacggcataggaaaccaccgtatatccggcggagatccacagcacgcgattggggatttcctccaatgcgcgtttgatgtcatccaccttcagatggcggaattccctctgcaccacatagatcgcaccgatcagcagcagaatccccagaaaagcgggggcccgccgcaggatccgcttgccgcgaaccagcagcctcagctggcggatccgctttgcgtcaagccgtgggagtgttttggcgcgcaagggcggcctcgatcagagaagcggtttcagcaacgccgtagacggcaacaaagttaccgaagcgcggcccctccacctggcccaacagcacctgataaagacagccgaaccaggcgcgtaattctgcgaattcatgtctcttgccgacctcgaacactgcattctgcaggacggtttcggacgcatccggttccatagcccgcaacacatcgcgcagatcaaccagggcagcccgctcggtctctgtcgggtcgcgatagtttttctgcggcagcacgaaatcacggtaatacatcaccgcatgatcggccagccgcgccagaaacggctggttctccggcgtggcaccggggcagtagcggcggatgaagccccacagaatatcggcattctccgcattcaccacactggccagattgagcaacatcgcgaaactgagcggactgcgctggtccggcacctgccgtccggcaatatgccaggagggattggtcttcagcgcggcctcatcctgagtcgcggctttatcggcatgggcgagatattcatcggcagcacgcgggatcacgtcgaaatacaggcgcttggcccgctgcggcgcgttatacatgtattgtgccagactttccggcggggcatagcgcagccattcctcgacggacaggccattgcccttcgacttgctgatcttctgaccatgctcgtccagaaacagctcgtaggtcagcgtcaccggcggctggccaccgagaatggagcagatgcgggaggatagccgcacactgtcgatcaaatccttgcccgacatttcataatcgacacccagcgcataccagcgcatcgcccagtcggccttccactgcaacttggcggcaccaccggtgaccggcgtctcgaaacgtttgccattctcgtcccgccagacgatcgttccagcctccacatcacgatgctcgatcggcacctgcatcacgataccggtttccggatgaagcggcaggaagggggagtaggtcgcccgacgctccggccccagcgtcggcaggatgacagcggtcacctcatcatacacttccagcaaccggcgaagggccacatcaaaccggcccgaccgataatactcggtggaggacgcgaattcataggaaaagccgaacccatccagaaagctgcgcagccgggcattgttatgagcaccgaaactgtcatgggtgccaaacggatccggcacgctggtcaacggacggccgatgaactcggccagcatctccttgttcgggacgttatccggcaccttgcgcagcccgtccatatcatcgctgaaagccagcaggcgggatggcaggccggtcagctccgtaaaggcattcctcacccaggaggtgcgcgcgacttccccgaacgtgccaatatgcggcaggccggatgggccatagccggtctcgaacagcgcctccttttttccggttgcagccagacgcgcggaaacgcgctgcgcttcctcaaaaggccatgccttgggaacctccggcacagggccggaagaggagggatcagaaggagaagaagcggataaagacgtcaccatgcggcgcaagctagaaacggcaggccgtccggtcaatcggagccgtgaacatggctccgctgatcggcaggaaatgctgcctgatcactcagcgacacgatgcgcagatacgctctggcggccagcctgcttagccctataaagggctgatgcagtcccggccccccagcatcatccggcaggaatcttcttcacaggcagggtatgccgcccttgtcgccggatacggacaggcagcactcattgatccggatggcgtgctgcatcagaccagcagcgccagagccgccgccatgctgcgcacactgccgcctgtgctggttattcatgcgcccgccacactgaaccggcttgctctgcatggccatgccgtgccgtgccttgatttgctggaactgtttgctttcgtgctgcccggcaagaccgcctctcctaccccgcgcgggctggcgctggcgcttgatctgccaccgccgggacctggcctggaggaacaggtcaccagcctgtcccgactggcgtccaatctgctgaaccggttgcaagccggacgcatgacacccttgaaccgcgatgctgcggctctcgctgcacggatgggacaaagcggctgggcatgggcgccttatgtcatgcaggcgctgggacagcccgatgccgccgcacaggccaatgcgctgagaatctggaaccggctgccggaatgggaagacctgccacccccaccgcccccatcctcccacccggtcagcgatgccgaggcaaggagccgcctgcgcagcattctcggcactgatgcggagcaacgaccgggacaggcggattatgcgggtgccgccagcgccgcctttgcgccgagacaaagccggggcgatcctcatctggtgctggccgaggcaggcaccggcaccggcaaaacgctgggctatatcgcccctgccagtctgtgggccgagcgtaaccacgggtccgtctggatcagcacctatacccgccatctgcaacggcagatcgaaggtgagttggcccggctatttccagatcccgtcatcaggcggcagaaaaccgtgttgcgcaaaggacgggagaactatctctgcctgctgaatttcgaggacgccgtggccagcgtggcagggctggcgcatacccgcaccattccgctcgcgctgctggcacgctgggcactggtgacggaagatggtgatctgcaaggcggcgatcttcccggctggctgccggaactgtttggtggcgggttgctgccggcactggcggaccggcgcggcgaatgtattcacgccggatgcggccactggaagaaatgctttgtggaacacagcatccggcgggcacgcggggccgatctggtggtggccaatcacgcgctggtcatggcgcaggcagtgtggggtgggctggacgacacgacagttcccacgcgctatgtttttgacgagggccaccatgtcttcgatgccgccgatggtgcgttttcggccatcctgtcagggatggagacggcagaactccgtcgctggctgcgcggagcggaaggcggccgttcccgcgcccgcggtctgcgccgcaggctggaggaactggtggccgatgatcccgaccttcaggccccgctggaagcagccctgaccgccgccaccgctctgcccccgcaaggctggcagatgcgtctggccgaagcggcccaggatgcacaggaacacccggattcttcacccggcaatatcctgctgcccgatctcggcgggattgaggccggacggcaaaatccggcggaggctctgctgcatctgctgcggcgtcaggctctggcacggtcaaacgacaaaaccgagctgccccgcaccgccattgaagccgatctgcatccggttctgcccgaactccctgacgctgctgctgtgctggatcgggcgctggaccgtatcctccaaccgctgaaaaccctccgccagcgtctggccgaccggctggaaagcgagtccgacacgctcgatcagccaacccgcagccggattgaggccacctgccgctctctgggacgccgggccatcgacccgctttcagcgtggcgtaccatgttgctggcaatccagtcaccgccaccggaagcagggctccggccggagcatgtgcatttcatccgcctgcaacgcggcgatacgggagaccgggatgtcggattgcaccggcattggctggacccgaccattccttttaccgccacgctggcttcgcccgcgcatggattgctgatcacctcagccacattgcgcgacggcggcatggaggatcaggccgccgcctgggaagcggccgaagcacaagtcggcgcgccgcatctgccctcccccgctatccgtgccgctctggccagcccgttcgactatgcgacacagacgcgcgccttcatcatcaccgatgtagggtacgaacttgcggcactcgccgctgcctatcgcaccctgtttctggcggccggcggcggaggattagggctgtttaccgctatcacccggctgcgcgccgttcatgcacggattgcacccaccctggaagcggagggaatacaagtccttgcccagcatgtggatgccatggacaacaccacgctggtggatgtctttcgtaccgaaatcgattcctgtctgctcggcaccgatgccatgcgtgacggggtcgatgtgccgggtcgcgccctgcggcttgttgcgttcgaacgcgtgccttggccgcgtccggacattctgcatcgggaacgccgtattcatctttccggcggcatgccgtcagcttatgacgagcgcatcacacgcatgagattgcggcaggctttcgggcggcttgtgcgcagcgcttccgacaggggagtattcatactgctggaccgccggacgcccagccgccttctctccgcctttccccccggcgtcacagtcagacgggtcgggctggcggaagccgccgcagaaacagccgattttctgagaaccgaacacaaaaacgtgatgcgtgccgagccattcggaatgtgatgcgtttccgcttgcacctcttgccagtatcagcgagttttttcctatgttgacccgtgaaacactgaccccccaggaagcccttgtgtgtacgatggtgctggtggcggctgccgatggcggtatcaccgaccgcgaaatcggcacgatggccggcctggtccagtttctgccggtttttcaaggtttcacggctcaggaactggccagcgcgagcgacgccacggtcaatctgctgcgggatgaaaacgggctggcccatgcctcccgtctgattcgcaacgccttgccgaaccggctgcgcgaaaccgcctatgctcttgcctgcgaagtcatcgccgccagcagcgaagcccagcaaccttcattgcgtatgctggagatggtggctcacgaactgcatctggacccgcttgtcatcaccgccatcgaacgctgcacccgcgcgcgccaccagcgggtctgattctttaccctgccggagccagcccggtcagaacctgacggaacatgtgccgtcagggagcgttcgccttccatgacaccaaaaccatgggagatgacggaatgagccacgatcacagcaagcaaagcccggattttcagccctccgtaaccctgatacaagcccatttcgacagcgatgaagccgtgcaggctgccattgatcgtgtgatgcaggccggaatcgaccgtggcgccatttccctgaccaatcgggccaatgcccaggccggtcccgatggcagtgtcgatgcacccaccacggaaacagatcatcgccagttacgcacgctcggagcaggagtggcagcggcggcaggcgctatggctgctgccggggctgtggtagcgacaggcggggcagccttgccggtggtaggggcggcgctggcaggtggtgccattgcaggaggtgctgcggaaggcatcgggcaggcggccagccatgccggacacgaaaaacgtgaaacagccgcagaggccaatgcgctgatcctctcagtctccgtgcaggatacgaaccagcaatatcgtgccgaacgggccttgtcagaggcagggggaacctcgatcaaccgggtcgagaagggctgacccgtccttatccatgtctgaacataaaaaaaccggtcgctccatcaggaacgaccggtttttatgatcttatgatcagaccaacccgatgcggtaaagcatcaggctggatgagcaatcaatcaggccacgcgaaggttggtggcagcggccttgccgcgttccatcgcaacttcgtatgtcaccttctgaccttcgtccaggccacgcagaccagccgcctgaacagcggtgatatgcacgaatacatccttaccgccatcctgcggcatgatgaatccgaagccctttgtggcgttgaaccacttaactgtacccgtagccatagcgcgtcacttctccgtcgttaacaccacacacattgtgcggtgatcgacaaccgagccttttgtattacttgaaggctccccccggtggggcaccggtgcatatgttccgaaaaacactctcaccgggaacggacgcgcagcaaggcaagcaaaagtacgattgacagtttgcagtgggacagaaagctccgcagatgtcaattgcggatcaatgacaagccgccttgatgatcgaccaaaaacaggcttctgctttggcgattcaacacggcttaaagaaaaagggcggccaccagggccgcccttcaaccgtccgatgaacggatggatcagaaatccatatcgcccatgccgcccggaggcgcaccggccggagctttcttttccggcttctcggcaatcatcgcctcggtggtgatcagcagggctgcgacggaagccgcatcctgcagagccgtacggacgaccttcgccgggtcgatgataccggccgacaccagatccttgaactcgccggtctgggcatcgaagccgaaattataagtgccgttttccagaaccttgccggcgatcaccgcaccgtcttcacccgcattctcggagatctgacgcagcggtgactgcagggcacggcggataatttcaataccgaccttctggtcgccattgtcatagccgagatcggccagcttcagggaagcacgggccagagccacgccaccacccggaacgatgccttcctcgaccgcggcacgggtcgcatgcagggcatcatcgacgcggtccttgcgctccttcacctcgacctcggtggagccgccgacgcggataaccgcaacgccgcctgccagcttcgccagacgttcctgcagcttttcacggtcgtagtcagaggtggtttcctccgcctgcgcacggatctggctgcaacggcccttgatgtcgtcgggagaaccggcgccttcgacgatcgtggtgttttccttctcgatcagcacgcgcttcgcggtgccgagctgctgaagggtgacggtttccagcttgatgcccagatcttcgctgatcaccgtaccaccggtcaggatcgcgatatcttccagcatcgccttgcgacgatcaccgaagcccggagccttcacggccgcgatcttcagaccaccacgcagcttgttcacgaccagggtggccagggcttcgccctcgacatcctcggcgatgatcagcagcggacggccggactgcacgacgctttccagcagcggcagcagcggctgcaactgggccagcttcttttcgtggatcagaatataggggttatccagctccgcgatcatcttctccggattcgtgatgaaatacggagagacatagccacggtcgaactgcatgccttcgacgacgtccagctcggtctggatgcccttggcttcctcaaccgtgatgacgccttcattgccgaccttctgcatcgcctcggagatcatacggccgatctcgctttcgccattggcggagatggtgccgacctgagcggtctcggagggattggtgatcttgcggctgttggccttcagatcctcgatcaccacggcgacggccttgtcgatgccgcgcttcaggtccatcgggttcaggccagcggccacggccttggcgccttcacgcacgatcgcctgggtcaggacggtcgcggtggtggtgccgtcaccggccttgtcattggtcttcgaggccacttcgcgcaccatctgggcgcccatgttctcgaacttgtcggccagctcgatttccttggcgacgctcacgccgtccttggtgatgcggggtgcgccgaagctcttgtcgatgaccacgttacggcctttcggaccaagggtcaccttcaccgcatcggccagaatgtccacgccacgcagcatgcgctgacgggcgtcgccaccgaattttacgtctttggctgccattgtcgtttctctcgattacagtctgtggggaggaaaacaggacttcattcagaacaaaggcgcaggcttttgccgtgcgcagccttatccgatgatgcccataatgtcgctttccttcatgatcagcagctcttcgccgtcgatcttcacttccgtgccggaccacttgccgaacagcacgcgatcgccagccttgacatcgagcggctgaatctggccctgctcgttacgtgcgccggcgccgacggcgacgatttcgccttccatcggcttttccttggcggtgtcaggaatgatgatgccgccagaggttttttcctcagcgttcaggcgacggaccacgacgcggtcgtgcaggggacggaaacttgccatcggaaaacgctccataaaactcgtgcgcctctgtccggcgcttgatgggctcgtttgttagcactcccatgcggggagtgccagccatgtatggcagctcatttcatttttcaagcaattcggtgttcggatcctgtgaatttttggcagccacagcgcatcgcgagtgctaatttattgataagaaacatttttcttgaaatcagccaaaccgcgatgtcacgcttctgaaacgggctgcggtcagacgggcgcaggcccggttttttaccgtcaggaggcacccttatgaatcttggccgtcagttgcaggactatcgtctgaccaccgctgaaattctctatcacctgcccgatcatcccgccctgttgcagagctatatctggcaggagctggacatggccccccgctttcccgaacttcataaattcctggatttctggagtcgtgagcttgagggcaaactccattcggtgcgcgtgacagctgccggtctgattacacccggcgagattcgtcatccggcgctggtggccactctgcactgacgctgtcatccggctgtatcgcctcccgtcccagccgggtacggcgatacagccagaacccaagcatcgtggacatgcagaacagaacgatcgccagcgccaactggacgccatgaccgattcgggtgcccccgcccagcagcacgaacaccagcgtttgcgggataaatccgacgatactggccgccacaaaagggatggggcggatatccagcacgccggccagaatattgagcagcagattactgccaaccggcagcagacgcagggtcagggtggcgctgaagggatgcacggccagaagccggctgagcctgaccagacggccgccctggtcccgtcttgccagaaaacgccgcatccaggcgcgcgccagcagccgtgcccagagaaaatcgacaacgcaacccagcgcggtggccgacaaggccagtccaaatccttctgccgccccgaaactgtatccacctgcaaaggccaccacctgacgcggcattccgactgcacaggacagggcagccagcagcagataggacatcccgccacccgtgctgcgcagcctttcaaccgacagcccgtgcatgatcagcccggccccaaccagaccggcaatcagcaagagcagcttgccgacgcttttccacaaagaaggggcgacacgcagcgatacggacggagcagcctcgggaggctcggttgtgaccatggccatcccggttagcgtcatgaccgggcagcatcaagccatacaggtgacccatactgttgccatcgccatgcctgctgttcgcccgctgctgaaaccgttatagagcaggcatcatgtcagatcatatccgtgccgcatcctccccatcccgccatggcagcgaacatgggtggcagcatgccgtgaccccgcagcagcgtaaccgcattctggttgcaacatggatgttcacgctctgcttcatgattctggtcatggtcatgctcggaggggcaacacggctgaccggttccggcctgtccatcatggaatgggcaccgctgatgggcacgctgccaccgacctcccagactgaatgggagcggctatacgcgctgtatcagaagatcccgcaatacgcgctggtcaatcatggcttcgggctggacgggttcaagcatattttctggctggaatggacgcatcggctgtggggacgcctgatcgggctggttctgttgctgccgctgatctttctggcggtgacgcgccggatcgagcgcagcctgatcccccgcctgatcctgattttcgtgctgggcgggctgcagggtgcagtcggctggttcatggtcgcctccggtttttttccggacagcacggcagtttcgccctatcgccttgtggttcatctttcctttgccctactgctttacagcgccctgctctggactgcgctctcggtcctgaatcctgagccgcgcccactccccggcacggtgggactacgccggatgagcgcggtcacgctggggctggtctgtatcaccatcattgccggcgggttcgtcgccggtattcatgccgggctggattacaataccttcccgctgatggatggacgcctggtcccggaaggttacggcgaaggccaccgtgccatgttcgaaaacattcccaccgtccaattcgatcaccgcctgctggccacattgacggccctgaccgcgttgcttaccgggctgatcggattccgcagaggcggcaatgcccgacgtgccgttttaccgctgatggtcgccgtgatcttgcaatatgcgcttggcatcgccacgcttctgagtgtcgtcgccgttccagtggccgtggtccatcagggcatggctgtcctgctgctgacggccgcgatcgtcaccctgcatagtctgcgtggtgccggccgcaccgcttccatcaatgccccggcctcttctcactagccgggcaggagttgtcatgagtctcgataccgccctcgccgccaccgatcacctgttcttcgaacgggcggacgcgaccctcgatcaggacagcgccctgaaaatcacgcaggatgccctgctcggggccgaggatggggagctgttcctggaatatcgggaaagcgaggtcgtcagtctggatgatggccgcattcgcggcgcaaatttcgacaccgccacgggctttggcctgcgcgccgtcgccggtgaagccaccggatatgcccatgccggggagatcagcgaagccgccttgcgccgtgccgccaccaccgtggcctccgtcgcgtccggccatggcggtaccctcgccgagccgccgcgggcgaccaacgcacggctctacagcgacgccaacccgctgccgagcgtcgatttcgccacccgcaccgccctgctcgctaccatcgacgcctatgcgcgggaaaaagacgcccgcgtgcggcaggtgacggcctcgatcgtcggggaatggcaggctgttcagattatccgcgccgatggcttgcgcgtcgctgatctgcgcccgctggtcaggctgaatatcgccgtcatcgtcgaacaggatggccgccgggaaagcggcagcttcggcacggggggccgctatggctatgatcgcctcctaaccgaggaaacatggaaaaacgggatagacgaagccctgcgccaggcgctgatcaacctcgacagccgcccggcccccgccggggaaatgccggttgtgctcggctccggctggcccggcatcctgctgcatgaagccatcggccacgggctggaaggcgatttcaaccgcaagaaaacctccgcctttgccgggctgatgggacagcgggtcgcagccccgggcgttaccgtggtcgatgacggcaccctgccggaccggcgcggcagcctgaccgtggacgatgaaggcacgccttcctcccgcaccgtgttgatcgaggatgggattctcaccggctatatgcaggataggctcaatgcccggctgatgggcgtccgccctaccggcaatggccgccgccagtcctatgcctatgcaccgatgccccgtatgaccaacaccatcatgctgggcggcacgcatgagaaggaagaaatgatccgctcggtgaaacgcggcctgtacgcagcaaatttcggcggcggcagcgtggacatcacctccggcaaattcgtgttttccgccagcgaggcctacctgatcgaggatggccgcattaccgcgccggtcaagggtgcaaccctgatcggcaacgggccagacagtctgacgaaagtcgagatgatcgggccggatgttgcgctggaccctggaattggcacctgcggcaaaagcggtcagggcgttccggtcggtgtcgggcagccaacgctgaaactgaccggcctgaccatcggcggtacagccgactgagagggttgcctcattaccgggacgaacgttttcattgcggtgtgcggtgtatccttaccgatagaatccggaaggctggggtctatcggtaaggatacacccctgctgcactctgaagatgaatgagatttaaacagattcaggcttttctcccggctctctccatgccagcgatagttcctgtttcatggtaagccctgataaggcttgagagcatccaatgatcaaacgtggcgtgataaatcgcattgtctggaaaaccggcgctttattggcattcgccgctccggccattggtacgctcacagttcctttcatggcccatgccatgcaggagaataattctgcatcttcctcttccatccaggtggcaacatcctccccaccgccgagctgcccggcttacgagatgccgcccctgcatctcaaaaatctgcgggatgcgctggaggataatgaacaggtggtgatcgtcgccatcggttcctcttccacgcagggatggatgtcgtcagatattggtgcctcctaccctgctttgttgcagaaggaactgtcagaggctctgccgcatgctcatatcgccgtgatcaaccggggcatcggcggggaggacgttgccgaggaaaccccgcgcctgcaaagtgacgcgctggatgttcatcctcaggccgtgatctggcaggtcggcgccaatggggcgatgcgcaatatcagccctgacgtattccgcaagatggtcatggctggtgtcgtccggatgcacaaagcatccgccgatgtggtgctgatggataatcagcgggcaccccgtatcatcgcaaccaaggaaggtcctttactggacagcaccatggcctccattgcccacaaaaccggcgcggcgctgttccagcgtgggcaattaatggatcactggcgggatatgggtcacccatacgctgatttcatcgcctcagacgggctgcatcataacgatctggggtatcgctgcgtggcccatgccctggcacaggctattctggcagggctcaaggaaaccggggccaaacaggataccatctccggccttcctcatcacgccgctcatcccgcagtcagaaaagcctcccccggcgatgctcacggaccggatggggatgatgatggagatgatgatggcagttaggcgacctgagcctcgttgaaaatccggctcacatcccctgcccagacgctctgatagcggttcagccagtgctccgcctgtgttggagcgccgccttccacgatgtcgcgcagcggatcgaggtatacttcttccccctgcccacgggcacgcagaccgtccgcggcgatggcgaccagatcgcgggccaggtcgcgtaccgtgccatccgcaaaaggcgtattcactgcctgccttgcgacctccgaccgcaatccgaccagactctgccatccatgccggttcatcagcgcggtcgcggcctccagcgcagcatcatcgtaaagcagaccaacccagagcgccgattgagccagcatcatcgccatactgccggcatcagcaccccgcatttccagaaaacgcttcagtcggacttcagggaaagccgtcgtggtgtgatcggcgaaatcaccgatggtcggacgctccccttcccggcccggcagacgcccggccatgaaatcacggaaactggctccggcgacatcgacatatccgccatagccctcaccggggcgatgcacgaaatacatcggcacatccagcagccactctgtccagcgctcgaagccgaacccgtcctcgaacacgatgcccggcaatccggtgcgatgggggtcggtatccgtccagatatgggcgcgataggacaggtaaccgttcggcttgccctccgtgaagggagagttcgcaaacagcgccgtggccaccggctggaaggccagcgcaacccggaatttgcggaccatatccgcctctgattgcgtatccagattcacctgcacggtacaggtgcgcagcatcatgtccagcccgagcgtcccgactttgggcatgtaggcacgcatgatttcgtaccggccctttggcatccacggtatcgcggcgcggctgtgcagcggctggaaccccagcggcgcgaaacccagacccagcggagctgcgacacgatgcaactcggcaaaatggatttgaaactcctgccttgtctggtgcaggttcgtcagcgcaccaccggacagctcaaactgcccgcctggctccagcgacaaagaggcacccagggaagaggacggacctttcaggccgatggagtggccacggtccagaatcggtgtccagccctctgccgccttggcagtgtgcagaccttccagaatcgccgcaattccggcagggccatcatagggaggggcagcaagatcggtcagggaaaagccgaatttctcgtgctcggtgccgatacgccagtcggaacgctcacggcagccgctggcaagatagtctgcaagctgacgggtcgtggtcgccggagtggtatcggcgtctcctggattggacatcggcttcctgactgactggaacgttacagggtcgaatccctgcggctactcaagcggcatatcagacacaggcggagctgtcagcaaggccagcccggcaatggcggcggtctccgcacgcagcaccgttcgcccgagagacacgggaataacatgcgcgtgggaacgcaacatgaccagttcctgttccgcaaatcctccttccgggccggtcagcagggccgatgggccggccacccctctggcatgcgccacatcggaccgttcgattgccgcatagagtcgccgatcctccggccagtcgcgtaacagggccggcaatggctgaggcgcctgaagcaccggaatgctcagacgttcacactgctctgcggcttcaaccgcgatggcttccagccttgccgcattgatgcgttcggcattggtacgggtggtcatcaccggaatcaggcgggagacgccaagctcggtcgctttctgcaccaccagttcggtattagtgcgcttcagcagggcaaaaaccagccatggcccctcttcagggacgggggaacgaatctgctccgtcaggctgagtgtcgcccccttacggtcgatcctctcaatcacagcccgccattctccatccgtggcattgaacaggctgagtgcatcccccaccccccgccgcatcacggtgccgaggtaatgggcgcgcgctgtatccagtgttaaatgctcgcccccacgcagggcgtggtccatatgcagccggatggaaggggcacgggcggatgaaaaacgattcgaggctgtcatgacggggcatcctgccacaaaccctgcccgcacggcagagaagataccaaggcctcacaccgatctccgccccgatggctggattacccgcctgccccggcggatacagccttacgccctgttggcccgtctcgaccggcctgtcggcatctggctgctgtttctgccgggcgtatggggaattctggcggcacggccaccggaccgggaaagcctgcgcctgatcgtaatgtttttgatcggcagcgcggtgatgcggtcggcgggctgcgtcgtcaacgatatgtgggaccgtgatctggaccgcagcgtcgcccgcaccgccagccggccactggccgcgggagtgctggggatgcgtcaggcgactgtatttcttggcctgctgctgctggcgggattcatggttctgcttcagcttccgcgcatggcacaaattgccgccgcttcatccctgctgctggtggctatctatccgctcgccaagcgcgtgacatggtggccgcaactggtgatgggattcacgttcggcttcggcgcacccgcaggtgccatcgccgcaggcgcggagacagggccgcactggtggcttgtggggttcctgtatgccgccgctattttctgggatctcggtttcgatacgatctacgggtttcaggatatcgaggatgatgccgtgatcggcgtcaaatccacctcccgccgtttcgcgcatatgccgcggcgtttcgtcggcacaagctatgccttgatggtggttttcctgattcttgccgggatcagggccgggctgccatggctgtatgaccttgcactgacactgcccgccgctctgctgctgtggcaggtacacaggctggatattctcaatcccgcagcctgtctgggcgctttccgggccaatacccgaatcgggctggccgtggcgggcgcattcctttggggctggatcggattgttgccatgaaagacactgccttcatccgcgagaatacggcatggtcccacgcgcctctggtgccggagctcgggctgtttctggccaccgccatcaccccgatctggcaggccacggaagactggctggcgcaacggaatgtcgagccgcctttctgggcctttgcgtggccgggcagtcaggccattgcccgtcacgtgctggatcatcccgagctggtgaagggccggcgggtgctggatttcgcggcaggatgcgggctggcggccttggcctgcgcccgcagtggcgcacaggaggcagaggcagccgagatagatgggctggctctggccgccaccacgctgaacgcgactgaaaacggcctgaccgtccgtctggccgaaggcgatgtggtgggcagcccatgccgctgggatctgatcctttgcggcgatgtctgttacgaggcccccatgacccgtcacatcatgccgtggctgcggcgcatggcgaaaacggcagaggtctggattgctgatcccggacgaagctacctgccgcaagagggtatgaccgctttcgccgaatataccgtgccgaccacgctggagctggaagaccgcaccgaacggcatgtccgcctgtttcgtcttgctccctgacccctaccgcttcatcagtaccggaatgcgcgcatgttccatcacatgccgcgtcacaccccctaaaatcatctgtctcaggcgagaatgggaataagcccccatcgccagcagatcgcaggaaaaatcctctgccgcctgtaacaacccggctccgacactcccgtcgaccggattgaaatgagcaatatccgcccgaataccgtgacagccgaggtactccaccaattccttcgccgccggtccctgacggtaataggaatgagccgtcagaatacagactgcctctgccttctgcgcccatgacagagccgcccgtacagccgacgcactttcgaccgtgccattccaggcaatgcagacccggttgccgagcgtatcccccggctgatccggcgccatcagcaaagggcgtcctccgtcaaaaagcaccgcgtgcaacgcctcggtcgaggacagatcatcgtccccggacgggcgggcaatgacggtgagatcggccacacgcgcctgccatgccacgatgtcctcctcctgccctgtcctttcttccaaccggatggaaacggggggatgccgatcacgggtgacggcatcaatcatcgcctgaatggccacgccccgctcccgtgcttctgtctccaccgcctcgatcatgtcctgcaccatcgcaccggacaggccttccgcagccagcggggctatgtcgctgctgtcggtacggatgtgaacggccagaatttgggcttcccatctggcagcggcctgtatcgcgaccgccagtgcggatcggccacggctcgggcaacggagcggcaataaaagcttgcgaatggccatagcagcttccttttccgatgataccaccctgttccgccttggcctgttccgccttgggaggatctgtctacacccgatcctgtggcgttaccggtcttatcgagagaacatgatcggtcctgagcgcgccatataaatgcgggaaaggcggctgatccggctccgacacctcccagcgcaacagtgcggacaggtcatcagccgacagagacaacagcagcagaccgtcctgatcagggtagtgaagcctcagcacgaaagagagttgctcgggagtacagagatgaatgaatccctcccgctccagacccggcggcgcataacaaccctcctttaaagcattctgccagtcttccgggctgatgatgtgcagcaatgtcggggctgtgctcatctcaggcctcgttcgaaaggggtgcacaggcggcttccagccatgcctgctccgacgggggcagcagcgggccgatctctgccagaacgcgggcgtgataggtatcgagccagaccctttcagcctctgtcagtaaaccaggctcaatcagggtgcgatcaaacggggccagggtcaaagtctcgaagccgagaaaaggacgggcggtatccagcacgtccctttcctgcaccaggagcagattttccagccggatgccgtattcgccaggctgataatagcccggctcgtcagacaggatcatgcccggacacagcgcaacaggacgccccgcgcgggagagagaggccggtccctcatgcaccgacagatagctgccgacgccatgaccggtgccgtgatcataatcaagccccacatcccacaaggaccggcgcgccatcgcatcgatatgcggtccggccaccccttgcggaaattgcagcgtcgccacggcgatatgccctttgagaacccttgtaaaacggtcccgcaacagcgcaggcggcgcctccggtccggtccagatcgtgcgggtcacatccgtggtgccatccagatactggccgccggaatcgatcagatagacctcgttcggtcgcaagggccggtctgtttccgccgtgacgcggtaatggatcaccgctccatgctctccggcaccagagatggcaggaaagctttcccccctgaactcatcagcctgctgccggaacgacagcagacgggcagcggcgctggcctcggtttctccctcccgcagcggattcaggctgtacaggaaacggcacagcgccacagcatcacgccggtgggcgtgtctggcccccgcctgctccaccacgttcttgcaggcacgcggcagagcgcagggatcagcgcccggactcaagacggcccctgcctgccgcagcacctgcgcaaaccagaccggagccgtggccgggtcgagccgcacggtttttccctccagcgcctgcaaggctgctgacagcgccgtccggggttgcagggttacgtcagcgccaagccattgcgcggtggcagcggggattttctccggcgccatgaacagcgcgaccttgccatcggcgaacagaaccgcaaatccaagcgcatagggcgtgaaaggcacatcctgcccccgaatattcaacagccaggccagagaagcagggtccgtcagcaccaccgcatcctcgccggcctcggccagagcatccccgatctccatccgtcgggacgcggaatcctgccctgccctctccagcggatgaggcacggccgcagccagaggcggcgctggccggtcaggccacaccgcatcgaccggattggcggcaaccggcaccatctccagccccgctgcggtaaagcggcccagcccatcctcgctgatcagcagcggatcatagccgatccgtgccccttttcctgcggcatttgccagccagagcggaggagatgcctcgataatatggcactgctcccaaagagagggatccgtttcctgagcggcctgaagcgtataacgcccatctgtgaacagggccgcacgctggtgcaacaccaccgcaagaccagcactgccggtaaacccggtcaggaaggccaaacgctccgcacaggggggaacgtattcacccagatgctcatcagcccggggaataatgaacccttccagtccctgccccgcgatcaccgtcctgaagaccgcgagacgtgccgctgcctgagcattccgtcccgtctccaccgttgccatcctgccgcccttatctctttttgcactgcaacatatgcatgcctgtcttttactctttactcgccgcttttagaggcaaatagatcatataatcaccacaaggacgctgccttccgaatcaatgccaaggaggcccggcagtgcctcagggaaccgatcacatgaccaccacgaccttcaatcagggtttgctttcctcccgcagcctgcccgcacaaatcgttgccgtccatggctccgtgcgccagcagttgaaggctgttcaccagcgcctgcagaacgagcgcgcccggcgttgtacagcccgcattctggcagcccgcacggatcaggaactggacgatctgggtctgcatcgtggtcagctgcgcatcgagcgcaccggtctgttcgactgattccttccgccgacctgatcggatagaaatgggcgcgatcctttcggggatcgcgcttttttattggtcgccgccgaggctggtgcgtgccagacggtcaaattcctcgatcgtcaaggtctccgcccgacgatcaccggcaatacccgcgcgggacagcaacccttcgccccctaatgatttgagggcaccgcgcaacattttgcgccgctgaccgaatgcagccgccgtgacccgctccatcgccgtgaacaaagccggggatggttgttcctcacgaggccacagcgctgccacagcggaatacactttcggaggcggatgaaaggctccgggcggcaccgacatcagcatttccacccgacaggtccactgggccaacacccccagacgaccgtaagcatcgctgcccggtgcagcacagatgcgttccgctacttcctgctggaacatcagggtcatgctctcgaacagcgccgcctgacgcaaccagccaaccagaaggggcgtgccgacattgtaaggcaggttggcgacaatgcgtctcggccccgtggtcagcgtgccaagatcggcccgcatcgcatccgcttccagcaccgtcagacgatccggatagaaaccggcaagctcctccagcgccgggattgcccgatgatcgagttcaatcgccaccacccgctctgccgcagtctcaagcaaggcacgggtcaggccgcccggccccggcccgatctcgatcgctgtacggccctgcatcgggccagcttcccgcacgattcgcgccatcagatgcggatcgagcagaaaatgctgacccagcgccttgcgggcttccagcccatgccgggcaataacgtcgcgtaagggcggaagcgccaaaggggaaccaggcactgtccccacagccgcctcagtcatggccccgcatatcgatcagggcgcgacggcgcagctcacgctgaagctgacggctggcggtttcaacacgttcgcccagaatctgattggaaatatcctccttgccgggcagaccgaaattcttctgggtccggctgcacaccatcatgatggcaataccgtcctgagagacgatcggctggctcggctgacccaccggcagagaagccagaagggcacgaaactgcggcggattaatgctttccagacgcagctcaccgggatcggagggccgcgatcctcccatcgccttgctggcggcctcgactgcggcacaatcatgcatagcagcggcggcggccttcgcatgctccagcgttttccgctgctgatccgtgggcgctgccggattgagcggggtcgtaaacggatagaaaacctgtcggatcgataaggcagtcccctgatcattaccgatgatccgcttgccgcgcagggccacgatctcgatcccccccgccacgtcgatcgggttgctgatcgccccgggaggcatttccttcagcaccgacacaacctgcggatcaagctgattgggctgcacccatcccagatcaccgccctcaagtgcggtctgactctggctgaactgggcggcgacaacgggaaaaggtgctccgctgcgcagttgctggatgaccgtatcggcaaaatcatgggctgcctgcgcacgggagggatcatcgacggggatgaaaatttccgaaacgcgatattccgtctggcctttctgggatgccagcagttcttcctcgtcctggatttccttgtcgctgatcctgacacgctcccccagctgctgacgcagcacccgggtccagcctaactgaacacgaatctggtcgatcagcgtacgcatgctgaccccatccgcagccagtttgtggcgcagcgcatccggctgcataccgttccgctgctccatcccctgaatggagtgggcaatatcgctgtcggtgatgacgataccacgacgctggatttcctggagccgcaatttttcgtccaccaactgacgcaggacctgcggagtcagacgatccagcacctcctttgacattggcaggcctgtggacatggcaaacagccgccgacgcgcatccacatcgcccttgctgatgacatcgccattcacaaccgcgacgatactggtctcatcaggcgaagaagcgggtgcctttgccttgccggcggcactccccccatgggatgcagccagggccggctgagcagaagacaatgccagaccggcaagaagaagggcgcgaaaacggtcaacagccatgagggtaagcgtcctgtcctgatcctgatatctctgatagccagcagcagcccgcctagaaagcccggaagccaaacgatcccagcgttttaaacgtcagagagaacatgatggtctcgttcccggtatcattcaggatcgaggtatagcgtttgtacaaacgcatcgccaaaatgaagcactcattctcgtaagcaatgtcgccccccagcgccaccatctgctcggcttccagattacgacgcgcataggcgctgaagcgccaatgctcataatgcgtcgacaggccgagcatggcttcgttacgcggtgtcgtgaccagctgatagacaggcgtagaggcaggcagcaccgtaccgggcgcataggtcagatcgtaaaaattattctccgccgtatacagatatcccacactggcgcgcagccatgatggtccgaaggatgccacggcctccccgtaatggatccggccgctcttgtgatcgaaacggccccgtgtggtcagatcatatccgatgccgctcaggctgacccgccccacaatatccgaggcacggtcggacagacccagcccgggcatgaatgtatcatcccgatgggtccggtaggactgaccgaccagcccatccagcatcgtggtcttgtatttccaggaggcatgaagaccgacattggcccggatgccgccttccatacggtcaaggccgttgaaacggttgagcgaaaacagattggcatcggtaaactgcgtcaccagactgtcttcattggggaaatagcgatacccgcctccgcctgtattgggggcgacgatcaactgggcgatcggctcgaccacctgtgtgccccactggcccgcagtgcgggccagcggcacccggacctcgaccgccgcctggggcaaagcacgcgcatcggttgtgctggtatagggtgcatagaccggctgctggttcagccccgtcgcattataggcgaccgtatccccatgcagcgtgaatttccacagatcgccgaagcgcccgatggcaggccggtcccagttgagactgagcgaggctctctgatccgaaacgcctttctcgcgcaggacgctgaaatcatcggtcctgagcgagaaatgtcctcccagtgaatccggctgccccgcatattcatagatataatgcggcaggacataaggaaccgtcgaattggcgaaggagccgctgatcccctgataggacatcgcattcagacgggtataggaaccctgaccgaagccctccaggtagatattgttcgacaggacgttcgtgccgacaccggaaatatgataatcgcgcagataggcagccgaggtcgcattgttcagattgaagccgtaacgccacgtatcgtcatagacgaattcgcccttcgcgaagatcaatccctgaaaaccgggccggatcggatcgtaataggcgttactatcggtgcggctggacgacgccacataggcggccgccacattgatctgcatgtccccgctattgaacttcttccggtaataggcctgcaattgcggtccggtctgcgagggcagggtcgcggtcagagtgacatcggatgagtcgtcgatcaccagatagtacggaacccgggcaaaaacacccagatagccggactggccgatcccgggcaccatgaagccgctcttgcgcctcaccgaaggatcaggatgcgacatgtaagggaggtacagcaccggaatgccgtaaatctccatcaccgcatcctgatattcgatttttttctcctccagatcctgtgtgccggtaaaggcgcggatctgccagaaaggcggctttttcgggtcatccagacacaggttacaggtcgtgtagagcacccggctcatgtcattgaccttgccatcggtacgacgcatgccgttggcaaccagacgaccgttgaatttcagcagggcgcgcatgtttttcatcacgccgtctttcatgccctgactgagttcggcgtaatcgctgaacagaacctcgccatccggctccagcagcaccacattgccggatgcggcggcaacattggtgttacgatcatacgtgaccttgtcggcgcgcagcacgtggtcgccctgccacgcttctacatgcccctccgcactgaccagcgcgccgtcacggtcatatgtcagatgatcggcggtgaaggtgaccggcgtctggccactgaccgtagagccttttttgcgtggtgaaggggccgccacgggcggaggggcggaggctccgttcggatcgctgcccaccatggcaggctccagcgccgaggaaccgctggcaccgggggaggatgtctggttgaactgattgaacaggctgtcactcgcctgcagggaactgacctgggcaaaggccgaagcccctccggccagcatgcatgcggacatcactaccagaaacaatgacaggcggtgatcatgaacagaagccgtcagccctggcaggaccaaccgcgtcttcattcttccgatgccgtttcgtttcatgtgcatgcgtgtccttagcctgtccgcgcacgatctgtcagcatatcagccgtcttccagatgcagcagcagcgccactgccagcatcaacccggcgaccgaaggcgcccatgccgccagcaccaccggaacagtgccggactgcccgaattcctctgccactttggagacgacgaacagacagaatccggccgccacaccactgccaatcattttggcaaccccgccccgacgggagggtcgcatggaaaaccccgccgccaccagcgccatggtggcacataacaaaggaagggccagcagagactgaaaacgcagacgatgccgcaacgatgaaaaccccgaccgatccagcaggcggataaaatccggcaggctccagaatgacagcgtatcgggggaggcaaagctttcctgaatacgccgtacggtcagatcggtcgggatctccacagtatgcggcgggtccggcagatggctgggacgcaagactctggcattgtccaaaacccattggccggagaccagtctggctgttgccgcctcgatccgctggaccaggcgatcctcggaatccagccggaaaacagtgatggaagaggcttgcagactgtttttatgggctgccacctgcattgcatggatgatcgacacaccgtgcgggtccagcccaggatcggactgacgcagccaaagctggccgcctgccagccgcatcggcccgccgctggttcgcagataggtgttatcgagttgctctgcacgcgacagcatgaccgatgagagcggactgatcaccgtcatggccagcatccccagcagggcagcagccccgaccggcagcgccagaaactgccaggcggagatgcccgcagcccgggccaccaccagttccgaggatcgggtaagccgccagaatgccccaattccccccagcaaaaccgcgaaaggcaggatggtgatgctcatccacggcagtcgcagcgccgcgatggtcgaaaccagcccgaatgagacatccggcttggtcgccgcccgacgtagcaattcaatgaaatcgaacaacccgaccagcagagtaagggcaacgagaacaaccagcgctgcggccagaaaaacccgggtgatataggatgacagggtcaaggcgcggatcatttaacgcgcccctgacggaggaagactggcaaacctgttgtgacccgcctccctgaaagatgttctcccgcgccattccggccagaacatgatccaggccccggccataccgggcgcaacagctgcaatccagatcaggggaatcagttgcggcagttttgccgcagcattcgccacggccagtccaacagccagcaaagccaccaccaccagcgccgccacacccggacgcagcagaccaccatgtcgacgaaaagcgccgttcaacaccgaaacgagcgccaccaccgcaaaagacagaacattgagcggaccagacagacgcctgtgcgcctccaccctcaactttggaatatcccgcgccatcacctgtgaaggatcgggatgcaaaagctcggtcagcgacatttcattggcatcgcgcgaccgctgttcatccttgccggattgttcgaggctgatcgtgttctcgttgaaagtcagaatattcagccgacccgtatggcggtccagctcctgccggctgccgctttccagcacgacctgaggcgcaccattgctaccctgctccatccgcccacgctgggcgatgatcgtcgcatggctgtcggccttgcgggcatcatcaatcaggatgccatgcaatgtcccgtccgcgtcgcgtttgcgtatgtagacgatcatgtcatcggaaacgggggtaaacacgccatcctgcaacaggaaagccgccatcttgttgcggatttcccactgatactcccggaacgcactgaaggccgccggcacgatccacagattcaggacgaaggacagcagcattgtcagcagtgccaccagcagcgccgggcgcgccatgacccagctggacagcccggccgcccgcatgaccgtcaattcccgatcccctgccaaacgctgatacacgaattggaccacaacataagtcgtgatgggaatgatcaccgccacaaagctggggatcagcaggccggtcagtttcaggaacacaaaaacggacaggccgcgattgaccacaagttctatgaaacgcagcgactgggtcagccagatcagcgccaccagcccgcaggtgcaggcgaccagcgcaaccagcaactggcgcatcacatatcgatcgagtgtcgtcagtctcaggctcatgagcattgtctgggacaggaacgaaaggaaagcaaccaccggaatgcgacagcataaccggggaagagcgccttcatcagaccgtcttatggctcccccaccgcgtcggatggcatctcacgcggggccgccgcacgggccagacgatcattgatggcctcgcccaacccttgcatcggcacgcgcatacaggcgatccctcgcagaccccgttgcctccccttgctatccagggttctcaaccctgaaaacaggcgcgtggcggcctcaatcacatctccggcagcgcttaaattccacaccagcccagccccgggcaaaggcggcccaaaagccagcaacgcctcatcagcggcaaccgataccgcatcaagccgcacggtcagggaaggcgcataatgagaacgcatcataccgggcgagagcaacacctgttccctgcttccgtccgcccccccttccggagcggataaaaccgtcacatccccgatgacatcccgcaacgcctcgcgggacacaccgcccggacgcaacaggatcgctgaaggaccgctgagatcaatcacggtcgactccacccccaccatgcagtccggcccatccagcacggcgtcgatacgcccggccagcccctccatgacatgatcacggctggtgggagacacccgtcccgaccggttcgcggaaggcgctgccaccgggcaccctgccgccaccagcatcctgcgggccagatcgagagcgggcacacgcaatgccagtgtctcctgcccggcactggccagcaggctcacaggactgtccgggttccgccgcaacaccatggtcagcggccccggccagaatgcagccgccagcgcccgcgccctgtcatctgcgataccatgggtaaaagcggattccgcatccggcaagtggcagatcagcggattgaaacgcggccgatccttggcggcaaaaatccgcgccacggcatcggcacaggtcgcatcagcccccagcccccagaccgtttcggtcggaaacgccaccagcgcgccctgacgcaacagcctgcccgccgcctccggctctgtcagcaaggcggtcgtgcagggcaaaatgtcagccatgcgcgccattacagatgaaatgcggattttcccatcccggcttgccatagccgagcctctgaccatcaaaagtgaggaccgaccctccggcagcctccagaaccgcctgcggtgcagccgtatcccattccatcgtgcggcccagacgcggatacagatcggcctcgccttccgccagacggcagaatttggccgccgagccgatattactgagggctgcaaccttgcgctgacccaggaactccgccagacgcggatcatcggcatagtggcgggaagccatgacggtcagcccttccgccggtggtgtgcggacatggatcggcctttcgccatcagcatcccgcttccatgcgccttgccctggaatgcccagaaacagctccccgtaagcaggcagcgccacggctcccagaacgggtcggccatgacggatcaggccgacattcaccgtgaaatcccgtgttccggcggtgaactcccgggtaccgtccagcggatcgaccagccagaacgtatcggcgggggcggtcatcagacccgctgcgacctcctcctccgccaccaccggccattgcggtgtggcggcacgcagaccggcaaggatcgccttttccgctgcatgatcggcctcggtgaccgggctgtgatcggatttatggatcacgtcgaacccgcgggagcggatcgtcatgataatcgaggccgcctgctgtgccagttcagccgccagggccagtgcttcaatgtcattcatgcgcttatcatgcggtgtatcgcgccagagtaaaagcaccggaagaaaagcggtggagtaaccccccctccctcttgccctttcgatccgatggtatcccgtctctcatcaacaagacatgacggccacgcggtgcaggccgttttcatccgcagccaatctgctttagcgtcagagtcatctgactgcttatccgttccggaacggctttcccgtcccggtccaagtctgtgggaacctgcatgctcgatatcgcttttgccaaagctgccctgcccaaaaacggggcactggttctgtttcttgcgcccggcgaaacaccgtcgggccttgtcgaagcagcggacaaggctacgggcggggccattacccgcgccatctccatcgccgatttcaaggcagagcatggcaaaagcctcaatctgcttgcccccggtgccggcctgtcccgtatcgtgctgatcggtctgggcaaggatgtgccgacccagacatctctggaagaagccggtggtgccgcatggccctccattgcgaaggaaaacacggccgccattgcagccccgaccctgtccaacgaacagattgcgttcatcgcgcatggggccacattacggtcctaccgcttcgatcgctatcgcaccgatgaaaaagcggatgccaaaccgacactgaccaaactgaccgttctgaccaccgatattgccagcacccgcgccgctctggccccgctgcgcgccattgccgaaggcgtgttcctgacccgcgatctggtgagtgagcctgcgaacgtgctctatccggcggaattcgcggaacgctgccgcaagctgaccacgctcggcctgaaagtcgaaatccttggcccgaaggagctgaccaaactcggcttcggcgccctgctgggtgttgctcaaggcagcgaacgcgaagcccgtgtggtgataatgcagtggaacggagccggagcccgcagcaaggaaaaaccggtctgtttcatcggcaagggcgtcactttcgatacgggcgggatcagcatcaaaccagccgccggtatggaagacatgaaatgggatatgggcggggccgggactgtgaccgggctgatggccgccctcgctgcccgcaaggcaaaggtcaatgcgatcgggattatcgggctggtggaaaacatgccctccggcaccgcgcagcgtccgggcgatgtggtcaccagctattccggccagaccatcgaggttatcaacaccgatgcggaaggccgcctcgtactggcggatgtgctgtggtacgcccagcagaaatacgatccgcgcatcatgatcgacctcgccacgctgaccggtgcgatcattatcggtctcggccatgaatatgccgggctgttcagcaatgatgacacactggccgagcagatcgccaaagccggtgcggcaaccaacgagaaagtctggcggatgccgatgcatcccgcttatgaccgccagattcgctccgacattgccgatgtgaaaaatgtgggtggtcgtccggcaggctccatcaccgccgcccagttcctccaacgcttcgtcaacggcaagccatgggcacatctggacatcgccgggatggcatggctgactcacgataccagcctcgcggaaaaaggcgctgccggatatggcgtgcgtctgctcgaccgtctggtcgccgagtattacgaaggctgatgacggaaatcggcttctatcacctgacgcggacagggcctgaacaggccctgccgcaactactcggtcgtactctggcagcaggcgagagagccatggtgctgtgcggcgggccggagcgggtggccgcattggacaccacgctctggctctgccccaacccggactggcttccccacggcaccgcccgcagcggcgatgcggcccttcagccgatctggctgactgcacaggatgaagccgcccccaatggcgcccacttcctgttcctgatcgacggcaccgccagcgagagactgcacgattatacccgcgtgttcgatctgttcgacggaagcaacgaagacgccgtcgccgccgcccgcctgcgctggaaacaggcaaaaaacgccggccacacccttacctactggcagcaggggccacgggggtgggagaagaaacgctaacggttctccaccaacgtctgcgagaagctgtacgccgtaatcgacataccttcccggaaataaaaacggtgcgctctggcgcgctgcacaccggaatcgagatcgagtgcctgacagcccctctgctgtgcccgctgccgtaaccagccgagcaaggcctcgccatggccacaggagcggctggcctcatccgtcaccagatcatccacgtaaaaccgaaaaccgcgataggtggtcaggtaacaccgatagaccgccaccgccctgacgaggccgccttccgccaggactgccatctccgccccctgcgcgatcatcgcccgcatatgccccgcataaggatcggggatcgcagggcgtagctgacgatgcaccgcctcggcagcacccagccatgaagcagcctgttcctccggcagatcggtcaccgggacaatcagacgctccgtgctttcagtcatggcatcctcatttttcactccgacaggccgaggccacccagccagtgacgcagccagccctgccgtttcgtttccgtgcgggccgcatgaagaatggtccgcacctgatcaatcgcctccggcagatgagtattcaccacgacataggggaactctcccacatgggcgatctcatcccgtgccgccgccatacgctgggcgatgatatccggtgcgtctccccgcccctccagccggctggcgaggtcgtccagcgaggggggcagcacgaaaatacccaccacatcgcccggtaaggcggagcggagctggtgatagccctgccagtccacatcgaacaggacgtcactgccctccgacagggccttctgcaccggcccgcgcggcgtgccatagctgcgcccgaacacacgcgcatattccagcagctggccctctgcggccatcgcatcgaactcttcctgtgtacggaaatagtaatgcacgccctcctgctccccggcacgcggagcgcgggtggtcacactgaccgaaagacgcaggccgggatcttccgccagcagcgcacgggtgatggagcttttgcccgctccggaaggtgccgccaccaccagacacagccccctccgccccgtttcaggcagtggacgcatcataccctctgctcccgcaaggcagcatggcaaatggtttgacggggtatagtctggctgaaatcgattcgtacggtcgggctgggcaccatctgagttcgtctcccctcgcgcgccgtataccagcgggggcaggcaatgggccagcgtgacaaacagagaatacgtcaaaaggggcagatcgccgcccatcatctggctcaggaaggggccattgccatcaccggagcctccagcgggatcggcgcggcgctggccattctctgcgcctttcccggcgcgcgcctgtatctgaacgggcgggatctacagaggctggaagaaaccgggcaacaatgccgggatcaaggggcacaggtgcgatgcttcagtgccgatgtcagggatgaggtcgccatggctggctggatcgagagcatagctgcccacggagaccggttgggaacgctgatcgccaatgcaggcatctcccccgccatgagcggaacggcaacaggcagcggcctggaaatgccggccaccacccgcgctgtgttcgaaaccaatgtcaccggcatgctgaacagcgtcctgcccgccatgaccctgatgcaggggcaggccgtcattgatgacgctctacgtggccggatcgcggtgatcgcctccatcgccgggctggcacccctgccctatgcgcccagctattccgccagcaaggccgctgcacaaagttgggccaccgccgccgcctcccgtgcgtggaaagacgggatcaggctcagcgccctctgtccgggatttatccgcacaccgatgaccgataaaaaccgcttccggatgccgtttctgatggaggccgaggacggagcgtcccggatccttgttgcgattgcacaggggaaaatacgctacgccttcccatggcagatggcggccctcgcccatctgaccgccctgctgccccccgcgctcacggcacggctgatgcctcaatagaaccccgcaggttcagcggctttttttgccgtcccgccatttgcgcacattggcctcatgctggccgagatcacgtgcaaaattgtgcccgccatttccatcagcaacgaaataaagatcgtcgctgtgcaacggatggagcacggcttccagcgccgcctgcccgggattgccaatcgggccgggcggcagaccatggatgcggtaggtgttgtacggctcgtcaaaagccagatctgcatgggacaaaggccgttccagctgaccactgccaccgctggcggcatagaccagcgtgctgtccgcctgaagccgcatcccatgtttcaaacggttgagaaaaaccgccgccacatgagggcgttcctggggacgggctgtttcccgctccacgatgctggccagaatcaccgcttgctccggactggtcaaaccgatggagcgatcccgtccttgccatgctttctcaagccagtgacggctggcctcggtcgcccgctccacaatctgctgacgtgtggccccccgttcgaaagcgtaggtctgcggcagaagactcccctccggcggtaccggcgcatcgccggtcagcacgggatcacgggacaaaatctcggccacacggaatgcggtaatgccttcaggcaacgtaatcgtatgctgcaccggccgggctgtacgcaggatatgcagcacggtcatcaccgaggcgtgagccggaaattcgaactccgccgcgtgcaaggtaccggccccctgccaccgcgtgatctcgaccgcggcacggaacaacagaggagagtcgatgatacccgcctgacgcagtgcctgcgtcacatgaaccagaccaccacgcggcacgacaacgatggtacgagcttcggaagggccatcggcataggccgtcagccagccatatccggcaatcccgcccacagcagcgagcagagccgccacaccgccccccaaccaccaccgccagtgacggcgctttgccggaggagaagacggcctggtctggtcaggtggagatggaggaccggccggggatgcatcatcccagtccgattttgaacgtgcctcaccgctcaccggttggggtgaggcttcatccatgacagggtgatcggtgtcatctccggcaccatcatgggtggaagcggcctccgtatcggcggaaggccgcaccagcccatggcggcgtgcagcctgatcgtctccgttctgcgcgcgggcaccatcgcctgcggagagcggcgtatgatcagacggcgcggaagatgatgctggcgttggttccaccgaaaccgaaactgttggagagcgccgctttcacaggacgacgctgggcctcaagggccacacgatcaatcacgctttcgcggctcggggtatgcagattgagggtcggcggcaccacgccatcccggatggcgaggatagagaacacggcctcaatcgcgcctgccgcacccagcagatgccccgtggcggatttggtggaggacatggcgacggtgcgcgccgcatccccgaagaaacgctcgaccgcctccagctccagatcatcgcccagcggggtggaggtgccatgcgcattgacatactgaatatcggcaggcgtcatcccgccattgcggaacgcggccttcatcgcccggaacgcgccatcgtggccttctgccggggcggtgatgtgatgcgcatcacccgacaggccatagccggacacttccgcatagattttcgcgccgcgctttttcgcgtgctcgtattcctcgagcaccagcacgccggagccttcccccatgacgaagccgtcacggtccttatcccatgggcgggatgcctcggtcggcgtctcattgaacccggtagaaagggcacgggaggcacagaacccggcaatgccgagttcacacaccgccgcttccgcaccacccgcaaccatcacatcggcatccccgatggcgatcagacgggcagcatcaccaatggcatgaacgccggtggcgcaagccgtgacggcggaatggttcggtcccttgaaaccatatttgatcgacagatggcccgaggcaagattgatcagcgcggcaggaatgaagaagggcgagatacgcgccgccttgccttcataaatcttgacggaggtctcgtaaattgtctgaagaccgccaatacccgaaccgatcatcacgccggtgcgttcacggccttcctgatcgtcctcaccgggcatccagccggaatcctcgaccgcctgcgtggcggcgaccagacccagatggatgaagcgatccatcttcttctgatccttgaccggaatccattcggccagatccaggctgccttcggctttgttaccgacaggcacctcccccgcgatgcgggcgggcagagccgatacatcgaaagcctggattgcgccgatgccggattccccggcgatcaggcgcttccagacgtgttcgacaccaagcccgagtgggctgacaatccccatgccggtaacgacgacacggcgtccacggctgttagcagagtcggaaatgctcatcccgctcgatcctggtgtcttgtgcgtcaaatttggaaaagagggccgggccgaagcctcaggccgccttctgcttttcgatgtattcgaccgcgtccttgacggtgctgatcttctcagccgcgtcttccggaatttccaccccgaacgcctcttcgaacgccatcaccagttcgacggtatcgaggctgtcggcacccagatcgtcgatgaacgacgcttcgggggtcaccttggactcctcgacgcccaggtgctcgacgacgatcttcttcaccttgtcggcgacttcgctcatcggatctctatctcctgcttgcagcatgcttgctgtggcctgatccggcttccctgtctggtccaccggacattatccccaaagatgtttcgccccccggcctttttcgaaccctgtccgaaaccgggcaagacgaggcctgatggacgatgacccaaaggccggaacattccggccatcaggctgacggctgcgcgatagcatggtttttcgcacaccgccaccatcctgccatagttcagatcatcgccataccgccatttacatgcagtgtggcaccggtgacccatccggcttcgtcagaggccagatagaccacggacgatgcgatatcctccggctgccccatgcggccgagaggaatagagtgcaacagcttttcacggctggtttcgggaagaacatcggtcatcgcggtttccacgaaaccgggggccacgacattcaccgtgacgccgcgtgaacccgcttcctgggccagagccttgctcatacccaccagccctgcctttgctgccgcataattcgattgtcccgcattgccggttgcaccgaccaccgaggaaatctggatgatccggccggcccggcggcgcagcatgcccttcagcgcggcccgtgccagacggaaaggcgcggtcagatcgacatccagaaccgtctgccagtcctcgtccttcatccgcagggccagcatatcgcgggtcaggcctgcgttattgaccagaatgtgaagcgggccggccgcttcctccgccgctgcaaccaacccttccgccgctgcgggatcggacagatcggccgtcacgatataagcacgctcgcccagagaatccgccaacgactcgagagcagggcggcgggtgccggacagaaccacacttgcaccctgcgcatgcagggcacgggcgatggcagctccgatcccgccagaagccccggttaccagagccactttaccatccagccggaacatcggcgtttcccctcatctctttattcgttgtccggtacggaaccggcccccgccggggattccgcccacgaccagtctgatccgtcaaaatgtcttgagcagcgcctcaatctctgccggggttccggcagacagggtcgttgcatccggtgcaattcgcctgatcagaccacccagcaccttgcccgcgccaagctcgacgaacgtatcgacgccgagttccagcatcgttgccacacattcccgccatcgcacggtacctgtcacctgccgcaccagcaggtcgcgcagttccgccgggtccgtggccttggccgccgtgacattggcgatcaccggcaccaatggcgcatgcaacggatgttccgccagagcctgcgccatcacatccgccgccggcgccatcaacgccgaatggaacggagcagagaccggcagcagcacagcccgcttcacgccccgcgcacgggccacctcgatcgcccggtcaatcgcgccgcgatggccggaaatcaccacctgcccgccgccattatcgttggcgggctggatcacctcatgccgacccgtctccggatcagtggtcgcttcttcacagatggaagccgcctgatccatatcgacaccgatcaacgccgccatgccgccttccccgggcggtaccgcattctgcatcgcctgaccgcgcaaacgcagcagcaacgccgcttcagccacggacagtgcattggcggcagacagggcggagtattcacccagagaatgcccggccaccaccgcagcccttgcaggcaggatgaagccgccttccttttccagcacgcgcaggacggccatcgacatagccatcagggcgggctgggtgttttccgtgagggtcagatcctcggcaggaccatcgaacatcagacgggacagtttctgacccagcgtatcatccacctcctcgaatacttcacgagcgatggggaacgcatcggccagatcacggcccataccgacgaactggctgccctgacctggaaacaaaaaggcgcgaacggtcattcgacgcaatcattccgaactgttggaggaacgccgcgtaactttcacacgccgataagtcaatgccgggcactccaaggctgaccggcttgccttggaatcggtgccagacagatggcaaacagactgccatgtgctgcgatcctgcctccgctgcgcggtttttccttgaaacgaaacgggtttcgtgatgttaccccgcccttccctgccggggcgacggcatcgtcccggctatgcccgcatgcatggcccggttttccggggatcccctgcatggaccataccggtcggggccgaacagccagagggggaatgaaatgccgctttacgagagcgtgctgattgcacgtaacgatgtgacccagcagcaggtcgaaagcgttgccgaccatgttgcgtccctgatcgaggccgagggcggcgcgatcaagaagcgtgaatactggggtctgcgcacactggcctatcggatcaagaagaaccggaagggccattacatgctgctgggcctggacgcgaagcccgccacgatcacggaagtcgagcgtcagctgcgcctgaacgaagacgttctgcgcttcatgactatccgtgtcgaggagatcgacgacgttccgtccgtgatcctgtcccgcaagtccgatgaccgcgaacgcggtttccgcggcccgaagccgcccggccgtttcgagtcgggtcgcaagcgtggctatgatgaccgcgaggaattccgcgcccgcgccggcggcgacgatgacgaccgcggtctggatcaggagtaagttgatatgtccgatacccaggatgtgaatcccgccacccgccgcgctgcggtcggtgcgcgtcgccccttctatcgtcgccgcaagtcctgcccgttcagcggcccgaacgcgccgaagatcgattacaaggacgtgcgcctgctgagccgcttcctgtccgagcgcggcaagatcgtaccgagccgcatcaccgccgtttcggccaagaagcagcgtgaactggcgcaggctatcaagcgcgcccgtttcctcgcccttctgccctatatcctgacctgaggagggacccatggctgctgttgaactgatcctgctgcagcgggtcgaaaagctgggccagatgggtgatctggtccgcgtgaaacccggctatgcccgtaacttcctgctgcctggcggccgcgccatccgcgcgaccaaggcgaatacggagcgcttcgaacagcagcgcgcccagctggaagcccagaacctgaagcgccgcgaagaagccgagcgcatcgccgaacgcgtaagcggcctgtcggtcgtcatcatccgtcaggcgggcgaatccggcggcctgtacggctccgtcagcagccgcgatatcgcggttgcaatcacggaatccggcctgagcgtgaaccgtcagcagatccagcttgatcagccgatcaagatgctgggcctgaccgatgtgcgcgtcgtgctgcatccggaagtcgtgctgccggtgacggtcaatgtcgcccgcagcgtcgaggaagccgaacgtcaggcccgtggcgaggctgtcggccttgccgccgaggaagccgctgctgctgcggaagccgccctgattgaggttgcggacgaagaagaggtcgagatctccgcctgagcggtgatcccgagactatgaagcaaggcgcggcaccggtttcggtccgcgccttttttctgtttcgtttcaaagagataaccagccctatccaagttatccccgttattagcattcttccacagcgacgggcgcgccagcctgtcttatgatcgccggcgatgaatactctggtgaccacatccccgtccgaacccgcgctgctcggcctgtcgcaacgcctgccgccctccaaccatcaggcggaacaggcgctgctgggtgccttgctgaccaacaacaaagcctatgaacgggtcagcgaatttctggcccccgagcattttgccgacccgattcatggccgtctgtatcactctatcgcccggcggatcgaaaccggacagttggcggatgccatcacgctgaaggcggaatacgagcattccggcctgctggatccggtcggcggcagcgcctatctgggcaagctgatgagtgccatggtcggcatcatcaatgccggtgaatacggccgcgccatccatgatgcctggctgcgccgccagctgatcgaccttggcgagcacgtggtgaaccgtgctttcggggcggctgatgatgccgcacaggctctgtctgcacgtgaacagctggaaaccgccgagcagaccctgttcgatctggccgagcgtggcggcagtgaaggcggattcgtcagctttgaagtggcgctgaccgccgccattgccggggccgaacggtccttcagaacaccgggcggtgtgtccggcctgtctaccggcctgcgcgatctggacaagcgcagcggtggtctgcacccctccgacctgctgatcctcgctgggcgtcccggtatgggcaaaaccgcgctggcaaccaaaatcgccttcggcgcagcccgctccctgttgatcgaagcgcgggagaaagaccccaatgcggtgccatccggcacagtggctgttttctcccttgaaatgagcgcggagcagcttgccacccgtctcctctccgaagaggcccgcatctccggcgatcgcatcaggcgtggcgatatcgggcagcgcgatttcgaccgcttcgtggaagtcagccgggaactggcggtcatgccgctctatattgacgataccccggccatcacgctctccgccctgcgcacacgctgccgccggttgaaacggaccaaggggctggcgctgatcgtggtcgactatcttcagctgatgcgccccgccgccggcacacgcccggaaagccgcgtgctggaaatcagccagatcacgcaggggctgaaggccatcgccaaggaactggccgtgccggtcatcgccctgtcccagctctctcgtgcggttgaaagccgggaggacaagcggccccagctttccgatctgcgcgaatcgggatcgatcgagcaggacgccgactgcgtgatgttcgtgtatcgcgacgaatattacctgcaacagcgcatgccgaaggagatcgccttcgagaatgacgagaaattccactcggccatggagaaatggacacaggatatggagtccgcgcacaataaggccgaactctacatcgcgaagcagcgtcatgggccgaccggaaaaatcgatctgttcttcgaggctgagttcacccgcttcggcgatctcgatgtcgtccatggcgaggacatctgacgatatcgggccatatgaaatgcccctgacagaagcggaggcatcccgcggtccggttgatattttgccttcccttcagggcgaagcgcaccagaacgggccgggtgtggcacggctggagatcgatctggaggccattgccgccaactggcgctttctgcgtacgacccatggtacgaatcgcatcaccggggccgtggtcaaggcggacgggtacgggctgggggccgccgtcattgctcaacgtctggtgcaggagggatgcgatcacattttcgtggcccatccgcaggaagccctgacgcttcgtccgctgattccatccgccacgttgatcgtgctgaatggcctgtggcccgggtgggaagctgcttatacggatcatgggctaatcccggcgctcggctccctcgctgaaatcgaggcatggcggcaggaggcaacccgccgcgaacaggccctgcccgcttttctgcatgtggataccggcatcaaccggctggggctggacccgcaggaacgtgaccggctggccgaacggcccgagctgctggacggcattacgctacgggccatcatgacccatctgatcagcgctgaaattcccgaccatgacagcaatacacttcagcgccagcgttttgctgccgcgtgcagccgcctgccgcctgctccgcgcagcatcgccaattcctccggtatttttctggggccggattttgccagcgacatcgcccggcccggggctgcgctgtatggcatcaatccggttccaggccgcccgaacccgatgcgccccgtgttgcggctctctgcaagagtgcttcagatcagaccggtcgaagctggggagatcgtaggttataatggtatctgggtcgcccagcgtccctcccggatcgcggtgtgttcagtcggatatgcggatggtttccagcgtgccctgagcagccgggcagaggccgcttttgacggggcacgcattccactggtaggccgtgtctccatggacctgacgacctacgacgtcactgacgatccccgtatcacggtaggctcctggctggagcttatcgggccagaggtatcccccgatgaagtcgccgcacgcgccagcacgaacgggtatgaggtgctgacctccctcgggcggcgctatgagcgtgtttatcggcctttgaccccatgatcctcagtccgcttgcatggctgggcaggggctttttctcggcctgtgccagcacgggccggatgggcgtattcggtctcaccgctctatcgcatctgctgcggccgcctttttacgggcgtatgtttctgcgggcattggtggaaatcggctatttcagcctgccggtggtggcactgaccgccattttcaccgggatggtgctggcgctgcaatcctataccggctttgcccgtttttcggccgagagcgccattgcgtctctggtctcgctctccgtcacccgggaactgggaccggtactggccgggctgatggtcgccgggcgcgtcggcgcggccatggcggcggagctgggcacaatgcgcgtgaccgaccagatcgacgcgctgaccaccttgtccactcatccgatgaaatatctggtcgcgcccaggctgctggcaggcaccatcgccctgccgttgctggtcatcattgccgatattctgggcgtgatgggcggatggctggtggcctcaatcaagctgggtttcaattcgcacacctatctggccaataccatcgcctccatccacatggatgatgtcatgtccggcctgacgaaagcggccgtattcggattcctgattgcccttcagggctgctatcatggctataacagccgggggggcgcgcagggggttggctcggccacgacatccgccgtggtgaccgcttccgttctgatcctggcattcgattacgtcctgaccgaactgtttttctcacgatgagcgcaccttccatccgcatcaccgggctgcgcaagacgttcggcgagcgccggattctcgatggcgtcgatctggatgttccagccggcacctctctggtcgtaatcggcggctccggctccggcaaatcggtgctgctgaaatgcattctcggcctgatcgagccggatgagggaaaaatcgagttcgacggacgcgacattctcaccatgcctgccgatgaacgggccgcgcagcggcaacggatcgggatgctgttccagaacggcgcattgttcgacagcctgccggtctgggaaaacgtgaccttcggtttgttggcccgcaaccgtctctcccgctcagaggcgaaggagatcgcaacccgatacctggccaaagtaggactcagcgcagagatcgggcgcatgtctccggccgagttgtccggcggcatgcagaaacgggttgctctggcccgtgccatcgccatgcagccggatatcctgtttttcgatgagccgacgaccggtcttgatcccatcatgggcgcagtgatcgacgggctgatcgtcgaatgcgtcaccgccggcccgtcaggtggcagcacggccattgccatcacccacgatatggccagcgcgaaacggatcggccacgaagccgccatgctgtttcagggccgcatcgtctggaccggcaaagccgacaggttgatggacagcgacaacccctatgtcgaccagttcacccatggccggcgcgaaggcccgatccagatgcagctgcgtcattaggaaataatacagtcagaagttgaaaaacatgccttatttttcctgtaaaaaatatttattttgttctgtttcatttcttctgatttttaaaaaatagttttccagtatctattttatttcgatactcagatgatatgaatgatgagagatcatcatttccttgccccccccacttcaacgacccatcatcttgatgaagaggagatcactggaccaatgcgcattgccatgatcggaggcggatatgtcgggctggtctccgctgcctgttttgccgagttcggggttgaggtcgcggtcgtggaatccgatccggccaagctggcggctttgcatgagggtcggatgccgatctacgaaccgggactggacaagctggttgccgacaatgtcgccgcaggccgcctgtctttcggcaatgatctgatggctgccgtcaaggatgtggaggcggtgttcatcgctgttggtacgccgacccgccgcggcgatgggcatgctgatctgacctatgttttcgctgctgccgaacaggttgcaaaagccctgaccacccattgtgtcctggtgaccaaatcgaccgttccggttggcactggccgcaggctggaagcgctggtgcgggaaatgcgtcccgatctggagatcgacattgcgtccaaccccgaattcctgcgcgaggggaacgcgatcggcgacttcatgcgcccggaccgcgtggtggttggcagttccaccccccgcgccagagaagtgctgaaccgtctttaccgcccgctgaacctgatcgagaccccgatcctgcataccgggctggaaacggcagaactcaccaaatacgctgccaatgcttttctggcgatgaaagtcaccttcatcaatgagattgccaatctctgtgaggcgaccggtgcggatgtgcatgatgttgcgaaaggcatggggctggacgggcggatcggcagcaaatttctgcatcccggtccgggctttggcggatcctgcttcccgaaggatacgctggctctggtacggatcgcccatgatgcgggcgcaccgacaaggctgatcgagacggtggtcgatatcaacaatacccgcaaggaacagatggccgagcgcattatcaccgcctgcggaggcagcgtgaacggcaaacgaatcggcgtactgggcctgacattcaaacccgaaaccgacgatatgcgagacagtccctccatcccgatcctgagcctgctgcatcaggcgggcgcttcgatcatcgcctatgatccggaaggaatagagcaggcccggcccctgctgccggatgccattacttatgtgggcagtgccattgaggcgctctccggtgcagatgctctggtgatcatcaccgaatggaacgaattccgtgccctctctccggaaaagctgcttgcggagatgaatggacgagtggttgttgatctgcgtaatgtcttcgaccctgccgcgatgcgagaggccggcttctcctattcctccatcgggcgcccagagaaaaggcatcaagacgcgtgaccactgcggcggctgtagatgaggcatggaaatatcccgatattcccaaccctgacattctggaccggattccgttatcagcccgcatcgtgcttgatgtgggatgcggcactggggcgctgggggctgcctacaaacagctcaatccagctgcccgtgtcttcggaatagagaccaaccaacaggccgcccgcctcgcctcatcccggctggagacggtcatcaacagcgatgtggaaaccgccgtttttcctgaggagctgctcgggcgcgttgactgcctgatctatggcgatgtgctggagcatcttcaggatccctggacgctcctgaaaaatcatgtggagacattgctggctccagggggtgtcgtcatcatctgcatgcccaatgtcgaacattggagcatcaccacacgccttctgaccgggacgttcgactacagcgataccggcctgctggaccgcacgcatctgcgctttttctcacaggccatgatggagcactgcatccgtgccgcagggttgcaacccattgattgcctgccgcgtattttcgaggccgagcaggggcgacagatcatcaatgccctgaaaccagtgctgcagacgatgcaggtcgatccggacgcctatgcgcagcgcgccctgccgatgcaatatgtctggcgtgcccgtgccggggggcctggcactgttcaggtctattccaccatcctggcaccggtcggcggtgtcagcgacgtccgggtgatcgaaccgatgcgtgctctggctgccgagccgggcatccgggcggcgatcgtcaagggtggcgaactgcctccccccgatccgtctttgccgaaaatctggattttccatcgccctgctctcgccggagaggaagggctgtccgtgctgcggggaatcctgcgacagggatttctgatcgttacggaattcgacgatcatccggattacattcctgttcttcagcgcccggatatgtggaatttccgtggtgtgcacgcggtccagaccaccaccatggggctggccgatgtattccggaaagacaatccggaagtcgccatattccccaatggcatccgcgccctgccggtaccgcacaatcatgcgaaacgcccgcagatgagaatgctgttcgcggggatcaatcgtgaaaacgactggcccccttacattgacgccctcaacacggcggcacgtctctgcggagagcggctgcatttcgaggtcgtacgggaccggggatttttcgacgcactggatacgccgcacaaatccttctccgacacgctggagtatgcggcctatcatcagaaactgtcggactgcgagctgtccttcatgcctttgcaggacacgccctttaaccgtgccaaaagcgacctgaaattcattgaggccgcctctcatcgcgtctgcgctctggccagcccggttgcgtatgagaacagcattcaggacggcaagaccggcatcctgttccgcacgggagccgagcttcaggaaaagcttgtggccctggtcaataatcctgatgcggttctgcagatcgccactgcggcgcgcagctatgtcgctgccgaacggatgctggcctatcagatggctgcgcgcaccgcatggtatcgcagcctgtgggcacgcaaggatgcgctcaacgccgccctgctggagcgtatgcccgccttaagggaaggataacgccttccccggcaccgcttcatcctccgctatgggaggaaaagtggtttgcagcgcctgccggtgcccgtcgcctgccatgcggtgcaggaagcgggaagtccgacgcagcgagtcccggctttccggcagaaaggtcgcgaaaatctggaacgcatgcggcactttgggccagatgcgcagatcaacgctgccaccgctgctccgtacacgctccgcaagtctgcaagcatcgtccagcagaacttcgtccgccccgacctcgatcagcaacgggggaagcccgtcaagcgcaccataaagcggcgaggccagcggatggtaagggtcggccccctgaagatacagtgtcgccgcgcgggatacatttccatccagcatcacatcccgatgagcgttatagtgcagggacgctccggttgccgccagatcggtccagggagaaaacagcgcggccgccaccggcaatggcagtccagcctgtttcgccgccagcatcagggacagcgccagaccaccgccggccgaatctccggcaatgaccagacgggcgggcgaaatgccagagtccagcaatgcccgatacactgacagcgcatcctggaccgcagcggggaacggattttccggggccagacgataggccggtgcatagacctcaaatccggcccgcgcgaaaaacgaggtgatcgggcgatgtgtcgccggggaacagcccagataggcgcccccgtgcagatacagcaggacggtcggcacaacatgctccgtccctttggaagcccccactttggaagccccccctttggcggaatgagtgcgcagatgctcggtccccacgccgcccatgtctttcatactgatccgtatgtcacccggcaggcggcgaatggtcagtgcgaagtcacggcgcagttcccgcacatcctgtacacgggataagcggcgcttaaccttccagcgcaggatcggcagcagggcacggagacgaagactggacacgcgctgtttgtctctctcgcctgtttcggaacaaagacgcttccgctatccaatccgagcctgaaaagccagctttatgaaagacccgcatgagcagtctccgtcatagcagtgatgatacaagctcatcccgccctgtctggtggcccctgatgggactggcggcaatcatgaccgtactggccattgcctttctcgatcggggctggtcgagctgggcccacgccaccctgccatcgtggaaacccgttttcatctggatgacgcgcccggccgaaatagcggccccactcggcgcactctacctgtttttagcggccctggcggcagcatccggacgctggcagcccggcaggatgggatgggcgctgattgcagcctctctggccgcgctggtggccgtgcccgtgaaggatgaactcaaatacctgttcggccgtccatggccggaaacatggatcgacaacaacccatcctggattggcaacggtctcttcggcttttttccgctgcatggcggacggggctgggcctccttcccctccggccatacgacgatgattaccgcccccatggctgcactgcgcgacaggttgccggaattgcgctggctgtggttgctgccgatcgcctgtgtcgccatcgggttgctcggggctgatttccacttcatcagcgatgtgacagcaggtctccttaccggcatcacctgcggagtgggcctgtccgccgtcatacgcccttctgaacggccctgagaaagatcaggatcggcagttttgcttgcagcggggcgtggggccgcccatcttcccgtcatgtcccagatcgccgcccatcccatgctgttcatgccgcaaaagcagcccgcgaaacccctcacgaaggcactggaagtcgtctctgactacaagcccgatggtgatcagccaagcgcgatcagggagctggtcagcggactgcggcaaggggaacgcaatcaggtgctgctcggcgtcaccggctccggcaaaaccttcaccatggccaaggtgattgaggaaatgcagcgcccggccctgattctcgcgccaaacaagactctggcagcccagctctacggggagatgaagtcgttctttcccaataacgcagtcgaatatttcgtcagctattacgactactatcagccggaagcctatgttccgcgcaccgacacctatattgaaaaagacgcccagatcaacgagcagatcgaccggatgcgtcacgccgccacacaggccctgctggagcggaacgatgtcatcatcgttgcctccgtctcctgcatttacggtatcggctcggtcgagacttacgcgaagatggtggtgcggttgcaggtgggcggccagatcgaccgggatgcgctggcccgggcgctggtcgatctgcaatatcgacgcaacgatgccgccttccagcgcggcacgttcagaatgcgcggagagacggtcgacatcttccccgccagtcatgaggaccgggcctggcgcatcagcctgttcggtgacgagatcgacgccatcagcgaattcgatcccctgaccggcaatgtgaccgcaaaactggaagaggctgtcgtctacgccaacagccactatgtcacacctcgccccacgctcagtcaggcgatcaaggaaatcaagcaggagctgcaacagcggctggccgaattcgacgccgaaggcaaggtgctggaggccgagcgcctgcgtcagcgcgtgaccttcgatatcgagatgatggagaccaccggctcctgcaagggaatcgagaattactcccgctatctttccggtcgcgcaccgggagacccgccaccgaccctgtttgaatatctgccggacaacgccattctgatcgtcgatgaaagccatgtgaccgtaccgcagatcggcggtatggagcggggcgaccatgcccggaaatccattctgtcggagttcggtttccgcctgccctcctgcatcgacaacagaccactgaaattcgatgaatgggagcgcttccggccggaaaccgtgttcgtcagcgcaacccccggcccgtgggagatggaacagaccggcggtgtgttcgccgaacaggtgatccgcccgaccgggctgatcgatccaatcacggagatccgcccggtggaacatcaggtggatgatctgctggcggaaatacgtctcgtcacggccaaaggaaatcgcgtgctggtcaccaccctgaccaagcgcatggcggaagatctgactgaatacctcaccgagcacggggtgaaagttcgctacctccactccgacgtggacacgctggaacggatcgagatcatccgcgatctgcgcgtcggcgtcttcgatgtgctgatcggcatcaacctgctgcgggaggggctggatattccggaatgctcactggtcgccattctggatgcggataaggaagggtttctgcgcagccagacctcgctgatccagaccattggccgcgccgcgcggaatgtggaggggcgcgtgatcctgtatgccgataccatgacgcgctccctgaccttcgcggtggaggaaaccgcccgccgtcgggagcggcagaaagcgtggaacgaagcgcacggcatcacgccgaccacggtacgcaagcagatcggcaaaatgctggaaagcgtgttcgaacaggattacgtcacggtcgcgccgacctccgccacctcggccgccgagttcgtgggcaaggatctccgcgcctccattaccgagctggaacgccggatgcgcgctgctgccgccgatctggagttcgaggaagccggacgcctgcgcgacgaaatacgccgtctggaagcactggaaatgggcctgccccccgtaccggcccctgcttcctccatgcgggctggtgcgcagaaagatggcggacgcgcccgcaaggaccgcacgccgcaaccgcttggccccggcggcggcggttatgatccctccaaggtcagaggtcggcggcgacgtgggtaattccgaccgtcacgctggcatactgacataaaaccatggcaggcaccacctgccggattatggcatccttgcactcactgtgcgtcaccctgctccacccggcctcacaggatcttctcatcgtggaaccatcgccccatgctgcattccctgcccctgtctgaagccatgccgcgcaccgcgctcgtcaccggtgccgggcgcaggatcgggcgcgccattgctctggcgctgggagaggccgggttttcagtcgccgtgcactacggaaccagtcgcaccgaggccgaggaggtcgtcaccacccttcaccggagcggacggaatgccgttcccctgcaagccgatctcgggcgtgagcacgatgcccggcggctgatgcaggacgcgactgatgcgctggggccgatcggcgtgctgatcaacaacgccgccattttcgaattcgatgcctggcatgacgcgacccgcgacagttgggaccgacatatggaaaccaatctccgcgcgccgctggtactggcacagtcctttgcccatctgctgcccacaacggcacagggggctgtgatcaatatgatcgaccagcgcgtatgggcaccgggaccgggttttatttcctatacagtcgcgaagagcggtctgtggaccctgacccgcacgctggctctggctctggctccccgcatccgcgtgaatgccattggccccggtccggcagcccccagcaaacggcagaccccggaccagttcgcggagcaatgccgcagtgtcccgcttggtcatggcaccaacccggacgaaatagcccgtgccgtgctgtttttgctctccctgccctctgtgaccggtcagatgttggcactggatggcgggcagcatctgcaaggggccggcagtacgactctggttgaataagacctttttggctcccgcggcctgaaaaccggtcaagccataaaattacttaaatcactgattcttgtgcttgacactctcttcccgaagcgggttgcggccggacttgtccacctgcggcgcaagagaatcatatttttcagtatgatgacggcaccaccatcctccacaaataataaagctatataattcaataacttatgctgttgcttcgaatctgtgcaatcggcgtgtaacccttgtgtactgcgggtttggcgcaaatgtgcgcagcttcttccacaatgttatccacagctttggtggatgaattttatcctgtctcttatccacttcctgccccgagatccgggcggccaacccttgaggaagtgcgaggcaacccctaatccatgactatgcctgatgctcccgccaacccgccgaaagaagctgacaatccttccctgccaattgtcgaggcacccccgggcaaaggggtgactgtcattgaggcaatgctgaaactgttgccggacaggccgggcgtataccggatgctcgatggacaaggcgaagccctgtatgtcggcaaggcgcgcagtctgaaaaaacgcgtggccagttacacccagatccaccgtcttcccgagcggctgcgtcgcatggtcagcgagacggtttccatggagatcgtcaccacccataccgaagccgaagccctgctgctggaagccaatctgatcaagcggctcaagccacgcttcaacatcgtgctacgggacgacaaatcctatccatggctgatgctgaccgaagatcatgctttcccgcagattatgaaacatcgcggcgcacagacccgcaaagccgccagctactggggaccgtttgcctcggcctgggcagtcaaccagacagtgaccgccatgcagcgtattttcctgctgcgctcctgctcggacagcgtgttcgccaaccgctcccgcccctgcctgctgttccagatccgccgctgctctgccccctgcgtggaccgtatcagtcaggaggattatgccgagttggtcgatcaggcgcgggccttcctgtccggacgcggcacggagattcaacgcgatcttgcccgccagatggaacaggccgccgaagccctggaatttgagcgcgccgccgccatccgtgaccgtattcgtggcctgacccatgtgcagggcaccgccgtggtcaatccggcctccatcggcaatgcggatgtcatcgccgtctggcaggatgcgggacaaagctgtgtgcaggttttcttcatccgtggcggccataataacggcaaccgtgccttctatcccgcccataccagtgccgagacagcacaggatgtattgggagcctttatcgcccagttctatgacgacaagcccccgccccctttactgttgctcaatcataccatcgccgagcaagaactggtctcggaagcgctcagcctgaaagcagggcgccgggtcgagctgcatgtgccggtacgcggagaaaagcgcgccgtggttgcccatgcggagaccaatgctcgggaggcgctggaacgcaaactggccgaaagtgcaggccagaaccgtctgctggacggcgtggcagagctgttcgacctgcccacccgcccgaaccggatcgagatttacgacaacagccatatcatggggaccaacccgtacggcgtcatggtggtggcagggccggagggctggaataaatccgcctatcgcaaattttccatccgtggcccgatcacgcccggcgacgatttcgccatgatgcgcgaaatgctggagcgtcgtttcagccgtggtctgaaggaacgtgccgaaggaccggagggggaagccaactggccagatctggtgctgatcgatggcggggccggccagttatcggccgtccgcggaatcctggacgagatcggtgtcacggatgtcaaactggtcgctattgccaaaggccctgatcgcgatgccggccgcgaatggtttcatacggagggccaggccccgttccagctgccaccccgtgatccggtgctttactacctccagcgtctgcgtgacgaagcgcatcgcttcgctatcactacccatcgggccgggcggtcaaaaacactggtccgcagtgaactggacgatattgacggcatcggagcagcccgcaaacgcgccctgcttaatcatttcggctcggcacgcggtgtcaaacaggccgggctcgcggcgctggaagccacgccgggcatctcgaaggaaaccgcgcggcgcatctacgcccatttccatccaggcgcgcgggcagactgagcccgcgcccccagcgtctttcagtcctcggttttcaccagcatcgggccaagcggacgcccggcaaacagatgcacatggaaatgcggcacttcctgcccggcatcctgaccactattggccagcagcctgtatcccggcacttccagccccatgtcacgcgccagcttgccaaccgtcaggaaaaacgtcccgacttcctccgcggaggcacgctccgtaaaatccgcaaaagaaatatacggttttttgggaatgatcagcacatgggtaggagcctgcggattgatgtccagaaaggccagcgcatgatcattctccatcaccttgcggcatgggatctcgccgcgcaggataagggcgaagatattgtcggggtcgtaatccccgatggcgctgaccggcattgtcttggccttttctgttttcaaatctctgtctgatgacgagatcgatatgatcagggaattttggtcgtcttcaaccctgcggcgcgcggcaatattttggcacgggatgctttttcagcaataccgctgatgccttcgcgcttggtcagttcccgccatacctcggcaggctcgaccccgaccgcaacccacaggaccagaaggtgatacagcacatcggcgctttcaccgatcagagcttccttgtcgccgctcaccgcctcaatcagacattcgacggcttcctcgccgaatttctgtgcaaccttgccgataccgcgggacagcagacgtgcggaatggctgaccgcaggatcagcgtcccggcgctgcatgaccacttcccaaagccggttcagtacctgcaccgcattatcaggatcaatatcagccagaggcgaaagtcttctggatttgatctttacggcggcaggagcggacgttttcttatttatcttcgtgactgtttttttcttaacggctttgaccatcataatccctcaggcagcctgcatggcaggccgggtgaaacgaacgggttgtcccgctgcatgcaacgcatttttgacctgctcgattgtgaacgtgccaaaatgaaaaacggatgcagcgagcaaccctgttgcccccgcttctgcaccctcgacaaaatgctgcaatgtgccgataccacccgaagcgaccaccggcaccgacacagccgcacagacccgacgtaacaattcggtgtcgaatccctgccccgttccatcccgatccatactcgtcagcaggatctcgccggcacccagagacgctacctgacggcaccattctatggcatcaagcccggtccctgtacggccaccatgggtaaacacttcccagcccgatgacgttttcttgacgtcaacggccaccacgatggcctggctgccgaatttttcagccccttccctgatcaactcaggacgcgccacagcggctgaattcatgctgcatttatcagcccccgccagcaacaggcgccgcatatcacccacggtgcggacgccacccccaaccgtcagcggcagaaagacccgctcggccgtgcgggcaaccacatcgagaatggtatcacgattatcggagctggccgtaatatccagaaaggtcaactcatccgcaccggccgcatcatacagggctgcctgctcgacgggatcacccgcatcgcgcagggatacgaaattcacgcctttgacgacacgcccgtccttgacgtccagacagggaatcacacgaagcttcaacacggcgcaatccgttcaccggcgaccggcacaatttaaggatcaggactggtctgcgccagccaccaaaagtggcggggttttgcagctaaaagccggggaaatgcaagaacttcgtgcggcgttttcacgcaatggtttgttaacgcaaggaaacggcctgcaaggccgctgccgggtctacccgaccatcgtataaagcacgcccaagtataacgcctgtaattgttccggcgtcgtagacatcaacaatatgcgacagatcaccgaccccaccactggcaatcaccgggatcgtcgtggcacgcgccaaagcaagcgtctgttcgacattcgggcccgtcagcatgccatcgcggccaatatcggtatagatgatcgcggccacaccctcatcctcaaaccgggcagccagttcaacggctgccaccgaggatgtctcagcccagccttcagtggcgacaaacccgtcacgcgcatcaatgccgaccgcgatccgccccgggaaggcacggcaagcatccttgaccagctgtggcgttttgacggcagcactgcccagaatgacacgggaaatacccgcctctatccaccgctccacggccgccatgtcacgaataccgccacccagctgaacagggacggaaacagcgccgagaatagcggtaatcgcctcggcattttccgagcggccggcaaaggcgccgttcagatcgaccacatgcagccacgcaaaccctgcatcctgccattgccgggcacgaacggcgggatcgttgccatagatggttgcgtcctccatctcaccacggcgaaggcggacgcactggccatctttcaggtcaatggcagggtaaagtgtgaaacgcatgttctttcggtccgtgtcacgccgtcatgatgcggctgtcagcctgcaacagcttgtaatagtaatatccgcgcagggtctgcccccgcgcacgggcataaaccgggtgggtgccccagcaaatatagcccatggattcgtaaagctttttcgccgcttcctgatcttcccgcagatcgagattcagcacctgaaatccaagcgcccgcgcgcaatcctcgacccgttccgtcaacaggcgggccagcccgaaaccacgggcgaagggagccacgaaactatgcgccagcatcgcgccgaacgctctggcttcctcgttcttcgctggacggatgaactgtgcggccccaaccaccgcaccattctgacgggcaatgaacaattcccgctccggcaccaacagaacgccacgaaaatatcgctccagagcctgatgccccggcggtgtgatccagccggagccgccaccgtccagaatggcggcatgcgcggcttcacacaggctggctatatcgtcatcgctcagcgcctcgacgcgctcgacatcctgtgcaggctgctctccatgacgatcatccggcggttgagagcctgtcatgaaccgcttgttccttcaggagtccagaccatgaaattctgcaggatacgcaaaccgacttcctgacttttttccacatgaaactgggttccggcccggttgccggaggcaaccatcgccaccaccggaccgccatactccgtggtggcgaggatctgtgcctgatctccatcacgcaatgcatatccatgcacgaaataggcatgatcatccgcctgcaatccattcagcagcggatgcacacagccggtagacgtaaaatccaatccgttccagcccatctgcggcagacgcagaccggggcagcttatcggcgcgatctcgcccttgatccagccaaagccgggcgcgccttcgtgctccagaccgcgttcggccatcaactgcatgccgacacagatgcccagaaaaggcttgcccgctgcaacgccctcctcgatcgcgccgcgcataccctcgattgcggcaatgccgcgcgcgcaatcggcgaaagcaccctgtcccggcagtacgatccgatcggcattacggacatccagcggatcggcggaggcaatgacctttgcatccaacccggcgcgaccggccgcgatctccagcccgcgacgggcagaggccagattgccggtaccggaatcgatcaccaccactttcatatcgtctgctcccgcagggccggatgagcggcctgctgtttttcttccatccgatgcatccgggccagcgccatactgagcgccgtatcaacatcggcggctaccaggacacctgccagcctgtatcctgacagcgtcaacgaccagcgccgcagatcctgagcaaacagtccctgcgccaccatcagcccaacaaagaccggtccccaccaaagcgaaggcagaaaagcgatcagcaacatccagccggccagcaggatcattgccggcagcaccgcctgccgcatccccagccagagcggcccgagcaagcttgccggaatgctgaactgctccggaatcacccgcggcaaggcgttgccctttgtcgccgcatcaggaaaatgaacggtccagatcgtcatggcagcacaggctctacagggcgcccttggtggaaggaatggcatccccgacacggggatcgcgctccaccgccatgcgcagtgcccgggccaccgccttgaaacacgcctccgccacgtgatgcgtgttggtgccggccttgagcgtcacatgcagcgtcatcagcgcattgcccccaaaagcgcggaaaaattcctcgaacagctcggtatccatggtgccgaccttggattgcagaaacggtaccgaccaggccacatgcgcccgaccggacaggtcgatcgcggcttcggccagtgcctcatccatcggtacgatggcatggccgaagcggcgaatgccttttttatcgcccagcgcctggcgcagcgcctgacccagcacgatcccgacatcctcggtggtgtggtgatcatcaatatgcaggtcgctggtggcgcggatcgtcagatccagcagcgcgtggcgtgccagcgcggtcagcatatgatccagaaacccgataccggtggcgatatcggtctgtccggttccatccaggtcgatgctcaaccggatggaggtttccgaggtcgtacggtcgatggtggcttggcgcgtcatggcggagtgctagcgcctcctgttccgaaacaccagctttgagacatcaatccgttgatccggccttgccgccatgcgctcgaagcgccatgtgaggcgatcatgagcatctccctctatcctgccgcatcatcccatgatcctgtgggctggcacggcaccaccattctctgcgtccgtcgcggagacactgttacgatggccggggacggacaggtcagcctcggtcaaaccgtcgtgaagggcaatgcccgcaaggtccgacgtatcggcgcgggcggtcaggttctggccggcttcgccggagcgaccgccgatgccttcaccctgctggagcgactggaagccaaactggaacgctttcccaaccagctggaacgcgcctgtgtggagctggcaaaagactggcgcaccgaccgctatctgcgccggctggaagcgatgatggctgtggccgatcagaaccgcagcttcaccctgaccggcaatggcgacgtgctggagccggaggacggtatcatcgccatcggctccggcgggaattacgcgctgtcggcggcccgcgccctgatgacggtggaggggctggaagccgaggaaatcgcccgccgcgccatgcgcatcgccgccgatatctgtgtctacaccaatggaaacgtcatcgtcgaaaccctccgtggcgaggcggaataacgcatcatggacatccctacctattcaccccgcgaaatcgtctccgaactggatcgcttcatcgtcggtcagaccgatgccaaacgggccgtggccattgccctgcgtaatcgctggcgcaggcagcaactgccggaagcgatgcgggaagaagtcgtccccaagaatattctgatgatcggccccaccggctgcggcaagaccgaaatcgcccgccgtctggccaaactggcgcaagccccgttcctgaaggtcgaggccaccaaatttaccgaagtcggttacgtgggccgcgacgtcgaaagcatcgtgcgcgatctggtcgaggcctcactgaccatgctgcgcgataccagccgccggaatgtgcaggcgcaggcggaactggccgccgaagaacggctgctcaccgcgctggtcggtgaaggggctgccgccgatacgcgttcccatttccggcgcatgctgcgcaatggggagctggaagaaaaagaaatcgagatttccattgccgccgctccttccgcaccgccatcggtcgatatccccggcgtcccgcccggtcaggcgatcaatctgaccgagatgatgaagggcatgttcggcaatcgccagcagcagaagaaactcaccgttgccgcggcacgggagctgcttcagcgcgaggaagccgatcggctgctggataatgacaagctcgggcgcgatgcggtggagcatgccgaaaacaacggcatcgtcttcatcgatgagatcgacaaggtttgcgcccgcagcactgaaggcggcatgcgcggcggcgatatctcccgcgagggcgtgcagcgcgatctgttgccgatcatcgaaggcaccaccgtgaacaccaaatatggtccggtgaaaaccgaccatatcctgttcatcgcctccggcgcgtttcatctggccaagccgtcagacctgctgccggaacttcagggccgcctgccgatccgggtggaactgcaacccctgtcacgtgccgatatgcgccggattctggtggaacccgagcactccctgctgaaacagtatcaggctctgctggggaccgagcaggtcgatctggacatcaccgacgatgcgatcgacgcgctggccgatctggcggcggagatcaatgaccgggtcgagaatatcggtgcccggcgcctgcatacggtgttggagaaactgctggaagatatcagctttaccgccgccgatcgtgcgggggaactggtcaccgtcgatgcggctctggtcagggaccgcgtggctccgctggcgggcaaggccgatctcagccgctttattctgtgaccggcctttgatttcgttgcgacctgcctgcttgacggcgcggcgggcaggccgcacatcgcagccatgacagacgatccgttctaccatccgcaggaagacagcgcagaggccgccatcgaggccatcgcggacgagttgtccgtgttcgatgaggattgggatcggtaccagttcatcatcgatatgggcaaaaccctgccgccatttcccgccgactggatgaatgacgcacacaaggtgccgggatgccaaagtcaggtctggatggaagcgcgcgtcgagaacgttgcgctgtatctggccggcaaatccgatgccctgatcgtcggcgggctgattgcactgctgctgcgggtctattccggccgaacacctgcggaaattcttgccaccgatccggtctggcttaaaactctcggcctgaccggatcgctctccatcaaccggggtagcgggctggaagcgatggcgcggaaaattcatgaactggcggcatcggtgcggacacagtccggcacctgatccggtatcaaaggtgcggcggatgagcctgcaaaaccttgccgcaacccatgatgtttttctgatcgaccagttcggcacggtccatgacggcacacatccctatccgggagcactcgatgctctgtaccaactgcgcgccatgggcaaacaggtggccctgctgtccaactccggtcgccgcgccggaccgaacgcggaacggctggccaaaatcggggtaccggacgatgcctatgatctgaacatctcctccggcgaggtcgcgtaccatatgctggccgcggggattctgcccgaagccaccggtgcgtcacgctgcctgctgatctcccgcgatcatgactgctccatgctggaaggcaacgggctgaccatgaccaacgacccgcaggaatgcgatctggtcatcatcggcggcagcgagggggagaaagtaccgctggccgattatcgcaccctgcttgcccccgccgccgcgcggcgcgtgcccgctttatgcgtcaatcccgatctggtcatgctgacgccgcgcggacaggctttcggagccgggcgcatcgcggagctgtatattgagctgggggggctggtccgatggatcggcaaaccttttccgtcaatctatgattatacactgcgtctgctcggcgatccgccacgggaacgggtggtcgccatcggtgacagtgtcagacacgatatcaagggtgcccgtgccgccggatgccatgccgtattggtgttgaccggtatcgccggtccggcagtgctggatgatgaactccatcccgatatgatcctgccgggactaagatgggatgcccgcgccgtacgggaacattgatcctgacttccgacaggttatcagccattctttcgccatgaatccgccatctgaaaggctaactgggatgcctgattggagcaaagaaggaggacagagcacggaaatcctcctacctttatgacttgaacaacagcacagtcacgatcccggtcttgtgaaccgcccggcgaccggagtgctcgataaaacagggatggcgacgtcatcatgcaatcagaacgagtgtcctggcctgcggaaacctctcacggggccggtacccatcagctgttcctgcgtgaggaggaattgcggctggcacaggatctgctgttcttcgcctatcgcgatttcacagcgtctgcagatgctgcgctggaggagctgggcttcggtcgcgcccatcatcgcgccctgcatttcattgcccgtaatcccgacctgacagtcagcgatctgctgtcgatcctgcgtattacaaagcagagcctggcccgcgtgctgggcaatctggtggatcgtggttatgtcatgcagtcgcccggcaatgaagatcgacgtcaacgcctgctgcgcctgaccgaaagcggggagtcgctggaacgccgcctgttcgaaagacagaaagccattctgacggccgcctatcgcgagtctggtggccatgcggtggagggttttcgccgcgtgctttacagcctcgcggggaaggatgcccgcacctgtattgatcaggcggacccggcgtttcgcaatcggaggaaaatctgatgtcgccatcagatcagggcggcggagaagccaccatgatcttggtagtcgatgatgatgaccgcctgcgccgcctgctgtcccgctttctggccgagcgtggatttcgtgtcatcacggctgaaaatgccactatagcccggcagaccatggggtttcttcaacccgatctgatagtgctggacgtcatgatggcgggggaggacggtctgagcctcaccgaaagtctgcgtcaggatggacaggacgtgcccgtcatcctgctgacggcacgcggcgcaccggaagaccggattgccgggctggaagccggggcggatgactatctcgccaagccgttcgaacccgatgagctggtggcccgcatccgtgcggtattgcggcgcacttccattccggcgaccccacccgcaccgaccggaccggtcaaactggggcagatcatcttcgacccggatcgcagcgaattgcggggaccggatggagcaacccgtctgacgggcggcgaaaccgccctgctggcggccctcgccggacgggccaatgaagttctttcccgggaagagctggcagcggttctgagcatggacgaggccagtgaacgcgccatcgacgtgcaggttacccgcctgcgccgcaagatcgagactgatccaagggaaccccgctacctgcacacggtacgggggcgtggctatgtgctgaaaccgggcccatgagcggcccgcacgatcacatctctgagccggacctgccggaagcgcaggacatatcaccccgtttccagttggccggccggatgcaacgcgccgggctgcgccgggccattaaaaaatttctgcctcgctcccttctggggcgctccctgctgatcatcctgctgccgctggtgctggtgcaggccgtctcgctcaagattttctacggcagccatctggatgtcatttcccgccgcctgtcattctcggtcgccggagaaatcgcctacacaattgatctgctgcgccgctttcccgatacggccgatcaggactggatcctgcgccatacctgggggcagttcgcgatcatggctaccattcggcctggtgccaccctcagcccacgggaaccccacaacattctcggcccgatggatgatgaccttcgggccgcgctggaagaaatggtcaagctgcccttcaccatggactggatttccgacacccaatccgtcctgatccatgtgcaattgccgcagggcgtgctggatgtgaaagccccccgcaaacggctttataccgccactatctacctgtttttgttctggaccgtgggctccgccctgctgttgttcgccgttgccgcgctgttcatgcgcaatcaggttcgggctatccgacggctggccggggcagcggaagccttcggcatggggcgggatcgtggaccgatcaaaccggaaggcgctattgaggtccgccgtgccgccaccgccttcaaccgtatgcaggagcgcatccgccgcttcatcacgcaacgcacggagatgctggccggtgtctcccacgatctgcgcacgccgctgacccgcctgcgtctggccgtggccatgttgccctctgtacctctggaagagctaccggaggaaagccgggccatgatcgccgatctggaagacatggagcggatgatcaaggcctatctggcgtttgcacgcggtgaaggaaccgagcagacccagccctctgacctcgtccggctggtgcagggggtcgtgaacggcacccgccgcgccggagccgatatcacgctttcagccccgccggagctgatgctgccgctgcgcccggatgcctgccgccgcgccgtggccaatctggtcgataacgcctgtcgtcacggtcaacgggtcgtggtcagcatcaacgcatggtcccgggccgcccatgtcacggtggatgatgacggtccgggactcgcccaggaatggcgggaagccgctttcaagccgttccagtccggctccgccggcgggaccgggcttggtctggcgatcagccgcgacattatccgcagccatggcggggacatcacgctggaggacagcccgctgggcggcctgcgcgcacggatcacgcttcccctgtgatgcggtccgcaagggcggccatcaccggcttcggccaacgccggtgcagccataaccattgctccggcacggcccgtatccagcgttccagaacctgattcatcgcaagggtcaacgccgcgatatcctcggcccgctggccggtctccggcagggataaaggcggctccacaatcaggcggaaccgcgccgggccgatccgccgcatataaccggggatcaccggacagttgaatttcagcgccagagccgccgctgccggagcggtcatcgccggatagccgaacagcgaggactcgatgccgtcattcatcttctgatcgatcagcatccccagacaaccgccggcccgcagatgcgcaacgctgtaccgcgcgcccacggccccctttggaaacagtggaatctccgccccgatggcgcgacgacgcaaggaaagcaggatttcgtccaccaccggattggcgggcgcgcgatagatgctggacatgaacatcccgaacgtcgccacggcgggcggaagcacttcccagttgccgatatggccggagacgaaaatgcaggctccccctcgcgccgcctgcgcaagcagaatctcctcgccctcgatttcccagcccggtccggactgcgtacgcttcagcaatggcagatgcggatattcggctacggtgcggcccagattatcccataccccggcaatgatccgccgtctggctgctgcatccagttccggcatcgccagacgcagatttctgtccgcgacatggctgaccggcagatatggcccgatcctccgcgccacagcccccccgaggtcagaagcccgctccgcacccaatgccttcagcaatgccagcaccagacgcagcgcctgaccctgaatcgcgtgccagaccttcatcggcaatggctcatgccagtatggtggcagaatcgtgcgactgtcgcagagcagcctcagaggcacggtcatgccgggtcggcaatgtatccagcagacgatccagcgcctgttcgtcctcccagacgatgcggacgcccgatacggtaacccgcttctgccagtcagaacgcaaccggacagcatctttcggtgtcgtaaccagcacggcccccattgcggccgcatcctgcgcgagaagagtcaggtcgcgctcggtaaagacgtgatgatccgggaagccacgcagttcgacgacctccactccggcccgtgtcaaagtttcggcgaatttggctggacggcctattccggcaaaagccagcaccgggcggccaatcagggcttcagtccctgttgcggtcaggtgcgcccgcagaacctgcaaaccggcaggcaattgacgcgctgtgccggtcacgtcatcccccacgatcaccgccgcccgacagcgtgccgcagccgccgcaaccggctcccgcagcggaccggccggcaggacgcgcccgttaccgaacccgaccgcgccatcgataatcagcagggacagatcgcgggcgagaccgggattctgcaacccgtcatccatcaccagcaccgaggctccggcggcaatcgcctcccgtgccgcagcagcgcgatcaggggcaacccagcaaggggcagaagccgccaacaacaatgcctcatcgccgacctgaaacacggtatcgtcgggctggacctgcaccacaccctttacacgtccccgatacccgcgggtcagggcatgcggtgtgaaaccgcgctttttcagccttgcgatcaaatccagcgcaattgtggtcttgcctgcgccgccaaccgtggcattaccgcagcacaccaccggcactggtgcccgccagcccggccgggccacacgatgcgccgtgaaagccgccgtcagggctgaagccggggccagcaacctggcggttgggccgttgcggagccagaatccgggggtgcgtatcatttcgtcatctccgacaccatcacagccaaacgctgcggcagatcatcccatccctgcaccgccgcgcaagcccgctgcccacgcgcggcagcttcatcgggatcattcaccatatgccggacgaaatcggtcaatccggcttcatgatcaacccgtatcaatccccccactgcctccaaagcctccactgcatcggcgaaattctccatatgcggcccagccgcgcagggacaggcaaggcgcgcggcttccaacggattttgcccgccatgcgggataagactgccgccaataaaggcgcagtcagccacccggtaaaacaaccccagctccccgatcgtatccgcgacataaatcccggactctcctgcaggcggaagcgcctgctgcaacgatctgcgtggagaacctggggcaatcatggcgccccgctccgggtggcgcggcacgatcacggtcagcagaggggcagcagactctccggcaagacgggcatgtacagccagaacggtttggtcctctcccggatgcgtgctggcggcgagaaaaatcgcacggccaccaatctgcgcctgtaaaagtcgcaatgcagccggatcggcaggcaagggaggagccgcaaatttcagatcgccggccgcctgcaccttcatgccccccagcgaccggaaccgggcagcatcttcccccgagcgggccatgataaattgcattccggccagcatctcccgcaccagagcagggaagatgcgccagcttcgggcactccgcgccgataaacggccattcaacagggcatgaggcaccccccggctccggcacgccgccagcagattgggccagagttcgctttccacgaacacggcggcatccggcttccatccattcagaaaacgtgctgcccagagcggcacatccagcggcacgaaacggtgcgtgaccgctgccgccagtcccatttcagcaagcctcgtttccatcagcacggcagaggtcactgttccggtcgtcaacagcacatgcagagcgggatcaagacgatgcagggcagccagcaatggcagcactgaaacactttccccaatgcttgccgcatgcagccagagcagacgccccatcggacgatcagcccccaacccgcgacgttccggcaggcgggcaacctgttccttgccctgccgcgcccgtctggccagatgccggttcagcagcgggatcgccacactggccgcacctgcgtacagccatccggccaaagaacgcatcacggtttcgccacgcgtgccggcgtccccgtcatcacgtccggagccagaccacacagccggttcgcttggtccgaagcgcgattcaacgcttcctccaacagggtggtggcatggcgcatatcatcccgttccaccaggatcggcgcagcaaccaccacggcaccacgcccgaatggcatcggcaccaccatccggtcccaacttttcagcaccagacgacggctgatctgtgcagcaaccggcagcaaggggcggccactcatcgccgcaatcgccgtggcaccgggcgccgcctgccgtcgcgggccacgcgggccatccggtgtgatgatgatccggccgccctgctccagaatacgcagcgtgtcccgcaacaccgtggcaccgccccggctggacgacccgttgagcgttttcgcccccagcaggcgcatcaaggtcgcgaccagacgcccatcccgatgccggctgatgatcacatggcacggctccggattggccttgcggaaccgcagccagaccttcggcatcagggccagctgctcatgccagaaagcgcagatcagggagtctccacccagaaaagtggccacatgctcctctccctcccactgccagcgcgtcgtcgtcagggcgaaatgcagccacgcccggagcagccaggcaccggcactctgtattccgggatgacgggaaaggcgtttgagcatggatcgcgccggtagcacgcacaccgtcaaagcgaaaggcgcaacctacctttcctccccagcatggtagcgacctgttttctgctgcaacccccagaccgggcgaagattgctgacgaaaacgcgggcacattgcgcccagctgaactgctccgcgaaccggcggcattgcgcccgatcggcattcagagcctgcatggccgctcggctgagtgcctgctgggtcagatcctccgccagcacaccgacctctccggcatcgcgcagcagatcgcccggcccggtgacggaaaaagccgcgacaggcgtaccggaggccagcgcctccagcgtgaccagcccgaacgtatcggtgagagaggggaaaaccatgacatccgccccggcgaagcacgccgccagcgccgcgccataacgcgcgccaagatagtgcgcagagggccattgacgcttcagcagggcggcgtgcgggccttccccgaccacgaccttgctgcccggcagatcggtgctgaggaaagcttcaatatttttctcgaccgccacacgcccgacatacagaaaaaccgggcgcggcaaatcagcgaagacatcttccgtatcagcgccgggatggaaaatatcgagatcaaccccgcgtgaccatggcagcagccgattgaacccgcgttcggaaagctcccggcgcaggctttccgtcgcaaccatcatcccttctccggcagcatgaaaacgcctcagccatcggtagaagggcgcagccggcaggccggtgcgagccttgatataatcgggaaagcgggtgtggaaagcagtggtgaaagggaagccatttcgccgcgcccaccgtgcagcggccagccccagcggcccctcggtcgcgatatgcagcgcatccggcctgaacgccacgatcatccgcctgagtctggtcgccggaaacagggacagcctgatctccggataggtcgggcaggcaatcgtgcggaaccggtccgggccgatcacctcggccacatggccttgctgtcgcagttcgcgctccagcatggtcaaggtgcgcacgacaccgttcacctgcggctgccaggcatcagagataatcaggatgcgcaaacctatccccgttggaggccatacgcgatcggaatcgcgggcgatccgcccgaaactgccggccctgaaagcactgtcatcaggcagtttgcagtacctccgaccggcgccccgcgaagaatgataactggtttctggccgcccagtcgatcagttccagttgaccgtctgcatgctcgaccagcgccgtgcagctttccacccagtcaccgtcattgatgtacaaaacaccgttcacctcacgcatttcagcatggtgaatgtgaccgcagaccaccccgtccagaccacggcggcgcgcttcaccggccagagcgttctcgaaccggtcgatcgccttcactgcctccttgacctgacgtttcagccaggcggacagggaccagtacggataacccatccggcgtcgcaccgcgttgaaccagcgattgatctccagcgccagcgtgtaggcccagtcccccagtacggcgagaaacttcgcatagcgcacaacgctgtcgaactcatcgccatgcataaccagaaactggcgcccatccgccgtttcatgcacggcttcccgcatcaatctgatcccggccacttccaacccgtcgggctgaagccaggcgcggaacatctcgtcatgattgccggggatatagatgacttcggtgccggaacgggcgtgacgcaggatcagcctcacgacctcatcatgctgctgatcccagtaccaggctttacgcagccgccagccatcaatgatgtcgccgaccagataaagccggtcacacctcacccgccgcagaaaatccgccagaaactcccctctgcacccacgcgtgccaagatggaggtcggatatgaaaacggttcggtaatgttcgacgctgaccggcaggtccatccgatggcctccttgctttccgcatgccggataggccgatttaccagtcaaaaatcatgaatattatgtgacttggaagtgataatggaattactttaaatataatatatctgccatagtgtcgaaataccgatgtcacacttgagcatcataatgtgacattcacccttttgtatacgacagcgcaggcaagctgatcttgatcgtcattttcaatccagcggcagggcaacgtcgacccggccggctttgggccgtgctggatctgctgattgagcacgggatcaaggtcgagcttgcggaaacgcgccatcccggccacgccacagagctggcacggcaggctgccgccagcggtaccgacatgatcgtcgctgccggaggcgacggaaccatcgccgaaatagcacagggcatgatcggaagccctacccgactcggcattctgccgctcggctccgccaatgtactggcgcatgagctgacattaccggtcagggccaaggccattgcctccaccctcgccttccgccgcacgcgcccgctctggcctggtctggtgcaggccgggcagaggcagcgcctgttcgtccagatgctgggagttggattcgatgcgcaggttgtgcatcacctgccccttcccttgaaacgctttaccggccgcatcgcctatgccgcgcaaagcattcgggagatcagccgctaccgcagcacccgctttccggtgatcatagatggccaaccgcatgaggctgccaccgtgatcgtcgcaaaaggccgctattacggtggccccttcctgctggcccctgatgcggcctccgacagtcccggtttctccatcgccatgtttcagcaggattcaacgcgcgacattctcaaatacgggctgcaactgctgtttggacagttgcccgcctgcaccggtctgaaattcctgcgcggcagagagatcatatttccgggcagcacgatcctgcccgcacaagctgacggcgacccggctggccatacgccgcttcatatcggcgatgccccctgccccctgcgggtggtggtgccgtaaagccggaaaaccgggtttttgatgaccccggaacggcacctggcagaaaattccagcatcaatgcgataaaagtatcatatcagcccttgatatgacggattttttaatgatgatgcgcggcaataatgcgggattgaaatcaggctgaccgcacgcggtggttggcgttcttccctgtgatatgttgatggaaacgacatgagcaccgacacgcacagcgccgcgatcccggtgagttctggcatcaggcagccttatcaccttgttgatccaagcccctggcccattatttccgctttctcaggcggcttgctgctgttcgggatcgccgaatatgccaaccaccacagcaagctggttctgcccgccggtatcgccgccgtgctgctgtgcatgttcggctggtggcgtcaggttctgaaagagagcaacacccccggtctgcacagcccgctgacgcgcctcggcctgcgttatgcgatgctgatgttcatcgcatcggaagtgatgttcttcgccgcatttttctgggcgtatttcaacttctcgattttcccgagcaatatgggcaacctgaccagcgcagccgccgctgtctggccgccagccggggtgcataccttcaatcccctgcatctgccgctggtcaataccctgatcctgctgacctccgccctgaccctgacctgggcgcatcacgggattgcccatggcaatcgccggacactgattatcgggctgattctgaccatcgtgctgggtatgtccttcacgatctgtcaggcacgggaatattcggaagcgccgttcaagttcaccgatggcgtctatcagtccgtgttctacatggcgaccgggttccacggcttccatgtcattgtcggcaccatcttcctgaccgtgtgcctgatccgcgccctgcgtggcggcttcaccgcggagcgtcatttcgggttcgaggccgccgcctggtactggcatttcgtggacgtggtgtggctgttcctgttcgtcgcgatctactggctgggttatcggggctgatcccttccagatatcgaaacgccgatatgaaggcgcccctctggcgggggcgccttttttcgtgaatatcagacctatgtccacctatcgccgttttctgattcccaccggaatcaccgtcctgctgatggcggtgctgatctttctcggctactggcaagtgcagcgtctgcactggaaaaccggtattctggcccagctcgacgcggccgaggccgcaccaccaacgccgttgccggacgcacccttgccgtttcagaaagtcgtcgtaacgggcacactcgtcccctcggaaagcatattgttcggcgccgaaacccatgtgacccaacaaggggaacctatgggggcacaacttctgatgccgctgtcacgtgccggccataaagcggtgatggtgcaactcggctgggtggccgatccatccggacggaatacgcccgtacctgccgggcctgtcaccatcacgggttacatcctgcccgatcagaaaaagggttggttcacacccccggccgatccggcccatcaccatgtctatctgcatgattccaccaccatcgccgccctgagccatgccggtgatatcgaaccctatacgctggtcgcgctgtcacccgtttcgcaggagaacggacacccgatcccggcggaggggctgcctcgcccgcagaacaatcatctggggtatgctctgacctggttcggtctggcgatcacgctggccctgctctatgcgaactggctgaaaaaggcgctccgctcatgatcgattctgccgcagcctctgccccttatccgtggttgaaggaccgtttcaaccgcatcgccacgcttcaggaagcttccagcatgctgggctgggatgcctccgtcatgatgcctccggggggtgctgcggcacggggtgatcaattggccctgctcgccgggatggcgcacgaattactggtcgatcccgccacaggggatgcgctggcatccgccgcccggacaccacctgccgatctgtgggaccggcgcaacctgcaactgatgcagcatgcccatatccgcgccacggccttgccgggcgatctggtcatggccatcagtcgagcctgctcctcctgcgagaaaatctggcgggaggcacgggcgcagaacgatttcgcccgcgtgcgtccagcgttgggggaggtgatcaacctcacccgtcaatcagcgaacgcgctggcgcccgtgctgggcctgtccccatatgatgcgctgatggacgggtttcagcagggaatcggtgccgctgacgtggccccggtttttgctgcctacgaaaccttcatcgccgaggcactgccccgtgcggaagaacttcagcacaaccacccggcccctgtcccgctcggcggaccctttccggaagcggatcaggaaagcctctgtcgttttctggcggaacgggcgggactggatttcaccagagccaggctggatcgctccacccatcctttctccggcggtacgcataccgatctgcgcatcaccacccgttatgataccgccaatgtcgcatcagccatgatgggggtactgcacgaaacggggcatgcgctgtacgaagcggggctgccggatgcgtggaacaggcaaccggtcggggaggcagccggcatggccgcccatgaaagccagtccctgatcgtcgagatgcaggcctgccgttccgacccttacctctcctggctcggcccggtgttgaaagagcgattcggcggcgatgcggacgcttacagccccggcaatctggcagcgctctggcggcgcgtggagcggggcttcatccgggtcgatgccgacgaaatgacctatccggcccatgtcatcctgcgattccggctggaacaggcgctgatcgatggcagtctgactgttgccgatctccccgccgcctggaatgaagggctgaaaacactcctcggcatcgtgccaccggatgacagacatggctgtttgcaggacattcactggtatgatggcgcgttcggctatttccccagctatacgctcggggccatggccgcggcacaattgatggaagcagcccgcgatgcgacgccgggactggatgaggcgttggggcgcggcgatctgtcaccgctggtcgcgtggctgcggaccgaggtgcatgaacgcggcaatctgctgggtttcaacgatctgctgcgcgccgcaaccggaaagccgcttgatccggcggcctttcttacccatctgcgtcaacgctacctcgattaaccgtctgccagagcctgccccgcgcttcaggcagggcggcaaagcccgaaacctcccttttaccagccctcgcaccgccatagattgagtccatgcgttatatctccacacggggcgaggccccgatccgtgacttctcaggcgttctgctcgccgggcttgccgaggatggcgggttgtatatgccggaatcctggccgcagttttcccacgatgagtggcgcgccatgcgtggcctgccctatccggatctggccgcacgcatcattcagcctttcgtcggcgactgcatcccagccgaaactctgctgacgctgtgccgcgatgcctatgcgggctttacccatccggccatcgtgccgctggtacagctcgatcacgatgtctatacgcaggaactgtttcacggcccgacccttgcattcaaggatatggccatgcagttgctggggcggctgttcgattacgtgctgagccagagcgaccgccgcatcaccattgtcggcgcgacctccggcgataccggctccgccgctattgaggccgtgcggggacgggaccgggtggatatcgtcatcctccaccccgaaggccgcaccagcaccgtgcagcggcggcagatgaccaccgctatcgccccgaatatcggcaatgtcgccgtgcgcggcacgttcgatgactgccaggatctggtcaaggcaatgttcgccgataccccattccggcaggaaatgagcctgtccgccgtcaactccatcaactgggcgcggatcgcggcgcagattccctattacgtctacgccgcccttcaactcggcgcaccggaccgggcggtggcgttcagcgtgccgaccgggaatttcggcaatgtgctggccgcttatgccgcccatcgcatggggctgcccgtaggcaagctggttgttgcctccaaccgcaatgacattctctaccgcttcctgagcgcgaatgacatgtcggcacgcccggtcgagccgagcctgtcgccgagcatggatattcaggtcagttccaatttcgaacgggtgctgttcgaattgctggatcgtgatcccgccgccaccgccgccacgattcgcgctttccgggaaacaggccgcatgccggtggccgatgccacatggcagaaggcaagaactctgtttcagggcttccgcatggacgacacggacacggaggccgccattcgcgccttgcgacaggaaaccggctatctggccgatccgcacagcgtcatcggcattgcagcggcacggagcctgcgcaacgctggcagtctgtcggcagccggtcccgtcatcgccatggcgacggcccatccggccaaattccccgatgcgatggaacgcgccaccggtgagcgccccgccctgccgcctcatctgagcgatctgtacgatcgcgaggagcggttcaccgtcgccgataataatctggcggatatcgaggctctggtgcgcaatatcgcccaccgcaatacaagcccggcatcctcccccgtaaccggagtgcctgcctgatgtccgaaacgctcgatgggggcgcggtgcgcctcacccgcctgccatccggtctgaccgttgtgaccgagcgcatggagcgggtggaaacggtctcgttcggggcctatgtcggcgtcggcacacgccatgaaaccgccgcggaaaacggcgtttcccacttcctcgaacatatggcgttcaagggcacggagcgccgcagcgccgcgcagatcgccgaggaaatcgaggcggtcggtggccatatcaacgcctacaccgcccgggaacagaccgcctattacgtcaaggtgctgaaggagaacaccgatctcgccgccgatatcatcggcgatatcctgacccactccaccttcgacgcggcggagttcgagcgggagcggggcgtgattcttcaggaaatcggtcaggccaacgatacgccggacgacatcatcttcgaccattttcaggaaacggctttccccggtcagccgatgggccgcccgacactgggaaccgaaacgattatccgtggcctggaacgggatgcggtggccggttatatgcggcgtcactatgcggcctccaacatggtggtcgcagcggccggcgcgctggagcatgatcgtatcgtcgatctggtgcagcagcatttcgccgatctgcctgcctcaacggcgctggacgcctcccccgccgattacaaagggggagaattccgggaaaaccgcgatctggatcaggtgcatatcgtgcttggcttccccagcgtgagctatgccgatcctgattatttcccgaccatgctgctctccaccctgctgggtggcggcatgtcatcgcgcctgtttcaggaaatccgtgaaaagcgggggctggtgtactccgtctatacgttcagcctgcctttcctcgatggcggcctgttcggcatctatgcgggcacgggggagcaggaagcgaaagagctgatcccggtcacgctcgccgagctgctgcgcgtgcagaacgacgtgaccgagcaggagcttcagcgcgcccgtgcgcaggtgaaggcctcggtgctgatgtcacttgaaagcaccggcagccgctgtgagcagattgcccgccagtaccagattttcggccgtctggtgccaacctccgaaaccgtggcgaaaatcgacgccgtgacgctggacgatgtccggcgcgtagcagccgccctgttccgcgccagcccaaccctggccacccttggaccagcaggccatgttcctgatctggcccgtatcagtggatcgctggcagcatgagcacctatctggatttgatcgaccagcttctgacccacgcaaaacgggcgggcgccgatgccgctgatgcgctgatcgcggcgggaacctccctttccgttcaacggcgtctcggccagaccgagcatgtggaacgctcggagggccgggatctggggctgcgcgtgctagtggggcagcgttcggcggtcgtgtcctccagcgcactcgatccatccggatttgcacggctggcggaacaggctgttgccatggcccgggtcgtgccggaagacccctatttggggctgggcgaggtgtttgctccggcggatgccaccctgctcgatctgaacgatccgtcggagccggatgccgatgcactcggtgcactggcgggtcgggccgaggaagccgcgctggccgtcagcggtgttacgaattccgaaggctgcgaggctgggtatggcaagacggacattgccctgggtacctccgccggttttcgcggcgcttatgcccgcaccagcttttccttctccgccaccgctctggctggcaccgggaccggaatggagcgggattatgattacagcaccgccgtacatttgagcgatctggagcagccggaactgatcggccggaccgccggagaaaaagccgtcgcccgcctcaatccgggccgtgtgaaaacggcgcggatgccggtgattttcgaccctcgggtttcgaacgggctgatcggtcatctcgccggtgccatcaatggcgcctcggtggcccgtggcggcagttttttgcaggatcgcctggggcagcgcctgttccgccccggcattgtcatgcgtgacgatccatcccgccggcgcgggttgcggtcccggcctttcgatggagaaggccagcccgtgcagcctctgtccgtgattgaggatggtgtgctgacaagctggattctcgatctgcgcagcgcccgccagcttgggttgcataccaccggccatgccgcgcgtggcactggcggcggcccctcccctgcggtcagcaatttctatctggaagccggaatgctcagcccgatggcgctgatggccgatatcagggaagggctgtacatcaccgaaaccatgggacctggcgtcaacctgaccaccggcgattacagccgtggctgtgccggtttcatgatccgtaacggcgcactggccgaaccggtggcggaaattaccattgccggacatctactctctatgtttgcggagctgacgcccgcggatgatctgcgctttcgtggctctgtcgatgcgccaacggtccgtatcgacggcatgatggtcgccggagcctgagaaaaagcccatataatcgggctttcatcatcatgtcgccgctacagtttcgaggaaatacccctatattagggacatgataattcggaacggacctacgatgcgcaaagctttgccggtttttctggccgccacgctgatcctctcccctgttcttgcccaggcgagggccgggggaggatcgtcaatgggcagcagggggagccggacctattctgcgccccgctctaccccggtggcaccttatgcagcgccgatggagcgcagctacaccgcacccagccgcccctcctataacagtcctcccggcatgccgcccatgcagcctgctatgtcccggcgttccgcctttacgtccgggctgttaggcgggctgatcggtgcggggatcggtggattactgatgggccatgggctgtttggcggagtcagcgggattttcggtttcttcggcctgctgctgcagattttcctgatcgtgatggtggtgcgttttctgtggcgccgcttcgcgggtgggaatgctccagccatggcaccggccggtgccggcatgaccaacccgttcaccaccaatcagactgatcgcggcccgatagggggaggacagatggggggaggcccgatgggaggaagacagagcagtgtccaaccgatccagctttctcagggagattaccagcgcttcgaatccctgctgaaagaggtccaggcagcctggaccgatcgcaatcttcagcagctcggcagcatcagtacgccggaaatggttggttattttaacgagcaactgaccgctcttgccagtcgcggcctgcataataccgttaccaacgtcaccttgcagaagggcgacctgtcggaagcgtggcgggaaggtacgctggaatatgcgaccgtcgcgatgcttttctccatgatcgacgcgacctacgactcaagcggtcgggtggttgagggggatgcttcccagctgcagacagcgaccgagttctggaccttcgtgcgcagtccgggcgggccgtggattctctctgccattcaacaggcgcgataacagggtggaagcaaagaaaaaagcgccccggcaagggcgctttttttattagccggtgtgttccgttttctgtcagcctgccggagaagccataccggctggaaccttgcctgattcatgcggcgtctgatgagcaatcttcaccatcgccatcgcgtaaaacaggaaggccattccgaacagcacgatcagcatcgccagattacggccccgacgtttccggcgaagttcatcagactgctcctgcgtcaggcgcgggggaaaattgaccataccgatcacacaaaacgatcaacggccagcgccagaaacagcacggccagatagatcagagagtatttgaacgcggcacgggcaggtgcatccttggtcaggctcagcccgacttcgtcctgcttgtcccgcagcacccgccagctttgtaccagaaagccgaggctcaatacgacagccgatagtccgtaaacgcgtccggtatcacccagcgcccagggcagcaccgcgatcactgacagcagcacagtataggccatgatatgctgacgggttttacgtgcccccgccaccaccggcagcatcggcaccccggcccgctcataatccatctgcgcccagagcgagagcgaccagaaatgcgggggcgtccagaaaaagacaatggcgaacatcatcaccggcatcagatcaatcgtgccagtcactgccgcccagccgatcacgggtgggaaggcacctgcagcaccaccaataacgatattctgcggcgtgcttcgcttcagccacatcgtatagataaccgaatagaaaaagatcgcgaaggccagcaccgcagcggcaacaacattcgttgccagccacatcaccagcaccgatccgaccgccagcacgataccgtatcccaaagcctcgcccggctcgatccggcctgccggaatcgggcgatttttggtccggcgcatcaccgcgtcgatatcgcggtcgtaccacatgttgatcgcaccggaggctccggtcgcaaccgcgatgcacaggatcgcaatggcacccagaaccggatgcagggagcccggggccaccagcataccgatcagcccggtaaatacgaccaggctcatcacgcgcggtttgagcagggtcacccagtccgctgccgaggccatgccaggcatttgagcggaaagcggcagagaggatacctccctgccgccattgacgaacgcactgtcgctcatacgtctttcatccgtcccgagggaaccgcgcgtcaattgacgcgcggcagctcctcaaaggtgtggaagggcggcggagagctgacggtccattccagggtcgtcgcaccctcaccccagtaattcgcaggcagatgttccttcgaggtgaaggtcttgtacaccacgaacaggaagatcagcacggaaaaaccggaaatataggcaccgatcgaggccacatagttccaacctgcaaaggcatccggataatccggataacggcgcggcataccggccaggcccaggaagtgcatcgggaagaaggtcaggttcacaccgatgaacgtcacccagaaatgcaccttgccccagaattccggataggggcggcccgtcatcttgccgatccagtaatagaagccggcaaacatggagaacacggcccccagcgacagcacatagtggaagtgcgcgatcacataataagtgttgtgcagcatctgatcgacaccggcattggaaagcatcacgcccgtgacgccgccgacggtgaagaggaagataaagccaacggcccagagcatgggggtcttcatctcgatggagccgccccacatggtggcgatccaggagaaaatcttgatgcccgtcggcacggcaatgatcatcgtcgccgccatgaagtaggcgcgggtatcgacgctgataccagagataaacatgtggtgcgcccacacgacaaagccaaccacgccgatcgcgaccatggcataagccatacccagataaccgaagaccggcttgcgggagaaagtggagacgatgtggctgatgatcccgaacgcgggcaggatcatgatatacacttcagggtgaccgaagaaccagaacagatgctggaacagcaccggatcaccaccgccttcgggagcgaagaaagccgtgccgaaatcacggtcggtaatcagcatggtgatcgcacccgccagcaccggcagggacagcagcagcaggaacgcggtcacaagctgcgcccagacgaacaacggcatcttgtgcagcgtcatgccgggggcacgcatgttgaagatggtggtgatgaagttgatcgccgccagcagcgacgaaacaccggacagatggagcgcgaacagggcgcaatccataccgataccgctctggaacgtgctgttggacagcggcggatacagcgtccagcccggaccggcctcgcctagatagagcgcatagctcagcagggcgaaagaaggcaccagcagccagaaactgatattgttcagacgcggaaaagccatatccggcgcaccgatcatcagcggtacgaaccagttgccgaagccaccgatcagcgcgggcatgaccacgaagaagatcatgatcagaccatgcgccgtaacgatggcattccactgctgcccatcaccgatcagggtgctgtgcggatgcatcagctgcgcacgcatcagcatagacagcccagcccccagaaacgatgccagcacagaaaaaatcaggtacagcgtcccgatatccttgtgattcgtgctgaacagccagcgggaaataaagcccggcttgtgatcgtgatgatcaccggcatgggcatgagatgttgcagtcgccatttcgttagctccctcagacaccgatccttgacggatcagcgccccccttctgcgaactgccgcgggatggtctgcccggccggcgtattattgagcgacgtttttttcgtcttctggctttccgcccatttctggaactcttccggagacaccgcctttaccgcgatgggcatctggctgtggaaagccccgcagatctggttgcattcgccataatagacgcccggcttgtccacgcggaaccatgtttcaatggtacggcccggaatagcataacgctgcacaccaaggctgggaataaagaagctatggatcacgtcggcgctggtaaccaggacgcggacattcttgccatagggtacaaccacctgattatccacggacaacaggcgaatctgatccggcttaaggtcgccatcctgaataacccggctttcgatactgtcgatgccattatcaggataaccgtattcccagtaccactgatgtgctgtcaccttcagagtgacgtcagggttatgggtccggtcttcataatagaccaggcggaaggaaggaatggcaatcaccgccagaataagggcggggatcagcgtccaggcgatttccagccacgtatggtggctggtacggctgggaaccggattgcgtttcgcggaaaaacgatacgcgcaccagccaagcagagccgccacgaatacgacgatggcggtgatgatcaccatgatcagatcatgcagggaatcgattcgctctttcagcggaccataggcggtctgcatgccgatttcccacggcttcggcacacccagaccggtctcaccggattgggcatacgccgagctggccatgatctgggcaagcgccaccagcacgctggcagcgagagactgtcttaaaaatgaattggcggcaacgcgccgcaagaaggacaccatcggccgtttcatcccggttctggaggatacggccggagagggccgcatctttgcgccaatcggctacaggactccccgcccaagatcaagcgtttgtcagaaaaatgccgcagttccgttgctgaacgacaatttattaccggaaatcagtcgttttggagctgtacaagcgtaaagataccgaatggttgcaccggcgtaatttccgcacgggcgcgatcctgtggcgacagaagggcctcgaacgcaaaatcaggatgccagcccagcgcatgggaggcaggcgccatggcgcgctcgatccaccaacgtggacctttttccgcagcgaaatggttgacgaacagcagccacccacccggacggaccacacggcgcatctctgccatcaactgtaccggatgcggcacaactgaagcgacaaacatcgccaccgcgatatcaaaggaattatccgcgaaggacattgcctccgcatccatttccagcagcgtctcgacattggcaagctgctgctcacgcacacgttcccggcccagcgccagcatgtcggtggaaagatcaatgccggtaatccgcttgtcccggtgatagcggggcaaagcaaggccggttccaacccccacctccagcacctgctgaccagtcagccggttcacggcctccacagcgcggcggcggccataggcggacacgccgccaaacaccgagtcgtataccttcgcccagcgccgataggcatctctcaccgcatccgcattcaggctggtatggggcacagcctgggggccacgggtgttctccgcagccccggagctggaggatgcattctgggcagatgtctgcggaatcttcatatgagaggtcgacaagcggcaccgctccggatgtaagccacaaaagtgctgatgtgggtaggcgacgcgctccaactgcgcaagcccgaacagaaacactgccctcagcccatctgccggatgcctccctcctgaccccctgttactccgaaggcgtatgatgaaagatccgtctgtcaatgccccctggccaatacccgttggccaatgccccgatcgctgacagaacaagacagacgcgatctatccaccgcaatcagtcggcgcgtgtcagattgaccgcagccgctcggccattctgttgctgctcgatttcgaaatccagttgctggccttcattcaggctcctcagcccggctctctgaaccgcactgatatgaacgaaaacatctttttcacccgtggaaggggcaataaagccgtatcccttggtcggattaaaccatttgaccgtgccgtgtagcatggcgcgctgcctttctttagccggcgcccgcacatgggcatggcgccgaaattgacgtcgacgccaggccgaaattctccgaaccgacgccatattttcctcttcggccagatgcgtttctatcgaacgccttcaccggccagtggaaacgatacgtcggtctctcggtatctgcaacaatgatatgaggtgattttttctgcctatcaggcagcatcatcccgccgatcacgcactttcacataggctaaagcggcatgttccgcacaatacggcttcccggccatagcgggagcatcgcagaaacggaactcctttgtacccggctctccgatcggccagcaacaggacacaagccgcccgcctgaagggaaagccggggacgcgactttggagatcgcacgcggggtgggacgggcagcaggcggggaagaaggggtcgcaacggcggcaggttgcactgacggaagcgccttgtcttccttggcaatattcccggcggcaacaaccggcgcagatccctcggccggttcacgcgcctgctccaccaaagcagcagacaccgggacagaccgtggggcagaagcaagttccaccggcacggaggcagcctcaacggcgatgacggcttcatccgccacgacggcaacggttttttccggcacggacaaggcagcgatggccgcaggttcatcaccgatagagggatcagccatggagggtaacgtcacggcactggaacgacggctgccgggtgacgggcgggatgccaccccatcccgccggatcggcgaggggcgggccgccaggttgaggcgatgcgccttacccaccacggcatttttggaaatgcccatacgccgcccaatctcggcggttgaaagcccttcatcccaaaatgcgcggagcagggtgattgcctcgtcgctccactccatatcgtgcgctcctgatcttcgctgccactaaatacagtatatctgccgtttttctcaacgggcacagacgccataagttgtggaaaactccattaaacgactctgtctacacacagaatggtgatgctggccataaaacgaaacccgacaccgaattgtggcagattggcgacacacgctttctctcctgcgtcaatcaggctttctggaaatttttctctttacatgacgtgacttggcggcctttcctcatgtcatggcgcaggtggggaccaggccattgtactcacaacgcagagtaccttgccgggatacaggggatcagtgtccggaaagccgacagcacgacataaatggtcggctgtcggctttttatctgtttccgatactcctgctgctcactgcgtgcggcggctcgccgcaagggggcgggatttcggccagtcaatggcagtgcgccccttttgcccgcgccgtctccggcatcgcattatccggggatgccgcggattggtgggatcagaatgatggccgttacctctccagccatcagccatcgcgcggtgccgtcatgattttcgcacgctcccgccgcctgccgcatggccacgcatcggtggtcgaggatgttctcggcagccgcaccattaccgtggcgcatgccaactgggttcatggcgtcgtcaataccagccagaccgtggtggacgtctcccctcgcaatgactggtcccttgtgcgcgtctggtggccaccggccgggataatgggtaccaccccctatcctgtacgcggctttctttcccgtgacggcaggggagccgatccagcgcagatcctgtcgatggcggaactgacggcgcactccagtgcctattgaaccagcaatacgcacatcattccatacgtccaatagcgcatgacacaggtttatcgtatgatgtgatccttccccactgggaagtgccccaaaagatatggctccggttaatggcttgcgttatcgccatgtccgcgccatctcctgtttggtaaccggttcgcgcctcggagagatcatgggtagtctgagcatctggcattggctgattctgctggcggttgtcgccatcctgttcgggggtgggggcaaaatcagcggtctcatgggcgatctcggcaaagggatcaaatccttcaagcggagcatggcggaagaggacgatgcttccatggagcatgatccgaaaaatcccgcagtgccgcccccttccccgaatgcatctttggggaaccagcagcccgcacagcatgacacgacccctcgtccacaatctcatgtctgacgacatcgctttatatcggcagggttgaggatagatatgaccgggacagtcacgtcagtcaggcagccgccggaatgggctgccgtcaccattgttgcagccggacaacggatggatgcacgtgggtgggtgccggcaaccgccgggaatatcagcgtccggctgcccgatgataccatcgccattaccagcagcggcaaccacaagggcttcctgaagacctccgacatcatggtggtcgatcaagccggcaagcctttgacccccgggcttaaacccagcgcggagacactgctgcattgccagatctatcgtctggacaaccaggccggcgcggtcgtgcatggccattccgttgccgccaccgtgctgtcgatggcaccggggaaaaacgacgccccgcccgacttcattcggctggaagggtatgaggtgctgaaagcattcggcgtaaaaacccaccagatcacgctggatttacccattctggacaatgatcaggatatggaaagactggccagcattgccgaaccgatccttcttcgtggggcaccgcttggatatttaattcgtggccatggcgtttatgtatgggggggcgatatggctgccgctctggcgcggctggaaggtctcgaattcctgctggcctgtgagctggaacgtcgtcgcctgcgctgagacacatctggattgaccgggggcatacgagatgagccgtctgaccatttacgcagactccacaccggatgcgccgctgctccggaccgaagatccggaacggatcgcacaggaattgagtagcatcggtgttcgcttcgaacgctggagcagcgctgttaccccgtctccggatgatgacgaagccaccattctggccgcatatcgcccttacctgaatgcgttgatgggcgaaacgggtgccggcactgcggatgtgatccgcctgcggcccgatacaccgaacctgcccgcgttgcggcagaaattcctgtccgagcatacccataccgaggatgaagtccgtttcttcgttcatggcagtggcaatttcattctccatgtcgatgacagggtttatgatgcacactgcacacagggggatctgatttccgttcccaccggcatcaaacactggttcgatgcgggcgaaacaccctttgtcaccgccctgcgcgtgttcaccgataccacaggttgggtggcccattacacgggtgatccgattgctgaccatttcccggctgcatgatagatccgcctttttccccgcataaggcccgccatgaatcctcccaaggccattctgaccgatatcgaaggcaccacgaccccaatcgccttcgtgcatcgggttctgtttccctatgccaaagccaatatggccgggtttctggcggcttattcggatgatgaagcagttgccgcaatccttgccgaagtagaggcgcagtatccgggccgaccggcgctggaaacattgctgggctggatggatgaggatgcgaaaatcaccccgctgaaagcattgcaaggcctgatctggcgggaaggatatcgcaatggcgccctgcaggcgcaggtgcacccggatgccgcgcagagcctgcgcgcatggcatgaggccggcctcaacctgttcgtctactcatccggttcggtcgaagcccagcaattgctgttctcttattccgatcagggtgatctgtcgctgttgttcggcggctttttcgacaccagaatcggcggcaagcgcgaggcagacagctatcgccatattatcgccaataccggcatgcaaccgcaaagcatgctgttcctctccgatatcgaggaagagctggacgcggcactggatgcgggtttgcgcacctgccagctcgtccgtgccggagataacggggggccacccactctgcgccacccccatgccccggattttatcgccgtcgcacacctgttcggcctgcctcatccctgatgcgggatgacggccctttctctttcagcgtttgggcagggtcaggactccggaaggcggagacaaggttgtcggagaagagccagctgcggttgaacctggtgtcgccggcgccacaggctcaggcaagggtgccgtcttgacgcccggaggagcctgcaatgtctgttgctgcacagcccccggcactgaggtcatcgacgtatcctgcaaccagtctttcagtgaatgccgaacctgatattccagttcgacattcatatcgttcatcatacctttggtgacatcgtagagcgctgcctgcaacgcatgaggaccacgatcgggatccgtcagcgccctggtgacgcgggcctcggcaaagccgctgcgtgtgccgctgccggtatagacatcgacatgcaccgccatcgccccgttcagcgtgccgtgtgacgaaacaatcgaggcatccagaatcttcacctcagcccgaccactgctgccgcccggcacaatgcgctctttcaaatcctccgccagcgcctgcgcgggaggaaccggcgattgcggaccgagatcacccgccttcggcaggaaatccggcgtcacctgcacatccccgacattcagacgcagcttggtgagataggaataattgagcggtgcgaaattgcgcggctcatcatcgctggaacaggctgccagtgcggccatgacggccatggcggtgaggcgcagaatacgcgccgccatcggataccgcctcgctcgccgggtggatgaaagaaaggatgtccttgcgggagcttcacactgcacgttcattcgatctcttccacttgcttcagccactctgcacagccggatctttattcaggctttaccccggacctcttcccgcgcgaaccggaaatcgaggttacagaattcacaggtcatgacgatatcctgctcaaccgtcatatgatccagatcgtcggtgctgaaagtctccagaacacctgccagccgtgcccggctgcatcggcaaccaaaggcgagcgcccgtgggcgatccgctgcgacaccttcggaatggaacagctgatacagcagacgctccggtggcagttcatcatccagcagttccgaatcacgcagcgtcccggccagcgccagagcggaacgccagctttcctgatgatcctccgttatctccggcagcgcgccagtgccgccttcccgtgccacctgctccagcacaagggcacccgcccgccagccattctcagtctgacggcaggccagttgcacatgacactgcatctgctcactggtctggaaataatgcagcgccatggcggcgagcgtctccccctcaatgccgacgatcccctgatgaggctccctgtccggtccctgatcgaccagaaaggcgaaatatccctgccccagcaattgggcggcggtcgggtggggtgtttctgccagaagggcttcaagcgcttcatcgtcggtgcgggcataaccacgcagcgcgccggtatcggtgcagtccgccagcagcagacgcaacggtccgtcgcccttgatctgcacgctgaaggagccacggaatttcaacgctccggccatggcggcagcgagagccagcacctgaccgaccagctccgccacaacgggcggatgatcatggcggttcaacaaggcatccgccaacgggccgagccgtaccagacggccacggacaggccggtccgggatgaaaaaaggcgtcataccacgcggcacgacgatatcggggacatctggacgtccaccatccagaaatgcgggtgtgtcggacatgagacgctaaataggcgctgcctgccttcaccgctactgtcttgtgatggcatttctgcaccagcccgacgcatagggtcagtacagggaggctgatatgcatgatcatggacgggacatgcaggcacatcagccattttcaggtcagataggaatgcaccagcctgatcagttcctcagccgcctgagaggagtcccgtgcgttccgggcgtcgatgatctgctcccggatatgatcctcaatgatttccgcgataaatccatccatcgctccgcgacaggctgtcgcctgctggatcagtctggtgctggcggcaccctgttccagaaccgcgcgatgcaacgcatcgacctgcccgcgaatacgcttgagccgtttcaggagtctgattttttcatcggctctggaagggatcgggatagtgtcggggcttgatctcatacccccatgggtatacgccaaagcccgtgatggatgcgaggctttcctgtcgcgcaatcagccacgacttcgcgaccggctttcaccggtcatgtgcaaccagtcagggatcaccatgaacccgcgatccagcagccagcccccggaaggcgacagtaggcatttcacgcctgcactgacgattccgacgggctggacatcatgcccgggtgtgcatggaacaccgatagcaaggcgtccgcagggctgagaccatgcgccgccgatctttcggcggccagacactcccgagcttcagcaaccgcttgagcaaaaaggaggtgtctgtgatgagcacccttcttcatatcgacgatctgcaccgtcacctgacgctgctgccggaaacgcttttccaaaccggccaagcccacgggcctgcccatgggccagcgatgtcccgtcccatcctgcgcgctcaatggcatgtaggggaggatggccgtccggcctgcaggtgggcagccgtcacgccacccagatcgcatgcagcccgctaagacgaacgtccggctgaactccgggcctgaaagattccatcaggcccggagccaactgtcagatggcgtattcgggcggcggcagagtttgatccatagtcagtgccggcatgccctggttacggggcccaaccggatgcgcgggcacacccacgacagtggtatagggaagcaccgaatcgagcacgatactgccggcgccgatcttggcaccttcaccgatcgtcacattccccagtatcttggcgccagccccgatcagcacgccacgccgcactttagggtgacggtcaccggtttctttccccgtgccgcccagcgtgacctcctgcaggatggaaacatcatcctccaccacggcagtctcaccgatcaccagaccggtcgcatggtcgatcaggataccatgacccagccgggccgcgggatggatatccaccgcgaagcattccgacatacggctttgaaacacccgcgccatatgctcacggccatgggtccagagatgatggctgatgcgatacgcctgcagggcctggaaccccttgaaaaacatgaacggggtcagaaggtccgggcaggcgggatcgcggtcccggatcgctgtcaggtcgatgatcgcgctttctaccagagacggatcggtctcatacgcatcgccaatcggccccagcaactggtccgccggtatccacgcattgcccagcttatgggcgatcaatgcgccgagggccgccgggaaacatccatgcaccagtaaggcacgttccagcccggccgccatggccggatcggtcagggcgatctcccgcgcttcacggcacaggttgaaccacacatcctcgacatggatcgaaccggcggaaatccggcggcataaggcagcagtggctggggacatcgtgtctcaccggatactatcgttgcagggaaaggtaggaagcccaccctctccctgccagtgcctgacggcgtggcttcacgctatcgtagcattcccatggcccagaccagcacgcctttctgggcgtgcagacggttttcggcctcgtcgaacaccacggaatgaggaccgtcgatcacaccatccgtgacttcctccccacgatgagcgggcaggcaatgcatgaacagcgcatccggtgccgccagcgccatcagcgcctcatcgacctggtagggacgcagtttctcgtgacgaccggacggatcatcggacatgctgacccagcaatccgtcaccacacattgcacaccggcgaccgcctctttcggatcagccaccagcgtcacgtcaccgccattatcgcgcgcccaggcgacgatatcggcgtgcggctgaagtgtgtcggggcaggccagacgcaggctgaacccgaaccgcgccgcagcctcgatccagctgtgcgccacattattgccgtccccgatccaggcaacggtctgacctgcaatcgggccgcgatgctcttcgaatgtcaggatatccgccatgatctgacagggatgagacagctccgtcaggccattaatgaccggaacagtggcatggcgcgccagctcatgcaatttcgtgcttgatccggtacgcagcatcaccgcatcgacatagcgggacagcacccgcgccgtatcggccagcgtctcaccacgcccgagctgcatttccttgcccgagagcataatgacatccccgccaagctgacgcatggccagttcaaagctgatgcgggtccgggtgctgggtttttcgaaaatcaaggccagtgtacgccctgccaacgggcgagaggacgtatcggcgcgcttgaacccggccgcggcatccagcatgcggcgcagcgcatccggctcaatgtctttcagatccagaaaatgccgtacacaggaagcatccggaccggctccggcagccactctggcggacatgctcatgatgcactcccccccatttcacgcgcaaatgtcacggccgtctcacggatgatcgaaagagccgcatcgcaatccgcttccgtcacaaccagcggaggcgccagacggagcacgttttctccggctgccacgctcagcaaaccgttttcacgtaacgcttcctgtacggccgtattggcgggaccgcagagcaggccaagcaacaggcctttgccgcgcacctccttgaagatatgcgggtaatcccgcgcaatggcttccagcccggtgcgcagctgctgcccgcgttgctggacggcatccagaaatccgggcgccagcaccacatccagcacggcattggccgcggcacaggccagcgggttgccaccataggtggtgccatgtgtaccgggcgtcagatgacgcgccagtgcgtggcgcgccagcacggcccccatcggaaaaccgcccgcaatccccttggcggaggacatgacatccggcgcggcatcacccgcccattcatgcgcccagagccgaccggtgcgtcccatgccgcactggatttcgtcatagccaagcaacagcccatgctcatcgcacaacgcccgcagctgacgcaggaaatcgagcgcaatcacacggataccgccctcaccctgaacaggctcaatcaggatccccgccgtttccggagtgatagctgccctcactgcggcgatatcgccggggggaacctgatcaaacccatcgaccgccgggccgaaacccgcctgatatttcggattgccggtggcggagagcatggccagagtccggccatggaatgccccctgaaaacagatcatccgccagcgttccggatgcccggtctcgctctgggtacggcggatcagcttgaccagcccttcattggcctcggccccggaattgcagaaaaatgcggcctccgcgaaggagtgcgccgtcaagcgctcggccaggcgttcggcttccggcacgcgatagaggttggagacatgcatgaccttcgccgcctgcgccgcgatggcaccggtcaggccgggatgcgcatggccgagggaagaagtcgcaattcccgctccgaaatcgagatatcgtcggccattcactgccgtcagccatgcgccttctccccgctcgaaagcgaggtcggcacggttgtaattcggcatcagggcggaggtcacgaacagcgtccttgatatttcgatttttaaattccgattttccgcgccttgagtaggtaagtcaattattctgaccgcatatcggatgccgaacccttcgcaagccaataaagccaatgtccttacattctcctccgcttcctgatgaagctgcgttgtacgaagcggctctacgctatctcagccggttcgcggctacccggaccggggtcgcccgcatgctggaacgccgtatcaagcgatggtcgcgcatgatggaggggaccgatatggatcaggccgcgctgcccgatgccatccatcaggcgcaacaggcggcccggaaggtcattgagcgcctggaacgcagcggcgtgctggatgacgccgcctttgccgccgcccgcaccagcagcctgacccgcgccggccgctcccgccgcgccgtcgccgcccatctggtggccaagggggtaccgcctgagctggtggcacagagcctgccggataatcccgagcttgaactcgccgctgcggtaaagctgacgaaacgcaaaaaactgggaccatttgcggtagaacgaacaacaccgacaccacaggcccggcaacgtgcgctggccgccatggccagagccgggttcgatggaaggacgtctcaacaggctttaggtatggaacgggaggaagcggaagctttactggagacgttgcgctcagggatttaaagaatgcatcgacaagaaatcacctgagtgcacactccccatctgacgcagcatcactgcaccaatcctgctctgttactctcagtcagaagcagcaacagccctcttcgaaaatgtgtagtgcctgtggccaacgtacgaaatcgcaacgggtgacagcacgccgatgaaatgggcaatatcatccgcatgccatgtcagccccacccagggaaataaaccctttgccagagcaaggctcacaccccagacaataaacaacgcaaatccattcacgacggcaaaccgcctgaactctgaagcgcgggagcgtcccgattcatcgaacacgtacactcttgccagcacataggccgtgatcataccgaacagataggcaatcggcactgccacccagaacggcatgacgagattcagaagatagcggcagccgagattaaccagggccgcgatgccacccgtcaacagaaagcgcaggaattgtcggctcatagcgcgcctttttgtcccttgatggaggcctcgatagattgcgccatcagcctgccatagcggacgctttctgaaatgccgcgatcttccgggtaataaaaacaggtatccgcgatctgaagccccttcacctgggtctggacaggcggaatctggctggcaaatcctggcgggcaaacaggctgggcatggcgcaggcggccaacacgcgcatcgatgcgatcactgtctgtcagcgcggggttaacccgctttagataggaaaatgcctcatccagcagatcatcgtccgaacgcgcccaattgggctgatcgaccggcatgtagtatggcacatacacaatcgtatcaccggtcgagcgcagattggagaactccacaaagccgggaatacccatcgccggatcaaccacattgacccagaaatgaggggtaacctgtttgcgcagtttaaaaatcaggcaggccacaccgatattcagaatatccgcgtagcgttgccggtccggcagatcgggcaccatctccgggattaacggcgtgggcacagtgagaatggcggcatcacatgctatttcctcgcctgcaacgaccacaccgcttacacgaccctgattggtcagaaccttctccaccggggcatgcaaacggattttacctccgcctgcctctatggcttgcacaagccttgcaatcagcgtttcggagccgccctcaatatagccaagctcctcctgcatgatggaacgtcttgaggtgccgacacgcttgatgcgtgtccagatccatgccgctgaaacaggatcggcgtattgatagaatttcagatcaaacagggagcgccacaatttttgataaacgctctgcccgcaccatgcctcgatccatttctttgcagacatgttttccaacgagcctgcggatttccgtttggtggccagaaacatcatcaggccataacggaatttttcaatcagcgtgaggccgggaaatttgagcagcgcaaccgggttaccccattcgctcagttttccctcaaaaaaataacccatgctggttggcatccaccgcattttatggccgatacccagctcctgcatcagatcgaaagtcggctgatcggatttgcagacaaaatgataatagcgttccagagacaggccgccgaaatcgaaatgcgccgccataccgcccggcaccgcatccgcttcataaacggtgacatcatgaccggctttcaccgcatgataggccgccgccaatcccatggcacctgcaccgacaaccgcaacacgtgccatctctcagaactccagagcaatctgcgcataggtcgggtcacggaaagtcacttccagcgccttgctcagcttcgtgggctgaacaccaaaaataccgggccagtcgatgacttcaaaaatatccggcgtcaccagagctttcaactgactggcggtaaaaggcggattgctgttcaccagcgcatagatcttgagcaacagccagaacagaccataaggaatggtcacaatccgcgcttttgcacccgtggcggttttaacggcccgcatcaggtcgatatagtcgatacgctcccgcccggtgatgttgaaggcagagccgtgatgcggtttctcaagacaggcactgataatgtcacaaaaatcaccgacaaacagcggctggcgcagatagcgtccattccccggaatcgggaaaaccggcacctttttcatgaaccgggccagccagcccagatgcttccggtcgaaccagccgaacatcaatgtcgggcgcaaaatggtgacgggcaggccactttcgacgaccagcttttcctgcgcttttttcgattccgtgtaaaaatcccgtgccgccgaattcacgaccgacgaggaaatatgcacgacattgccgatacccgcttttctggcggcagcaataaccttctctgtcgccgtaatattattggcgataaaaggctcctccgtcagcgcaccgatctgcgcgtgattcagcaccagcgcatcagccccggaaaaagcatcctgccaagggccatcttctgaaagatcagcctcaatgacctcgatcccgggatggagcttacgcagcaacgcggtgttggacggatgcttgtcgatagcaatgatccggccagcctggcggtccaccagacgctgaatcagattttgtcccaccagaccagcagcgccggtgacgataatcgtccgtgtcgtattcaagtgtcgtccctttacaggcgggtcttgtggaaaatacgggcaggcactgaacggatcaccaacatgatcaaacgccagaatcccggtgcataaacaatggccttaccgttttctgcagcgcccacaatgatctttccaagctgctctgcactggcccaaagcggtcctttggaaaagcctgccgtcatgggcgtgtcgacaaaacccggcttgatgagaacagcgcgggcaccactgcgggcaagccgatgggcaataccctgtaccaacacaccaagtcctgctttcgctgcaccatacacatagttcgactgccgcccccgatcccccgccaccgagccgattacaaccagactgccgaatgtctgtttctcaagcagattggacgctgcctgacaccataaagcagcactgacgaaattcacctgcagcagatcggccaaagcattcgggttctgctccagcattgtctgatcgccgagcactccataagcgagcagcacgatatccagccccccaaaccgggctgcaatatcatcaagcacagcaacagaatccgccttcgcgcagtcacaggcaaccgtcacgatttcggaggctccccgtgtggccagatcatcggcaatcacggcgagccgcccctcatcacgagcaagcagcccgatccgtgcgccctgcgctgcccagagacgcgccgcctcctgtgccatggcagaagttgcgcccagaatcaggacccgtttaggtgctctcattgcgacacacgctgccagaaactggacgtcatgaccggatccttatgaggaagaaattgatcgagccggggaaaagactgtctgaacatgccggcactcatccgcccgtctttcgcagggtacaacgccccgcccgcttcccggacgatctcatccagccgcagcagagtggccaaagtcccggctccccggaaaggaaaatccaacgccagagtggcaccgggacggggaaatgataacagccccggtgatactttctcaccgaacgtcttgagcacggccagaaaagaggcttccccgctgctggcgatggcatccagcaacacgggcatggccgcacgggcggtctcgaacggaaggacgcattgatattgcagcatgccgcgcgcgccatacaggcggttccaactgcggatggcatcaagcggataaaaatgctggctgtaatgctggacctgttttccggctttacgctgatgggcgcggtagtacagttcgttgaaggcacgcacgctgaagcgattcagggcgaagcctggtgcatccagcggaacggatttccagctgcgatcatcatgcgggtcaaggcgtccatcccgcctccagttggcacgggtgaagatgccacggcctgcatgcgggccgcgtgacaggcagtcaatccaggcaacagtgtgttcgaacccccctgcgctctcggccgccagatcccagaaagcatcgatattcccataagggatggtttctacatccagccatgcgctggcaatcggggagagctgcaactccacccattcgatcacccctgtcagcccaagccccccgagcgtcgcagcaaacaggccgttatcacttcttgcctcaagcacccggcgctctccattacctcgcagcaggccgagcgcccgcacggagcaaccgaaagagccggcagaatggtgatttttgccatgcacatcattggcaaccgcgccaccaagcgtcacgaaccgcgtaccggggctggtcgcggtaaaccagcccttcggtacggtgaagcgcagcagatcggacaggctcatgccggcatccgcccgcacgatcccgttttgtgcatcgaaatggataaagcggttcagcccggtcatctcgatcaggcgaccgcccgcattcaacggcgtatcaccgtaggaacggcgcaaaccaaccgccaacagactggagctatcactctccggccctgtcaggctggacaacgcggcaggaaaagtcgggcgggcgacgtaatgcggctcacggaccacgcgtccccaggagcagatatccgtccgcagaatgaatggagaagcagccatcatcaaaccggcacaatggcagccagaaacaaggctattgctgtcgccccatagaatagcgacacacgatccttcagagcaaaagcgacaggatcatcctgcagttcctgacgctggcataacagccagatgcggcccaggaacagaaaaatgatcatgggaaagccccataacagggcggggtgacggtaaaaactcgcctgaaacgcttcgtcgatcagatacagtaccatgatggcgaccgcccccatgctggaagccaccccgagcgccagaatcagcggcgcatccacggccaggtagccacgtccgagcactttctgatgaccatgctgcaccatgcgcatcacctcggtatgtcgcttcaccagcgacagggagaggaaaataaacatggaaaacaccagcagccatggtgccaacgcaacaccggtcaccacctgcccgagcacaagcctcattgtaaacatgcctgccagcaacagcacatcaacaatcggctcgcgcttgaacttataggaataggcgaggctcatgaccagatagatggcaagagtcacgatggcaccgacaccatcggcaacggcaaacagcagagccgccaatccgcagaccatcaacaggaacaggccgtcatccagtggtaattgcccactggcaagcggacgctttttcttcgaccagtggcgacggtcctcagccagatcccacatgtcattggcgatataggtgcccgaagcgagcagccccatcgccatgaaggccaatatggccgccccccaggcatgggccgaaaaaatttgtccccccagcaccagcggcacaaaaaccagagcgtttttggcccattgatgaagccgcgccgcccggcggagaacattggcgcgttggccggatgggcggatatgggccaccaccggcgtatcaggctgaaccttgcttctcaggcgcttgccgcgctcaacgatgacagcagcccgggcagatcgccacacatgaagatccgcttcggaatcacccgcatagatgaagccatccgggtagcggcttgtcagggcggcagccttggccgctcctttgagattaccccgatcatcagaggccagaacctctgaaataaaaggaaaccgggcgcttattttctccgcaatagcccgattggcagccgtcgccaggacgattttacgcccttttgctgcctcccgctccgccagcgcaatgataccgggggtcgcaggaagggcatcgatatcctcctgggtcagtacctcggcaaagcgctgcttgaactgcgcacgaccggccatcacccagagcgggagcctgacaagatcagaaggcgtatttttcagatgttgcagcagagattcatgcagtgaatcagtagcaatcagtgttccgtcaagatcaagtacaagaggaattgaaatatcctgatccaagtaagcctcttgcattgaaatgtagaaaccgtggcattgcacgggcaagcccgttaaagagtatcttaaacttgcctgttgtcagggggaagcgacaccggtcgcataaaccaccctctgccacgattcataaggctggcggcagtgtaccccgcctgccagcctggggttttattttttcagcccgttcatctgactgttcatctgggccatattctgtttcagcatcgtctccatctgcttacacagtgctgtgggcgtggtctgttgccgctttgccgcatcctctatcgagattgtctggccacccatggagacagtgccacctttgcctgtctgctcagcggccgcttcgcctgcatcggccgggggaggcagcatggcgatgattttgcgctgaatatccagcgtctccgcactgatatccccgcgtgactggcaatattccaacacaccaagctgattggccgccgccagacgcacggctttcatatcagcggtgggagcaggaatggccgaaggtgcatcagcggcctgtgccacgccgatgctgaacaggcccgcgacaaaagcgggtaagacatgacgggtcagagtcatggtcggcgtctccctaatgttatttttcagtcctgacgataaagtctaacgccctctcggtcagccctgttgcagatgctccgggatcaccatgcccaatcggacgggaatgttccagcgctcggccatctggcggtagggatgaaaaccgacctggcgatacaacggcagtgcccgtggatgatcagcgttacaagtattcaccgtgacataccgcgttgaaccggttgcccatgccatatccaccgcatgccgcagaaaagcatggcccagcccgcgccccacccagcccggcatcaggccgaaataactcagattgacggaaggcgcatagcgcgcatccagctcataaaatccggctgtctgcccgtctgcttccaggacgaacaccccaatttgcggatcagataacagagccgccagatcccggtccggcatgacacgacggagccaccacagatagggcgcccccaccgtcgcgtagagaaaccggtagaatgcaaggtcaggcgcaatgacccgcacgacgcgcatcccctcaggcaatgcaggggccgggacggcaggcgggcgatccatccgcagaaacgtcaccgtcacatgcgcgcggatgaccggttcggaaccgctcatccggccatgcccgcgccccaggacacacccctgccgatcaatcgtccaggaatgagcgcagcttacggctgcggctggggtgtttcagcttgcggagcgccttggcctcgatctgacggatgcgttcacgcgtcacgttgaactgctggcccacttcttccaacgtgtgatccgtattcatgccaatcccgaagcgcatgcgcagcacacgttcctcacgcggggtcaggctggacagaacgcgggtggttgcttcacgcagattggcctgaatggcggcatccagtggaatgatcgccgccttgtcctcgatgaaatcgcccagatggctgtcttcctcgtcaccgatcggggtttcaaggctgatcggttccttggcgatcttcagaactttccgcactttttccagcggcatgccgagcttttcggccagttcctccggctgcggttcacgcccgatttcatgcagcatctggcggctggtacgcaccagcttgttgatcgtctcgatcatatgcaccggaatgcggatggtgcgggcctgatcggcgatggaacgcgtgatcgcctgacgaatccaccaggttgcataggtgctgaacttgtagccgcggcgatattcgaatttgtccaccgccttcatcaggccgatattgccttcctgaatcaggtcaaggaactgcaaaccgcgattggtgtatttcttggcaatagagatcaccagacgcagattggcctcgatcatctccttcttggcgcgggcgctatcgcgttcgccgcgattgacggtcttgtaaacacgcaggaattcggggatcggcagtccggcatccgccgcaacctctccgatccggccccggatctggccgacttcctgcgggtagcgggccgaaaaattcttccatgccttgccgggcagggtagagacacgctccagccagttcggctccagctcatgattacggtgctgttccaggaaggaatcacgcggcaccttacagctttccgccagacgcagcagttgcccttccagtccggtcagacgctggttgagctgcttgagctgaagaaccagttcctccacgcgtccattatgcagccgcacctcgctgaccttcgcgaccagttcatcacgcatcttttcataggttttttccgagcgcgcggtgacttcctcgccggaggtaaagctgtcgagacgctttgactgcatcttggacagttttttgtagatcgcctcgatttcctcgaaccgttgcagggtctccggcttcagcttttcctcaagcgcggagagagacataccgataccgtcggcatcgtctccatcctcggattcttcaggcgggggcggcggagtgaaggcttcggcatctgcctcgccttcctcggcaccttcttcaccaccctccaccacaccgggcggcggaccgccctgcgtggcttccagatcgatgatgtcacgcagcagcatctcaccggccttgagacgttcatgccaggtgatgatggcgcggaatgtcagcgggctttcgcacagcccgccgatcatcatgtcgcgaccagcctcgatacgcttggcgatggcgatttcgccctcgcgcgacagcagctccacgctgcccatctcgcgcagatacatgcggacggggtcatccgtgcggccgaggctttcctcgtccacattgccggagcgttcctcatcctcggtttcttccgcccgttctgcgcgggcagcgggttcgccgctttcctcggtctcttcactctcgacgacctgaatgcccatctcgctgagattggccatcacgtcctcgatctgttcggagctgttctgctccgacggcagaaccgcgttcagctcgtcaaaggtgatgtacccccgctccttgccacgcgcgatcaggcgtttcaccgatgcggactgggtgtcgagcagggtggtttccacatcctgttccgacgacgcgctctccgcggtagcagcctgcttcgttgccatcgatcaaaccactcctcaacacatcacaggcgagcccgatacggaaacccggggcttatgcctcggcatcatccgattcgcctcgccttatcttatcacgcgcctgaaccagtgccgtcaggcgccgctggctctgctcgtccccatgttcatcccacgcatgctgcgccgccatgacttcctgatccagacgatcccgatgcagaaagccaaaaatatgccaccatgccgcctcggcctccgccggcatcaccgcgccgccggaaaccgcacagattggaagcggaaaaggatgaggcgcgaaaacgcgctccacctcccgaccaagccccgcgcgttgcaggtggtctatcagaccctccgagtcaagcgggtccgtatgatccggtatcgtaaggatcgcccggcgcaccctgtccagccagtccggcagatcgagcgtggcgaaagcttcttccacatcatgcagcaacgccggatggctgagcagaatggcggtcaagatacgcaagcgttcgatcccggccatttccgccgccagagccggatccagacgattcggcgcaggctgagtaagctgccagccgcttccccggctgcctccgccataatttcctcctcggcggggggctgcggcaggacggcgcagcgcataaaatttttcgcgcagggcagagcgatattcagccgccaatgtcttgtctgcaatgcgggcagcggcatcgttcaggcggcgctgaaacaccgcccgttgctccggcgtctccagcgcctgcccttcccgcagcatggcgaacagcgcatcggcaaagctgcgtcttcttgcatcctccagcacggcggagaaagtatcggccccacgggtgctgatcaggctgtcgggatcttctccgggaggcagccgcgccacatgcagggtgcgctcggtcgtcagcaaaggcagcgccagttccgccaccctcaacgcagcccgcgcaccggcggcgtccccgtcgaaacacaggatcggagccggggaaagttgccacagcgcatcaagctgctcctccgtcagcgctgtgccgagcggagccaccgcaccgctgaacccggcctgatgcagggcaatgacatccatataaccttcgacggccaacaaggccgcaccgccgcgcaccgcctcccgcgccagatccagcgcataaagtgaccgccgcttggaaaaaacggccgtttcagggccattcacgtatttgggctgtccgtcgccgagaatacggcccccgaagctgatgatccggccgcgccggtcgcggatcgggaacatgacccgctcatgaaactggtcccacggacggcgagtcggaccgtcctcatccagtcggagcaacccggcctcggcaagttgctccggtgtaatgccctttccggccatagccatggccagactgcctcgcacgggcgcccagcccagaccgaaacggcgtatcgtcgcctcgctcaagccccggtccagcagataggtcaggccacgctgaccctccggctttgataacagggtcgcataatagtcacccgcctgcgccagaacctcatgcaccccggcacgggcctcggcctgccgggtttcttcccggctcggcttcggcatatccagcccggcctcggcggcaagctgctccaccgcctccagaaaaccggccccctgcgactgcatgacgaaactgacgacatccccatgcacaccgcagccaaagcagtggaaatggtcgtcatacacgtaaaaagaaggcgttttctcgccatggaagggacagcagcctttccagttgcgtccggctttgctcagccggacgcggcgaccgatcaccgaagcaatcggcgtccgcgcccgcagctcatccagaaaatcaggcgacaaagccattccggcacgcccccatgcaggaggttccggctttagccgttcaggcgcgctttcaccagcgccccggcggctgccatatcaatagtggcagcatatttcgctcgcagcaccgccatgaccttccccatatccttcacgccgacagcaccgctttccgcaatcgccgcatcaaccgcggaagcggttgcggcctcatccatggcctgcggcaggaagctttcaattactgcgatttccgcctcttccttttccgccagctccggacgattgccttgaagatagagagtgacgctctcccgccgggatttgatcatgccacgcatcatcacctgaagcgcggtatcatccactgtttcccctttggcccgcgcctcgatatcctgttccttcatcctggcgatgatcagccggattgccgcaacacgcgccgtgtcaccgctcttcatcgcggttttcatctggtccatgaaatcatcgcgcagggccatggcgggtctccatctggtatttgacttcccgaaatcgggaggcaagaaaaattatgccgaaagtgggaaattatttcccaatcgcttctgggtgccttatattagcacgcatgacaaccagtgtagacgatatcatcgaacgcctgggcggcgcggacggcgctgcacgcaggctgggcgtgggcacggaagcccttcgcaaatggcgtcagtcccgctcgatccccgcgcgccactggcccgcattgatcgagtcgctgggcattacgctggaggatattcccggggcaccagcccgcaccgcgctgacagaagcccccccggaaggggccaccgccgttttggcgctcagcgatggcaccctgttctggggacgcggcttcggtgcgtcgacacaggggacacagcctgctgaaatctgcttcagcaccgggctgaccggatatcaggaaaccctgaccgacccctctttcgccgggcagatcatcaccttcaccttcccgcatatcggcaatgtcggcgccaacaagtatgatatggaggccgccaccatcgcggcacgcggactggtggtgaaggaagacatcaccgccgcctccaactggcgggcggaaaccagcctggacgcgtggctgcagcatcgtggcatcaccggcatttcaggcgtggatacgcgcgcgctgacattgcgcatccgcgatcttggcgcaccgcatggtatcatctccttccctgcggacggacatttcgacattgcggctctggtagaagccgccgccgcatggcccggactggaagggctggatctggcgaaggatgtctcctgcacccagagctatgagtggtccgaaggcacctggtcctggcccggagccttctccgcacccacgccgaagcatcatgtcgtggcggtggattacggggcgaagcgcaacatcctgcgcagcctcgccaatgccggatgccgggtgacggtcgtaccggccaccgcctccgccgaggatatcctgcggcacaatccggatggcgtgttcctgtccaacggccccggcgatccggccgcgaccgccgcctatgccgtgcctgccattcgcggcgtgctggaggccggcaagccggttttcggcatctgcctcggccaccagctgctgtctctggcgctgggggcaaaaacctacaagctcgatcttgggcatcgcggggccaaccagccggtcaaggaactggccaccggtcgcgtggagatcaccagccagaatcatggttttgccgtggatgcatcctccctgcctgccggggtggaagtcacacatgtcagcctgttcgacggctcgaacgagggtattgccgcgccgtcgaagcgttgcttcagcgtgcaatatcatccggaagccagtcccggccccagcgacagccatcatctgttccatcgtttcgtggatatgctgggatcgtaagatcccggcccgcgcgcttttttcaggatagcccggcctgttcccgccgggttcgccgcccggtccgatgcgggcggaaaggagaattccggccatgccgaaacgtacagacatccgctccatcctgatcgtcggcgccgggccgatcgtgatcggtcaggcctgcgagttcgactattccggcgcccaggcctgcaaggcactgcgcgaagaaggctaccgggtcattctggtgaattcgaatcccgccacgatcatgaccgaccccgatctggccgatgcaacctatatcgagccgatcaccccggatgtggtcgagcgcattatcgccaaggaaaagccggatgcgatcctgcccactatgggcgggcagaccgcgctgaacacggcgatgcagctgcatgccagcggcgcgctggagcgccacggggtggagttgatcggcgcaaaggccgatgtgatcgaccgcgcggaggaccggctgaaattccgcgatgccatggacgaaatcggcatcgaaagcccacgcagcgtcatcgcccacacgctggaagaagcccgtgaggggctggcccatgtcggcctgccggcggtaatccgccccagcttcacactcggcggcactggcggcggcatcgcctataacaaggaggagttcgagcagatcgtcacctccggccttgatgcctcccccaccaccgaggtactgatcgaggaaagcgtgctcggctggaaggaatatgagatggaagtggtccgcgacagcgcggataactgcatcatcatctgctccatcgagaatatcgacccgatgggcgtgcacaccggcgacagcgtgacggtggccccggccctgaccctgaccgaccgcgaatatcagcgcatgcgcgacgcctccatcgcctgcctgcgcaagatcggcgtcgataccggcggctccaacgtccagttcggtgtaaacccggctgacggacgcatggtggtcatcgaaatgaacccccgcgtgtcccgttcctccgcccttgcatccaaggcgaccggcttccccatcgccaagatcgccgcgaaactggccgtcggctatacgctggacgagctggcgaacgacatcaccaaaatggaaatcgacggccagcttcgcactaccccggccagtttcgagccgaccatcgactatgtggtggtgaagatgccgcgcttcaccttcgagaaattccccggcacgcccgctctgctctccaccagcatgaaatcggtgggcgaggcgatggccattggtcgcaatttctctgaagcattgcagaaagccttccgcagcatggaaaccggcctgaacgggctggatgacattacgcttgacggcgaaggcccggatgcgttccgcgccgccctgtccaccccgcgccccgaccgtattctggtcgccgcacaggcgctgcgccacggcctgtcggtcgaggatgtcaacgcggcctgcaaattcgatccgtggttcctgcgtgaaatccagaagatcgtcaccaccgaagcccatatccgcgcccacggcctgccggagaacacacgctccctgcgcgcgctgaaagcgctcggtttttccgatgcccgcctcgccgtcctgaccggcaagaccgaagcggatattctggcccatcgcgagaagctcggtgtcatgccggtctacaagcgaatcgacacctgcgcgggcgagttcgcctccgccacctcctacatgtatggcacgtatgagggcgggttcggggccccatcctgcgaatcaaatcccaccgaccgcaaaaaaatcgtcatactcggtggcggtccgaaccggatcgggcaaggaatcgagttcgattactgctgcgtgcatgcggcctacgccctgcgcgaggccgggttcgagaccatcatggtcaactgcaatcccgaaaccgtcagcaccgattacgacacctccgaccggctgtatttcgagccgctgaccgccgaggacgtcatcaacctgatccgccgggaacagcagagcggcaccgtgctgggctgcatcgtacagtatggcggccagactccgctcaagctgtcccatgccctgtcccgcgccggaatcccgatcctcggcaccagcgtggacgcgatcgacgcggcggaggaccgggagcgcttccaggctctgctcaacggcctctccctgcttcagccggaaaacggcatcgcccgttcagcgcaggaagcggaagccatcaccgcccgcatcggctatccggtggtgatccgccccagctacgtgctgggcggccgggccatggaaatcgtctatgaccatgccggactgaaccgctacatgcgggaagccgtgcgcgtttccggcgacaatccggtgctgatcgatcgctatctgaacgacgccatcgaggtcgacgtggactgcatcgccgatggcgagcgcgtctatgtcgccggggtgatggagcatatcgaggaagccgggatccattccggcgacagcgcctgctccctgccgccctactccctctcccccgccctggtggatgaattgcgggcgcagacggaggcactcgcgcgcggccttcaggttatcgggctgatgaacgtccagttcgcgatcaagcgggaagccgatggcagtgaccgcatctatgtgctggaggtcaatccacgcgccagccgcaccgtgcccttcgtcgccaaggcgaccggcgtagcggtggcgaaaatcggcgcccgggtcatggccggggccagactgacggaattcgacctcggccccaccccgcgtctgccgcatgtcgcagtcaaggaagcggtgttccccttcgcccggctggccaatgtcgacaccattctggggccggagatgaaatccaccggcgaggtcatggggctggataccagcttcgagcgcgctttcgcgaaaagccagctcggagccggggtcaaactgccggattccggcagggtgttcctctccgtccgtgataccgacaagacggcgctgttgccggtcgcccgcaagctggtggagctgggcttccgtctggccgccacacgcggcaccgccgcacggttgcaggaggccgggctggaggtcaaggtgttgaacaaagtgctggaaggccgcccgcattgcgtggatgcgatccgctccggcgatattcagctgatcatcaacaccaattccggtgcgcagtcggtcagcgacagtttcgatatccggcgcagcgccctgacgcacggcgttccgaactacacgacgatggccggggcacgggccgccgttcacgccatagccgccttgcgtgaaggaacacttgaagtcgcgccgctgcaatcatactttcatcgttcgttctgatcgcccggtactgccggatacccctgctcaaagctgtggtatccggcggcacgggccgatcatgtttggacatgatccgttttttgccgaggactgacccaaagtgcagaagtttccgatgaccgccggcggcctacagcgcctggaggacgagcttcgccaactgaaatcagtggagcgtcccgccgtcatccgcgccatcgccgaggcccgcagccatggcgatctcagcgaaaacgccgaatatcatgccgcaagggagcgtcagagcttcatcgaaggccgcatcgaggagctggaggtcatcgtctccgctgcggaagtgatcgacccttccacgctgagcggcgatcaggtgaaattcggtgcccatgtccagatcgtggatgaggaaaccgacaaggaagcctcctaccagatcgttggcctgcatgaagccgatatcaagcaggggctgctctccgtctcctctccgctcgccaaggcgctgatcgggaaaaagcccggtgacaccatctccgtgccggcgcccggtggcgatcggagctatgaaatcctgagcgtccgtttcttctgagccattccatgatcggtcttgaagatgtccgggcggctgcacagcggatcgccggaaaggtggtgcgcactccaaccctgcgcaatggtacgctcagccagcttgccggtgccgatatctggctgaagctggacgttttgcaggcaaccggtgcgttcaaggagcggggtgccgccaatcgtctggccatgctctccgccggggagcgggccgccggtgtggtcgccatgtcggccggcaaccatgcccaggccgtcgcccgccacgcccagttgctggggatcgaggccacgatcgtgatgcctcggttcactccggccaccaaggtgacccgcacggcgcaatggggtgcgcatgtcgtgctgcacggcaagaccctcgcggaagccgccgagcacgcctgggcgctcgccgcagagcggagcctgaccttcatccacccctatgatgatgaaggggtgatggccggtcagggtacccatgcactcgaaatgctggaggatgcgccggatctcgatacgctgatcatccccatcggcggcggcggactgatcgcgggttgtgccgtggcagccaaagccatcaacccggccatccgcatctatggtgtcgaggccgagggatatgacgcgatggtgcaggccctgcaaggccgcgcggtcgaggtcggtggctcgaccatcgccgagggcattgccgtgcgcgatgtcgggcagcttccgctcgacgtggtgcgcacccatgtggacgatattctggtcgtcacggaagtcgcgatcgaaaacgccatctccctgctggccgaaaatgccaagatcgtcacggaaggagccggtgcgacaggtgtcgccggactgctgtccttccccgatttgttcaagggccgcaaggtcgggatccccctctgcggggccaatatcgacagccgtattctggcccatgtgctgcaacgcgtgatgctgcgggacggacgcctgatgcgtctggtgctggatattccggaccgtcccggcgtgctggccgaaatctccgcccgcattggcgattccggtggcaatatcatcgaagtgtcccatcatcgcctcttcacctcccccagcgtcaagtccgcaaggctggaaatcatgttcgaggcccgcgaccccgaacatggcgcggccgtagcggcagagctggagaagcattacaccgtcacccggctgtaagccttcctcacacgctcaggagttccgtcacgatgtccagcgccgccctccatttcgatctgctggtccggaacggtcgctgcattctgccctggggggaggcacagacggatatcggcatccgggatggtgtgatcgtcaccctctccgcccctgcctccgcgactgccgagcaggtgctggatgcatccggcctgcatgttctgccggggctgaccgatccgcatgtccacctgcgcgaccccggcaatgccagcgtggagaccatcgaaaccggcacacgcggcgcggtgctgggtggtctgacggcagtctatgacatgccgaacaccagcccttccatcatcgatgcggaaacggtgcagtggaaacaggggcatatcggccagaccgcctggtgcgacatggggttctatgtcggcgccaccaaagccaacattcaggatctggctacgctggaacatcagcccggtgtctgcgcggtcaaggtattcgcgggcagttccaccggcgatctgctggtcgaggatgatgccagcatcgaagccgtgatgcgcagcggccatcgtcgtatcgccttccacagcgaggatgaataccggttgcaggagcgccgcccgtcattttccagcgggatgccttatgtaaaccacatgatctggcgggatgaggaatgtgctttcctcggcacgcgccgcatcatggcgctggcacgcaagacgggacgcccggcacatatcctgcacacctccacggcggaggaattcgagtatctgaaagatttccgcgatgttgccaccagcgaggtgctggtgaaccatctgacccagattgctcccgaatgctacgagacgctcggcggttatgcggtcatgaatccgcccctgcgtgaccggcggcattacgaagcagcctggaaagcggtcaatgacggtctggtcgataccatcggcagcgaccatgcgccgcatccgcgggaagcgaaggagcgtccctggcccgactgcgctgccggtctgaccggggtgcaaaccctgctgccggtcatgctggatcatgtgtcagccggacggctcagcctgacccgtctggtcgatctgctggcggccggtccggcgcgcgtgtatggcgcgattggcaagggacgtctggctgtcggctatgatggcgacctgacccttgttgatatggggcggcagcagcggatcgaagcgtcctggctcgtttccccctgcggctggagtccgttcgaaggcagattatgtcagggctggccggtcgccaccgtgctgcgcggtcatgtcgcgatgcgcgatggcgcattgcagggtgaggccacaggccggctgatctccttcctgccgtaatctctctgattggagagggacgtgccggtcagcgttcaggagcgtccttcgtctccggcatcagtgcgacggcgatcatgctgatcagggcggcaacagtcagataatatccgacccagtgcagaccacccagatcggacaggcgctgtgcgatatacggtgccagcgatgcaccgacaatccccccgaggctgaatgacagcgacgctccggtatagcggagcttcaccggaaacagttccggcaacagcgcgcccatcggccccagcagcataccggtggtcatcagcccggcgcaaagaaacaggaaaaccgcttccaccctgccactgccgagggccgggccgagcaggcagcccagcacccctgccagacccatcaccgccatcagcacgggccgcctgccgtaacggtccgcaagcagggccgcgagcggtgctcccaccaccatgaaagcaatggccacacattgcaggcccagaaataccgggcgggaataatgcagcaccgtggtgccatatccgaggatgaacacagtgcagagataaaacagggcgtaacagcacaccatggagagcatgccgagcaccgtcgcccgcccatgcccgatcagcacggcgcggaacggcactgcaaccggctccttccgctccagcacgcggcgaaaagccggggtttccgtcagcctcagccgcacatacagcccaaggatcaccagcaacagcgacagcaggaacggcacccgccagccccagctgcgaaaggcttcgtcactgagcgtcagggccagaatcaggaacagcccgttggcggcaataaatccaatgggggcacccagttgagggaacatgccgtaccaggcgcgttttccctccggcgcattctccatggccagcagagcagccccgccccactcccctcccaacccgattccctgcccgaaacgcagcaggcacagcaaagcaggcgccagagcgccgatcctgtcatggccgggcaataatccgaccagagccgtcgaaatgcccatgatcagaagagaggcaacaagagtggatttacgcccgatcctgtcgccgaaatgcccgaacagagcggcccctataggccgggcgacaaaggcaatggcaaaggtcgcaaaggcattcagcaactgcgccgcgggggaggccgccggaaacatcaacggtcccagcaccagtgccgtcgccgtggcgtaaatatagaaatcatagaactcaaccgccgtgccgataaaactggccaccacgatgcggcgcagcggcacggcctccatcgcagcctctgcactgatgttgccggatgctgtcacagaatatgccgactgggtcataaaagctgcataccgttgcaaaagaagcctgtcgcctgaaaatcgcaccgcttccccaacattgttccagaaaaagacggattttccggccgagatgccctgttctgcgtcctcgccgtttgctccggaggcttggcgcggctatggtccgcggccattattcaggcaagcgttgccagatttgcgaggacactgcgtggccgacatctttgatgaggtcgaggaagatctgcgtgcagaacgcgccaaaaaactgctggtccgctatggcggcccggcggtcgggcttgtgctgctggtcattctcggcgccgctggctggcagggctggctttggtacaagcatcgtcaggatgccaccgcggcagagcgtttcctggccctgactcgtaatcctgtcgatccgctggcgcccccggttcacatcgtacccgatgcgaaaaccgaacaggcgctgaccgccttcgccaaggacagcccggaaaactatgcgacgctggcccggctgcgtgccgccgccctgctgacggctggcggaaacaaaaaaggggctgaggccatttacgggacggtcagcaatgataacgccgcgctcccggcgctgcgcgatctggccacactgcaatcggtctggaacaggatcgacgatggcgatcccgcgaccttgcgcgggcagctggcccccctgctggccgatggtaatccatggcagccatttgcacgggaaggcaccgccctgctcgacatccgacagggccgtatggatgatgccaggcggggccttcagacgctttcccaagacgaaaacgctcctccaggcgtgcggaaccgggcaaccggactgctcgcgaagttcggtggttgagacatgacattccgtattcgcccggcccatccatacgctcggaataaagcacccaccggcaaacgctccgctatggcgctgctggccctgtctactgtcagcctgggcgggtgcagcatgctggacagctggttcgcggcggacaaaccccctttgcccggtcggcgtgagaccgtgttgccgctcagcgatgtgctgccggtggcctcctcaccccctgcgatcgcgtttcctacagatgcacctttgcagaactggtcacagccgggtgccaatcccgcgcatcatgtcgataacgtcgccatcaaaggcatgacggaagtatggaccgcacaggtcggttccggcagcggttatcgccagaagatcaccagcacgcccatcgtcaaatacaatctggtctataccatcgacagcaatgcgctcgtacgagcctttgacgtcaagaccggtgccatggcctgggaattcgtgacccagcaggaagacgaccgcagcaccaatatcggcggcggtctgacctccgacgataccggcacgctctatgccgtcaccggacgcggcgatctgattgcgctggatgccgccaaaggccgacagaaatggcgcgtgaagatcggtgtaccatcccgctccagcccgacctatgccgagggcaagctgttcctgaccacgctggaacagcagatcgtagcctttgatgcctccaacggcaaaaaactctggtcgcatcaggccagcgaggccgataccagcctgctcggcgatcccgcccccgcctacgcggacggactggtcattggcgggttcggctccggcgacgtcatcggcctgcgcgccgccaccggatcggtggtgtggaccgacagcatcgcctccgcctccggccgcaccagcctgtccgatctgtcagccgtcaccggcctgccggtgatcgacggcaatcaggtttatgtcatcgggctggggggtcagttcgtttcgctggatctgcgcaccggtcgccgtctgtgggaacgcccggcgggcggaggacagaccccgtggctggccggagactggctgttcgccaccctgaccagccagcaggtgatcgccatatcccgcaatgatggggtcgtggcatgggaaacccagctgccgcgctggagtaaggccaataatcgcggcgagcgcgcacagtggttcggcccgatcatggcgggctatcgtctggtgctggtcagcaattacggcaaaatgatcacgctcaacccggtttccggcaagatcagcagcgtccgtgatctgtccgatgcagccgccgttccgcccatcgtcgcgcagggcacggtctttgtgatcaccgccgacggcctgttacacgcataccgttgagatgaccgatttgccccccacccccgagacaaccgacgaagcccccgcggaacgcctgcccatcgtggcgatcgcggggcgacccaatgtcggaaaatccaccctgttcaaccgtctggtcggtcgtcgcatggcgctggttgccgatacgcccggcgtcacccgcgatcgtaaagaagcggaagcgatgctacgcgggcgtctggtcaagctgatcgacaccgccggactggaagaagccccgcaggacacgatcgccgggcggatgcggcaatcctcggaaacggccgtctcgcaggctgatctggtggtgttcgtggtcgatgcccgcagcggcatcacacccgccgacacgcatttcgccagctggctgcgccgtcagaaccgtcctgtactgctggtcaccaacaaggccgaggcacgtggcgcaggcgcagaagcgctggaagcctaccggcttggtctgggcgatcctctggccgtctctgccgagcacgggctggggattgccgatctgatgcgggaaatcgccgaccggctctccaccgatgcagaccggccctccgatatgccgaaacgcaagcgccggggcgaggccgaagcgtgggaagacgaggaaaatatcgttgaacaggggcctcccaagcccctgaaactggcgattgtcggccgtccgaacgcgggcaaatccaccctgctgaaccgtctgctgggtgaggaccgcgtcattaccgggccggagccggggctgacgcgcgattcgatcagcgtcaccctgtccgatgatatcggcgagatcgaactggtggatacggcagggctgcgccgccgcgcccgcatagacgaatcgctggaaaaaatgtcggtcagcgcctccatcgaggcactgaaaatggcggaaatcgtggtactggcagtcgatgccacggaagggctgcacgagcaggatcttcagatcgcccgactggtggaacgcgagggacggggcgcggtgctcgccctgaccaaatgggatgcggtggaagatcgcggcaaagcggcccgcgccatttccgaccggttggagacaagcctgacgcagtgccgcggcattccggtggtaaccctgtccggcctgaccggatcaggcgtacagcgcctgctgcctgccgtgcgggaggcccatgccatctggaacaagcgcgtggcgaccggagaattgaaccgctggttcgaggcgatgctggaacgccatcaaccaccgctggtggacgggcgacgcctgaaactgcgctatatgacgcaggccaaggcacggccaccgacctttgtgctgtttggtacccgagcagaacaattgccggaagattatcagcgttatctggtgaatggattgcgtgaagcgttcggactgaaaggcacaccgatccgcctgcaactccgtggcaccaaaaacccgtacgcagataaataaattgggcagcatggacggcgtcccgcagaacgagcagcacagtgtccgcgattttcacggcctgacggcagacccgtttgccccggcacatggtccttccctgaccgcatcacagcaggcagcggcgcatgaaatcaccgccgcgatacaatctggccgagcgctgatcatcatcgacggagaagtcggcaccggccgcaggacggttctgacgtctgccctgtctgctgcctctatcggcgacgtgatcgaaatcgccaacaccttgctactgagcggcgaccaactccggcaacaggcgcagacagaagaagaacgcgcggccggaaccgggcagcaaccgcctttcattctgatttttcagaccgccgatacattgcaggaggctgcacaggctgccctggtcgatctgctgcaggaacggaagggcgtgtttcaggctatcctgatcggtggacaggaagcgggtaaggcgctgttggacggtccgctcggttctctggccgaaacggaacggctgcatgtcacgctgcctgtgccgacggccctggaaatgcgggatattctgcgccttgccattgagcaggccggacagaccttgtcttccgtcatgacgccggatgctgtggaactattgctgactcaggcccgtttcagcccggcacggctggcaggactgacccgtcaggcgctggtactggcgcaagaacggggcatcaggccggtggatgcttccatcatcaccatggtggcaggcagaagcctgacggctgaaaaagccaatagcaccacacgagagccgggcctgatttcgccacccatgatgctgtccattgcggtagcggttctggcgctgctgagctggtgggcagccgcccgctacctgcccgatcttgtcagggcgggtagcccatcctccgtatcagccccgcccgttccggcgcagccggagaaagtgcaacaaaccggcatggccgcaacgccggaagcacctccgccgcctccggaccgccagcctgaatcgaaagccgccgccgaagcaccctctatcacccaacccgagcccccgccttcatcctccggcccggctaacgagtatgatgatctgccccagccgccgcatccctaccggctgacgcgttccggcacgatcggcgagattctgctgggcacaatcgaccgtgatgatgatgcggcggtcgaggcattgctggaagtcaatcccggcctgacccgcagcgcccgtctgccggcgggggtgatattgctgatgccctcgatctggccggaccccctggattcggcccccgtaccgaaatcatcgtcgcggccaaaacggccgcgtcatccgcgcccgtcctggtgcgaccgggcgcatcccaccacaccggcttccatcgcctatgtgcgccagcattgcgggcggtgagaccggaatagaatggttccggcctcatcaccccgatcaggctgagcgcaaggcgcgccagccaatatcccggcgaaaaaaaccttccggccaacgcagcgccgccacggcacgataggctacgtcacgggccgtctgaatatcgggaccgcgccccaccactgtcagcacccggccaccggcaggatggatttcatccccccgccgggtagttccggcatggaacaccaacgcacccggcacggcagccgcctcatccagccctccgatcggtccggatggttccggcgtgccgggatagcctttcgccgccaccacgacagcaaccgtcgcatcgtcgctccagcgcagatcgaacgccccaagctctccgtcacaggctgccagcagtgccgccagcaggtcggatttcaggcgcggcagcagggcctgacattccggatcaccaaaacggacattgaattcaatcagttgcggaccatccgatgtcagcatcagcccggcaaacagcacgcccctgaacggtgtgccccgacgcaccatttccgccaaagcgggcatgacgatgcgtttcattgccgcatccgccgcttcggccgtcaggaagggggtgggggtgtaggcccccatgccacctgtattcgggccggtatcgccctcgcccacccgtttgtgatcctgagccccacccagcagcagcgcatgctctccatcgcacagggcgaacagcgaggcttcctcgccgatcaggcattcctcgatcaccacggaagcccccgccgcaccgaggctgccatcctccagcatggcggtaatcgcggcctcggcttcctccaccgtcgccgccaccacgacgcccttgccggcagccagaccatcggccttcacgacgatcggcgcaccacggaggcgcacgaaggcacgggcttcttccgcctcttcaaaccgttcccagcgggcagtcggaataccggcggcatcggccacttccttggtgaaggtcttgctgccctccagctgcgccgccgctgcgctcgggccgaagcagcggattcccgcttctttcagcgcatcggccaatcccgccaccagcggcgcttccgggccgggaaccaccagatcaaccgcatgatcccgcgcgaaagcgaccagagcagcgacatccgtcactggaacggggaccagctccgcatgggcagcaatgcccggattaccgggggcgcaccacagtttttccagcatcgggctggcggcaagcgcccagcacaaagcatgttcccggccgcccgatccgatcaccagaacccgcattacgatcccgccttctgcctgcgttcttcaaagctggccgcatgtagcataggctgcggccatggacgattcatccaatccacatacgacccaagaaacctctgccggcgtatccggcagccgggggctggacaatattcccgaatattcggtctccgacctgtccggcaccatcaaacgcacgctggaaggcgccttcggacgtgtgcgcgtgcgcggcgaactgacggaggtcaagcgctacccatccggccatatctatctgtcgctcaaggatgagggcggcaaaattgctggtgtcgtatggaaattcgccgttccccgtctcggcatgctgccggaaaacggagtggaggtggtcgcgaccggcaaaatctcctcctacgcggatcgttcctcctaccagctcatcatcgaccggatggagtatgcgggggccggagcgctgctggcgcgaatcgagatgctgcgtcaacgtctggcggaggaagggctgttcgatgccgcccgcaagcgcgccctgccgcggctgccgcgagtcgtgggcgtggtcagctctgaaaaaggggccgttcttcaggacatccgcacgaccatcgcccggcgctttccccgcaccgtcctgctctggccggtgccggtgcagggcgaaggggccgccgcgaaaatcgctgccgctatcgacggattcggcaggctgccgccggatgggccggtgccccgtcccgatgtgctgatcgtggcgcggggtggcggcagtctggaagatctgatggcgttcaatgaggaaatcgtcattcgtgccgccgccgcctgcccgatccccgtgatttccgccgtcggccatgaaaccgatacgaccctgatcgactacgcctccgaccggcgtgcccccaccccgactgccgcagccgagctggcggtaccgatgcgggccgaactcacggctgatctggctcacaagaccgcgcggctcggcggagcgctcagtcggatgactcagggtgcatggttggggctggctcaggccgagcgtcttctgcctgatctgcccactctgcttggtcatgcgcgacagaggctggatgaccgctcactgcgactgggcatggcgctgcccggcctactggcggcaaggcgggccgggttacgcaatgcggcgctacggctgcctcgccccgcccatatcattacccaaacccgccagcacctgcgaggggccgaaaacagtctgcgtgtcgcgatgcccatgctgctggcccataaaaggagtgccctgcggctgcatgcgctgcgactgggagccagtctgcggcacagccttcatctgcatctgggtgacgcccgccccctgttcgtccgcatgagggcagcccccctgcccggacggctgcgggaggcacaggcgcggctggacgggctttgcgcaaggctggaaagcgtttcctatcaagcggtgctggcgcgcggctatgcgctggtgctggatcatgatggccatgccgtcacccaggcggcccggatcgccagcgggcagatactgaccttgcgcttcagcgatggcgagaaaaccgtgcaggcaacacacaatccggcaggaagcacgccaccggctggaaacgacactgcctctgtcaaacgcactgccagaaaaaagtcaggcccccagaaacagggggatctgcttctgtaaactctccctcacccatgggcacgcatccggtagagcaaacgcgcgatggcatcgagtaaaaatccgagcaagccgatcacgagcacgaccgccgtcaactcgccatacgccatgcggtctctggtatcgagcacgaggtaaccaagccctccggccacgccgagcatttccgccggcaccagcacgatccacaaaataccgatcgccagccgcacgcctgtcaggatcggcgccagcacccccggcagaacgatacgcgtcaatgtttcccaccgcgttgccgcaaggctttgcgccagcaacagccaacgccggtcgagctgcttcacaccatcggcggtgctgagcaggatgggccagacggcggcgaaagacagcaggaaatagatcggcgcatctcctacccccagcaccatgacagccaccggcatccaggaaagcggagaaatcatacgcagaaactggaacaccggcgaggtggcggcctccaccacccgcacactgccgaccgccagccccagcggcacacccaccgccaacgccacggccaatcccaccagcacgcgtttcaggctgagccagacatgggtcagcaaatcaccatgccaccccatctcgatcaggctggtcagagccagcccgggtgcgaagcgacgactgaaactgcctgccccggccagtggtccggtgaacaaccaccagacagccagcaatatccccaggcctcccatgcccagcaggaagcgccctacatggccagacaagccaagactcaggcggccaccatgcgagcggatagcgggaagagaaaccggcagggacacagacagatcgctcacgccgcaatcgtctccgtgcgggtgaagctgtcggagatcccgaacacgcccggaccacctgccgccgcaatggcgtgacgcacgaaacggtcatccaccagttcacgcgtcgcagcaaccggatccagtgccgtcaggaagccgcgatcaccctcgacaagggtatcctgcaacctccgcaccagttcctcggtataggaaggaaagggataaggctgaaaatcgatccggcgattggtccagtcggcatggcggatcgcgccggaggccacataatccgcgtgcgccgtttccgatggcgccagcaccttcgccagcaccgcagcgggatgcggtgtatagcgattgggattctcgcgtgagatcaattgagccgtctctgcgcgatgatcgcggatccatgcctgcgccttgacgactgccgtcacggccttctgggaccattccggtcgccgtgtgaggtcttcctcatgcatcgccacgacgcagcaggcgtgatcgcgccagacatcccccgtaaagcgcagcactttccctatattctgcgcctctgccgccgcgttgaaaggctccgccacgatgtagccggcaatacgccgggccgcgagcgccggaagcatgtcggagggagccatcaccaccagcgccacctcatccgcagcaggggctttgccgttgcgggcaatgacgggcttcaatccattggccttcagcagcgtacccagcacgacattatggatggaataccagaacggcacagcgaccgtctgcccccccagctctttcacactgttgatgccgggctgcaccgtcaggccggagccatcgagatgattccatgccaccaccttcaacggtgcccggctgccgaaacgggcccagatggtcatgggggacagcagatgcaccatatcgacctggcccgagagaaacgcctcgatcacctgtgaccaggaacgcagcatgaccggcttttccgcgcggattccttcagcttcgaaaaaaccctgcccatgcgcgaccagcagcggggtcgaatccgtgatcggcagatagccgatccgcaatggcgcatccggacccggctgcgccatggcctttctggcccgcaacaacggcaaagcccctgccgccgtgaaaagcccggccagccgcaaggcatcccgtcgggaaaaaaactcattgtccatggcgctcattccatcaatgactccgcagagccgtgcgcaaggtttggagaatttcgatacgcagcctgcccaactcatccagcagggcctcccgcggctgaggaaggtctatgtcccaatccccgaccacacctgccggagtgcctcccagcagcagaacacgatccgccaacagcagagcttcatcgatatcgtgggtaatcagcagcgtagccgggcggcgctctgccacgatgcgcagcagaagctgctgcatttcagcccgcgtcacctcatccagcgcgccgaacggctcatccagcagcaatacggcaggatgacgggccagacagcgcgccagtgccgcgcggctggccatgccaccggagagctgcgaggggtgaagatgtcgcgccgcctgcaatcccacggccgcaatcgcctcctgcacccgcgccttgcgttccgatgtcgtcagggctggctgatgtttgaaatcgaggccgaatccgacattcttctccagcgtcaaccagggcagcaaagccggattctggaaagccagcgccacagcgggatgagccccctcaatggagtttcctcccaccatgatccggccaaagctggctgtttccagcccggccagagtccgtaacaggcttgatttgccaatgccgctcggccccagcagagccacgatccggcccggatgaagatcgagatccagccccgccagcacaggatggggggagccgggataatgcagggctatgtcacgggccgaaagggcagcattcatgccgcgcacccccggttgcgtgtgtgcctgaccagcgcatcctgcaactgcaccaggctgggggtaatcaccgggatgaaagcggcctcccgccaccgccgcgcaaaggcggagccatgcggctggagatacgccttgccccccgaggcctgtaattccatccccactgcctcggcgacaatggccgccagacgaatgcgaatttcaaacagcgcctccggcacggccaggaaccgttccgtcctcaaccctgcatacagggcgcgctcctcatcccgaagacgcgcggtcagggtgtccagcggttcatgcaggacatcccgggccgccccttcgtgccgcagcgcttcagccagagagcgacgggccagaccaatcgacagaccacattgcagacccagaaaagcaggccgcacctgcggcagccagacggaagcatcgggatgaatgatctgatccgcgtcgatccatgtctcctgcaaggtaatcgccgccgtattcgccgcgcgcagcccgagcaggtctagatccccactgcgcgtcagccccggcgcgtcatgcgacagagcggcgatgaacgctccgcttccatccgcatggccgatcgcagcggccacctgaaatccttccacccgcagattggtcacccacggcatccgcccggacagcctgtatccctgcccttccggttgcgcggtaatctgaagcggctccagcccagacaggaacttcatcgcattggacaggccggtcgcccctgcttcctccccccgcagcaaagccggcagcagacgattgcggagcccttcattcgggctttgcagcagatattcgatgaaggaacgatggctccagaacacgaatccggctgccagagaatgcgatgaaaccgaggcgatggcctccacagcctctggaagagtgctgcctgcgctgccctccatgccggcaaggcccacggcgaacaggccttcctgtgccagtctgggcagcagcagggccggatcgatatggccttcatccagcgccagagcgttttgctccaaccattcggacagggcagcggggagagcagacatcagcgcttacccggcggagtcagcgttgaggccattccagcggaacggctcaagctgttcattcagcgggggctgacccagattattggcaaaattgcacaaggtcgccaggctgacgcccagtaccacttccagcgcctgttgatccgtgaaacctgccgccttgaaagtggccagcgcctcatccgatacggccccacgcgatgcgatgacggcccgcgtgaaatcggccagcgttgccagtctggcatcggttacccgatcgagctgacgcagagcctctaccgtggcggcatccagaccggcttttttggttgccaatgcggtatgacccgccacacagaaaccgcatccatgggtggctgcggcggtgatctgcacgacttccctttcctgcaaggtcaggctggcgcgtgcgttgatgccggaaacggtcagataggtctccagcgcgaccggagcattggccagcacacgcagcagattgggcaggaaaccgttattcttctctgccgctgccaaagcgggttgcgcctcggtcggtgcattttccagggtacgaagagggaaacgagacatcacttcggctcacatgttatacgtgaatccttagtgcttattcatttaaacttcaatcatacgttttaaaaaacaggctgaaaatgccattcaaaaaagtgattattttacataaataattgatttataatgataaaataaattttgtagatttataatacactcttacaaaatcacaaaaatttacatttattcattataattttacgtttaaaaaagattatttatgatgaacctgtcatgaggagaccgacaattctccgtctcacaccggagaagcggatcccgtatcagtcagcaatcagagcgggaaaaatgtcacgaccgtgacgaagcagacaggcaacagacaaactggcccgttcctttatgcaccccgacaggtgcaacgttcgcccagcgtgtcacggaacacgctgacttccgccagagcgggaagatcaggggcgagatgccgccaaatgaacagagcgatgttctccatcgtcgcgggagcaagacccggcacttcgtccagcaggcgatgatccagcgcgtcgcggaccgcattcatcttccgttgcaacaggccgagatccatcagcatgccgctatccggatccaccccgccacgtagcaccacctccacacgataggaatggccgtgaatacgcaggctggaatcggtctcgatctcccgatgcagcgtatgggctgcctcaaaggtgaattgcttgccgatttccagcacacgcggcatggaggaagaaacgatcgtcatcagggtatgcccagcgtcttgtgagtctgcaccgacagacgccagcgcgggtgatggaggcagtattcaatcgcggcccttgtgtgatccgcgcgccgcgaatcgtccagcggctgtagcaggaaatgcctgaaattcagagcctcaaaccgctccggcggcgcatccggctgggggaataccaatttcaactcgtccccgcccgtcagcaccagcggattatcggccttggggctgacgcagatccagtccagccccgccggagccggttgcgtcccgttggtctccaccgcgatctggaaatgggcctcatgcagcgcgtcgatcagggcggcatccacctgtaacagcggctcccctccggtcagcacgacgaaacgatgctcggccccgccctgccagcacgcggcaatggcccgcgccagactggcggcatcgggatagcgaccaccgttttcaccatccatgccgataaaatcggtgtcgcagaaggtgcagcctgccatctgccgatcttcttcccgaccgctccagagattgcagcccgcaaaacggcagaacactgccggacgaccggcatggatgccctccccctgcaaggtcaggaaaatttccttcacggtgtaattacgggtgggctgcgtcatgacagcgccgcacatagggggtccggggccttatgtcatgcgccggatcgccatggctccgcttcgtcccttgcaggggcagggggaatacaccccataagaagagggggggggttatgcgggcggtggcgggtcatccggtggaacggcgacacgttgctccggggcggcatgcaccccggcatcctcctcatcagcctccgatccgaccggctgaacggaaggcagcaaggcggcaaactgctccgcccgttccagcgccacatccagcgccgccagagtagggccgagttcttcagtctcgtcgcggctccatgcccggatggtccacagccagacagtcagcaatcccttgatccgcagcccgcccagaatcccgccggagggaatgccggccccttccagcagccaacccatactggcgcgattacgtcgggccagaaacagcgccagcaccggatcgaacggcaccgctgtcaacagtgccagcatgccctgacgatgaagctgtaatacgtcgatacgacgcatcagaatatccagcaggcgatccctgatctctcctcccggcagaggtctggccaaggcggcttcatccgcctgccgcccgaacaccgacaggatcgcaaaccggtcgggaaagcgccggcgcgcctgatcgagcggcagaccagcccgccgtgccgcctccgccacggtcaagccccgccagccacgctcggccatcacggagaatgccgcagcgatcagggcatgatcgaaagcgctatcgtcacgtccatacgtcattggccctgctccctgacagaccggttcgggggattcatcgcactcctaccgcaccggttccacgaccggcgcgccggacaactcacctgcccgtttgatcgccgccttaacggcacgggaaaaagcggagggcagggcgtcttcggccatcagtattttcaacgcctgttccgtcgtaccaccagggctggtcacagcgcggcgcaataccgccgcatccgcttcctcccgctccagcagcaatgccgcgccaatcacggtctggcgggccatgctgcgtgccagatcaggctccagcccctgctccagagcacaattttccagcaattccgcgatcagaaacacataggccgggccaccgcctgaaatcgccgtggctgccagaagctccgtctcttgctccgcccacgccacggtaccgacggcttccagcagggtgtggcacaggctacgctgtgcgccatccacatgcggaccggcatgcgccatggtaaaccctttaccgatcgccgaaggggtattgggcatagagcggacgattgccgcttgctcacccaatattccggccaaaccagcctgtgtcagcccggccatgacggacagaaataccgaatgcccggcaaaacggacataatccggcaaaatcgacggcgcgacctgcggcttcactgccagaatcacggcggccggacgaaaatcaggaggaatatgcgtcgcatccggcacgacggccacgctctcccccaaggcgcggggggagggtgagacgacaaaggagcgggacaatccccgctcctgccatgatcgcaacatagcgctgcccatcttgccgcaaccaaccagcaggatgggcgggatcgggggaaggctcatgcctcccccacacattccagcatggccgcagccatggcctcggccggggccttgccgccccacagcacgaactggaacgccgggaaaaaccgctcgcattccgtaatggcgatatccatcatgtcctccagactttccgcagacgcacccggcgcgccacgcagcagaacggaatgccggaacaacggcatgccatcctcactatccattccgaaatggccgatccagagtttgtcattggccaatgccaacagctcataaagagcggcgcgccgcttttccggtactttcagatcgaatgtacaggtgaaatgcatagcgctgatttcagacgaccaactgaaatacagcccgtaatcacaccattttccaggggcctcagcggccatttcgtgatcgctgcggcgatcgaaaatccagtcatttgcggtgacgatctgctccagcatatccagcggattggaggaacgctcctgcacggagaaggacagggcagtcatgatgggtctcccacctggaggaaggccaaatgtggccatggggacgcaacggcaccggtgcggttccggtcgtaccctggataccactccggcagcctaacgatgtgtcgggccgtgccgcaagggctgctgaatcatcggacggcccgttcaggcaccggaaggcttgtcctgttgcgcaacagagacaggatcagcctccagcgcggccacacgctgctccagcgcatcgaccctggcctgaagggctgcctgcgtatcacgggcggtcgcggccagctccagtgcaacatccagatcctcacgtcgggcgacgtccagacggcgcagcgtttcctcgacccgcgcccgcaccagtgcctccaactcctccctcagtccggagactgcggacagggcaccgccggccagaccagccagatcgtcaaaaaaacgggggcgggatgtcattgcgaacgctccttgcacgtcgggccttgcacgtcgggatgggcagggatcccttttcgaaaaggcacccaccatcaggggtcgatacagcatcgaacgggcggccacgtaaagagagcatccaccataccagattcagtctatttgaccgtccgtgaagcactgcctattcaccctcaggacagccccatcaggcgtgacgccgcgaggagtagcatgctgcccgtgatgatgtttcccggcttcgaccccgttctggtacaggtcggcccctttgcgatccgctggtatgcgttggcctatattgtcgggctggtgctgggttggcggctgatgcggcggctggtacggctcgaccccgccgtcgccagcgtcgaacaggtggacgatttcctgacctgggccacgctgggtgtcgtgctgggggggcggctgggatacgtgctcttctaccagccatcattttttctggcgcatcccggcgccatccttcaggtctggcatggaggaatgagcttccatggcggcatgctgggggtggtcgtggccactctcctgttctgctaccgtaatcacatttcttttctgggttttgccgaccggctggtcgtctgcgtgccgctcggcctgatgctggggcggatcgccaatttcatcaatggcgagctatggggccgcgccgcaccggactggctgccctgggcgatgatttttccctccggcggtcctgtgccacgtcatcccagccagctttacgaggcggggctggaaggcgcgctgctgtttatcgtcatgctgctgctggtcagtcggcctggagtgcgggcgcggttcggacagctcggcggctcgtttctgatcggatacagcattgcccgcatcatctccgagcatttcagagagccggattcgttcctcggctttctgacattcggcctgacgatgggacaaattctctgcctgcccatggccatggcgggactatggctggtcctgcgcgcccgcaccaatgcccctgccactgggcagacggatatccggtccaccccatgaccgcacgcccggagcggctggaccgtttcatggcccgggctaacgcggcctattacgccacacatgacccgtttgcggatttcaccaccgcgccggagatcagtcaggcgttcggcgaggtgctgggtctgtgggcggccatggggtggcagcagataggcgcacccgcccggatcgtgctggccgaagccggaccggggcgcgggacgctgatggccgatgctctgtccgcgatccgccgggccatacccgcttttgccgacgctgccacgatcatgttcatcgaaacgtctccaagactgcgcgccattcaggcgcagcgcgtgccggaagcccgctttgccgccgatctcgatgaaattccggatgcgcccctgatcctgctgggcaatgagtttctggatgccctgcctatccgccgcttcgttcgacagaaggcggaatggcgggagcaatttgtagaggtgcagcccgatgggagtgcaacccttacaacagaccccatggaacctcccttcccctgcctgccggagacggtcgcagaaggcacaatccgggaatggtcggaagcatcgcatgacatcatcacccgcctcgccggacggctgacacgccagagtggaatggcgctgtttctggattatggtccggcccaaagtggtttcggcgatagtttgcaggctctggcgcaaggtgttccggtcgatccgttcagcctgcccgccggagccgccgatctgaccgcccatgtcgatttctccgctctgctggacaccgcccgcagcgcaggtgccaacggatacggaccggtggcgcagggacggtttctgctgtcgctcggtctgatgcagcgttgccagcgtctggcatccggcaagcccgccgccatggcgcgccagatcatgaatgcggggcagaggctgacacaggcggaatatatgggcaccctgttcaaggcgatggccctgacctcgcccggcctgccggttccggcaggtttcgaacctctcccgatacgggacatgacctgatgaccgatcttgcccaagctgcctcctccctgccggagcggatcacgggaccactggcagccccgcatggttttttcacccggcgcggcggcgtttcatccgggccttatgccagtctgaacggatcgctttcaggcggagatgatcctgttgccgtgcatgaaaaccgcgcccggatcgcgcattgtctgggggccgacacgctgctggggctgcggcaggtgcacggcaccacggttatcagggtcgaaacgccctgggctgccggttccggcccggatgcggatgcgatgatcaccgaccggcccggtatcgctctgggcgtcatcacagccgattgcggccccgtgctgttcgagggcaaacgcgatgacggctccctgatcgtcggcgcggcccatgccggatggcgcggagcggtagcggggattctggaagccacggcagattccatgcgggcctggggagcagtctccttacgcgcctgtgtcggcccctgcatcgcccggaacagctatgaggtgggggcggatctgcgggctgccctgctggcagccgatccggacggcaatctctacctgcatgacggacgggatgcggaacactggcaattcgatctggcgggttactgcctgcatcgtctgacccggaacggaatcgaggccgaggctctgttgatcgatactctgacggatgccgaacgcttctatagtcatcgccgccgcaccctcgccggtggcggtgccatcggccaccaggtctccgcgattctttgcccgcaacccggcgcagcctgaccagccagagacacccgtcagggacacctgccagcgacaatcgggaaaacattcatgatccgccttcccttctgcctgagccgcttcactctcatgcttacctgcctgagcggtctgctcggcctgtccggctgcggcgatctgccacgccctttcatggggcatcccggtcagaccgccatgaagctcgccgcgccaccacctgcgcgtctggcagtgcccacgcccggcaacgcattgctggatgacgattccagcaagctgtttgcgacctccattgcccatgctctggatgaccacaccgtgcctgccgtggccgggcctgtgaaaaaaggcgactggtggctgggaatcaccgccaccacgcagggcaacactgtcgtgcctcattacgaagtctttgacccgaccggaaaatcacacggcaaggctgatggtcagtccatgcccgcctcagtctgggccgccggagaccgcccgatgctgaaacaggaggccctgacctccgccgacaaaatctccgatctgctgaacgacgtcgatgcggccatgaaacagagcgatccgaacagcctgttcaaccgtccggcccgggtcgccgtgctggacgggatcggcgcaccgggcgatggcaatatggcgctctccatgcagatgaagctggcgctgcccaaaatcgggatcactatcgccagtgacgaatcggcccagaccgcgcccgccgattttaccgtgcaaccacgcgtcagaaccgcaccgggcgccaatggatcggagcggattgaaattcagtggatcgtcaccgatggcagcggccaggaaagcggtcgcaccatccagatcaacgagatcccccccggcacgctggacctgcactggggcgacgtcgcctatgtcgcgtctaccgaggccgcaggcggtatcaagcaggtgatccagaatgccaccggcctcaaccgggccaaggtcgccgccggaaaaaccgcagacaaaccggccggaaccgcatcctccaccgctttgtccgccccgccggatgccttgcaaaaggcccctgtttcgccacgatcccctttgccatgagggtgaaaacatcatcgaaacaacccgcatggcggatttgctgcacaggatggttggacacggttccgacacattggtagaaggcgcgcgccgtcgggcatccgggccgcaacgacggttaagacgcgggatctgaaaatcatgaagattgtggcttgcaacagcaaccgtccactggccgaggcggtcgcggcagccctcaacctgcccctgacgaaagcctccgtcaggcgcttcgcggatatggaagtgttcgtggaaatccacgagaacgtccgcggtgaggatgtgttcgtcattcagtcgacctcctatcccgccaatgacaatctgatggagctgctgatcacgctggatgcgctgcggcgtgggtcggcccggcgtgtcacggcggtgatcccgtatttcggttatgcccggcaggatcgtaagtccggcccccgcaccccgatcagcgccaagctggtcgccaacctcatcaccgaagccggcgccaaccgtgtgctgaccatggatctgcatgccggccagattcagggtttcttcgatattccggtggataatctctatgccgccccgcttttcgcccgcgacattgcggagcgttttcacgggcgtgatatcatgatcgtctcccccgatgtcggcggcgtgctgcgcgcccgcgccatcgccacgcgcctgaacaccgacctcgccattatcgacaagcgtcgtgagcgggcgggcgtgtccgaggtgatgaacgtgatcggcgatgtcgaaggacgcgactgcatcctgatcgacgatatttgcgactcgggcggaacactctgcaatgccgccgcggccctgatcgccaatggtgcagcctccgccagtgtctataccacgcatggcgtgctgtcaggcggtgcggtcgcccgtatcgcctccagccccatcagcatgatgaccatcaccgacagcattctggccaccgaagcggtcagactggcccagaatgtccgtcagctgaccattgccccgcttctggccgaagcgatgcgccgcatcagcgacgaaagctctgtcagctctctcttcgattgaagccggggctatcatgggccttccccccgcctccgccagccgcatgccacccccgcagggtccggaactggcagctgtgccgttctggttcctgcgccatggcgaaacggactggaacacgctcaatctggcgcagggtgtcacggacgtgaaactcaacgccgccggactggctcaggcgcgccttgcggcggagcgtctgcgagggcgcggcattcgcacgctggtcagctctccgctgtcccgggcccgcgacacggcggaactggtcagtcagcatatcggggtaccggtgcagattgatcccaagctgcgtgaatgcgctttcggagaacgcgaaggccagccgatgagcgaatggttcgacgcctgggtgcgtggcgaatcgaccccggccggcgcggaaagcttcagtgatctgaagcgccgggctgccgtggcagtgggcaatgcgctgcaactgccgggacccgtgctgatcatcgcccatggcgccctgtttcgtgcggtacgtgcactgatgggcatgccgccgaatgtccgcacccccaatgccctgccttatctgtgccgcccccccaccggcagcgaccggccctggaccctgatgcccgccacctgagcatcagtgaacccgtttcttgcagaacaggcaggaaacagaagcgtgttgccggaacggatacgattcgctaaaccgcgccccacgccggcacccctggaggccggcgtttaacgtttttgcttaggagcatttccatggccactttcacacagatcgaggccgaggcacgctcgcgagccggtaagggggcggcgcgggcgactcggcgtgagggtaaggttccggccgttatctacggtgcgcgccagaccccggacctgatcaagctcgacccccgtatcattcatcgcgagctgaatcgcggtggctggcggtcccgcctctacgaaatcaacgtcgatggtgcctccacccgcgccctgatccgcgacgtgcagttccatccggtcaccgatgctccggagcatgtggacttccagcgccttgccgccggtgagccggtacgcgtggccgtggccgtgcagttccagaacgaagccaccagcccgggcctgaagcgcggtggcgtgctgaacatcgttcgtcacactgtggaagtgctgtgcgaccccgatcacgtgccggagcatttcgaagccgatctcggcacgctggatatcggcgacaacatccgctggtccgatctgaaggggaccggcgaagcgaagccgaccattctggaccgcgacttcgtcgttgccaccgtcgcaccgccgaccaccatcgccgaagcggccgccccggctgctgaagcagcggcacccgccaaggctccggccaaaggcgccaagaagtaacgaggccgtatcgtgccgtccttgctgctctggaccgggttggggaatcccgaacccggtatggcgcttcagcggcacaatatcggcttcatggccgtcgatgccatcgcgcagcgccatgggttcaccccatggcgcaaccgattcaaagggctgacggcggaaggaacccttgccgggcgcaagatcatcctgctgaagccgatgacctacatgaacgcctccggcgaaagcgttcagcctgccaccgcgtttttcaaactgcctcccgaagcggtcagcgcctttcacgatgagcttgatcttgcccccggcaaggtgcgggtcaaacggggcgggggtgccgccgggcataacggcctgcgcagcatggaccggatgcttgggacaccggaatattggcgggttcgcctcgggatcggccatccaggcagcaaggagcgggtgcacggccatgtgctgggcaatttcgccaaaagcgatcaggaatggctcggtcccctgctggaggccgtcgccgatgccgcaccgcttctggcagaaggccgcgccgaggatttcatgacgcgcattgccctgctgacccatcgccaatgagtttcccgcctgcatgcaggcgccttatccgaaggttaagaccccatgggatttaattgcggcatcgttggcctgcccaatgtcggtaaatccaccctgttcaatgcgctgaccgctaccgttgcggcacaggcggcgaactatccattctgcaccattgagccgaatgtaggccgggtcgccgtgcccgatccgcgcatggaaaagctggcaaccgcggcgaaatcccagaaaatcgtgccgaccagcctggaattcgtggacattgccggtctggtgcgcggtgcctcgcgcggcgaaggtctgggcaaccagttcctgggcaatatccgcgaggtggatgccatcatccacgtgctgcgctgcttcgaagatgacgacatcacgcatgtcgaaggcagtgtcgatccggtgcgcgatgcggaaaccgtcgagaccgagctgatgctggccgatctggaaagtctggagaagcgcgtgccgctgcttcagaaaaaagcccgcggcaacgacaaggaagccgcagcccagctggaactgatcgaaccgatcatcaccgcgctgcaagccggtcagcctgcccgcaccgccatcccggcggatcagcgtgtcgccgcatcccgcctgcaactgatgacgtcaaagcccgtgctgtatgtcgccaatgtcgaggaggcctcagccgccagcggcaatgcgatttccgcccgtgtcgcagacctggccgcccggcagggaacacgctccgtggtcatctccgccgcgatcgaggccgaggtcagccaactgggcgatgaggaccgcgccgaatttctcgccggtctcggtctggtggatagcggtctggatcgcgtcatccgcgccggatacgatctgctgggtctgctgacctatttcacctgcggcccgaaagaaacccgcgcctggactatcgagcagggcacccgtgcccctcaggccgccggtgtcatccatggcgatttcgaacgcggattcatcgccgccgaagtaatcggctacgatgattacatcacgctgggtggcgaagccggggccaaggaagccggcaaggcccgcgtcgaaggcaaggactatatcgtgaaggatggcgacgtcattctgttccgcttcaacgtatgagcgggaccgtctgatcctgccctgataacggcccggatgcgcgccagtggatttccacttgggaaaatccgggccgtcgccatatccttcccggataatgataacaatgacggccgggaaacgattcaatgcgcacaagatacctgctgatgggcatgctgctgacagctgtccatctcccctccatggcacaggcagcagaggatgaggacgatccggcccgtcagcatcgctgggccgatctgaaacaggcggtgtttgcgcagcgccctgttgcggtcgagcctgcctccgagcatctgatcgggcttgaggcgcccgtgcgcgccctggatgcggcactggtgcccgtcacggtcacggtgtctgatccctcggcgaaggggatttatctgctgattgatgacaatccctctcctttggccgcgcatgtcgtgttcggccccgccatcgatccacgcagcatgagcttccgggtgcgggtgaacacctacacctttatccatgccgtgctggaacgggatgacggctctctgattgaaaccgcgcgcttcgtcaaagcctccggcggctgctctgctccggccggcagcgacgccgaggaagcgttgcagaatatcggcaagatgaagctgaaactggccggaaaggactcccctctggcctcccctctggccgccacgctgatgatccggcatccgaatttcaacggtatgcagatggacccgctcacacaggcctacacacccgcgcattacgtccagaaaatcaagacgacctatgatggcaagctggttttcagcctcgatacggatatctccatggcgtccgacccggtgcttggcttcttcctgcgcactgaatccggaaatgaccacaccctgactgtcagcgttcgcgacaatcaggatgagcactgggaaaaaaccttccctgttatcgcacccggcccggcaccggatgcgaaactgcaagccaaacccggtggttaatgatccgggctgttgaaaaacggccctgctacgttccggtccgtctgtcacgcaaacgatgctgatatggggcggactggagtgactgtcgtcacctcaatgaagtatccgcctttagcctggaaatagaagcaccaggcgccatgcgcatcatgcggcctctgggtttcccagccatcatcacgcaggcgctcatagagtgcatccacagcttcacgggtttcctggatgaaaccgatatgcaggatgtccagctgtctgggataagcgaacccatcaagcttcgtctcgaagtgattgacgatcagcaccagcccgtcatcatcctgcatgatcgccatcttgctgccacgcacgacaagcgtgcgcagcccgaaataccgctcgaacatcacccgatcggcttcagtgtcatgactatagagattgatatgattcagcttcatggttgtgcctttccgtttgaaaaacggacaccgatcaaccagagccttgaacgaccatgaccgatcacctgcatggagtgcgcctccatactgtgtccggccaaggccaagagcggtgtcacccactcaagcgtgactgtctccggagagaccgcaggttgtcaccatacctgcatcgctgtctttttaggcgatctgatattgagatgaggggtggatcgcgtcaagcggcccttgccacacccgactgttgagggggggaatcgttctcattccgtgtaggcacaacggacggcaccagtctgatgaacggtcgcatccgcataacgaaaactggtttccgcctcgatcacggctccgccaccctgagccttgaactgcttcagagcggggcagttggcctgcgtgacagggcggtccgtgaccacccataaagtcacgtccgttttgccgtatcgcggctgatcctgcgtcgccccgctatacaaacgcttacgactggccatgtcatagatgctgaagcctcgcatcgccgaggtgccgctgtcgatgaacagatagggttcgatcaccttctgaacgtaatccgcatcatcccgcccgctgacgatccagtcccccgtttttttatcaaaccggcaaggccccgtgatccggccgcgcaccacaatatcctgtccgacctctgccgtccggtcccgtgcaatgaccctgtgccgattcgtatcgaaacagaccggctttgccaccggatcggggttgttatccgaggctgaagcgaaaacgggattcagcacaccggccgcaaccatcaaaactgccgcctgaaagacacagtgaaacaaggttctcgctgtcatgatgccacatcatcccgaaaagagattttcattcatcccgcatgtccacacacagattatagtcggtcagaatacatcgccggaacattccggcccgatctgcatgctcgcgaccagagccatcagcacgggcgaagaatgaaccgcaagactgcttcaaggcaatggaatgacgctcacgatgccacgcctcatgacggccttgatatgcgcctgcactctcagccttgcctcctatcctgcccatgcggtgccacagaacccggatgagtgggccaaaaatatggaagcggcttttcgcaccggcaagctgataaccatcggcaagctgatggatcaggccgtcgatgaccatgatcccggggaagccaaacgagcgcaccagatcatcgctgagaatatccgcatgatgaccgaaagcttcggcaaggaggggccaggctgcgccgaattgtttgatacccgtcgcatcggcagttttttccgccgctatgatttcgcagtgtgcaacggtaccgagcgtatcttcttccgtttcgatctggtacggcgggagaagctgggctggctgttacgttcttggcaagccagcgagaatctcgataaaatcgtcaatgcgcctctgcccggtaatgccaattacgaccgggaataatccccccgtcctgtatcagggcttctcaaaaggggcgctgatgatcaactgcacgtcatcgcccaccatatccagatagcgcgatatcccgaatgcggaacgacggatattaccccgtgcctcgaagccgatcgtgtatcggcccgacagcggattgatcccgccaccattgaagtgcaccgtcagcgtcacgggatgtgtgatgccatgcagggtcaggtcgccggtcatttccccgctctccggtcctgtggcgcgggcggaggtagagcggaacgttgccaccggccagcgctgcgcatcgaaccattccgcaccgaccagagtctggttcaaaaccgggctggtcgtggacaggctggagactggcaccgttatctccagatgactggcctccggatgggcgggcacgaaatccagccagccggaagcctcaccgaaccgtccataataggtgctgaaccccatatgcgagagtgcgaactcaatctgcgtatgggatggctccagcatataacgcgcagccggcacctgagccggattccttgtggccatcatctgggcctgcgccaccatcggcgctgcgacagcaagccaggacgcggcccccaccagcaccaacccgcatcgccaccatggagtcctgtcttctttcacctctttcccctctctgcatcacggcccggcttgcatcccgaccaatcaggccgcacatgagattccatgctgcatctcatgaagctggcggtcggtgtcgagtctcctgcgcatcttgccgctctacaggctgaacgcgccagagagcggccgggatcacagggcggggaattatggcatctgacccgccagactccgcgtcagggcgaggccctgctgaagggcggctcgctttactgggtgattggccgattactgtccgtgcgccagcctattaccgggctcagtgagcagcataaaccggatggcacgccgtgctgtgccattcatctggcacccgacctgattcccgtctcggcgcgtgtgatcaagccctttcagggctggcgctacctcaagcctgaagatgccccacctgatctgacccgtgccgtcaaccatgacgatattgcccgtctgcctgaacccttgcggcggaaattgcaggcgttgagcctgatctgaaccacagacaggttacccgctgtggcactgcccgtccggctgccccttacggcagccgcaaggggcagccttttgggtgggacaatttgtccatgccagacagcaaaacgggcgctcattgtcctgaattaggacttgcgcgcccgcttggcagcttttatgttgcagtgcagcagccgttgggtggctgtctattggatgtttcttccccaaacttggcagtgtcataggtatgtcctattggcgctgccgaattttctttagacctgtgtgccctgccatgcaacaggcaatttttccgttgtttgcccttgcaccatccgccgtggtctgattcatctgatatcatgaaacagcaggcgatcacgccgcccgcgccttgtacggatgactctgccagtcccacattttctggcggacgtgtccgtgccaaagcgggcaggccatcgaaaaaaaaaacctcttcaccctcgctccggccggtctggcccagtcctgcttctgccgaggatcggcatcggctgtattgtggggattgcctgaccgttctgccttttctggcagagggcagcgtggatgtgattgtcacgtcccccccctataatctcgatctcggctatgccagctatctcgatagcaggggggaagaagagtatctcgactggatgacgcaggttgctaccgcgctcaaaagggtgctggcaccgggcggttcgtttttcctcaatgtttccggctcgccttcccgcccgtggctgccgttcgagctgatcgtgcggctgcgcaccttgttcgtgttgcagaaccatattgtctggatcaaatccgtggcgacccccgccgtctcggtcgggcattacaagccggtgaacggcaagcgtttcctcaaccatgcccaggagcacatcttccatctcacccacaaaggagatgtgaagctggaccggcttgccgtcggggtgccttataaggacaagtcgaatattgtccgccgcggccatgcccaggatctgcgatgccgcggcaatacctggttcattccttatgagaccgtacgcagcaaaagccagaaattcctgcatcccggcacgtttccggtgacattgccgcgctggtgcatacggctgcatggtgtggccgatgcgctggtgctggatccgttcatgggcaccggcaccaccggcgttgccgcacaggctgaaggcgcgcgcagcatcggcatcgagcttgaccaaggctatatcagcattgccgcaaaccgcatgatggaagcagaaggcagctgacagcctctcttttctcacgatccgtccctcccccaggcaggaagcgagaccatgcctcaaccctcgaccgcccgcctgaagacagaaccgcgcgtcgccctgttcgtcacctgtctggtcgatctctatcggcccagcgtcgctttttccgcgatcaagctgctggagcaggccggatgcaaggtttccgttccgcgtggacagacctgctgcggccagcccgctttcaataccggagaccgtgtgacggccaaagcactggcgcgcgatattctggccagttttcagggatatgattacgtcgtcattccatcaggctcctgcggggggatgctgcgtcatcaattgcccgatcttctggcggatgaccctgctctggcgcctctggctgctgatctggccagacgctgtcatgaactggtcagtttcctgaccgacatacgcggcgtgacgacgacccccgccccttcaccgggccgtgtcacctatcacgacagctgcgccggattgcgggagctggggatcaagcaacaaccccgcgatctgctgcgcgccatggatgcggagatcgtcgaaatggaggccccggaaacatgctgcggcttcggcggtacgttctgcgtcaaatatccggagatctcgacccgcatggcccgcgacaaggtggcggacatcgtggctacaggggcagacatgattctggccggagatatgggctgcctgctgaacatggccggcacgctgctgcgcgaaggatcaacggtgcaggtccgccacgtagcggaggttctggccggccccactggccccgcaatcggtcagcccaccgacaaatgaccgtcacagccagtccaacgccggtttcaaggggccagtgacccgcgacaaaatgatgacagggctaccgttgacacctattgtgaacgaacaaccttcacattagtttcatcttaacctcgggatacgcaatttttattatgtccatgcctgctgcacggatggagaccttcaacatggacggacatgccgcctctttccggctcagccatgagagaacagacatccatgcgcgttactttgacgatttccagctgggagagcgttttattctgcctccgattgcgctgacccgctccctgatcgactctttccgcgccatcagcggcgagactcatcccctgcatcatgatccggtctggtgtcgggagaacgggcatcccggcgtgctggtgcatggatttcaggttctggcagtcaccacggcgggcgcatcaccgtttcatgccatggtggaaaacagcctgctgggtctggtcgaacaaagcagccgcttcatccgtcccgtctatgccggggatacactccatccggtgctgcaaatcgtggaactgacccccaatacgtctaccgggatacttgtcttgcgcagcaccgtgcataaccagcgccgggaactggttctggaaggctcccagcgctatcttctgcgcatgcgtgaccgtttgcagccggacgataatcaggcataacgccagcatccccaggctgctccggttgtttcgcgtgacaatcttccgccgggagaaacgcgaaggcagcgcaggaggacagccagatgcaggcccgctcggccatcttcaaggataatgcggcctctgcccttgctgatcagcggttgcaacaggcgctgaaacaggtacgcccgcgctttaccggtgggcgcgcccgggccagggaagcgctgcccgaattcgaaacgctgcgcaacacggcccgcgatatccgcaatcatacgctgacgaatctggatttttatctggaacgctatgccgcacaggtcggggcatcgggcggccatgtgcattgggcacccaccgccgaggatgcctgccggaccattctggatatctgccgccgtgtgggtgcccggcgcgtggtcaagggcaagtcgatggtcagcgaggaaatcgccctgaacgattttcttcagcaggacgggttgtcggtcgtagaaaccgatctgggcgaatatgtgctgcaactggccgatgaagcccccagccatatcgttgcccccgcctttcacctgaaccgcgatgactgggaaaaccggttccgtgaagcccatcagcatctccccgccgatcgggcctttgagagccggcaggacatcatgcgcgaagcccgcaccgtgctgcggcgccggtttctggaggcggatgtcggcatcaccggggccaattttctgattgccgagaccggcagttccgtcatcgtcactaatgaaggcaatggcgatctcagccagacactgccgcgtgtccatatcgtgctgaccggcatcgagaaagtcgtgccgacgctggaggacacgatgacgctgctgcggctgcttggccgttccgccaccggtcaggatctgacggcctataccagtttctctaccggcgcgcgccggcccggcgatctggacgggccggaagaatatcatgtcgtgctgctggataacggccgtagcgccatgatcggaaccgaatttcaggacatgctgcgctgcatacgctgtgccgcctgcatgaatcactgtccggtgttcggggcagttggcgggcatgcttatggctgggtctatcccggaccgatgggcagcgttctgacgcccgggctgatcggcatcgaacaggccgccctgctgccgaatgccagcacgttctgcggcgcctgcgaatccgtctgccccgtcaaaattcctctgccgggcctgatgcggcactggcgtgaaagagaattcgagcgccatctgaccccttcagcttcacgtcgcggtctggccatctgggcttttctggcccgccaccccgctttgtatcgcctgacgaccggtctggctgcccggctgctgtccctggccggaagacgcagcgggcggttccggcgtctgccgctggcctccggctggaccggcggacgtgatatgcctgccccggaagggaccagcttttttacccaatgggctgcctaccaaagaaagacccggaaaagggcggtgtcatgagcgcgggcgcatcaggaagtctttccggaaaggagatcatccttgccacgatccggcgcggtctgcggcgcggagtattgccaccggatcaggctgccatgctggactcccggctggcggcacatccgcgccacaccatccccgaacgcgcacggaaaccagccgcagagcgcaggaccgatttcatcacgcgggtacagaaagaattcggcaccgtcgaggaagtcgcctccctcagagacattcctgccgccatcgcccgttatctggcttcacgcggccttcccgctgccgtgacggtcgcgcctcatcctgccctgcacagcctcgactggtcagcggcaggtctggagacgggatggggccgcgttcatggaacggaaactgtctcggtccagtatgcctttgccgggatctccgaaaccggtaccctgatgatgccctccgggccggagcgcccggtcacgctcaacgtgctgacggaaaccgccattgccgtcctgccggtggaacgcattgtgggcgcttacgaagatgcatgggatctgctgcgcagggagatcggagccatgccacgctccgtcatgctgatcacaggcccatcccgctccgccgatatagaacagcaactggagctgggcgcccacggccctcgtgacatccatatcatcctgttcagccagcataccccatccgcgccgcatggctaaacggccttacaacgttcctccggtcacgcccggcaaggcgctgaccaggcccggacctccttcccgtcgctccgcacggaaactgagcgaggccgagcgcacggaatggacacgctataccgtggccgtgattccgctgcacggcaaagccggacatggggagaatgcgattcctcctgcagcggccatcacagactctccgatacacagcgccaggcacggccccgttgccgctccatccttccgccagactgaatccggggccggggcacccaccttcgcccagctttttcctctgccagccggggcgcagcctccgggggtggacaccggcacatggaaccggttccgcaacgggcgactgggcgcaacccggacgctggatctgcacgggcataccctgcaacacgcctatcatacgttcgaggcgatgctgctgcgcgcccatacggacgggctgcgctgcattgaggtcattaccgggcgtggccggaccggatcaggtgaaaccgtcggggcgatccggcgggagcttcccctctggatcaatctcccgcatctgcgtcccctggtgctgggcataacctatccccacgccgccaataccggatcagtgcgcatcctgctgcgtaagcagaaatgattaaccggcttattgtgctgccccgatcaagacgttttaaattgaccgtcgtcatgatacccgcgtgaatgcattatccagccatgggcagcgctgatcctgggcataagtgcgtgtgtggttttgctttttccgccggccaggcctgagcttcattcaggcccggtcatcgtatttgaaaagaatggatgcccatgtgcctgcctgaatcttcctccggctgcgacgattcagccccggttctttttcccgatgcggcccccggagaaatcattacttatctgcgcgccatggactgggacgcatccctgatcggtccccccgaaaactggtccgaaccgtttcggaatgcggttgcgctcatgctcaatgccaaagcacagatcgccatgttctgcggaccggagctggtcgcgctttacaacgatgcctacgcgcctgccatcgggggtcaccatccgggtgcgctcggtcgcccggcacaggaaaactggcaggaaatctgggatgtgctggaaccactgctccgctcggttatggagaccggccagacggtgtatggccagaactatccgttcagggtcaaccggcacgggtacatggaagaagttttcttcgatatttcctacagccccgttcatggtccggatggaacggtggaagccgttttctgcattgttgccgaccgcacccaacgggtcattgatgatcgtcgtctgcgcaccctacaggcgatcagcctgaatattctcagcaacacggttgaaaactgtgcgacctcggcgctggatattctggcgcgcgaaagcacacaggatataccgcatgccgctctctatatccgcagggaagcccccgagcggctggattgcatcggctggtacggtgcacagcctgcaacgctgagtattccccttgtacagcataccctcccggcagcggaggatgttgccacttcagagtcctggaaaaacctgatcagggcggctctggacagcgggaatgccgtctatggtccgtcacgggcactgtttcccactctgccggctttgagtgcggaacggatggccattcttccgcttcaggtgacgcaccatatcgccggtgtgctgattgtgggtaaaagcaggctctatccaccggatgcggagtattatcgctttttccagctcgtggccaatctggtctccaccggcctgaccaccgccattgccctgcgcgagcagcggcaccgggccaagatcctggaacagaaagttgccgccgccatcgccgagcgggaaatttcagaaaccagactgcggcaggcccagaaaatggaaatgatcggtcgtctggcgggtggcgttgcccatgatttcaacaatctgcttcaggtgatcggcagcaatctggaactgaccatcctgcaactgcccgaaacatcagctgaacgcagacgtctgacctccgcgctggaggcgatgcagcgcggctcccgtctggcctcccagatgctggcattcgggcggcggcagcccctgtctccccaagcggtcagcccgtcgcggctgctacagacagtgcaggatatcctgctccgcactttgggggccgggattacactgagaatccatacggctcccgactcatggaatattcgcgttgatcggggacagatcgaggcagccatcctgaacctgaccctgaatgcacgggatgcaatgaaaggccatggcagcctgaccatcaccacggccaacactgttgtgaagcccagccagaacggctcgattctggaaatacagccgggggattatgtcacgctgaccgtcaccgatacggggtgcggcatggcccccgatgtcatcacccatgtgtttgagccgttcttcaccaccaaatccgaaggtcagggcaccggacttggcatgtcgatggtatacggcttcgtcaaacaaagcgggggcgatatccggatcgattccgccccgggtcgcggtacatccatcagcctgatcctgccacgcgccgatgaagaagacagcctgtcggatacgccccttctggcgctggataataccatgctggaaggacacgaaacgattcttgtggtcgaggacgaagacgccgtacggcaaagcgtgcaggaaaccctcagtcagctgggttacaacgttctcaccgcccgcgatgccgacgaagcccttgcgattcttgacagcacgatccggattgatctggtgttcacagacatcatcatgccgggaacgatgcgaggcaccgaccttgccgtcaggatcagacagcttcggcccgaaaccgccatcctgttcacatcaggatatacggatagctccgttcatcgtgatgatgacaacccgattcagttactgaacaaaccctattcacgcgataagctggcccacagcatccgtgccgcactgataaccgcacgttccacgccgtcttttccgcacacagcttccctccagacagccggtgatgtcttgtcctccagccattccctttcctcagcctcaccgcagcaacaatggaccattctggtgaccgaggatgatccgctgatccgtatgaacctgatcgacctgctggaggaagcgggacatagcccgatcgaggcggaaaatgccgaggaagcgctgagctatctaaaaacccattcacccgacattctgttcaccgatataagcctgccgggcctgtccggtgttgagctggcctgtctggcacgtaaacgatatccttctatcgggatcattttttccagcggatacgcggatgttcccggcctgccggcggagatgaagcaaaacagctgcctgttgggcaaacccttcacctcccatgaactggttaaaacactgctgcaggcctgggaaaaccgcccggcccaagggactgatcatgggggctgatcagggatgacgcggccgctctattcggttgactttggcagcagcacataaagccgtccctgccggttcatctgccctgccaccgccttggcctgcgggccatagccaaaataaatatccgcccgcgtcatcccgctaatggctgaaccggtatcctgtgccaccatcaggcgctgaagggcgctttggccgcccggatccgtggtatccacccagaccggcgcgcccagcggaacgatacggcgatccaccgccaccgaacgtcctgcactaagcggcacccccagcgttcccggtgccccttcattgccaggcattcctgtcagttcacggaaaaacacaaaggatggattggcattcatgatctcctgcgcctgatcgggatgagtgcgcaaccagtcacggatggaggcttccgagacctgatccgccgtcatctcaccccgttcgatcagcactttcccgatcggcacataaggacggccgtttttaccggcataggtcacgcgtaccacatgtccatcgggcaagcgcaccctgcctgatccctgaatctgcagaaaaaaagcgtcaatcggatcagccagccagacaagacccagacgctgctttttcagggcaccggcctcgatctccgcccgtgtataataaggttccagctgcccaccgaccatacggccgctcagatacttcccgcctggatctgccggatccggcatcgacaccagatcatcagggcggcgcagcaggggcgtccggtaacgcccgatcggagaacgggagccttctacctccggctcataatatcccgtgaaaagcgtgggggcagaggagatggcataagcctgaaaataacgctgcacaaaggcccttgccgcttgctcatctccttcgggaacggcttgcaccgccttgcaggccgggcgccactgttcgggctgtccacccagcctggctgcctgatcggcggctccccccaatgtctgatcgttcggcaggcttaacagccggtcgcattcccgggcgaaaacggcaacgccacgggccacatggtctgtttgccaacccggcaaatcatccagtgccacaggctgaagctggctgacacggcccgtttgagcacaggcggtcagcaccaccatcagagacaacgcatacagggattttatctgcatactgcatagtatgcatcatgttgtattcgaaaaaaaccccttaaccttctgaaaggtcacatattatattgtcattaacctgtctcaggcattgtctgtgccggacagacgccaggtcggatcacggctggcgagatcccgctcaaacgtccagacatcgacaatttcggtcagcccttcgacaccttcgaccggctccccggtgcggttaagcataacattatgctgatcactgacaaaacgaatggtcaaagcggcctgcgtctgctccagccgggcattttcaatccggatatccctgatggactggatctccgtctgctgccgggccccgtcctgttcgcgcgcatcaatggcctgacagaaaatcgtaaacgtcgcctccgtcagcaggggacgcagcgcctcacgctcaccctgcgcataggccgtcacgataacgcgaaatgcctgctccgcattattcaggaagcgcactgcatcaaagctgcgatcaacctccttcatgcgcgcaagcacctgcccggtcgggctggatgcatcaggcaggacataagtccgcgcttcagccaccgcggcatcgggccgacgcaggcgaaccggcaaaccgggtatccggttaccggtctggccttgattcgccggcacctccgggcgttcaaacccgacacgtcgccccagcacactgcgaagacgcagaaccagaaaaaccgctatcatccccagcaacaccagatcgacgggaatatcgccgttcctgatagcctccatacctgccatccaatcgcgccattaaaatacaaaagacggtttctgctcattcagataagggggcaggccgctccacacaacctttgtatcttctgacttcgtccttccaggctttcttacctgatcagaaaaccgactctggagagtccatcgcctgaccggaaacaaaaggtccgtcaaaaagaattcttcgtgtcagcacgatccccgattgccgcggctggccgcgcaggccatacaggacgcatgattttgctgcgccatggacagagcgagttcaaccttcacttcacggccacacgccaggatccgggcattcatgaccctgtcctgaccgaggcagggctggcacaggctgaagccgccgccatggctcttgcgggggaaggcatcgagcgcatctttgcgtccccctatacccggaccctgcaaacggcacggcccattgcgcagaatctggggctgcctttgatcatcacgccgctgatccgggaacgctacgcctttgcctgtgatgtcggtacccctgccagccatctggcgaaggactggcccgaacatgatttctctcagcttgatgaaatctggtggccctccttaacggaaagcgaagcgtcaatcctcgcgcgggccggacgttttcgggcagaaatggctgccatcacagggtgggaaaatacgcttgttgtcacccattggggttttattctgtcgatgacagggcaatcattaacaaatggtgaatggatacgctgcgatccacgtcaggcaggaccagatacaattatctggtcggcataaacatgacttttgtttaaggccgtcttatgctggcgcctgctttttgaatgtgatattgctctattaatcatttaagagccttggagataccagatggctgacattgacgatacgactgacgaggacgtgcaggacgaggccgtaaccgaaaacaccgccagcactggcccgcaggcaggtccgccgctcgtggtcaatgtccagtatgtgaaagatctttcttttgaagtcccgggcgcaccgcagattttcgcagccctgcgtacgcagccgcaggttgatctgaatctggatgttcaggttcgccgtctggaagaacaggctcacatctacgaagtcgtcctcgccatccgtgcagaggccgtcgagcgggttgaaggcgaagaaaaggccaataccgtcttcatcgccgagctgtcctatggtggcgtgttcacgctgaacggtatcccggatgaaagcatcgaaccggtgctgctggtcgaatgcccccgtctgttgttccccttcgcccgcacgatcctagcgaccgtcacacgcgaaggcggtttcccgccggtccagcttcagccgatcgacttcgtcgccctgtggcaggcacgtcgtgcccagcagcagcaggaaacggtcgggaacgcctgatctcaggcttcggcatgatgttgaacaggaaacgggcctcgcgagaggcccgttttttgttatgggttgatctggtcagagcgtgcaggcaacagcggccgtcgtcaccccgcaggctgcgtcatgcgcatgattggcggaagcgatcatgatcagggccgccagaaccagaccggacagcatcagggcagcggcccggattggggtgggacaacgcatcagaatggatgttttcatggaacgaggaccttctcagcgagaagccggccccgtgccggccttgcaaagagaatgtgatccttcttacagtattaatccaatcgatccttatcataatgtccatcgttcatcgtaatctatcccgccttgatctgaacctcctgaccgccttcgatgcgatctataccgagcgcagcgtgaccaaagctgccgaatgcatcggggtcgggcaatcggcgatgagtcataatctcgcccggctgcgcgaagccttgcaggatgaattattcgtccgcaccccctccggcatggagccaacgccccgcgcccgtgcgattgccgatacagtccgcaatctgctctggactgtgcaggacaagctgctgaccacccgcagcttcacccccgccacggccgagcgcatctggcggatcggactggccgataatatcgagagcctgctgatgccgcctttgctggacatgatgctgaaagaggctcccggcatgcgtatccaggcgatcttcaccgatggtctgcgcgtgctggaagcactggatcgtgatgagctggatatgggcatcggcgttttccgccatggtggcaacgttcataaacggcgcaatttcgcaccggattcctatctgtgcctgtacgatccaaagcagattacgctagagggaccgatcacgctggaccaatatgcctccctgccgcatgtgctggtcagcctgcgcggcatcttccatggggtggcggatgatgcgctgtccctgctggggcggacgcggaccatcgtgatgaccacaccgcattttctctccgtgccttatgtgttgcggggggcgccggttattacgaccctgccgggaacgctggcacgctcggccgcctcggcacacgggctgtgcgtcagcccgttgccttttgaactggcaccgtttcgcctctcgatgttgtggcacagctcctatgacaatgatccggcccatcgctggctgcgcaatacggtcgccagcctgatggaccagatgcacacatgagcctccgtcaggacatctcctgtaccagccccatcgcctgccgttcgaacagcctgcgatacagcccgccctctcgctggatcagactgtcatgagtgccttcctcgacaatccggccatgatcgaacaccagaatccggtccatcgaccgaacagtggaaagccgatgcgcaatcacgatcgaggttcgaccggccatcagccgctccatcgcctgctggatcagcgcctccgactcggaatcgaggctggccgttgcctcatccagaatcaacaccggagcatcggccagaaaggcgcgggcaatcgcaacacgctggcgctcacctcctgacagcttgacaccgcgctctcccaccatggtgcgatacccttgtggcagggcgcgaatgaacgcatcggcatttgccagccgggccgcctgcatgatctcctccatggaggcaccgggacgggcataggcaatgttttcagccagagaccgatgaaacagcacagcctcctgcgggaccaatgccatctgaccgcgcaaggacgactgagtcacggtggcaatatcctgaccatccaccagaatgcggccatcggtgacgtcatacagacgctgcaacagcttgacgaagctgcttttgccggatccggaatgtccgaccagccccacccgctcccccgctgcgatgcgcagggaaaaatcttcaaacaggggtgtggtgtgactgccatagcggaacgtcacatgatcgaacatgatttctccccgaccggcccgcaagagtacggctccgggacggtcctccacaccgagcggatgggattgcatttccaccagctcctccatctcattcacgcagcgctggagattggcgacatgctgcccgatatcccgcagatagccatgcaccacgaaataggccgtcatcacgaaggtcacatcgcccgctgtcgcctgtccccgtgaccacagcacaatggcgtaaccgataatcaccgtccgtaagaccagcagcaccagcatctgcgccgagccgctattggtcccgtatatccaggtgcgtcgggtgcgctgccgccatttggtgaggatcctgcccagcaccctgtcctcccgcgcttccgcaccgaaggctttgacgacggcattgcaggtcacagcatccgccatggcccctcccatccttgtatcctgacggttggacaggcgggccgcaggggccacacaaagcaaggacaaagcaaccgacagcccgatatagaaaatggcgccgatcccgactgacagccccatccccggccagtaccagcccagcagcagcgcggagccgaccagaatcgtcagagccggcaacagcgaggtcagcaaggtatcgttcagcagatcgaccgcccagattccacgcgtgactttccggacaatcgagcctgcgaaattattggcgtgccagtccgtggaaaaacgctgcacgcgataaaatgcatcggccgcaatctgctccatcaggcgcagcgtcagagccgtgatccctacaaacgaaacatggcgcgcaccgacgaccagagcccccagcaatcccatcatgaccagaatcgtccatggaccccaaggtcgcaaccctgcatcaggaacggtcgatatggcatccaccagccagccggacaaaaccggcagccccagatcggcaatggttcccgccatcatcgtcagggccgtcagcagcaccatccgccattgccgaccccaatgacggaataaaaatctgagcaccatggcaacggcacccatgcgatcgcggtaaactgtcatgatgcgttcgttatctttcaggcagtgccgcagccatgccgaatggcggctccatccctgtaaagagagcaacagggaagatgtgaaaatgacgcacagaataatgttcgatcattccctgcatccaccctgtgcggatcgtggcagaccttctacagtttcatgatcgactgacgccttgcccctgcaattcaggtccaggaactatcagcatgagcggtaccagcagcatcgcccgcagcacaatggcttatgtcctggcgggggggcgtggctcccggttgctggagctgacggatacacgggcgaaaccggccgtttattttggcggcaaatcacgcatcattgatttcgccctgtccaacgcggtcaatagcggcatccgccgcatcggggtcgccacccagtacaaagcccattcgctgataaggcacatgcagcgtggatggaatttcttccgtcccgagcgtaatgagggcttcgatatcctgcctgccagccagcgtgtcagcgaaacccagtggtatgaaggcaccgccgacgcagtgtatcagaatctggacatcatcgcgggatatgagccggaatacatgatcattctggcgggtgatcatatttacaagatggattacgaaatcatgctccaccaacatgtggagcgtcaggccgatgtgaccgtcggctgcatcgaagtcccgcgagaggaagccaccggcttcggcgtcatgcaggtggatgatacgggtcggattacagcgtttctggaaaaaccctccgatccgcccggcatgccgggacagcccgacatagcccttgccagcatgggcatctatgttttcaaaacgaaattcctgttcgatgttctgcgccgcgacgccgccgatcctgactcaaaacacgatttcggcggggacatcattccggatctggttgaaaacggcaccgccatcgcgcatcgcttcagtgattcctgtgtccgcagcagcaaaacagcagaggcttactggcgggatgtcgggacgctggattcctactggcaggccaatctcgatctgaccaatgtcgtgccgacgcttgatctgtatgattcaggctggccaatctggacctataacgagatcagcccgcccgcgaaattcgtctatgacgatgtgggacggcgcggcatggccgtggacagtctcgtcgcgggcggatgcatcgtttccggggcctcgctcagccgatcattgatctccaccggctgtcgcgtgcactccttctcacagctgcacggcaccgttgtactgccttatgccgatatcgcccgcagcgcacggttacggaacaccgtggtggatcggggcgtgcgtattccggaagggctggtcgtcggtgaagaccccgagctggacgcgaaacggttccgccgcaccgaaaaaggcatctgcctgattacccagcccatgattgaccggctcggctgatcgttttccctgttctgatcggttcctgtccagatgcgtgttttgaatgtggcttcggaagcctatccatggatcaagaccggagggctggctgatgttgccggagcacttccagccgcgctcgccgagcatgatgtggatatgcgtaccctgctgcctgcttatgccgggttaaggcaaaggccggagacccgtccggttcatcattacgccgatctgttcggtggagcagccagtattcttgaggcccgcctcaccggtggactgaccctgtatctgctggatgcaccacatctctatgaccgtcccggcggcccttatacggatgccaacgggcgggactgggccgataatgccgagcgctttgcggctttctgccgggcggcagccgatatcgcccttggtattctgccggattggacgccggatatcgtgcatgctcatgactggcaggccgggcttgtccccgcctatctggctctgtcggaagcctcaccaagaccacccgtcctttttaccatccataatctggcttttcagggcgttgtcccacgggatcgtctggccgccctgctgctgccgcccgacagtttctcggtggatggggtggagtattacggccagatcggactgctcaaagccgggctgcactatgccgatgcgctgaccaccgtcagcccgagctatgcccgcgaaatccagaccgataccgggggcatggggctgggaggattgctgcgcgaccgcgccgccgtgctcaacggcctgctgaacggcatcgacatgaccgaatggaatccggcccatgatccgcatgtgaaagcccatttcgaccgtcacagcctggaacaccggaccatcaatcgtgaggccctgcgcacgcggtttggattggattcctcagcaggcccgctcttcggcattgtcagccgcctgaccggccagaaagggattgatctggttctgaatgctctgcctttcctgatctcgcaacaggctcagctggtcgtgctgggcagtggagacaaagggctggaacagggattgttacaagcggcgcaaactcatccaaggcagattgccgtcttttcaggatatgacgaggccctgtcccgccagattttcagcggcgccgatgccatgctgatcccctcacgtttcgaaccatgcggtctgacccagctttacgcgatgcgttacggcgcggttcccatcgtatcccgcgtggggggcctggcagacaccatcatcgacgccaataccgccgcctgtgaggcaggcgttgcgaccggactgatgttccagccggacggagaagatagtctgatcgaaccgctctcccgcgccatccggctgttccatcaggccgaaatatgggagcggcttcagcatcgcggcatggaaacagatagcagctggaccttgcgaagcacagcctatgtcgcgctctacacccggttgctctcgctccgttaaaagccgcctgctcgatcagatcggaacccgaacccccagctccaccacacgatcgctggggatgcggaagaactccgtcgccggcaccgcattgcgggccatcaccaggaacagccacagacgccagagcggcattttaggcgctttcccggccacaatggtttcccggccgaagaaatacgaaacctgcatcgattccaccggcacaccccgcgcccgcagcgcatcgagatcacggggaatgttcgggctttccttgaagccatagcgtatgatcacacgatagacattctctgccagctcctcgacttccagatgctgatccggcccggcttcaggctgatcgagcgtcttcacggtcaggaacaggacacgctcatgcagcaccttgttgtgcttcaggttatgcagcaacgcacctggcacataatccggattgccggtcaggaacacagccgttcccggcacacgcagaatccgcgattgaggcaggcgcgccagaaaggaagccagcggcaggctgtcctgcctccatctgctcatcagcagacgacgccccgcgctccagctggtcatcatcgccatcagcaacccgcccaacaccagcggcacataaccaccctgcgggatcttcagcatgttggaggcgaaaaacaggctgtccaacaggaagaaaaagccaaacacaaccataacactgcgccggctccaaccgaactgacggcggaacacgaccacggccagaatacccgtacacagaaacgttcccgtcacggcgataccataagccgccgcaagattgtcactggtgcgaaaggtcagaaccagcgccagcactccgatcagcaaggcgctgttgacctgcggcacatagatctgcccctgctccgtctcactggtatggcgcaccgtcatacgcggcagaaaacccagctggacgcattgccgtgccatggagaacgcgcctgaaatcatcgcctgactggcaatcacagtcgcagccgtagccagcaacaccatcggcaggcgcaaccaatgcggtgtcagcaggaaaaaaggattatccagtgccttgatatcatgcaggatcagggcaccctgtccgaaataattcaacgtcagggccggcaacacgatccatagccaggcctgcttgatgggccggccaccgaaatgccccatatcggcatataatgcctctgcccccgtcacagccagcacgacggaaccgagcacaataaaagccaacagcctgtgctggatcagcagcagccccgcataaccgggggacagcgccagtaacacctttgggtgatgcaggatcgccagcagacccagcaatccgatcagaagaaaccagaccgccatgatcggaccaaacacgcggcccatgatgctggtcccgcgccattgcaccataaacagcgccacgatcacgacggacgcaatcggcaacacgtagtccttcatggcgggataggtgatctccaacccttccactgccgacagaactgaaatcgcaggggtaatgacgccatccccgaagaacagacaggcgccaatgattcctgtcatacccagccagtaccgcatgcgtcccggattggcgacacgctgggccagcgccatcagagacaggatacccccctccccctgattatcggcccgcatcaccagcagcacgtatttgaccgtgacgatcaagaccagggaccagaagaccatggacagcacgccatagacttccagcctgttaatgacggacccatcatcctgaaaatgcaacaaagccgccttgaaggcgtaaagcgggctggtcccgatatcaccgaacaccacccccagcgcacccagcaacatgacaaggccagtgggttgaccagtgggttggccaatgggctttttttcgtcagccgccagtttttccgccgccgacattatatcatttccccgttcaagccgtcgtccagtcgagaattcagtcgatggcacaggacgtgccggtcaatatgcccgattctcatgaagaatgggtctcatgaagaatgggcgtttaaagatatccgccatccggcacggacggagaagagtgttccgccgcagatgggcggggccgggcaccgaaaatggctgttccgattcgcacatgcgttgctccgttggcaatggcctgctcaaaatcacctgacatgcccatggaaataaccggcaatccatggcgcgctgctgctgccgccagccataaaaaatagggatccggatcgacatccgccggcggaatccccatcacgccgcataaggcatccccgaaacgatgccggcacatctcgataaacgaatcagcctcccgcgtggggataccggatttttgcggctcatccccgacattcacctgcaccagcaggcggggcagacgcttctccttctccgcggccaatgccagtgcatcggccagacgcggacggtccagactttcgatcacatcggcaacacgcaccgcctcccgggccttgttggtctgaaggccgccaatcaggtgaagggtaggaggatcggcttcgtcacgcagcggcaggaacttcgtcagagcctcctgcaccttgttttccccgaacacgctctgccctgcccggcgcgccgccgccaccgcgtcaggaccatgcgttttggaaaccgcgacaagcgtcaccgtctgcggatcacgcccggcacgacgcgccgccgcatcgatccgcgcccgaatattggccaaagcagcgctcataaggtcaggctgctggtctgagagagaagtatcagcgtaagattgcaaggacatggaccaaaagctcattgcctgggcgcgcgccgtcaaggccaaagccccccgcaacgcaccaccgcccctctggctgttcacagatcatcgccgcgtacccgatccacgccctgacatcgcccggttgccgcgcggattatgcggcgtcgtctttcgccatgatgccctgcctgacaccgtacgggcaactctgttacgtcaggtcatccggctctgccgtgcccggcggctgattttgagcgtctctggctgcatccccgggggcctgccgatgtggacgcaaccccatcgacgcggcggcagattattagccaacagagccgacaaggcttccacctgtcttcccgctggcttgcccgctggcttgcaaggccgaccgataatcaccgcctctgcccatacaatccccgagatacgccgtgcacaccgtctgggcgctggcctgattttcttctctccgtttctgccgacggaaagccatccggggacagccgctctgggggccggacactggaatcggcttgtccgtatggctggccgcagtcttcacaacccgccatacattgccgctctgggtggaatagaaggccgccataccgctttactccgcatgagcggcatcctgaatgtgggggctattggtgccctgcatgcaaggcactgacggcaccgctctctactgacgtaatctggcgcaacaatcgtatgaggaatcgtgaagcagggatggcttggcctgcgtctgctctgacggtaatagggcatggaccgcatcttgttgcctgcccattatcggtccttaccgttccggaatacgacatgtctttatcctaccgttcagccatcgccgtttccgctcttctgctgctgagcgcttgcagcagtcaggaaaacgaaagcaaggattttaccgatccacaaaatcaggcggccgcacagagcgtcagcaatggggccaagcccgggcaggaagtgaatgtttttctgtggcgcgcgacgctcgacacgctgtccttcatgtccctgaaatccgctgatccgtatggtggggtcatcatcaccaactggtatcagcccccctcttcccccggcgagcggttcaaggtgacggcctatatcctcagcccggtgatgcgcagcgatggtgtgcgcgtctccctgttccggcaggtgcagaagggtggacaatgggaagaagcacccgtcgacagggaaaccgttaccgaaatcgaaaacaagattttgatgcgcgcccgctctttgcgagcagccggttttcagcagcagtaaaacagttttttcagtggctggtattactcagcggctcggaagccgggcgactacatgccaccgtcccgctattaccgacggcagcgatttctgccgcgtattttgcttgaacgcatgtgcagccggtcccctttaggaattggggatcggctttgtgtattatattagtatgttgatttgagatggttgcgggggcaggatttgaacctgcggccttcaggttatgagcctgacgagctaccgggctgctccaccccgcgtttgtggtggtaggtagcgtgaggggtgggttggaagacctggcggcgacctactctcccgcatcttgagatgcagtaccatgggcgctggggcatttcacgtccgagttcgggatgggatcgggtgtagtttccccgccatagccaccaggtcgtccaacccacctttttgggtggtgttgtgatgggatgttctggtgttttttaggatgtgctgtttgtcatgtgtggatgacttctgtgcatgatggaagttcttgagcctatcgggctattaggaccagttagctgagtgcgttaccgcacgtatacacctggcctatcgacgtgatggtctttcacggccctcagggagacctggttttgaggtgggtttcccgcttagatgctttcagcggttatcccgtccgcacatagctacccggctgtgccgctggcgcgacaaccggtgcaccagaggtgcgtccatcccggtcctctcgtactagggacagatcctctcaagtctccaacacccacggcagatagggaccgaactgtctcacgacgttctaaacccagctcacgtaccactttaatcggcgaacagccgaacccttgggacctgctccagccccaggatgtgatgagccgacatcgaggtgccaaacctccccgtcgatgtggactcttgggggagatcagcctgttatccctagagtaccttttatccgttgagcgatggcccttccacgcgggaccaccggatcactatggccgactttcgtctctgctcgaactgtcgctctcgcagtcaggcgggcttatgccattgcactcaacagccgatgtccgaccggcttgagcccaccatcgcgcgcctccgttaccatttgggaggcgaccgccccagtcaaactgcccgccatgcagggtcccggaccgggcttaccggtctcggttagacaccagaaaaacgcagggtggtatttcaaggttggctccacacaagctagcgcccatgcttcaaagcctcccacctatcctacacagcattttcctggtgccactgcaaagctgcagtaaaggttcatagggtctttccgtctgaccgcgggtaccccgcatcttcacggggaattcaatttcgctgagccgatgccggagacagtggggaagtcgttacgccattcgtgcaggtcggaacttacccgacaaggaatttcgctaccttaggaccgttatagttacggccgccgtttaccggggcttcaattcagtgcttgcacacctcctcttaaccttccggcaccgggcaggcgtcagaccctatacgtcgtctctcgacttcgcagagccctgtgtttttactaaacagtcgctaccccctggtctgtgccacccacacccggttgcccggacatgggtcttgcttatcccgaagttacgcaagcaatttgcctagttccttcgacatcgttctctcaagcgccttggtatgctctaccagtccacctgtgtcggtttcgggtacggtctattcgctggagctatttcctggaacgatccggctgcaggggcaatccagtaagtccccacaacgcttcacattcgtcacttccagcaggctcaggaatattcacctgattcccatcgactacggctttcgccctcgccttaggggccggctcaccctgcgtggattaaccttgcgcaggaacccttggactttcggcgacagtgtttctcgcactgtttgtcgctactcatgtcagcattcgcacttccgatacctccaggaggggtcaccccatctcccttcacaggcctacggaacgctccgctaccgcgtagatcactctacacccgcagcttcggtgtgtggcttgagccccgttacattttcggcgcaggatttctattagaccagtgagctattacgctttctttaaaggatggctgcttctaagccaacctcctggttgttttggaattcccacatcctttcccacttagccacaacttggggaccttagctggcggtctgggctgtttccctctcgtccacggaccttagcacccatggactgtctgccgcgctatacttcccggtattcggagtttggttaggtttggtaagcctttggagccccctagcccatccagtgctctacccccgggggtaaacacgcgacgatctacctcaatagatttcgcggagaaccagctatctccgagtttgattggcctttcacccctagccacagctcatccccgactttttcaacaggcgtgggttcggccctccagtgcgtgttaccgcaccttcagcctggccatggctagatcactcggtttcgggtcttctacctgcaacttgacgccctattcagactcgctttcgctgcgcctacacctatcggcttaagcttgctgcaaacagaaactcgctgacccattatacaaaaggtacgccgtcaccgcagatgcggctccgactgcttgtaggcattcggtttcaggtctatttcactcccctcgtcggggtgcttttcacctttccctcacggtacttgttcactatcggtcactagggagtatttaggcttggagggtggtccccccatgttcagacaggatttcacgtgtcccgccttactcatgtccttaatatcgctatcgcatacggggctatcaccctttgtcgccggactttccagaccgttccgctacacaatatcaaggcactggcctgttccgctttcgctcgccactactgacggaatctctgttgatgtcttttcctccaggtactgagatgtttcagttccccgggttcgcctcacgaccctatgtattcagatcgtgatctccttgcggaggggttgccccattcggatatccacggatcaatgcctgctcgcggctccccatggcttttcgcagcgtgccacgtccttcatcgcctcctagtgccaaggcatccaccgaatgcccttatcgcgctcaagagctaacacagatcggtcaaccaatccgtgctcatcatgcacagaagacatccacacctttcagtgcaacgcttctgcgtgattttactcagcacatcttaaacgcctctgatcatgatacccttcaccgtggacgacaggtctccccgtcaatccggtcagacaaccggtcaaggcatgcgcagaggcgcaccagaacatattcaccataacaaagaacaaatagcagagccttcaacaagaaggcccatcccgcatgatatcagaacccgaccggggccagactatcaccggaaatttttaacccatgcgacgataagggaaccggtcggcaaaccgccagtcaccacacgcaatggtggaggtgatcgggttcgaaccgacgaccccctgcttgcaaagcaggtgctctcccagctgagctacacccccatcacatcaaaccagccgcttcctcaaaaagcggccgatcatcatggtgggccagggaggatttgaacctccgaccccacgcttatcaagcgtgtgctctaaccagctgagctactagccccaagcagatatcgtcgcagcaaaaaataaaccagaccatcatctttcaatgacaatccagtccacctttcgcagaagggatacgtggacggcgcttcctgcctgaacaggtgcaccaggttgacagtgccttcgacgatcccatcgaaggacttcttataaaaccatcccaattcatccatccgcatggataaaactcaggacagttccttgaaaggaggtgatccagccgcaggttcccctacggctaccttgttacgacttcaccccagtcgctgacccgaccgtggtcggctgcgtcccttgcgggttcgcgcaccggcttaaggtcaaaccaactcccatggtgtgacgggcggtgtgtacaaggcccgggaacgtattcaccgcggcatgctgatccgcgattactagcgattccaccttcatgcactcgagttgcagagtgcaatccgaactgagacggctttttgagatcagcatggcatcactgcctagcttcccactgtcaccgccattgtagcacgtgtgtagcccaggacataagggccatgaggacttgacgtcatccccaccttcctccggcttgtcaccggcagttcctttagagtgcccacccgaacatgctggcaactaaaggcgagggttgcgctcgttgcgggacttaacccaacatctcacgacacgagctgacgacagccatgcagcacctgtgcagagggtccttgcggaaatgtccatctctggacacagccctcccatgtcaagtcctggtaaggttctgcgcgttgcttcgaattaaaccacatgctccaccgcttgtgcgggcccccgtcaattcctttgagtttcaaccttgcggccgtactccccaggcggtgtgcttaccgcgttagctacgacactgagttactaggtaacccaacatccagcacacatcgtttacagcgtggactaccagggtatctaatcctgtttgctccccacgctttcgcgcctcagcgtcagtcatgagccaggttgccgccttcgccaccggtgttcttcccaatatctacgaatttcacctctacactgggaattccacaaccctctctcacactccagcccgcacgtatcaaatgcagcccccaggttgagcccgggaatttcacatctgactgtacgaaccgcctacgcgccctttacgcccagtcattccgagcaacgctagcccccttcgtattaccgcggctgctggcacgaagttagccggggcttcttctgcgggtaccgtcatcatcgtccccgccgaaagtgctttacaatccgaagaccttcttcacacacgcggcattgctggatcaggcttgcgcccattgtccaatattccccactgctgcctcccgtaggagtctgggccgtgtctcagtcccagtgtggctgatcatcctctcagaccagctatcgatcgtaggcttggtaggcctttaccccaccaactacctaatcgaacgcaggctcctcccaaggcgacttgcgcctttgaccctcaggtgtcatgcggtattagctgtagtttcccacagttatcccccaccccaggacagatacctacgcgttactcacccgtccgccactgtccggccgaaaccaaaccgtgcgacttgcatgtgttaagcatgccgccagcgttcgctctgagccaggatcaaactctcaggttcatcaagccaggcacccaaaagcacccaacataacgaacgacccttggtctctccgacagtcctaaaaccgtcagtctcgaaacatactgtcaacgcatccaagatacatcaaaagcaagcgtcaataccaaagaaagaccaaaagtaaatcagtccaccagatacatacttaaccataaaagctaagcaaaacgccgcccgcgtatcccttcatatcttcattcaaatttcaaggaacaaatccgcaacttcaaaaaccagccaaccagccagtccatcgctgcggtggcggctatctacgccccacagacacctgtgtcaactcaatgacaaaaaataccccaaaccaatcctaacactctgataaacaataagtcctcacccacaaaacaacataaaaaaccctcaccaaccaactaaaataccaaaacaataaatagctaagtcgatatgcaaaaaatgcatgggttaaaaagttgcctcacgcctcgcccagggaagccatgtctatgacgaagcggtatttcacgtcgctccgcagcattctctcataggctgtgttgatgtcctgtatccggatcatctcgatatccgctgcaatgcctcggctggcgcagaaatcgagcatctcctgtgtttccggaattccaccgatcagggagcccgcaaagttgcgacgcttgaagatcaggctgaacacggccaccggtaatggatgctccggcgcaccaacctgaaccagcgtgccatcgcgcttcagcaatgcgagataatcgtcgattggatgctgggccgccacgcagtcgagaatcagatcgaagcgattggcttgctgcgccatctcctccgcattgcgggacaccacgacctcatgggcgccgagacggagtgcatcttccttcttgcctgggctggtggtgaacagcaccacatgcgcacccatggcccttgccagcttcacccccatatggcccaggccaccaagtcccacgactcccacaatctggccgggtccggctttccagtgacgcagcggggaataggtcgtgatcccggcacagagcaaaggcgcggccgcagccggatccagcccctccggaatacgcagcacaaaggactcgtccacgacgatactgtcggcatagcccccgaaagtggggccgccgatcacaggatcctggccgttataggtcgggttgaagcctgtttcgcaatactgctccaggccatcccgacaggatacgcaactgccgcaggacccgaccatacagccgacccccaccgtgtcaccggcacggaattgcgtcacttcggtcccaacctccgccacgactccgacaatttcatggcccggaatgcagggatagaccgtgttgtgccactcattacgcgctgtatggagatcggagtgacagacgccgcaatactgaatgtcgatcctgacatcgcgtggtccggtatcgcggcgttgaaaaaccgttctggccaaaggcctgtcagcagcctcggcgctgaaacccgtacatgtcagcatagggcgttcctgttcccatccttggtgacaacagcctaatgctaaggaaagttatattcaaacaggtattcttatattgattcgattgcagaacagccctccattgctgcttccgcatcaagcctgcgcggctctgcgggttgagacccgggccagcgctgcccaatcccaatgcccttcaccatgggcgaggctgtcgagatgattgtccctcagcacgctggcgatcggcagtggcacacggacattttccgccgcctccatcgtgagtcggacatccttgaggccaagagagagtttgaaccctgccggctcataccggttttccgcaatggcggccccatatcccttgtaaaccggagccgcaaaaagcgtggatgtgatcaagtcgataaaatcggcttttgcgattccgtatccctgggacagggcaatcccttcccccatcgcactgatagcgcttgcaatcatggtgttcacggccagcttgacggcgttggcctgttctggacgatccccgaatgtccatgttctctggccgagaatatcaaagacaggctggacatctcgcagggtagcggactcgccggcggtcaggatgttgagctgaccggcctcggcaacattcacacgcccaagcaccggcgccgagacatagcgcacacccttttcacgatggcactgctccagatcgacagcacaggccactgatattgtcgccatattgatatggatggcacccggcttcatcgcctccagcccgccggcatccatcatgacagcacgggtggccgcatcgtccgacagcatggagatgaccacatctgcatccgcgcaggtgtcgcgaggcgtcgccccggccacagcgccttgggccaccagcgctgagaccgagtccggcgagcggttccagactctgacccgatagccggccttcaccagattggctgccatgggcttgcccattgtgccaagtcccagaaatccgatcttcattccgcgtctcctcatggtcagggcttggtccgcagagttcttcatactctaccatgacaacaggcggctttttaccgcctgctccacaccacgaggaatttgacggctcttacagacccagcatagccccgaacggcagaatgaacgtgccacccacataaacgccatcctgaggccgcttcgcagcagtcggcgtatagtaggagttcggattgacgatgtagtcgaacaccggctcgaacgcgacggcggagtaaagctggatatgcgcgttcaactcgaaaatcgccttatcgcgggagaagtcaccgccgctgccaccagccaccgcattggcctgagccagatagttggccagcgcacccgtcatcctctcccatttgattttgactccgaaacgatcattgggacggctctggaaaggggcctgcagggtcgctccgacatagagatcggattgaataggagccgttgcatccagacccaacccaagtccgctatacagcaccagcgcggtcggggtcagggttttacctttgccgccatccgcacgccacaccgtctgctgagtattcagtaccagcccctgcgtaccgtggctctggcggagcggatcacccggaaaataggctttcggctgaccggagacagtcttgaaggaattatgatccgcattgttgtaaaatgcggtcaatgaatagctgccgggataggctgaattactgaaatcggttttctcgccgatttcaaccatggtcaacgctccctgcggcgtttccagaccccaatcccacccgctgcggctgttcgcattcgggttggtggcgaaagacccggcctgcacataccagccggggctgaaagcgtagctgaccctgccgccccacatcgaatactgcggagaaatatagccggcattgatataaagaacatcctgataacagctgttgatgacctgacagttcggagccgcgaaataccggttgggatgcgtgcggcctgcttcgatgaccagcttgtcattcagaagatgctgttcataggtcagcagggacaactgattaggacgaagattatagggaggcggataaccgatactgttatcgccgatctcccccgagatcaggacgttggaacgcagagtgaaaatcgtttcctcgaaatggaacgtgccgcccttgatcccgagaattttttccaggtcagcatcggccccgacaatcagataacctgaattcgcagtattgccggtataggtgcccgcgctcggattggcttccatgaaatcgagaaacgtcccgtgcagcttcagcccggattcgcgaagcttgcgcgagaacggggccaggatttcctcttttttctcctccggtgtgagcctcggctttgtcagcccctccaccacgcggggattgaaattgccctgtgcatccggtttgcgtaaggctcccgatgtctgagcatgggcaatactgccgccggccagcaccgcattcattattacaatggccgtcacagcggcccgccgccctgtctgcctacccatcaccatcactcgtctcccccgaaagaagcaggacgactgacttttcttcccgatcagattttcgcgacgcgttctgaaaagcgcattcgttcttctgtcgtgatgatgagtgaatcaggcagggcgggtggatacgtcatatgacgtatccagatggactatcaacggaacaggttggtacgggccatctccagcacggaatcgccgcggccgctcatcaccgcacgcagcatgtaaaggctgaagcccttgacctgttcaatgctgactttcggcggcatggacagttcctgacgattgaccaccgcatccagcagagccggcccgggatggttcagaacatcacgcacggcctcatccagcttgcccggatcctcgaccctgcgcgcatacacgccacaggcacgggccatggctgcgaagtcggggttatccagagccacgccgctttccagcaatcctgctgccttcatctccatttcgacaaagccgagcgtgccattattgaacaccacgattttcacaggcagacgatgctgcaccagtgtcaggaaatcgcccatcaacatggcgaaaccaccatcgcccgacatggaaacaacctgccgttccggtgccgatacctgcgccccgatcgcctgtggcagcgcattggccatcgagccgtgagcgaaagaacccagcagacggcggcggccattcatcttgagataccgtgccgcccagatggtcggcgtgccgacatcgcaggcaaagacagcatcatcactggcatgttcgctgatcagccgggccacgtgctggggatgaatcgggggacgacccgcctttccatcggccagatcatccagccccttgcgggccttcaggtaatgctgacgacaggtgtccagatgcgccgtatcctgtttggctttcaggcgcggcagcagggcactgatcgtggcactgacatcacccacaacaccgagatcaatccgggtacgacggcccagattttccggacgcagatcgacctgcgcgattttcgcctcttccgggaaaaactgccgatagggaaaatcagtcccgagcatcagcagcatgtcgcatgattccatggcgtagtaaccggatgaaaatccgatcagccccgtcatgccgacatcatagggattgtcgtattcgatccattccttacccccaagcgcatggacgataggggcttttaaatgctccgcgagcgccaccacctcatcatgcgcaccgcgacagccgcgtccacacatcagcgtgaccttacccgccgcctccagcagtgctgtcagggcattgagcgattcttcagaaggagacgtcaccggcggctccggacagagcgccgttttcgtcgagacgacgggcgatggaaccgtcttcatcgcaacgtcaccggggatcaccaccaccgcaacgccctgatggccgatggcggcacgaatcgcggtgttcaaagtgcggggcatctgatcggggtcggagaccgtctcgcaatagacactgcattcccggaacagcgcttccggtctggtttcctgaaagtagttcgagccaatttccgctgtcggaatatgagcggcaatcgccagcatcggagtgcgagaacgctgcgcatcatacaagccgttgatcagatgcaggttgcccggcccgcaggaaccggcgcaaacggcaatctggccagtcaattgagagtctgcacctgccgcaaaggccgctgattcttcatggcgcacatggatccagtccatgtccggacgccgccgcaatgcctccgtaatggcgttcaggctgtcacccaccacaccatagacgcgccggacgccaatgacttgcagtgtttcagccagtatttccgcgactgtcggctcggccatgaaaacctctgttccttcgattgaggaaatcgagcatgcacgaaaccatcactgtatgcgccctccaaattcattgggcgcaaaaaaatccctcgccgaagcgagggatgatcagcggcatccggctcagcgaccggtcatgatccggtcaacaagctgtttaacggtagggatgaacccgtttgcatagaacgggtcagtgccgaaccggtaggcattgtgaccactgaacatcagattgtcctcgatcacgtccgggtcgttcttgtgatgcccgatcgtctgcaacgtcttctgaatgcagaagctgcgcggatcggccttgcggccattggtatggttctcggaacgctggctccaattggagaaacggcattccgtcaggcaccccatgcacgccacctgatcggcctgtattgtatcagcctgatcgggggtgacgaaaatcagcgtggaatcgggtgtgcgcaaagcctcgataaatccggcctgttcccattcctgtacccgacgcagatcggccggggtcagatagacaggacgcttgcgcggccctactccgtataccgccgtatgctcgccgaccacctcacccgtgtaggcaacctgacggtcgctgcgggcgcggagttcctgcatgaaacggttgttcacggctgaagaataaaatccggtcgggctgaacggattcagaaacacatcccccggcttcagggccagcagcttggccttccactgctcggatacagggctttcgcgtgtgagcagaggacgggtgccaaactgaaaggcgatggggccgagttcgggattatcaatccagtcctcccactcctccagccaccagacgccacccgccataatgataggcgtctcgccaagaccgaactggcgcatctggttacgcaacgccagcacgcggggatagggatcttccggccggttcggatcttccgtgttggaaagcccgttatggccgcctgcaagccagggatcttcatacaccacgccgcccagcaggctggccgccttgtggtaagcgcgcttccacagcgcattgaaggcacgggccgaggaaacaatcggataataatgaatcccgaaatgggttgcgatctcggacagtcgatacggcatgccggcaccacaggtcaggccgtgcaccagacccttcgcgccttccagaatgccggtgatcacccgctccgccccgcccatctcccacaggatattggcgtggatgcggccgcggccgttggattcctcatgcgcctgccgggcctgctcgatcccgccgcgaatggcgtagtcaaccagttcgtcatgccgttcccgacgggtacggccccggtagatctgttcaatcaaccggccactggaatcatggctgtccgcgttcaccgcgctgaaggttcccaccccaccggcagacgcccagcagccggaggaacgtccgttggaaacagcaatgcccttgccaccttccaccagcggcagaacgtcaacaccgcccatacggatcgcgttaatggccttcatcactcactctcttccgcaatctgccagaacccgggaggaggtctgaccgatcctgaccgtttccggtcttaatcagcgtctccggcaggctgctcctgatcggggcagcctgccgaatcacgtcttactcggccagatcgccctcaccgcgaccgcctctgccacccttggggccgaccttgtcagagatgtcctcgcccgtggtctgatcaaccagccgcatggaaagtttcaccttgccgcgatcatcaaagccgagaaccttcaccttcaccacatcaccgacattgatgacgtcggaggtcttgttgacccggccctgctgaagctcgctgatatgcaccagcccgtcgcgggagccgaggaaattgacgaaggcgccgaaatcagcggtcttcaccaccttgccgttgtagatcttgcccacttccggttcggccacgatgccctgaatgcgatcaatcgccttctgggtgctttcctcgctggtcgaggcgatcttgatggttccatcatcctcgatatcgatcttcgcaccggagaattcaacgatctcgcggatcaccttgccgccggtgccgatgacttcgcggatcttttccttcggcacgttgatgacggtgatgcgcggtgccgtcgcggcgacggagccacgggcaccggtgatcgctttcgccatctcgcccagaatatgcatgcggccgtcacgggcctgctgcagagcgatgcgcatgatctcggtggtgatggaggtaatcttgatgtccatctgcagggaggtcacgccctgctcggttccggccaccttgaaatccatgtcgccgaggtgatcttcatcgccgagaatgtcggacagcacggcaaaggcgcgatcttccttgatcaggcccatggcgataccggccaccggacgcttcagcggcacgcccgcatccatcagcgccagagaggaaccgcatacggtcgccatggaggacgagccattgctctccgtgatctcgctgaccacgcgcagggtgtaggggaaagcgtccttggccggcagcaccggatgaacggcgcgccaggccagcttgccatggccgatttcacgacggcccgggctgcccatacggccggcctcacccacggagtagggagggaaattgtagtgcagcatgaaatggctgcgatattcgccggtcagggcgtccaccacctgctcatcctgcccggtgcccagcgtggccacgcagagcgcctgcgtttcaccacgggtgaacagcgcggagccatgggcgcgcggcagaatgccgacctcgccgatgatcgggcgcacagtgcgggtgtcacggccatcaatgcggataccggtatcgaggatcgcattccggacgatatccgcttccagatccttcagcatcgacttggcgatggattcttccggtgtgccaccgatccccagcgtttcgataatctgcttcttggcggcagaaatcttctcctgacggagctgcttcaccttttcctgataggcattgcccagcagggtgcggccagcctcgttcaggcgctgcttcagcgcgacatgctccggattctgctcgggcagggtccagggatcgcgggcggcgtgttcagccagggcgatgatcgcatcgatcaccggctggaagcctttatggccgaattcaacggcggccagcatctggtcttcgctcagctcttcggcctcgctctcgaccatcagcacgccttccgcggtaccggcgaccaccagatccagcttgctttcagcgcgctgctcaagggtggggttcagcacgaatgcgccattcaccagaccgacgcgagacgccgcgaccgggccgaagaacggaatgccggacagggtcagcgctgcggagcaaccgatcagggcgacgatatccggatcattctccatatcgtgcgacagcacggtggcgatgacctgaacctcgttatagaacccttccggaaacagcgggcggatcggacggtcgatcaggcgggagaccagggtctcatgctcgctgggacggccctcacgcttgaagaagccgccggggatcttgcccgcggcaaaagctttttcctgatagttgacggtcagcgggaagaaatcctgaccggcctttgcggatttcgcacccaccgctgtacacagaacgatggtgtcacccagccgggccagaacggcaccgtcggcctggcgggcgatcttgcccgtttccagtaccagcgtgcgtccacccagatcgagttccttgcggaaataattgaacatgcagtctccgtctcttgcggtgttttgagtgcgctgcgaggcggagtccggcggctcgggctacagggatcgcggcctgcatggatgcagccgcttgccgtgtagccggagacgccgatcaaattccgccacccggcgcggttcggtcactctcttacaggaacaggcgcgatagcccaaatcctaatcgtccgaccctgtccagggtgagagggatccagagtgtgtggggggagaaaagaatgtttctcccctgctccatcccttttggcatccggtcctgccggagaatcaggagtggagaagtccggcggaggccagcctgggctgaccccctttatgccggttggaaacgccagaattagcggcgcaggcccagacgcttgatcagcgcgtcataacgggcaacttccttacgcttcagatagtccagcaggccacgacgctggccaaccagcatcagcaggccacgacgggaatggaagtccttcgcgtgggtcttcagatgttcggtcaggttggcgatacgctcggagagcagggcaatctgcacttccgggctgccggtatcgttggcggcgcgggcatattcgctgatcagcgccgtacggcgctctgcggtaatcgacatcggtcactccatgattcgaggttacagcggacgcgtcacatcatgcgttcaggccgcaacaggccatcctgcaagcggcacagcccaacgacgcggctccccgccatggcacgaaccaatccaccatcgggatcgatccggtctggaatacggcccatcaacggaatcaggctgagtgcctgcccatgggaaaggccggtggcctcctgctcggtcagggccagcgccgggatgtcggccagcgcggtcgcgaccggaagcaaaaggtccggggaagcatggggggtatcgccggaagccagcgccttgtccagcgaaatagccgtcgcctccgtaaaggggccgacccgcagccgacgcagggcagcgatatggcccaccgttccgcaggcacgggcgatatcgcgggcgaggctgcgcatatagacgcccttgccggactggacctcgaacaccgccagatcatcatccagacgctcgatcagttcgaaccggtccacccgagcggggcggggcggcagatcgggcggacgcccatcccgcgccatatcatacgcgcgctcccccgccaccttgatcgccgaataggcgggaggaatctgcatgatcgtaccgcgaaaactctccagagccgcccgcagcacatcgtcggtgggacgcaccgtgctggtggcggttactgcgccctcggcatcgtctgtatcgcgcgactcgcccattttcagggtgaaatgatacagtttcgtgccgtccatcacataaggcaccgtcttggtcgccgccccgaacgcaatcggcagcagaccggtcgccagcgggtccagcgtgccgccatgccccgctttctgggcatcgaaaccgcgcttgaccctgttcaccacatcggtgctggtcatgccctgcggcttgtcaatgatcagccagccatcgagaggccgaccttttctgcgtctgttcatgctcaaaaactatcccggcccacccaaagggccgcctcccggcagcccggccgcgggcctgtaacatgggatgacgggttcggatatgccccgctttcccatatccggcatgtgcagacagggatcagagcaccacagatgacctttgcaggcagacttgccagttgccgcatactatggctcaaaagagttaataccattgcacgggatcgctatcgcatatgcccacagctctgattaccggcattaccggccaggatggcgcctatctggcgcagcttctgctcagcaagggctatcgcgttctggggatgatgcgccgctcggcctcctccgacgtgatcggtgagcgcctgcgctggctcggcgtgctggaccgggtggagctgattgacggcaacctgaccgatctgtccagcctgatccgcatcctgagcgagcacgccccggacgaggtctacaatctcgccgcccaaagcttcgtcgcagcaagctggcagcagcctttactgaccggcaatgtcacagcgctgggcgctggtaacgtactggaagccgtgcgaatcgccgcgccgaaagcacggttctatcaggcctcctcctccgagatgtacggcctgatccaggaaccgaaacagagcgagaaaacaccgttctatccgcgctccccctacgcggtggccaagctgtacgcgcactggatgacggtgaattaccgcgagagcttcgggttgcatgcctcatccggcatcctgttcaaccatgaaagcccgctgcgcggcatcgaattcgtcacgcgcaagatcaccgatggcgtggcccgcatcaagctcggcctggcgaaaacgcttgaactgggcaatctggatgcaacccgcgactggggccatgcccgtgattacgttcgcgccatgtatctgatgctgcaacaggacaggccggacgattatgtcgtcgccaccgggcgcacaacctcaatccgtgatttctgcaagatcgccttcggctatgcaggactggattgggaagaacatgtggtcacaagcgccgccttcatgcgcccggccgaggtcgatgtgttgcttggagacagcaccaaggcacgaacccgacttggttgggaacccgagacctctctggaagatatggctagtgagatggtggaggcagatctggcccggcatcgtgccaggctggcccgctgacctgcatgcatcccgtcagacccggcttcacggccatccggagctgacggatttcattaaaggagattattcgatgcgcttttcccgcgcgatttttctgaccattcccgccctgcttgcgacatccggcctgctcggactgaccggctgtgaacgcgaagcccccatgcaacgtgcaggggccgcgctggaccgtgccggaaccaaaaccggtgaggccgtcggcaccgccgccgacaaaaccggcaaggccatgaacaatgccggccagtgggttgatcagaaagtgaacgacaacaaataatcccgttggtaccttttatgatcggtaccggctatatgcaaaacccccgctttcagaggcgggggtttttcgtatcgggctttactgagccgcaacgtcctgcgcctccaccatcaacctgacgtctatcgaatccgatcgtcccgcgctgtcctgcacagtcaggcgatgaaaacccggcccatcctgttcctttgatggcgtccagaccggactctgcccgggaaacgaacccggcagagtccggccatccaccatccaccggtagggaggcttgcccttctcaacccgcagatcgaccggctgctcctcactgctgtcgatcacggctcccttgggcggaaacaggatgcgcggcccctgcgccatcaccgactgccccagacgcgccagccccgcccccagtcttccccttcgttccggggctgccaccgtcaaaggtgcttccggtggcagaagatcgaacagccggaacagcactgggccggaggcagtcagaccgtacgcaccgggtcgaggagaaccgtctttccgcccgctccagaccacgatcgtgtagaggggggagacgccaaccgaccatgcatcccggaatccataggatgtaccggttttataggcgatggggcgctccggcttcgccacgccatcgggcagggaggtatcacgcagactatccagcaccgccgcagcagaagacgcagagcacagccgtccattctccaccgtccgaccgtcacgacgcagggtgaggggagccatgatcccaccggaagcaagcccggcataaagcgcggccagatcctccatccgcacccccaccccgcccaatgccagcgacagaccggcagaggtagcccctctcggcagccgaaccgtcatgcccgcagcccgcagagccgccagaaaacgatccgggccgagccgcgccagcaaggccaccgccggaatattgagcgaccattgtaaggcacgacgtgccgtgacatcgccatgccagcgatgatcgaaattatgcggggcataggtgctggcctgcaaaggcacgtcggcaatcagcgtatccggggccgccagcgcatgatcgaacgccatggcatacagaaaaggcttcagcgtggagccgggtgaacggatcgcccgcaccatatccaccatcccggcatccaccatcccggttgagccgaaataatggccgcctccgacataggccagcacggcgcgatccctgttgcggatgaccagcgccgccatatcggcaccggagccgctccattgctccatctggctgaggatggtctgctccgtgccggactggatatgtcgatccagcatcgtctccaccggcccggcatcacgcccgaagcgagcggtgaggtgctgcgcaaaggctggaaacctgtgccagcgcatatcgggccagatggcagcagaactatcgggttttccatactgcgcaatgtccagaacatgggcggcaccgcgacgggcggcctcctgatgccgatcagggcggcggctggtcggactttgcggaatagcaaccagcagggacgcttcctccctgctcaggcggtccggttcatggccgaaccagatcagggatgcactgcgcaccccttcgacattgccccccatgggaaccagcgtctcatacagggccagcaccccctcccgcccaagatgcgcctgcaactgcaccgcccgcgccatttccagcagcttggcgggaataccccgccagttgcgggcatggtgatactccggatgcagcaggcgcacggtctgcatggcaatggtcgagccacccgacaccaccctgccatgccgcagcacctgccagctcgcccgcaatacagagaggggattcacccccggatgccacgcaaaccaccggtcctcacgcgccagcagcagggaacggtaaagcggcgccaccccgtccatgcgtggacgcagccgccagaacccgtcggaggtcacggcaacgttcagaatcccgcccgaggagtcgcgcagctccgttgaaagcctccccgcacgggacagatcgggcggacaggccgcgtcaagcgccagcaggctggacggcaccagcacgaccgccagcgcaaccagccgccatttaccccgcatgggtcaacgcgcaccaacccgcgtgacaccggcttccgtgcgggccatgacggacggacgatacatatcctcgacgatcgcttcggggcgggtgaattgtccgggggttaccaggcgcacgatataagccacccggaattcccgggatgacaggccgggatgttcttcatcgtgatcctcgtagcggcgactcccctcctgccccagcacgaaagcagccacgaagcggtcatcgcgagcctgccagttttgcagcggagacagatcctgcaggaactcatatcctttcacgctactcatcggcgcctcgatttcccagcccgccggtagcatatccaccagcaccgtctgatgattgccatcatcccggacctgaccggacagcgcgacgatcagccggtcgttctgccgcagacgctgcggatcaaccggcgatccatccatgttcagcaaggtgcgggtcagggtgtagccagcctcgatcggcttcggggacgctttcggcgttcccgtcacggtcaccgtgcggaaaagtcgcgcctgcgtgtcattgcggaccgcatatccgctggccagttgctccggcgagggggacagcgctatcggcaacatccccggtcgggatacaccgttcaccgtcagcaacgatccgcccttgatcggcgcgccgttctgtaattcatgcgccgccatcagcagccatgccttttcctgcgtattcaggctccccggctgaagattctggttctgcacgctcgccagcagagaggtcgcaagctcgtcattgcgtgtttccgccgcaatcgcgatcagcgccgccagatcacgcagcggcgtgtagtagaacccccccatccactcaccgggcacagaggaaagtttgagattggcggacgccagccggaacagttttttcgcccgctccgtatcgccggtgagggaagcagcccccgccagctgggcgagcgcaatcgccggggccggtttgccgttctcgaacgtcacactgcccggctccggcttgtcgccacccatccagccgagactgtcactgatacggtgcagcagggccgcatccacctgaccacccgaacgggccaacagataaagaccatacacgaccgtcacatcccggctggcgcgataataaccactttcctcgttgccggagccggatatgatggcctgaacattggccagaccgcgacggagcgccgcatcgggaatatcgaacccggcctgccgcgcatgcaccagaaaatcagcggcatagatattcagccaattcgaggccccgttatcgcccagatgccataaaccgaaccggccagatgcgtcctgacgatcgagaatggtgtcgatcgctccctgcacacgctgaatgacggcccggttttccttcccgtccctgccgatcagggtcggatcattgaaatagagcaggggcagggccgcagaggctaactgttccgtgcagccatacgggtactggtacagcgaccgcagcaaaccggcgacatcaatgccgccgaagcgattataaccaatagaaaccgacacactgccgggggcgaagcttttctgtgcaaccgggtcatagctccatagctctcccggcgtctgaagggcggtctgggcgatgctgaaggggaaatgaggctcccgtaccgcaatctcgtcctggtgggtaacatggaatccgttcgggcccgtgacctcggtctccatggtcaggatgccgtcaccactggcagtcagggtgagcggatcagccacgcgatccccaggcttcagatcatagtccagcgcatgttgtgcactgacctggccgggcccctgagtcgtgatcttcacggtgtagcggcctgccgctccgtcaacatcatgcagttgcaacactggctgcgcgacatcgcccggtgccagaaaacgtggcagcgccagagtcaccaccaccggatcgcgcaccgtcaacggcgcgtccgcatgccccagcgcctgcggatcataggccaccgccatcagacgtaattcaccctgaaaatccgggacatccagttcaatggtggcattgcccttcgcatccagcgcaaccggtccccggaacaacgccacggtccggctgctgcgcaccggcagggcggccccgcccagatcgtcatctccgccgccaccgccttcatgcaccgcgccgacacgggcaccatcatccagcaggcggccgtaatcatcacgcatggacacgcccagacgctgttttgccgccagcgcacccagcgggtcgggcgcgtggaatttcgtaatctggaggataccctcatccaccgccgccagcgtgacataggcggattgcggggtgcctccatcgggccgtgccacatgcaccggcacccatatgtgctgccgtggcaatgtctgctgtggcgccttcatctcaacggtcagacgatgggcggaggtatccgtggcgatccaggcaagccccaccgcccgtaccggatcatgcgcccgacgcttctgatcaagcggccggtacagcgttgccagaacatacgcccccgccccccaatcctccgccgccttcacatcgactgtcagaccgcccgctggaaccgcaacatcacgggtttccagcacccggctgttggcgatgacgatctccgcccggccggcaaaaggcgcgtcgatatgcacccgggcagtctcgccggctttcagggtgtttttgtccgtggagacagccagtttgtcggggctatccgcattcatatcggtggaggattgccagccggaggaaaatctcatgctggtgacagccccgctggcctcatccgagacgatcagccgataggtgccccatggcagggagcgctcgattccggtcttgccgtccgcggtgctgtccactgtgccggacgccaccgtgcgatccacgacatgataatgatacgtccaatggctgccgttttcacgcagccagtcccagtgccgctcctcctccaccagcgcccagtgcaggccggggcgggccaccggcttgccatcggtggagaacgtagcaacccggaaacgggcgggcgtatcctccttcacctgatcgccggagaattccggcagcaaaccgatcagaaggggttttgtccgcagcttgatctgctgactggtctccaccacccgcccgctcggctccgccagaccagccaccaatgtcgcaatcaggggggaggcaacagaatcgggcaatttgggggtcacatcgagtgtcaccttccccgccgcatcggcatcaggcagttcgagcggcatggcattctgcgccaccgtctcatccaccacgccgaaatgccagcctttcagaccgggcaccggttcggggtcgggggcgaattccagccgcgcctccgcatgcagcccggccgccggagccccatacaggaaccggcccgtcagcgtgccggtgataggctgggccgggccaattgccttcggcactccatccagcgtcaccgcaagcgtctgcggcacgaaatccctcacctgcacctgaagcgtgccgaccggcggtctggagggatcggtcagcgcctcgatcgtccagttaccgtgagaggatggatcagggagcgtgaaatcatgctggaatccgccagatgggctggatttcgcatccagcgtgatgcgctttgcctccatcccgttcgggcggcgcaacaccagactcaacggcatggaggcagccgcatccagagaacgttgacgcaggagcgccatgacatggatcgtctcgcctgggcggtaaatgccgcgatccgcataaagataggcttcgatcggaccaggcggctgccgcccggaaacaccgcgatcagacagatcgaaaggctgcccttccagactctggaccgcgatatcccctttcccgccctgtgcaatcagcagtgccggtgcagccgccccggtgcctgccagcaatggcgcggcgaaatgggctttgccggaggaatcggttttcgcagtggccagcacatcctgcccgcgtgagagcagatgcacgctcaatcccgcctgcggcatcgcatcggacagcgcacgcgccaccacggtcagtccatcctcaccctgccatgtggacaggccggtacgggtggcaatcagccagtgtcccgcaatgctgctttcatacacatcgccattgtcgctggctccatcctccgttcccggcagcaaagaaaccgccgggcgatccgcattttccgcgatgaccagatacgcaccagcttcttccggcttgatgatggagggaatcgggaaggccgtttcaacagtcgcgttcttctccgacgccgcgccggttccggtatccatcgtgccggaccagatctgtgtcgcgtcgctctgcaacaggcggcggagttcccagaccgagaaattctgtttgccgagatcaatatcgcgtccgtactgccccgtattcgtcagtttggaggacagcagacgttcacccatgcggaacacccggaccctcacccgtcgcgtattgaccgtctggatcgtcagaccggaggcagtcgcgcgcgacagaatccagcctttgccacccaccgcgatcatcggatcgcgatcaggcattgccgccttgacggtaaaggcacggctggtcttctgccctttgctgcccgtcagaccgggcagaacggtgatggtataatcgcgccccggcgacaggccatccacacaaagacggtttgcagtcacgcgggtgacgatgcgggcggccggagacactttcaaaaagccggcttcattggtgccggcctcggtcgagagcttgtcatcgaatctcaggcacagaccggagctatcggctgtctgttcgggggctacaccccgaaactgcaatgtctcctgcccaaaggcgggggaagcggccaatcctgccaacagagccgcagtccagaaatgtgttgcagccctggcagacattttttcatccttccgcgctgtcgatcagaaagcagcaagaagaatcatgatacaaaattcaagacgcaacatcgtgatttcgatctgaaaccagaacgcgcattatcccgccttgcgggatcagtaagccaatactgaaaccggcgcccttttcacggcgccggttctgatcgggatgatctgcttatttaaagaatactcccgcagacccgcgcgcggacggaggcccaggcggtgggcccggaggaggacccgggggaggacccggccgtggtcccggcggaggaggtccaggaggagggggaggcggtggcccaccaccccagcggcggccaccaccccaataaggcccaccccagtagggattgccgtaataaccgggatagccgccaccccagtaagggccgccatatcccccgctatacccgcccccatagccgccaaagccgcccatatccgagcaagcccccaccaccagcacagaggagaggagcaaacaacgtgtcatccagcgaaaagcggtacagtgcatcatagcaccttcaaacacctataaagtggccagatcatggcggcatagcgtaagggttacaacgtttaccgatcgtaaagtttccagcatgcgacagcccttttgggcacacgcaaaccccacactctcgtaaaagaatgtatgaagagaaatcaggggggaggatcagccggtcttcccggtggaagaaccggtgcacccgtccagttcctgcccccagcggcatacggatcaatcccgtacggaccgctggcattgccgggcttgtacgcggctcctgcatatcctccattctgcgcacatccggccagcgccagaccaaaggccagcagcagacatgaggtgcggagggcaccataccggatcacaccatcacggcataaatacacccccctcacagcagagtttccgcctgacgccgcacggcaggatggtcgattttcccactgcccatcaggggcagcgaatccaccgtcacgatcaccgccgggaccatcatttcagaggcaccggctgccttggcatgggccagaaacacctgtttggacgcatcggcctgcgtggtcagcatcacaatcctctcccccttgcggccatccggcagggaggtggccgccgacatcgcatccggccagagatcggaggcgagagcctccaccgccgccagcgagatcatttccccacccaattttgcaaaacgtttggcacggccctgaatggtcacgaagccgtcctcgccgatggtgacgatatcccccgtatcgtgttcacctcccggtggaggctcgatcacacccggtgcatcggtgcgcagatagccgagcatcacattcggcccccgcacccacagacgcccgcccgtctcgacgcctgccaccggctccagacgcggcacgatcccgggcagcaaacgaccgaccgtgccgtaacgattgtgcatcggcgtgttcaaggccagcactggggaggtctccgttacgccataaccctccagcacacgcacgccgaatttttcctcatagacatggcgggtcgcggcttttaccggctccgcccctgccacgacataacgcagggcgcgcatatcatagggatgcgccatacgcgcataccccatcagaaacgtgtccgtgcccaacaggatggtcgcattggtggcataaatcagctccggcacgatgcggtagtgcaacggcgagggatacagatagctcggcaccccgaaagacaatggcagcaccagccccgccatcaacccgaaagagtgaaaaacgggcagtacattgaacaccttatcctgccgcccgaagtcgatcactgccgccgtctgcgcggagttcgccagaatattccggtggctgatcacgacgcctttcggcgtaccctccgaaccggaggtaaacaaaatagccgccggcgcatcagggttccgccccggcaccagtgccctggatttggtcagcaccccgcggatcttgtcccatttgctcaacccggcgcgcacatcttccagatagacgatgcgctggctggcagagagggcctcgatcaccggctccagcccggccttactgatgaaagcgcgggaggtaatcactgttttcacctgcgcagcccggcaagccgccagcagattggccgcacccgccgtgaagttcagcatcgccggaatccggcgcgcagattgcagcgcgaaaaacgtcaccgcggttgcattggcgttaggcagcagaacgcccagcgcctcatccggcccggcatacacactcagcgcacggcccagcactgccgcaccggtcagcaggcggctgtaggtcagcggaccggtaaccggatcctcgatcgccacgcgccgccagccatgcaggcaggccgcctgtcgcaccgcctcgaacagtgtgtgatcgaccggagtcgtgcgccagatgagatcggtcatcacatcattcagtgcacggcccgcaacctccctgcggcgacgaccgatcagaccggcgggaacgtccagacgttgcggcgccagcgccgttatccgcaccttggggaacaggcgacgcggtgcctgtttccggttgaggcggctgaacggcgtgtattccagaccgctgagccggaccggaatgacgtccgcctcgctccgttccgcgatcatcgccgcgccgtcatagaccttcatcaggctgccggtgacggtgatgcggccctcggggaagataatcagcggatcaccggctttcacggcattgatcaacgtgcgggtggcaaacggcttcgccggctcgatcggtaacgcccgcacgaagcgcaggaaaggtcgcacccaaaatttttcagacacggagcgatcaatcgcaaaaaccggctcctgttccagcaaggccagagacagcacggcatccagccagctgacatgattaagcgcaatcacagtacgcggacccgtgcgggacagatgttcagccccctgcaactcgacccgatagacgatgcggaacagcagccagatcgcatcccgcagcgcattggtaggcaaaaatgccagcgccagcccggccaccaccagactggccatgccgagcagtccgaacaacaccccgctgcccaagcccatcagttgcagcactgccactaccagtccgccagcgaccatgcctcccgctgaaacaatattcgcagccgccacgacgcgggctcgttcggatctggcggcccatgcctgcaaggcggaaaaggatggcacggcaatcagaccggccgacaccgccagcaggaccagatcacccatcacatgcggcacaccgggctgctgcaggaacgtgccgagcggcagatcatgccctgtacccgccggcacatgcgcgatcacccgccacagatcgagaccggccagcccttgcagagccgcccccagcaccgaaggcagcaatgcgatccgtccgccgcccagtgccgccgccagaaaggagccgagcgccacgctgatggaaaacaccgtcagcgacagcgtcacggccagttcattgccatgcagcacggatttcacaagcggccccagcaacgacaggcccaccgcgcccgatacccagaaccatgcggcaatcagcgccgtccgccacagccgcttttcttcccataactgacgcagcagcgaaccggtggaggccaggatattggcccggacccgaagccccgggaccgcaacaccggtcgccggaatacgccgcgcaaacagaaaggagagcacggcaaacagtgttaccagcacggcgaacaccgcaggcggtgccccccttgccgccagtccgccagcaacagtgcccagcaggatggaaacgaaagtcgccgcctcgatcagcgcattcgcagcccccagacgggtctggggcaaatgatcgggcaaaatggcgtatttcaccggcccgaacagggcggacaaaacaccgaagcaaaacagcgccagaaacagcaaaggcaaagagtgcagcagaaatcccgtcacggccagaagcgccgccggaatttccgccgccttcaaccatgtggcgacacgggccttgtcatgtccatccgccagctctcccgccagaccggacagcagaaaaaacggcgcgatgaataccgcgcccgccagagtgaccagagcttccccgccatgctgggtaccctggtgaccaccgacaccccagaggatcaggaagaccagcgcatttttcagaaaattatcattgaacgccgcaaaaaactggcaccagaacagcggcgcaaaggcccgctcggccagcaacggacgccgctcgggcgggcgctccatggtcatctcctctgacggggttcaggcgcggaaacgctattcgagttcgagagtgctggtgggcaacggacgggcacgccgattttcatcaatggcgacaaacacgaacacggcccgcgtcaccttgcgataatcctccgcaacgcgggggcgtcgccatgcttccaccgcaatccgcatcgaactgcgcccggtggagagcagcttcgcatacaggctgacctcatcacccaccaccacaggcgccagaaaggcgatcgagtcgacagcgaccgtgacgcagcggccccgcgcatagcgtgtggccacgtttccggctgccatatccatcagcgacatcagccagccaccgaaaatatcaccggccggattcgtatccgccggcatggcgatagtacggatcatcggcggctcggcgggcgggccttcaccttcggacagttcaggatccgcagaacgggaggaggaggttaagtctggatcggacattcgaaccttcgcttttttccggctgtcacctggtgacaggtcaggaaaagggaggcaccctctcccctgaccgggttattcgatcctatcctgttgcatcccttcatgccggtccagagtcagaaccgccaaaaatctcacggccaaaaatctcacggatcgcatggctgacaggccgcttgacggcagggcaaggccattgccacatccgatccagtgacatgagcagtaccatgaccgatacagcgacaccttcccagcctgacaactctcctgacaaccctgccaatgccctcctccacccggaactgcctgcccttgatgaaaggctggcaacctccctgtttcgggacgggcggagcttcgaccgatggaaaccgttgccggtcagcgatgaaaccctgcgcactgtttatgatctggcccggctcggcccgacatccggcaattcctgtccggcccggttcgttttcatccgtcatccggaagcaaaacagaaactgcgcccggccctgtccagcgggaatgtcgaaaagaccatgcaggcgccggtaacggtcatcgtcgctcatgatccgttgttttacgataggctgccgcatttgtggccttacgaggatgcccgcgactggttcgtgcataacgcggcactggctgaagaaaccgcgatccggaatgccaccctgcaaggggcctatctgctgttggctgcccgtgcggtcgggctggatgccggccccatgtcgggtttcgaccgggcaaaggtcgatgccgcttttctgatgccgcagggttggcgcagcgaatttctgatcaatctcggctatggcgatcctgaagacctccctccccgtgcaccgcgtctgacattcaaggaagcttgcgagatcctgtaatccttgttttctaacggcctacagcgacaccgcactgtcctggtggggcaaacgagcctgaaaagcggatgaggccagcccattacctgaatccccgacagctggatcattgtctctggacagtatgtagggcggtgatttttcccacacgggaatccaaaaagcgaaagtgctgcctttgccctgctcgctctcgatgaataactgcccgcgatgacggttgatgatgtgcttgatgatcgccaggcccagcccggtaccgctggccgcacgggaccgtgccttgtccacccggtagaatcgttccgtcaggcgcggcaggtgcatgcgtgcaataccgggaccatcatccccgaccttcaccagcacaccccgccgtttcaggccgtaagaattcagggaaacatcctgatcaggctgcgcagtcagggtgcccgtctcaaagccggtctcgatcgcggtgatcgtgacttctccgccgtcacgcccgtatttgatagcattgtccaacagattctgcagaacctgtgtcaactgatccgcatccccggccactttcgacagaggcggcaggttcagctgcaatcgcatgttccgctcctgaaggcgcggctcgaacgcctcgatctgacgttcaatcagttcattcagcagcaccgggcggtccggacgctggtgctccatcagttcgatccgggacaggctgagcagatcatcgatcagccggttcatccgctccgcctgctctgccatgatgcccagaaaacgggcctgcgctggaagatcttcggcggcagggccacgtaaggtctcgataaaaccgatcaggctggcaagcggcgtgcgcaactcatggctggcattggcaacgaaatcggcccgcattcgctcaaccgccgcctcccgcgagcggtctgacagaaccagcagggcattaccggttttctgaggatcaggctccagatgcaggatggttgcctcgacctcccgctgcatcggcgcagccaacacgatacgggcattctggcgggtacgggtttcataggctttcgtcaccgccgcctgaatacccggatgacgcagcaccgccggaagatcatggccaaaagtcgtgcgggccgcctcgttacggcgcgcaggcaggcggcgctcgtccagaatgatcagcggatcaggcagtttttcaacaatcgtttcgttcagcagggcgcgatcatcggcagccgccacctgcaatgcgaaagcgccggttacacggcgggtttctgccctcaaccaatgcggcgcaccccatgccaccggaccatcgttcatcgcttccggcttcacgccgtcacccgcacgaagggcggtatacaagcctcgcagttcaataacccgcgatccggctgccgacagggccaatgccatgatgatcaacgcggtgatcgcacactcccgccaggccagaagctgaaacgcggccaatccgcccagcaacagcagaaagggcagactgagccgggcagccgtcagccagaacaacatcatgcccggcggtttgatcgccggagggggaggaggaaaagtcaggggcacaggagcaggctcaatgaaaacagggcgtcagcctagcgcattgacgcgccaggcggcagtcacaccgtgtgacacttcaaacacaatgacaccagcgcccggctctatcgtcagctcccggtagagttcagcgtctgcggggccggttcgatcattttgggactgcccgattcgatctcatacagagccagcccgcggctgacctttccatccggatgcagcaccagaaccccatccacgcccgcaaatccggccggccgggtcaggctgtccgccgacacgctgccttcactggcaatgacccgtgcgatggaggcagcatcataggccagatcctgcaacgccaacggcgccgagccgtatttcgtctggtaacgctgcacataatcggtgcgcgtggcctgatcgggggcagcataccatgcgccgttcaacgtatcgccggaaccggcgcgagcgcgctctgaagaccacagcgcaggccccatgatacgcacggttggcgtgttgatatcatagtagggcagcaggctgccgatctcggccagacgggttccgacatccgccagcagcagcgcatcgaaaggcggtggcggaacggaattacgggacagctctgccgccagtttgcgatcaccattctttttggcctcgcggattttctgctccagtggcccgcggcggctggcatagccggacagatcacgcacggtggcgttcatggcctccattccgccggagtaatgccgcaccgtggcatccggcgcaaactgcaccagcgcccggcccatggcagagcccagttcggtattcggcaacagagccgcgatatgagtcttgccctgggcgcgtgcggcctgcaccagccgctctacctgctgatcgggggtcagccccatcacccatataccgggctgggcctgggccggactggaggtaaaggcgagcactggtatcccggcctgccgtgccggccctgccgccgcgcctgtttccgccgcgctgaacgggccaagaatcatgtaggcaccgcccgccaccgccgcctgtgcagcctgtgccgccccgttgggcgtgccatgcgtatcaatcggctccagacgtggagaaccggggacatcaagcgccagctgtgccgccttgagcatcgcctgcccacgcgcagcgtcgggaccggagagcggcaacagaatcgccagatggtccagtttaccgctaccttgccctgcgctaccgctgagacggagtgggccgcttacccctgaaagggtgttcgagcaccccgccagtgccagactggccacgaggagagacaatgtccgacgccgcatgcgatcccctttccaccggtgcatccctgcccgatgcccatacccggcaggcaaacgcagagaacccggccattgttgcacaacccgcccgaacgacggaacaggacgatccggacgaacagacccgcgctcttcccgctggtcttgcaccttccggtcttgtgctcgtctccacgccgatcggcaacctccaggatatgtcggcacggggcattgagacactcagacatgccgatatgatcctgtgcgaggacactcgcaccaccacccgcctctgcaccgctttcggcatcaaccgccgtctggaagccctgcatgagcataatgaggaagcccggattcccgcgctgctgggcctgatgcgggccgggaagcggctggcgctggtctcggatgccgggacgcctctggtctccgatcccggatttcgcctggtacgcgccgccatcgcggaagggttgccggtgaccggcattcccggcgccaatgccgccctgctggcgctgaccctgtccggcctgccgccgcatcccttcctgtttctgggcttccccgccccgaaggaagccgcgcggcgcaccggctttaccaccttacgggcggcagaggcggccgggctgaacgccaccatgatctggcacgaagccccgcaccggctggcagcctgcctgcacgacatgctggccgttttcggggatcgccccgccgccgtcgcgcgggaattgaccaagcggttcgaggaagtccgacgcggctctctctccgacctcgtccagcattatcaggcccatgaagcccgcggcgagatcaccgttctgctcggccccgcccctgccgaacaggccacagcgcaggatctggataccgccctgttgcaggcgctggaaacccacagcgtcaaggatgcggccgccctggtggccaccgccatcgccatgccgcgcaagcaggtttatgcgcgcgcgttacagcttcagcagcagtcgaaatgatgcgatgaggacagcgaggggagtggtgtccccggcgggattcgaacccacggccccaggattaggaatcctgtgctctatcctgctgagctacggagacagtgtttcccatcatacccgatcctgaaattcttgctaccccgcgccacctcaagcagcgccccacggcagcaccgtcttgacttcgtccggtgagcgccgatgcttccagacatggactcgcacacactgcatcattccctgctgactttcgacagccatatcgacatcccgtggccggacggcccaggcgtgttcgaagacagcccgaagcggcatgtcgacattcccaagatggagcgtggctctctctccgccggatgtctggtggcctatgtgccgcaggggccgcgcaccgatgaaggccgcagcgctgcccgcgaccgcgcgctggccatgctggaaaccatccggcgaatcggcgaagatgctgcctcccacgggaaatccgtgcgcgtggtcgataccgccgacgccatcgaagcggcccatcgcgacaaggccatcgccatcctgcccgcggtcgagaacggttatgccatgggcaccgacctgaccgtgctggaccggttccgtgctttgggggcgcgatatctgaccctgacccataacggccataacgatattgccgactcagcccgccccattccggcactgggtgataaggggccggagcatcacgggctgtctgctctgggacgggacgtcatccagcgcctcaaccggctgggtatgctggtcgatgtcagccatgcctcgaaagagaccatgcttcaggcggccgacctgtccaccactccggtcgtggccacgcattcctgtgtccgggcgctgtgcgaccatccgcgcaacctcgatgacgaacagcttgatgtgctgaaaagcacgggggggctgatccagatcaccgccatggacggtttcctgcgcaaggggggcacgctggaaacggttggcgtcgcggatttcgtcgatcacattgattatgtcgtgcgtcgcatcggcatcgcgcatgtcggtatttcctccgactttgatggcggcggagaaatcaccggctggcggaatgcggcggacagcccgaacctgaccgccgagctggtgaagcgtggttatgacgaagccgccattcaggcattctggggcggcaatttcctgcgcctgttgcgaatcgcggagcagcgtgccggctgaacgaatacatgcccttcgaatcagatcggggcggttgccaaccgccccgacagcaaggggaaaccatgccacacctcgctttccccttgcctccagacgacgcgccaacccctttatggcaggccgtccgggcgttcccttccgccgagcagggggctttgcggaacagaacatctccttatcaatctgttcctcccttccgagcgggacgaaaaccggtctgacgaccgatgtaccagcgggggccagcaccgttcggatgggggaacatcgcccacactcttatcaatcgccctccggaaatagcgattgataatgattcgcatttaaagggtgggcacaagccccgtcaagcctcttttttccttaggctctcatttcgtgccgaacaagcgatctcccgcatccccgagaccgggccggatataaccatgcgcatccagctcccgatccagcccgacggtgacgatctcgatatccggatgggcggaggccagatgacgcaccccttccggtactgccagcaggcacagaaaaataatctgaaccgctccggcctgtttcagccgcgtgatcgccgtgaccgccgaccctccggtggcaagcatcggatcgaccaccaccaccagccgctcggcaatatcggcggggagtttcagataatactccaccggtatcagcgttgcctcatcacgatacaaaccgacatggccgacccgggcggcagggatcagttcaagcagcccgtccagaagcccgctgccggcccggagaatcgagaccagacacaatttcttgccagtcagaaccggggaccgcatcttctccaatggcgtttcaatttcgatatcctcgacgggcagggcgcgcgtgacctcataccccatcaacaggctcatctcccgcaccagacggcgaaactctccggtggaggtgtcatgacgccgcagcaaggtcagcttgtgctgcaacagcgggtgacgcagcaccgtcagagtcgggaaggtctcatctgtccggtccatgcaccccgtcccgctgctttcgccgcatcgtcgcatgtctgtatggccaggcgccagacaggaagcgaacagagtcacaatggcaaatgatggtccagccatacccggcatcgttctggccggtggtctggcccgcagaatgggcggtggcgacaaggggttgtgcctgctccatggccgtccgctgctggcccatatctgtgcccgcatccggccacaggtggccatgctggccctgaatgccaatggcgatccatcccgtctgacgcaggctctgcgccaggaggcggattatccggcatgggcgccgaccacgatcctgcccgacaggagtccggatttttccggtcctttggcaggtgtgctggcagggctggcatgggccgagtcgcatggattcacccatatgctgagcgtgccgggcgatacgccctttctgccgcccgatctggtccgccgtctttggcgcgcccggcaaggtctgaccgagacctcaacggaagcaacccgaatcgcccttgcccgttccggcgaccgcacccatcccgtcatcggcatctggcctgtcatgctgaaggactcactggcgcaggccctgcaaaacggcatgcggcgcatcggccagttcaccgccgcttttccggtggctcatgccgaatgggccatcaccgcagcgggtgatccattcatcaatatcaacactccagccgatctggaccatgcccggcttgcaggagcaaccttcccgtcatgaccgatctctctcccgatccgcagagcctgctgcagccggaagcggccggatttctggcccgtatgcagcaactggacaggccaggcctgcacacaatgccgccggaacaggcacgggcgatctatgatcgtggtcagctgcatctgaacccggacccaccgcccattgccgagtgccgcgacctgtcctgtcccgtagaaggcggcgagatcacattgcggctttaccgcaacgcaccgccacgttcggaaggcgatcccgtatttgttttcttccatggcggaggctgggtgctcggtactctggacacgcatgacgtgccctgtcgccagattgccattgccgccggaatcaccgttatttcagtcgggtatcgtctggcgccggagcataaattcccgaccgcggtcaatgatgccatcaccgcctgcacgtggatcgcacacaatgccgccatgctgggcatcgacccggcccgcatcgccgtcggcggtgacagtgccggtggcaatcttgcggctgtgctttgtctgacggcacgggaccagcccatcctgccccacccgatccgccagcagatcctgctctatcccagcacggatatgagaggacggcaggcaagccacaccgtgttcggacagggattcggcctgacatccgacgcgatgcgatatttcctgacgcattatctcagctcaccgcacgatatacgggactggcgagcctcccccttgctggcccctcggcatgatgccctgccggcagccctgatcatcaccagcgggtgcgacccgctgcgggatgaaggggaagactatgccatcaaactgcgcgaagccggggtgccggtctcgatgcagcgtctggaagggcagatccatggcttcctgaccatcggccgctatttatccgcagccggggaaaccgtcgctatgatcgcggattttctgcgccggctttagaaataaccgaccccgttcaccacatcctccccggtcagccagggatagtagtcgttgaatccggaataggtcggcatgccccctcccatcatcatgggaggagtcatggcggcaggcggagcaggctgagcagacgcggcaggctgctggctggccgccttggccttcatcatggcggccacatatccggcagccatgagcacattgccgtgctcctgcatgcaggtgagataatccggataggaataggtccgctttggttccgaagccggcagccgggccagcaaagccggatcacccgctttctcgcggcaggttttgccatcactgcgatattccgccagcgatttatacggtcccggcagagccaccagcggattgcgcggcggggtggaatgtgtcgagcatccgctgatcgccatcatgacggccagcccggccagagagccaatccgccttccatctcgtttcatccgcgtatccttcatcccgtcctgcctccttgaaccgctttttcgcgcgacaggaaaggcacgactagcgtagacccacccctgtccgattgccacctgcggtcgcggcggagcaagcggcccctgtcgacaggggtccccccctccgatgatcccgccctgaaacggagacgtcttttgtccgatatcggtaacccgttcgaccacaagcagaccccgcagatcatggaagacgccggtcgtgccatgccggggctgatggcccatgccctgcgcgtcctcatctggggcacctttcacttcttcctgtcgctgatcgagcagatcgcagccctgttcgcgccattgctgctggttgtcggcggtatctggctggcggtcaggcatgccgcaggcatggtcaacgtgcatgaagaccatgtgcaggaagccatcagccaggccactgccgttctcggccatgatgtcctcatcgccggtcatatactgtcaccgttagggctgattattgacgggctgattctggttgcaatcgctgccgcctgtcacacgttggggttggtactgatcaacgaaatgtatgcagacaaatgaagccgctttcccgccttttcatccttgccatgctgacaatgactctgttcgggctgaccgcctgccataccgggcgcttccaaagccaggacggtcggattcggggcggctatgtcagcggcggtatcggaccgggattctgaccctgttttattgataaaaattataaatcatataataagatttttttaaatttccattgacggtgccgttcagccttcacacagtaaggttgtctgatgacggcgtgcgggagagtgctttccctcctcacggagaatggccgccgaaggagcaaccccccgggaacctctcaggcccatgaaccgcacgctcaggacactctggagagaggcccggcagggtccgccgaaggggaaatccggctttttgcggaaacgccagccgggtgatgctctcaggcaccaagacagacgggggcgacggacacgcggagacacgtgaccggtcgcgttcccacccctgtcgaggaaccgaatcacgatgaacgcgatcacccttgccacccgatcccttctgccctccggccttcagattgcgccggttctgcatcgatttgtggaagaggaagcgatgcccggcactggcatcacagccgaggcattctgggccgcactcgccgtcgccctgcgcacattggggcccgcaaacgctgccctgctcaatcagcggaatacgttgcaggccgagatcaaccagtggcaccgcgtccatacgctgccgcaatccggcgtcggtgcggcactggcggcacaatccgacgcctaccgcgcgtttctgcatgaaatcggctatctgctgccgccaccggccgcgtttcaggtcgataccgcacaggtggatgatgagatcgcccatatcgccgggccacagctcgtcgttccggtcaacaatgcacgctatgctctgaatgccgccaatgcgcgctggggcagcctgtatgatgcgttatacggcacagatgccgtcggacgtcagcaaagcgcgacgcggggctatgatgaggcacgcggagccgaggttataagacatggccgcgcggtgctggacatcgcagcccctctggccgaaggcagccatgccgatgccatgctctatgcggtacacaatggtaagttacggattgcgctggccaacggacatgtgaccggactacgcgatgagtccggattctgcggatataccggcgcgcctgatgcacccagccgtattctgctggtcaggcacgggctgcatctggaaatcctgttcgatcgcgaccatcgcgtcggtcgcaatgataaagccggtattgccgatctgattcttgaatcagccctgtccaccatcatggatgcggaagactccgtcgccgcggtcgatgcggaggacaaggtcgaggtctatcgcaactggctgggtctgatgcgcggcgacctgacggtcaggttcgagaaaaacggcgccgccgtcgaacgtagcctgcatcaggatcgggtttacactacgcctgatggcagcggcagcctgacgctgcccggtcgatccctgctgctgatccgcaatgtcggtcatcacatgatgaccgatgcggttatgctggacggggcagaggtgccggagaccattctggatgcattcatcaccagcctgatcggcctgcatgatctgcgcgggcggcccggcaggcacatcaccaacagccgaaccggcagcctgtatatcgtgaagccgaaaatgcacgggccggatgaggtagcctgggcagcgcggctgttcagtacggtggaagatgcgctgactctgccccgcaacaccatcaagatgggcatcatggatgaggagcgccggaccagcgtcaatctggcgcattgtatcgaagcagtccgcagccgggtgtttttcatcaataccggctttctggaccgcaccggagacgaaatccacaccagcatggaagccggtcccatgctgcgtaagaacgacatgaaacagactgcgtggttcacggcctatgaaaacggcaacgtggatagtgggctggcctgtggtctgcccggccatgcccagatcggcaaaggcatgtgggcggcacccgacaacatggcggcgatgctggccgagaaaatcgaccatcagcgcgccggggccagtacggcctgggttccttcccccacggcagccacgctgcacgcgctgcattatcatcagatcgacgtggcgcaacggcaggcgaccattgccagagaaggtgcccgcacctcactgcatgctctgctgaccctgccattgctggaggaggcggggaaactaaccgctcaggaaatcagggatgagctggacaataatgttcagggtattctgggctatgtcgtccgctgggtggatcaggggatcggctgctccaaagtaccgaacatctacaatgtcggcttgatggaggaccgcgccacgctgcgcatttccgcacagcacatcgccaattggctgcgccatggtgtcgtgagccgggaacaggtcgaagaaacactgcgccgcatggccgtagtggtggatgggcagaatgcgggcgatcccgcctatcgacccatcgcaccagccttcgatggacccgcctttctggcggcatgcgatctgatcttcaaaggcaccgagcagccaaatggctatacagagttcgtgctgcaccgccggcgtcgagaggccaaagcccggacctgaacaacgctccgatcattccggttcatgatgagccggaatgatcccgcgtaactgccagcctccgccccccgcattcatctcaacgcgggagaggggtgcaatgtcgatcctccagaatgcctcaacgggcgcacccagcgcatggatgacagcagcccgcatcacggcgggatgcgtcaccgccatgacatacccacctgaatgctcagccacgccatccagccagttagatacacggctgagcagggcagagaccgattcaccaccatgcggcgccgcatcagggtctttgatccatgactgcaccgcatcccccatggtctgtgcgcaatcggccagagttctgccgcgccacgtgccgtactcaagatccgccagcgttgctgttatctccgtctgctcagcccgttcaggcaggcgcaaaacctctgccgtctgccacacccttaattcgggggagagaaacaggtgccccattctggcaggcagggagggattccatatggccagacgccgcctctcccgctcttcgatcggctcatcgcctggaaagcgcgcctgacgcgtggcgtcggtcgcggcatgacacagcaggatcagacgaagcatcccagccttctccccttcgcaacatacgctttgcattgacaggaaaggccgggattttctacggttcgtccactgtaaacatatggaagccggtgtaaatccggtgcggtcgcgccactgtaatcagcctgagagggctgaaagtcagaccctgtttttgcagactctatccattttacctgccgtttcatcggggcgcgcttccccgtcaggagtttccacccaatgtctgccatttattcgacccttccccgtccgaccgccaccccactgtctcgtccggttccgctgcgggatattctgccttggacgctgttcgggatggtcatgttactggcactgtatttcgtcggcattgaggaaggggccacctccctgatttccggcatgtatgtccatgaattcgtgcatgacggccggcatctgctcggctttccctgccactgacgccattattctgaccgtatcatgatccggacattgttgatccggggcatgtttgccgggtttctggcaggcattgccgcgttcgggttcgcacatctgtatggggaaccgcaggtggaccgcgccatcgcctttgaagccgctgccgaacacgcagcccatcacactcatcacgcctccggcgggacagcggaggaagcagaggccgaacctgaactggtatcccgtaccactcaggccgggctggggctgctgaccggtgtgaccgtgtacggggccgctttcggtggtctgttcagcctcgtgtttaccgccatgctgggccgcctgccgcttggtccacgtggcctgtccgccttgctggcaggatgcggatttatcgctatctgcctcgtaccggggctggtctatccacccaatccccctgccgtgggacaggctgataccatcaccgaacgcactgccctgtatttcgagatgctgctgatctccttgtcagccatgacgcttgccttcgtgatccggcagctttttgcaacacgctggggcggatggaacagcacgctggccggggccggtttcgccctgctggccctgcttctgatcgggcgtgccatgccggttatcaatgaagtgccggtgacatttcctgctgatctgctctggcatttccggatcgcttccttcggcacccaggccgtgctgtgggcggtgatcggtatcggcttcggctggtttgcagagcggcagataaaacacttatcccaccccacaaaccgctaacccagccccttattcagccgcgagacgggaggtctcatcctccctctccactccccaatccaccaatggttccggttcctccagatcgaaatgcggccggccgagcaggctgttgatgattgtcgcagcccgccatgccatcagactgagttgaggttcggcaatcccatggctgtggcgtcctgcattctggacaaagatgcgggcagaagcaggaccatcccagacagcagaaaaatcgggccgcaatgtgtaacgtccttcctcatccagtttgaggcgcttctggagcgatccaaaacaggctggcacagctgccttgtatccggttgcacagatgaccgtatccccggtgaccgtatccatctgaccatccaggtgatgacgcagatgcagggtaatcccttctccgtgacgccttgcagcctctgcctcccgatatggcatcagccgcacgaaatcgcgtcggccatcgagatgccggatctggtatagcgcgcggtagatctcgttcagtgtcgtcggggaagccccatcactggccagtttctgcgcggccacatgccgggcacggagatcaggcggcagcccatggaagcgcgcgacataggccggcgtaaaatactcgttgctgaaagccacttcatccagtgacgagaaattcatccggcgcgtgatccaggtgattccccccacacggtctggcccccggcgcagcagatcaagcacgatttccgcaccgctctgccccccaccgaccacaatgacatggcgacccgtgtaatcacggtctttctcggcaaaacgggatgtatgcaggcacatatcttccagaccagccgcccagcgcggcagatagggatgatgcccggttccgatcaacacattgcgcgctctgacttctccatggcggtgcgtcagcacaaagtgacggccatcgaaatcaaccgactcaacgggggttccgaaatgcagcgatggaagctgtgctgcaacccagccaagataatcatcgaattcccggcgatagattccttcaaatccggctgtgatgaattcgtaaaaccggcgccgtgccaccagataggaggtaaagctgaacgggctggtcggctgtacggcactgaccagatccttcaaccatgatgtctgcaaagtgacatcaggcagcatcatgccgggatgccaggcaaagcgcgggctacgatcaaaaaactgcgcctgcacctccggcacagcatccagcagggccgcgacactcagattgaacggcccgatcccgatcgccgcaagatcctgtaacggaaaggcagaaaactgaaaacgatccgtcatcaggccatactcccagactgaaaagctgcatgttggtgtaaggaatgattccaatcgctgcgaagtgaccagtcatcataaagaggattatggagaggcgttccaatttcaggtttcggccttaccggcgtatcgccatacccgatggagaaccgggcacggttgatgcagatacgcatcatggtcggggtaaaaagatcaaacatctcaaaacgccccgccaattccggacagcgtgcctgatattgacggatgacacgggcgagaccctgataaaaagcctgctcgggatatccgtcatgcgtcagcaaagcatccgacagaaatcggaggacgctgacaaaatggcccgtctgaaggtgatgaatcagatgctcagccggacgcctgccaacctgatcagccaatccttcgggcaaagtctcatgctccggcaagacaggcgtgacgagatcgaaatccccctgcaaatccttcagcgccacaccacagggcacccagtctttcaataacagcgtaacattctgtccatgggcgataaacccggcgccataccggcacatcaggtgatagagcgggaccacgacagaagaaaacaacctctccagccagatatcgcacggcatggaagaacgacggatacaggccgagatcaacggtacgccatccccgccacatacctgtaatgctcccagcatgatggcacgctcatcctctgccagtgatggctccgcgcgctgtcgccatacggcgcccagtaattcatgaaagcggtagggagcctgagcaatttttccatatacagtttgcggcactgcataaccggccatatcccgaaggatcaggactttcgtagtctggaaaacagcatctttcgcgacacattcgctcagccatgatgacaggccgacaccggtcaaaatgcctttaccaggcaggccgcgccatgcagacgtattcagaatggtgaccggcagtttgatatcatgcgccgccgctctttccgcattggccaacgtccgtagggattgctgtggtcgatagagatcaccccgttcacccagtggtacaatcctgcctgatgcaatatcagctgcaaaatgcgtctgaatataattctgccactgccatggatgcacgggaatcagccgatgactgatcctgtcgaatcctcgctcgaacagaatacgatcgatctgccgcagatcatcgacacgcagcatttccgacaaaagatcatcttcactgatatcacgcgtcatgccacccaaacaggcttcacgcgccacagcaatccagtgcaggcggaacacaggatcatattcaggtgcataggcgcgctgatcttccaatccccagccaaccctgcctttcgaggccggagctttgggatgcccatccagtctggcctgcaagcgatcattgtcgagatcaagcatggaaattgcagacagaccatcccgccttctcagcagttccatatctgtttgcagcgtggcgtaaagctcctgcagatacattgccagtgttgcatcactcatacccagtgcagcctgtgcatccacaaaaaactgtgcagcatcgtgggcctgactttcctcgccgttttcaatcctgatgatactatcagggtcaattgtcagctgcccccagatgcgcggctccccttcacatcggtaatgaacatcaccaaagcggaatatccataatccgcctgcttcttcctcgggatgaaatgcttcctcataggcaagctcagacagggattttgcaagacaggtcagattgacacgtcgccacagggaagcatgcaaggaggcatggcgtagagtatcctgacgatcacgcatcacgttgaattcattcgatacaatcatctgatgcactccctgaaaaagtgatcacgtgtgcaggtaatcagcatcgaacgtttgtgcggaaaatcgaactcgtattccagcgtgtaaccggattcctcacaaagccgcagcatattgctatgagcagcactcggttcacccaccacttttcgggttcggcaatcatccaggaacaggcaatgggtgatggcacggaaccatgccagcgtacggtcgcgcccaagatggcgtttttcgccgaccagcacatgccagccacgatcataatcatcggcctcgtaatgcgggccgagtctgtcttccttaccccaatagatctcgaaataggtcgatggttcaccatccagttcgccgatcacggagaatgcatgcggatcagcatccatacgacgcagataggcttcatgcttttcaatcgggccggcttcatcccagaatttggctacacgcggctggttctgccacatatggaacagttcgagatcacggccgatatccagtgcgcgcaaggttaattcatgcccggttatcgtatcacgccttcgatagaacacacctttcggggcaggtggacgtaacggatgatcccgcccatccgggagcgcacgacgcagaagcggctggcgatgcgcaggcgggccggcctgccagaaatcccgttgctgacgatgcccctgccggtacagaaaagcggtgttatcccgtatcttatgaagcgggaatgatgcatcggcaggatcagagactgattcaagagacactgaaaaacaatcagccccttctgaaaaagcataatcagccagcacatagatcagaaaatttctgtccctttccggcgcagaccaatcgaggacgatggccctggcaagttccccttcaaaatgaaggcgtgtatgggcgacgacagatccattgagcagtatgctcagttcgcctcctcccatgatcatgacagagcggccatgagcatcccggaatgtccagaccggttccatatccttaaccggtcgctcggccggatgctccagaacagcactcatgactgcaccagaggattgggaacggatacataactggcaagagggctggcagtatcggcgttttcgttgacatcccttagatatgtcatcacattgcctttcatccagattgacggacaatccagcagatagcgaatcacagatggatcacgcagcccatcatcgctcatggattgaagtcttttccttagaatacttagaagtgtctgttcctgtgcgactccgtccagcacaagcgtatcaagaacaccgaacacggaattaccgatcagataatacccgatcagctgcggccccaatgcggcatcaatgatattgtctgtccatcgtcccaactctggcacgtaagttcgcagagtctcgatcatatcggttgcaatggccgtgccctgacaatcacggaaccaggcctgttcgggccatccattccgcagaccaagcacgacattctgctgatgggcactcatcatcacaccatgacgggcatggagatacagtaccggttccatcagaatagagagaaaacggcgaaaccactcctccgcaacatcggactggctgcgtttatcgcgtgtagcgatcatacggatgatatggccgattctactgggagcatacctgtcgaacagatcatcctgacaaagcgtcgcaagcatcgcggcatgacgaccacccgcatatacgccctctgcttgatcggcaaaaggattgtccctgaatacaacggagctttcgaccagaaccttcccatcaggccctttcagcgacaaatgggctggttcttcaatcactgaaaaaccctgatagcgggcaaagacatcctgcccgaccggaccacgcaacagacgcgccagatgcaggccgcgatcaagctcacgcggcaaaattgtacggatcgaattggtaatccgcatcgaaagcgagaatttcatcatcaatggagactgcgcactccatagactgcgcagggatgcagttgcacggaattgcggccccatgataccgagatcacgaagtcgatcctccatgcgcagactggcaagttcgggcaggcacaaaagatgaccggcttgccagggatgaaccggcaacaaggtccagcctcccggaacggcatgcagtgcttcctgaccggcatcggtcgatgcaagcatctctttcagcagggattgtatgtcggccacgtgaacactgtcgccaatcatatgatccggatggactgcgaaccagcgtaacgcgaagctgttgccgtgatcaggcccatacgccgcatcttcactttcagagaggccttcacggaatttgggtgcgggatgaaacggatgacccaggatcagcccctgttccgccgtgataaaatcaggcaccctgtctgcctgatcatctgttctatagtgatgactgagcaaggcggctgagacacgttcggcactgtccatcacgcgttttcggaaagtcatcctggtcggcagtgatgccgtctgtgcaaaggccgtgtgatccagcagaagatccagcagcaaacgcacatccaccgatcggatggcaccatggcgcctcagcaaaggcggccccgcaaatctgaaacgcccggtttcagtggacgcggcaagcggcagcagcaactccccttcctgcaacagaaggggaactgaaatcgcacctgccggacaatgcatatgcgcaccacatcgtgatgcagcttcctgcggatcgagctttttccagccgcgccattcacgcagcaaaccgttcagcaatgtcgtcgtcgccattccggcctcaaagtgacgacgttcaatgcatgctgacgtatcgcgggtttccatggcttccagcacaggcgtttccctttctgttgcatatcgtgccgctttgcggagaatcaccttgcggcatattgcaattgatattcattcctaatttaatgctgaaatgcaaccccggaacacctccctctctgcgggcatcagccctgctgatccggcatcgcccgatgcgatcactttgtcgtgcgcagatcgcctcggctttgcttcgcttgtctgctgtgtagggctgacacaatcatcactgattgcatttttgccgattttatcgaccaaaacaggattatcggttctgtcactcggtattgttaccagttgtggaatgctggccatgcttggtggtgcgcctctggccggatggctgagcgatcgggcgggtcgacgacagactttgatggtctgccttgctattttctgcgtagcccagctttttctggcggccattgtatcggctgcgatgaacgggactttatccccctcactctgtctctcactgttgatgatatgccgcctgttacatggcattgcgacaggcggcctgcttccagtggcacaggcatgggtcgccgatctgaccggaattcaaggccgtatggcgggacttgcagccatcagtgccgggttcagtgccgggcggctggcggggccgttgctggtctcggtcactttaccactgggggccacgatgccgctctgggtcatggcgctgctgccattgccgctcggcagcatcctgttgcaccgcccgcccccggaaagccgtcataggaacatccggccccgatcaggggctgcctgctggcgcaatccggcgattctgcggttgctgatattggccgccatcgtcaacattgcttttggcaccctgcatttcgtgcttggccccttgttccagcaaaggctgggctggactgcacagatggcaggaatcaggctgggctggatcaccgccctgatggcagccctgatgctggcaaaccagatgagcgtcattccccggctgaccgcatggccccggcacactctggcggttggcatagccgtgatctggctctccgcactctgtctgacctgcgggcagagcgtgtggagtctcggggccggtgtctgtctgctcgggcaagggctggccttatcgggtccggcctgcacggccctggtcagcattgctgccggaggaagacagggggccgcctccgggctgttatcctccgttctgacgctgggatatgctgcgggagccacgctgggcggttttctgttcactttgggggatacatggcccgcgatgaccgcactggtgatcctgccgctgatcctgccgtttttcccgctccgggaatcatggacaaagctgtccgatgagcggcagatagcaagcgatgcgtaaagacgaagacatagcggcatggtgcgaggcgcgtatggcctctcccgccgggttttctccggcagatggcgtggacgtttccctgctgacacggcgggagacactggcccccggtgtagagcgattcgccaaaaccctgccggcaggcgccgatccacgtgccatcggatcactctggagcaaggcctatacgcgggccgtgctgccgccgctgtttattctggctattcgggacggacgcaacgctctcgatcccgcacagaccgcgccacccggactggttctgctcaaggatcgcccggatcagctggcgctggatgcggccaccctgccacgtcaaacgcctgagcagatcatgaccatcgcgctggggcaacatatgcaaagcgtgttcatcgcgttgcgggactgcaccggcctttctccacgcgtggcatggtccaatgcaggcaacatggccgatttcctgttccgacgtatggccgaaacgccatcattggccgatcaggccgcacaatatgaggccctgatcatggagccacggcagaccccgtggtttccacaccagaactggctgcatgcaccgttgcgaaccgtttccgtcatgctggacggagaagcgattccgctgcgccagcgccggatctgctgtctgcgagacaaggtgccgggcatgacactttgctctacctgccccagattatcggaggaagagcgccgcgcgctggtcggtcaacgccaccgccattgatcctgtccgcagacatttgtcaggaaggcgaaggataatgagccgccgtttccagagcatgctcctcaccccctgttgcatcaggggtgccaaactgcagagtatcgtccagtaatcgtggctcagctggccggtttgcagccatcaggctgacaagagtggcagtgccaagtgaaaaagtgcgttccatcacacgctccagccggtgatctgccgagtatgtcgataatgatagtgattcgcaactaaagactgctggaccggcggtaaaaagggaaatagccgtctcggcccctgtcccgctaaattcaacaggaagacgcttccgtgatggcgaggctcccggctatgtttttgcggtgatcacatgcaccgtttttcaatcgcgcccgacctgcccctgtaaaggggtgtaggcatggccattctgcccatcctgctctgcgccgccacctgcctgggactggcgggggaaaggctgatggctgcaccaccgcggcaggatcgtcggattctgccggcccggctgaggcggctggtgctgtgccatatcgtgctgtgtgccatggggggtctatcctgcctgtctgttctgctcgggggcgcttcatggaatggaacagcatgggttgggggcgccttgcccgcgctggtatcggataccattgccctgcgtctggggctggacggattttccgcctttacagcgctggccggattttgtgcgctcgggctggccagcgccaccgggctggatcgacccggaggagcagccacgcggctggcctttgtaacagccgcgttgatgctgaccgtcatggcggccgatgtcatgacactggcagggggcatcgctttgcttttcgttgccctgtgggcctgccccacgcatgacggggcatcccctgacacggaaacgaacacgtccaacccggcccataccgcgccccattcggggaatgcggctgccattgtgggaattccgctgctgatcatctctacggtcatgctgatgcagcacgcctctcccgcagatgggggtccggtacaggccgtcgggtcagcccggccgctggtctggattgccctgttactgctgaccatcctcgttctgacgacgatggttgccctgcgcacgccttcctccgggcgatcccggatcgtgacggagaagcacccttccgggttggaaccgaccgccccggaccttgctgccatcacccttgctttgccagtacagcgcagcccggcaccgagcctcgccactccggcgcagatcgtccggcccgccttgcaggtgattgtgccggtttacctgctcggacggctgggactcgacttcctgcgtgaggctgcgggaccaggagagagcactcccctgatgctggccggagcgattctggccatggccggtggaatcggcaccttgcggggacgcagcattggccgctgcgtgaccggaatggcggacagtcagaccggccttgcgattctgggctgtgggctggccgtagccgccatggcggttgatctgcccgatcttgccagcctttccctggcttccgccctgatcatcgtcctgtccgccgccctgctgatgccagtgctggcaaccggggccacattgatcgaggaaggggccggcaccaccatgctggaccggcttggcggcatcatcatcgggatgccacgcatcgccctgctgaccggcggagcctgcctggccagcgcaatgctgccgccttctccgctttatgccgggcgctggatgctggttcaggccctgatcggcggccagagaattcaggatgccggtctggatgccttgctgacgctcggactggtcgccacggcgctggcctcggcgttggggatggtggcagtactgcgcgtgctctgcatcgccattctcggccgcccccgtgcgccacgggctgccgccagcacggaaccgcgccgtcccgccgggctgcgggccatgcaggcagggcttgcggcctgtatcgtggcagggctgatcccgggccctgtgctgcaccttctgcacggggcgctggcggcgctgtgcggtcataccatggatgatcggactggctggatcggtatcagcgcgcaggtcgatagtatgctgagctataccccgctgtggatcgcgctggcattgatctgcggcaccgtcctgctgctgcgcttcctgcacgggcgacgcagcacgacccgcaatgccgtgccatggaatgatggcgatgcgccgccgccgccctggctgcccttcggcgatccagccacccagcctgaccctgattcggtggccgatacttttctggccccgctgccgcctctgaaacccatcccgccggccctgtccggcctgccttcacggctgtggatgatgctgacagccacgctgggccgggcagaacgtttcataccggccggggcctctttcgggctgctggcagtgctctgtctgttgctggccatggccgctctggaggcacggccatgacgggaagtatctcgggaagcttcttttcccccgccctgcatatcctgctgctggccctgctggcaccgctggtgtccgggatcatcaccagcatccgcatccgggccaatggcggcggctggctgtcgcccgcagcgccttacacatggctccgggcgacgatgaaacacggcatcgtcattcccgcacaggcaaccagcctgttcatggtcctgccatgcgtctccctgattgcaaccgcgctggccgctttcctgacgccttcctttctgatcgacggccctgtgaccggagaaggcgacgccatcctcatcctgggcctgctgtcactgtccctgatcgccagaatgatggggagcatggatacggggctgagccagaacagcattggcacgctgcgacagggtggagagggtctgtggatggagctgattgtgaccctcagcctctccgccctgacgatgctgggcggaaacccggtcctgacagccctgcatacgaccgggatgatgtccggtggaatcttgctgacctcattgctgctgctgcccggcctgtgccttgccgcgctggcaggcgcagggatgttgcgcacgccatccgatgacatgccgcatctctccggcccgctgctggccatggcttcttatgaacggtccctgcgtctgctgacctggatcagcgtcatggcggtcgtttttctgccttttggcatgatctcccttcaggccggcctcctgcactggggcctcgccattctgacatggggcggcaaaatcctgtttctggccgctctgctgggtctggcgcaggcgctgctgccttttccggcggctggacggggagctgcgttcctgctgctgggcagcgtctttacccttctggccgtcctgtgccttctggcgggacaatatccggcatgaccatcacacccggcaccattttcatcccgcttctggcgatgatcctgctcttcgccataatcgccgcgctctgcacccggcttcgggccgcgcgacaggcggtactggctcaagccttgctggtgacaatcgtggccgcggtgaatgcctcgttgacggctttcagtctgcctgatcgcccggcctggcccatggccggagttgccctgacggcgctgctggcaggattgtttctgggacacagatggcggagcaggccgcctgccctgtcatcagaaccggatctcaaaaccggtcagtcaaccctgcccgatacagtctggatgatgggaaccggcctgattatcgccctggtcgtctccggcggcatcggagtgacgcctgttgtctctcacgctccggtatccgccgcgactctacccatagtcgtgcccgatcccgcaacggtgatcgccatcagcctgacgatggggatgctgtccctgctatggctggcccgagatagcagggttggtttcctcggcacggccctgcttcaggccgggctggcaatcgcactggtcatgaatgcgctggatactcacctgctgatgccgctctatgccctgctgggtctgctgcccgccctgctgacggaagaagccgtccgccttctgcgccggcgggaaacacgggctgagacggaggctgcaccatgacggatcacgcccccgattggctttcccttctgaccgatccggcatggtggccatggctgctgccactgccgtcgctgttgaccgccgccctgagcatggcgctgtccggctggcggggagcggcctgggccggtctggtatccgcctgtctgacgctagggttagcagggggggggctggcaggaggggaaatcgcaggggctacatcgaccgccatggcatctgatccggctgcgggaggagcgttgctcacggccctgatcagcgtgatggccgccacatcctggcttggctggtgcgcggatgaagtcgcggccatgcgtatctccgtcgcccgattgaaaatcctggcggtcgggcagcaaaccgcattggcgggcattcttctggcctttgccccctctccatgggcaggctgggccgggatcagcatcgccatggcagtgctgactgttctggctgctttattcccctttgcggccacgtcccggcgaggagagacgctgacagtcggtatgatggcctgtctgctgtccctgttcggcctgatcatccttcaggggtcctcctccggccatcttttctccggacaggagcacagtctggttcccgccatgccgggcctgatctgcctcgccgccgggctggccgttcctgccggcctcgccccggtgcatcaatggctgcgggagaccgtcagcgccctgccaccgccgggacaagcgctgatcaccggcgggctgcctgctgccgccctgctgttcatgctgaaacaggccgcggcgggcatgccgccttttatctatggcacgctggggattctctccgtgctggccggtgcggtgctggcgatccgctccagcgtcaccttttcatggcgctggagcgggccactctcctgtctcggcggcggctgtctggcgggtgggagtcatggtctgctctatccggcactcgggctgctggccctgtgcgcctgtctgctgctcgacgggcgagcacggcaggtcggcgccgtctccgatcatacgccctctccgcaggggcatggcgggttggatgcattgcgactcgccactcgtttcagtctggcgggactaccgggtggcactctcgcgggactggtcgccctgctgtccgggactgccctgacgcatcctcttctggccctgctgctggcgggcgggcttggaagcaatggctatgcgctgctccgtcaggctccgatgctgcgacccacccgaaggccgccgccgccctcacgcgcctgtctgccgcttgatatgaccgcaaccctgcccgccctgatcctgctgctgaccggcatcctgctggggcttgggaatgggccatcccgctggttcgcctctgccgtcgctgcggtgacgcaatgagtctggactccctgttgcaaggtgccgacaccgaggccacccaccacgatgccgccacccatgccgtggcacggagactcctgaccgcctccctttggcaggagctggcagccagcccccaggccgggttgctggcgctctgggccgatcaggcgcgctgccatgccttgtatcgtaccgcgcatggcatcctgccggtggcaaccccgatcgaaggggggcgcttccccgcgctttccccttttcgtcccgccgccgcatggcaggagcgggccatccgagatttatgggggtatgaggccgagcacggcgtggatagccggccatggctcgatcacggcagatggccgataagtgccccgctttccccccggcccggaccgcctttgccaccgcccgagcaggcggagtggcggatgacctcgcccttcgcctcctcctttgtctcgtcccggcccgatatcgcgctgcacgagcgcagtatcgggcctgttcatccattgatgcgggagccggcacagttgcgcctgcacctgcatggcaccctcatccggcaggcggaatggcggctcggctatactcatcgtggcatccagtggctgatgcgcgggaaacccctgcgggacgcgatcaggatcgcagcccggatcaccggagatgcagcgctcgcccacggtctggccttcgcccgtgccgccgaagccgccttgcggctggagccgcccccccgcgccctgctgctgcgtggcctgatgaatgagctggaacgctgcgccgtccatctgcatgtccttgccgccacggccagcgccgcaggagccgacacctatgccgcgaaactgtccgcatggcgggagcgtctgttgcgcgccattcaggaggcgtttggcaatcgcatgatgatcgacctgcttattcctggcggggtgctgaccgatcttctggacggcaccgcgctggaaacagtcttgcaggccctcgcccgcaccatgccggagctgatcgaaggctatgaaacggctgccagcctgagtggacatggactctgcgcctgtctccgtggatgcgcggtcctgtccgggtcggatgctgtttccctcgccgtgcctggccccgccggacgcgcatcaggccgtccccatgacctgcgcaccacctggcagcaggctcctcatggcacggtacacaggctggtgctggaaaatggcgatgcggatgccagaatgcgggtacggctggccgaaattcaggagagtctgcgactggcactgctgttcctggagtccctgccggtcggaccgattgccaatcccatgccgatcggcacaggcaatgccagcggagaagggtatggcggagtggaatcggcccgtggcgcatgctggcactggctgcgcatcgaaggcggaatggtggtctctgcccatgcggccgatccatcatggcggctgattcccgctattgaggccgctctccccggcaccgacattgatcggctgggggtggcactggcttctttcgcgctctcgcccgccggggctgatctgtgaggcgctcatgaggtggttgccgtcccttcgtgcctcccatcccgggctgtgggatgataccgccagcctgccgcatgcggaaaccgtcgccgcactgatagcccgacgcagaagcagcgcacggccaaagctgggacaggccctgtccatcctgcacgttgagagcggcggcggcagcgcctgcctgcttgaactggaggcattgcgcgccgcgcccggcctgctggcccgtcatggattacggtttgtcacctcaccgctgcatgccgatatcctgctgatcaccggcgatggctgccacaatctgacgagcgccatccatcaggcatgggaggcgatgcccggcccgcgatgggccatcgccgtcggtgacggagccgcaggggatggtctgctgcgtggaagctatgcgagcaccggcaatatggaagagatcccttttgatctggtcattccaggcagcccaccggcagcggatacaatcctgtccggcctgcgtgccctggtcgcagccaatgctgatccgctctagaaactggccaccacagcggctgatcagtcgcatcatccgtggtacccattcctggtccggtgctgtaccgaccgctttccggtgtccacccacgctgtcatgatcctccacagacgctggaacagggctatttcatccttccacgctggaccctgatggccaggattgggtaaatcgctttccttcacagcgataagtgatcttcatgtccatgacccgtactgatatcgaccgcgtgcagacctacctgcgccgcctgcttggcaccgaccggattcaactgattgtcccgcccaaagccggactgtccgtagaagtggccgttcaggatgaagttatcggcacgatccacaaagacaccgatgatggtgaaacctcctattccgtgcacctgaccattcttgaagaagatcttcccccggccccgaaggccgcccctgtcaaaacagccagaacacgctgaccatacgacacgcggggtttcgttttcaggggcaatattctacctgaagacgaaaccccttcatttttcggaattttcttatcttctcaagacaaataactactcaatattcaacctgaggttttaaaaatccatataatttataaatacaacttataataaccaaaaaattatatttgttttttattagaaatttcttgccaataaacggaaatttagctttctttggttcgcgaacataggagccaaatccatggctatttccgtctggcaaaagaaaaaaatgttccagaatgctcgcgacatgcaatccccgccatcggaaaccccctcaaatgtgatttcattgcggggcggagacacacttgccgtggaaaacattctgaacgtgctgatcttcgatccggatttctaccggtcacgttaccttgatgtggctgaagccgggattgatcccgttgaccattactttaccgttggctggagagaagggcgtcagcccaacgccgcgttcgaccccgaagcctaccagactgccaatccagatgtccgggatgcacagattaatcccttcgcccattatctgctgagaggataccgggaaggtcgcccgctgcggtaaagcatggaatgccaggaatagaaaataatctccttttccgtccctttctgagttttactttcatattatggtttcaaacctgcctgactgcctccatcttttttgatggaggggttttcgtgccaatcaagaaaatgaggccggattttgacaagcaagatcatagccaggcgggttgaaaccggcctcaatattacgtttaagccttttctggtctccacaatgccggaattcgcttccgtcgtgctggaccagatactgaccgccaccatccccctcaagcacggcaaagacggcaccctcatcgccgatattgccctgccggagtgccagattcttcacacgctcgaactgctggatcccgcttccggacggtctctgttcgatgccccttattcactggcagatttctacagccttgaagctgaagaacataccgtgagcgacgggcggctgaccgggcgcttttccgccagcgcctttctggcagaccggcttctggtcgatctgaccactgaaaacgatacgatcgtcgcacgcggtttcgccatacggcagaaaaaaaccgctcgcatcgcccattatacgttcgacatccccctctccctgatgtgccgcccggatgaaaaaatcatcaccatcatccgcattggtggagccgtcattcataccccggtgaccatcaccgcacgggatatcggatggctcggtttcgtagatctggtgcagactggtctgatatccggctgggccattgatctgaccggggccggtcgccgtgtggcactggatctgatcgtcaataacgaggtcatgtcgcagattatcgcagatgatttccgacccgacctgcaacagaccggaatcagtgatgggcattccgccttttcattcagcctgacggcaaaaccgggattcaaaggtccctctccggcacgcgtcgtcgtctccggaacggaaatgaccctgattaatggatcattccaggccacgcccccttccagtattcgcggctgtttcgacattctgcatggcatgtccgcccatggttgggccgttgatctggataatccgaaaaaaccggtcaaggtggaagccgtctgcaacggcaatatcatcggcaccgcggaagccaaactgtttcgtggcgatctgctggacgccggatataataatggcctctgcgcgttcaaaatcgatattggtgcacagctgctcgaccttctcggacaggacgtgctggtgcgtattgccggaaccgatcaatacctgatcggatcaccacgggttgcacagcagaacaagcatattctgcgttatcttcagccacaccgggacgtttcgcctgccgtagtgccccgtctgaaacggatgatgaattatcgggccggtccagtgcgcctttcaatcgtcatgccggtgtataatacaccacaggattggctgatcgaagcgctgaacagcgtccgcgctcaatggtgcgacaattgggaacttctgtgcatcaacgatgcctcttccgagccgcatgtcgaaaccatcctgcgggcctatgcacagcaggatccccgcattcgtatcctgcgcacgggtaacaatgtcggcattgcccgggccacgaatttcggcctgcgtgccgcatccggacaatatgtcaccttcatggatcatgacgattatctggagcctgatgccgtctatcatctgctgaaagcagccggagaaacacaggccgatttcatctattccgatgaagccaccacggatgaaaacattgccagcattgccgaagtgcgcggcaggcctgctttctcccatgactattatctgtcccacccctatatcgtgcatatgctctgcctgaaacgcgagctggcccaccagctgggcgggtgggatgaaagcatggcgatttcagcggatgtggatttcgtcctgcgcatcatcgaacatgcccgcaccatcgcccatgttccacgggtgttgtatcgctggcgcacccatagcggcagcaccggccattccaagaaacagcaggttatggaggccacgcagaaagccattcaggcgcatctcgatcgcctgaaaaccggtgcgacggtcgaggaaggtgtgtggttcaatcagttccgcatcaactggccgaaaagtcagggcagggtactgattgttatcccgaccaagaacaaggccgatctggtcaaaaccgcggtcgaatctatcgagaaaaccactccgcccgatgtggattaccgcattgtcgtggtcgaccatgaatccaccgagccggaaagccgtaaatatttccatgccctggccaaacggcatatcgtgatgccgtatcaaggcccgttcaactattcgaaaatcaacaatgaagccgtaaaaaagcacggcgatgattgtgaattcgtcctcttcctgaacaacgatgtagaagccatcacagataactggatcgaccgtatgcgcagccttgcaagccgtcaggatgtcggtgctgtcggcgcattgctgctgtatcccgacaagcgtgtgcagcatgcgggcgtcatcatgggattcaatgaatctgccgatcatgccttcaagtttgtcgatgcctatctgaatgacaaggggcgtcgcaacctcggctataattgcagcctgagttcagtacgagattattctgctgtgaccgcagcctgcctgatgatgcggaaatccgtatttgatcaactgggtggcttcgagcccagattcggcgttggcttcaacgataccgatctttgcttacgggtccgggaagccaatctgaaagtactttatgatggcaccacggtcctgttccattatgaaagcgccacgcgcagccagaccaagcaggtgatgcatccggaagacaccgattatcttctgcaacgccatgctgcgatcctgaaaaacggtgatcctttctataaccccaatctcagctatgtgacgcaggatcacgttctgcgtgaagacgatggctgcaaatatttcagtgttcgggtgacggaaaagccggtttccgaaatcacgtctcctgtaaccgcatcgccgaaaccggccagaaaacagaagcggcaaccgccaatcgccataccagcctgatctaatcctttcaaaaaaaacctggatacaaaaaaggccagacgcttttgtctggccttttttacgattcgcagaattctgccggcttattcgtcgagatcccgcttaacctctgggcggcgaagcagggaatccacatgcattgcgtactccagagccgaatctggctggaaatgcaactccggcgcataacgcagccgcatcaccttggccacttctccacgcaaataggtcgcaacacgcttcaaattaggtagaagcggttcgatttcactgctgcccagacgagagatgaacacggtggcgtgtttcaaatccgggctgatccgcacttcattgattgtaaaagtggtcgtggctaattccgggtcccggaattcctgacgtgcgaacaccccggccagcacgtggcggatttcttccgctacacgcagctgacgctgggatggcgcgcctttcggtataccggcaggcccggaggaggagggcgggcggctgctcaagcgggaacaagctccgtctcatagcattcaacgacatcgccttccttgatgtcattgtagcctgcaaaggacagaccgcattcgtaattgcgggccacttccttcacatcatccttgaagcgcttcaactggctcaattcacccgtgtgaatgacaacgttgtcacgcaacagacgcacgccacagccacgcttcaccacaccttcggtcaccatgcagccagcgaccttgccgaccttggtaatttcgaaaaccttgcggatttcggcatagcccaggaacttctcgcgctgtttcggcgcgattttgccgcgtaccagcgcctcgatatcatccgccacttcataaatgatggagtagtaacggatatcgacgccctcgcgctgggcaagctcacgcgcctgattggttgcgcgcacattgaaggcgatcagcacggcattggaagccttggccagctgcacatcgctttcgctgatctgaccgaccgaggaaagcagggtacggaccttgacctcttcgtgctcctgcttctgcacggtggtggcaattgcctccgcgctgccctgcacgtcggccttgatgacgacagcaacctctttctgcgcgccagcctgaatgcggctgagcatctgttccaacgtaccacggccagcggcaataccggcggccattttttcgcggatcttgcgctgacggaactcgctgatttcccgcgcccggctttcattttccaccgcgacgaaaggctcgcccgccgacggaaccccggccaaaccgagaatctcgaccggtgtcgaaggcagggcttctttcatctgctggcccttatcgtccagcatggcacgcacgcggccccattccgccccggcgacaacaatgtcgccctgacgcaacgtgcctttctgtaccagcacggtggccaccggaccgcgtccacgatccagacggctttccaccacggtgccttcagcggcccgatccggattggccttcagatccagcacttccgcctgaagcagaatggcctcttccagcttatccagattttggcgcttcagggccgaaacctcgacatcctgtgtatcaccgcccatatcctcgaccacgatttcgtggtggagcagttcctgacggacgcggcccggattggcacccggcttgtcgcacttgttgatggcgacaatgatgggcgcgttcgcggccttggcatgtttgatggcctcaatcgtctgcggcatcacgccgtcatcagccgccaccaccagcacgacgatatccgtcaccgatgcaccacgagagcgcatggccgtaaaggcttcatggccgggcgtatccaggaaggtcagcttctgccgggagggcagagtcacctgatacgcaccgatatgctgggtgataccgcccgcttcacccgccgccacatcggtggcgcgcagcgcatcaagcagtgaggtcttgccgtgatcgacatgacccatgaccgtcaccacaggcgggcgcggctgaaggtcggagtcgatatcgctgatcccttccaggccgacttccacatcgctttcactgacgcgacggacgcgatggccgaattcctgcacgaccagttcggcggtatcggcgtcgatggtctgggtcacagtggccatcatgcccatgcgcatcagctgcttgattacatcggccgcccgcacggccatacggttggcaagttcaccgaccgcaatggtttccggcagcacgacatcgcgcaccactttcagctgatcagcgcgcagacgttccagttccgcctgacggcgttcacggtcacgctgacgacgcatagaggcgatggaacgcgtacgctcatcctccccctcgatcgcggcacgcacatcgatgcggccaccacgacgcggctcagcaacggcttttttcgcaaccggagcggccgctttgcgcggtgcaggtgcaccgccaccgcctgcgcggcgcggcttgcgttcttcctcaccctcatccccacgttcccgcagacgcagcgtctgcggagcggacggtgctgcaacaggaaccttggagggaatcggcgcggggcgggagggacgacgaatatcgtccgacggtgctgtgcgagagggggcagaccgcgaagaaggggcagccgtacgctcacgctgggccggaggaggcacaggaggagcctcggccggcggcgcggattcagctgccttacgggccgcttctgcggcaatccggtcggcctcttcctgttccttgcgacgtgcctcttcttcagcggcgcgtttggcttcttcctcgcgacggcgtgcttcctcggcagcagagaggatcgagatcttctcctgctcccggcgctccacctcacggcgcgcagcctcaacacgttgctgttccagcacgcgctggcgaatagccagttcctgcgccgtcagagcgcggcctgcgcccccggcaccaccacgaccggagccgcgattaccaccaccgctgcgtggcgtaccctgtggggcattgccactctgtggggcgggtgcgctgctgctgccgccttccggggccgaaggggtgccgggctgcaatccgcgcttcttgcggacctcaacctgcacaaccttcgaacgtccgtggctgaagctttgccgcacggatccggcatccacggtacggcccagctccattcggccagctggccgaagcgacagccggcccttgcccgcgtcctgatcgttgccttcgctcatctaacgccttaaccctcaatcgtgtcgccggtgagtccggccaaccgttccgcctcaatctccagccgcgtggccagagcccccggcgtaaccgcgatatgcacagcatgatcgcggccaaatatccgtcccagttcctcaccgctcagcggcgagatgaccggcacggtcctctgtcccgacaggaaacgcgccctttcgtccggactgccatccgcagcctgcacaatcagcgccgcccgaccggcgaccagccattcgcgggctttggtataacccgccactgcctgcccggcgcgtcgcgccagaccaaggcaatccgtaacccgccgtagaaggccgtgccgcaccctatcggtcagatcggacggaacaaccacctgtgcgcgcgcagccctggcgaaagcaccccggcgctgggccgtttctagcacatcgcgccgtgcgctcaaccatattcccctgcccggcagggttgccgtcaggtcggggaccaccgagccgtcaggaccaatgacaaaacggagcatgcgggcgcgttcaccctgcacccgcgtcacgacacaacggcgcagtggcccccgctcgtcctgctcatcatccgcgttgtccagcgaatcgtccggcactgtgggcacgtcaggcgtggtcagcctcctgttcctcatcggtgaaccaatgggcgcgggcggccatgatgatctcgttggccgtctcttcgtccatggcatcgctgccgacgatttccaccagctcgtcaccggccagatcggccagatcgtccagggttttcacgcccttttcacccagcgccaccagcatggcaggcgtcagcgtttcgatatcggcgatctcgtcggtcacacccagcgccttgcgcttgtcatccatctcattcgcacgacgggtcagatcgacttcggcgcggcggatcagctcttccgccacgttctcgtcaaagccctcgatttcgctgagttcttccacgggtgagaaagccagctcctcgaccgtggtaaagccttccgtcaccagcaggccggcgatcacgtcatcgacatccagcgcatccacgaacaggctggtacgcttgcggaattcttcctgccggcgctcgctttcctcggcctcggtcaggatgtcgatatcccaacgggtcaactggctggcgaggcggacattctggccacgacggccaatggccagactgagctgatcatccggcacgacgacttcaacacggcctgcttcctcatccatcaccaccttggtgacttcagccggagcaagcgcgttcaccacgaaggttgcggcctgcgggctccaggggatgatgtcgattttctcgccctgcaactccgccaccacagcctgaacacggctaccgcgcataccgacgcaggcgccgaccgggtcgatggactggtcacggctgatcaccgccattttcgcacggctgccgggatcgcgggaaaccgccttgatctcgataatgccatcgtagatttccggcacctcctgcgcgaacagcttggccagaaaattcggatgcgtgcggctgaggaaaatttgcgggccgcgcggctcctcacgcacatcgtagatataggcgcgcacacgatcgccattgcggaagctttcacgggcaatcagctcgtcacggcgcagcagcgcttcggacttgccaagatcgaccatcagattgccgtattcggtccgcttgaccacaccgttgatgatctcgccgacgcgatccttgaattcgtcatactgacggcgacgctcatattcgcgcacgcgctgcacgatcacctgcttggcggtctgcgcggcaatgcgtccgaagtcaatcggcggcagaggatcgaccagatggccgccaagctcgatatccggcttgaatttacgggcgatatggatcgggatctgagtctcctcattttccacgacctcgaccgcctcggtccagcgggacaggcgcacatcaccggttttacggtcgatggtggcgcggatatccttttcgtgcccgtatttcgcgcgaccagccttctggatggcctgctccatcgcctcgagcacttcttctcggtcgatcgacttttcccgcgccacagcatcggcgacgagaagcagttcgggacgggaaatcgccgtatccatgcggtcctctatcaattcggctgctgcggggaatcggccacgcctgcgtcctgggcggtggcgtcgatcaatgcatccgtcagcaccagtttagccttcttcagcccatccatcggcaagctgacttcctcgccatcatccagccggagacgggcagcggtttcatcagcccccagcaccgtgccggaaaaacgccggcgaccgccggggccgggaatcgacatctcgacctttgccagatggccggcaaaacgcacccagtccttcaccctggtcagcggacggtcgatccctgcggagctgacctccagattccaggtggactggatcacatcctccacatccagcagcgcaccggcagcgtggctgatggcctcgcaatcgtcgatgccgatcagggaaccgtcggcacgatcggccatgatctgcaccgtgggttgctcccgccccagcacggccacacgcaccagttcgaatcccatatcggccagaccgggagcgatcaatccggcaatacgctgttcgagaggagtttgcgccacgctcatatggtcatgcgtccagaaagaaaaagggcggcccgtgggccacccttttacaggctgaatatcttgaaaagggttcttacgcctttaccgtgtccggtgcaacacctgcctgtcggcgggcgtgccggtcatcggaataggcacgggtcaactcggccccgaacaggaaaatctgcgcggaataataaacccacagcagcatgatcaccagcgccccggcagcgccataagaagtcgccgcattgctggaaccgatatacatgccgatcagcatcttgccgacgctgaacaggagcgcggtcgtcacggcccccatccccacatcacgccatgcaatcacccggtccggcaggattttgtaggttgctccgaaaatcagggcgatgatgaaaaaggacatcccggcattggccagttgcagcagcaatctggtttccggaataaaactgtcgagccaatcaccgatggcggccagcacagcactggccaccagcgagaccatcagtaaaaaacccatcgtcatcaccagcccaaggctgagcaatctgaccctgaccaattgtccgaccgtggaacgtggcggctccgcccgccagatcacattcaacgtcgcctgaatttcgccgaacaccccactggcggttatcagcaatgtcccgatgccgatcaccgtcgcaatcggtcccgcgccatgccgaccggcactggcaatcatggcctgcaatgcctcggcggcctgcttgcccatcagaccgcccagctggctgacgatcgcaccgcgcgcggcctcctcaccgaacaaggtgcctgccacggcaatgacgatcaccagcaccggcgacatcgaaaacaccgtgtaatacgcaatcgccgccccgcggctgaggcagttatcggcgaggtaaccccccgccgcatccttgagaatagcaagaatacgcttcatgccgccattcccgactgctgctccagcgctgccgcatgcgcctgccgcaccgcatcccgcaaggaggtcacatagtagtccgccccgatcatgtcccgctgtgcttcatcagacagaatcgggtttcccgtcggccatagcccgaccatcagcttcgcatgaggggcatgggtacgcaggcgctgcatcagcatgcgcagatgggccgggcggctggtgacttccagataggaaacgcacaccagatcgaccgcccccagatcagtctgggcaatacggacgccccgcacggcatggcgtgacagaacccgtgccggcagaccatgcttggccatcaactgagccagcatgatggcagccccctcatccagtggtccccgccccgcgacacagacaaccgaataggatccggccgaaacaggctcgacatgcgtatccggtggtaaagcagcagtcccggccatgagcacccccgtttcttcaggcaacagggcttcatcatcgaaatcagccagctcatccgtcagatcgcgcacctgctgaaggatgacttctacccgatccggcgccagaacaccgcgctgggcgtctctaccggccagttgcagcgccttcagcgcgacctcatcgtaataggaagacaggctccgctccctcagcaggatctcggcatggtcctggacctcgtcggaatcaccggcaagcatgcgctgataaaaactctccaccggtgtcaatgccggcctgtcccccagcagaacatccagaaattccagtttcgggatatgccgccccatcaccaccagacagaccgtcaacggcgtggacaggatcagcccgattgaaccccacagccaggtccagaaaatcgccgacagcatgaccgccagaggcgacagcccggtcgaatgaccatagagcagtggctccaccacctgccccatcaggctttccgccaccagaaacatacccgctgcccacagcgccatgctccagcccggatcaaccgccgccgccagcgcgatcggcggaatggctgccaggggtgtaccgatataaggcacgaaccgcatcagcccggcgatcactccccacaaagccgggctgggcaccccgatcatccacagaccaagcccggtgatcagaccgaaagccgcattcagtccaagctgcgccagaaaataccggctcagtcggctggccgcatcatccatcgccagagtcgtacgatgcagatcagacgaaccgaacaggcggatcatccggtcccgcagatcctccagcctcatcaacatgaaaattgcgacaatgaacacaattcctgtggacgccagcggggcgataatgggcgacagataccgctccgcaatttccagcggagaaggattgacgggcgcaatggtgaccggaacaggctggacttccttccccgccccttcccgtcccacatgaggctgaagattgctgtcggccattcgctggggcggcggcagagcagtctgattatgggtcgactgagctggagaagtcggggaagcctgattctccggcgttgatgtctgggaagaaggcggcctggcgctccgctcgtgaccgaatgaaccaaaacgctcggcaagatgccccgcacgggtcatcgcccagtccctcagcaagtccgccttgtcgagaatggtcgactgatagcgcggaacgttatcagccagctgcgccaactgggtgccgatcagaccgcccaaggccagaatgatacccagagccagcacgacggccagcaccaccgcgataaatcgcggcatccacaaccggcgcagcaccgagaccagcggcgacagtacgaagctgagcagcacggccagcgtgatcggcaccagcacctctcgccccagatacagggccgccaccacgaccacgccgatcaccacagcgcgcaaatcgttactgctgggcgtttcggcggcggggatgcggacgcgattgtctgcgaccggcggcagcagggaggacgaggaggaagatggcgcgtcgggcatgagggtcgctttgctgcgaaaaaggcttcaccctaatgcgcagtaaagcgtgtcaggttcccgattacgaccatgctgtacgcaattggcaacgaatggtggcgtcagcgccgcacatagcgccaataaagcggctgacggcccgccctgatcgccttggcctcataacgcgtcggcggccagccttccggcctttcattgctcacggcaagcagctcgaaagcagtctgacgctccatgacctccggcacccaggcctggtaggtaggatcatcagaggcaatccgccattctgctcccggcttcatcacccgcgccagcgtagcggcgttttcaggatgcacgaagcgccgtttcgcgtgtcgcgccttcggccatgggtcgggaaacatcagaaaaacccggtccagtacctgatccggcagatcgcgcagcaatgggcgcgcatcatcatcccagacgcgcagattaccgggcagcggcgcagtttcctcatccagcggctccggcaggaggcgtgacagcagggaacacagaccgttttcgaatacttcgcaggcgatcagggtcacatccggatgcgcctcgatctgggcaacggcatgctcaccgcccccgaacccgatttccagccagagtggagaaacaccccgaagagaggacggtccggcatagcgcaggcgcggcagggtcaggtccagcagacgctgctgacgaggccggagcgcatggccacgctggcggccataaagtcgatcgggttgggatttcatcgtcatgtcaggcatcgattcaaatcggacagaagcagatgaccgagatcaaatgaaaaggtcagggattgctccctgacctttcatatcatccagtcagccggaagcgtctggtctcagcggttgaaggcggagcggagggctgccgcaatatccgtctgctcccaggtgaagttatccagcgccatatccggggtacggccaaaatgaccgtacgcggaggtcggcacataaatcggacggttcagacgcagatgctcacggatgccgcgcggagacaggttcaccagctcccgcaaggttttttccagcttcacttcgtccacatcatggcccgtgccgtgcagatcgacatagacggacagtggatgcgacacgccgatcgcgtagctgatctgcagggtcacacggtccgccagctcggccgccaccacgttcttcgccagatagcgggcgacatacgcggcggaacggtccaccttggtggggtccttgccgctgaaagctccgccgccatgcggggccgcaccgccataggtgtcgacgatgatcttgcggcccgtcagacctgcatcaccatccggaccaccgataacgaacttgccggtcgggttgacgtagatttcctgctccggcggcatccagccatccggcaaaacctgaccgatcacaccggttacgatacggcgcagctcgtcctgagaggcggcttcaccatgctgagtggacacaacgacactggtcgcaccgaccgggcggccatccacataacgcagggtcacctggctcttcgcatccggctccagcagcttgccttcggtggagccgcttttacgcagctccgtcagacggcgcagaatttcatgagaataatagatcggggccggcatcagggccggagtctcgcggcaggcatagccgaacatgatgccctgatcgcccgcgccttcatccttattacccgtgctatcgacgccaacagcgatatcggcggattgcgcatgcaggtgaatggccacgtcggcattcttccaggaaaagccttcctgatcgtaaccaatgtccttgatcgcctcacgggtgaggttttcgagcagttccggcgtcaccgaagcagggccgcgtgtttcacccgcgagaacgacacggttggtggttaccaacgtttcacaggccacacgggcgtaaggatcagccttcagaaaggcatccagcaccgtatcactgatccggtctgccaccttgtcgggatgaccttccgaaacggattcggaggtgaaaagatattcgcccttatcgcgcatggagttttttcctcttgtcgcgagcgtgaaccgctacgatcgccatggtggggggtgtggctgaaaccggtcatatcgtcaaggcgcgatggcctgccagacctgccggaaccggctgacagcataatgtcagcgatctgtcacagatcattccagcctgtgaactgcacctgtctgcccgtgaacgcgtcccttacctgtggatcgatcagggctgcgtattcaccggtctggtcgtattccggcatcagcgcctgcagtgtcgcatctggccgggatgccggatgcgtgtagatttcggtgacaccggacggcaaatgcctgctcagccgcaacagcttgtcggatgtcatgtgcccgctccagcgcaggccgaacacgtgatcgttgaccgaaagacccgctttgcgcgcctgcgcccgcagcataccggtccagcgatataacagcgtatcactcaggcccgtcttttccccgcaggccgccatgatggcaggcggctcggcaggaatacggatggcacgcagaccataatcccgcccgatctcgcacagcagcttccccaccgtcggatgcagatgcatgtgcttgtgcgcattggcgtgatccagcgtcagcccggtggcgcgaaaagccgcgaactgggcgtcgatctcctccgccagttgccgcctcgccgagggggaaaagaaataggtgaagccccgccgcacctgatcggagccgaagcgcccctgctgatcaaccagggccggaatccgggcatgcggcagcaccgcatccccttctaccagcaccaggtgcagaccgacccgcagggagggtgtcgcccgtgccatggccacggcctctgccgccgccggtgccgccaccatcaggctgcatgtcgacaggattccgttgcggtgggcatccagcaccgcctcatttaccgtcgaggtcaggccgaaatcatcagccgagacgatgatccgtctcataacccgtcctcatccttcataagcgacagggccagagaatgaactccggccctgtcccgttacccttgtttcaacccgtgcggatcaatcaggcagcgttacgctgggtcttgcgttccttgaggaattggaagaactccacaccctcgcgcaggcgacgcttcatcatctgcgggctggtgatcatctcgccgacgatggaggcgatcttcggcgcacggaaatagaatttccggtagaattcctcgacgctctggaacatctcggtatggctgagatgatcgtaatgcagcggcgccatctggatgccatgctcgtcgatcagttccgcatgctcggcatccagccagccattctcaaccgcctgattatacaggaacgtgcccggatacggcgcggcaaggctcacctgcaaggtatgcgggttcacttccttcgcgtattcgatcgtctcctgaatggtctccttcgtctcacccggcaggccgaggatgaaggtgccatgaatcttgatgccgagatcgtggcaatccttggagaatttcttcgccacctcgatccgcagacccttcttgatgttgtggaggatctgctggttgccgctctcataaccgacgagcaacaggcgcaggccgttatccttcagaatcttaagggtttcgcgcggcacattggccttggcattgcaggaccatgtgacacccagcttgcccatttcacgcgcgatggcctcagcgcggggcagatcgtcggtgaaggtatcgtcgtcgaagaagaattccttcacctgcgggaagtatttcttcgccagcgcgatttcctccgccacatgctgcgggctgcgcacccggtagcgatggccaccaaccgtctgcggccaaaggcagaaggtgcagcgggatttacagccgcgcccggtatacaggctcagatagggatgcttcagatagccgatgaagtaatcctcgatcttcagatcacgcttgtagacctcggtcacgaagggaagctggtccatatcctccaggatttcacgatccgggttatggatgatctcaccattcgcattacgccaggacaggccggcaatggtggccagatcacggccctctgccacttccttgacggtgaagtcgaattcgttgcgcgccacccagtcaaccggaccaccgcttttcaggctttcttccggctgcaccgccaccttcgcgccgacgaaaccgatcttgagagatggattcgcgtctttcagggcctgcgctaccttcacatcggaggcaaaggagggggaggaagtgtgcatcacacacagctcataatctttgatctgcgccgtcaccgtctccagcgtgatcccggctggcggagcgtcgatcagcttgctgcccggcaccatcgcggcaggctgggccagccatgtcggataccagaaggatcggatctcgcgccgcgcctgataacgggagccggctccgccatcaaatccatcgaaggaaggggggtgcagaaaaagggtcttcatcatgagcgtcggtacctctccatgagtcggcgccgacaggcccggctccgcttacgcaatcttacgcagtcattgtcttacgtcattgtggcgcggatacgtatgcccgcactgcaatcgacctcagcccttcaggaggggctgggccgccagcgtcgcctgctgcatggccggagacgagcgataggtcatccgcgtcacctgcaccacctgcccacgccatttgacctcccctttgcggaaggtggcgagaatggtggccatcgacaacagctcccgcacaggcagaagcagaagagaggtcgcgggagcaagcttcaacagacggtcgatcccgcgactgaccagaaaacgcaccatccagaaagcaaaaaacaccgccagcgcccaccccgccagaccggacagcgccacactcagcatggcccagaataacgggaactgaagcatggaaagaatgaacccgaccggggccacggactgaatagtgcgttgccagcgcagctcatgatcgaacagggcacggatcgtggtctccggcacggtggtggcgggaacggtatccgccagaccgacgcgcagcccctgccccaccattaaatggcccagcaccgcatcatcggcgatatgatgcgaaagcactgccagaccacccagattttccagcgtctcccgccgcagcgccatggtggcgcccaggcaatcctgacggcccagcaggcgcgcaaccagcgcaccgggcaggaattgatgggaaatacctgccatgcccagagtaccgatcaggccggattgtggcgacaccccggaatacagagtagttaccagcccgatttgaggctgctccagcgcagtcaccagacgtcggagataatcccgtgtgacatgtacatcgctatccgcaatcaccagcacatcatgccgggcgcttggatacatattgatgagattggcaattttccggttttcgccatggggggtggggtcaaccaccatcacgatatccagatggggaaaccgtccctgcaaacgacgcacgacgtgacgggcgggatcatccgcgctctgcacaccgaaaaccagctgataacgcgggtaatcttgctgacagaagctttccagcgcctgttcgagcagcggctcctcaccatgcaacggtttcatgatggtgacggcgggccagtcctgccgggggggcagaggctgccttgcatgccgggcaaatttccacacagccccaaggccgagaacggtctgcaccatcccgatcccggccagagccatggtcgtatcagcgaaaaaaagcatcactcaaaaaaccggattaaaatcttgaggaacacaccaggacacgcttcatcacatcgtgccaccggagaggtccgatattttctgacggagtttgtccagcagattatccggtccggctgccagcaatgtccggaaatcggagcgtgttacggccacctggctgatcgagccatccagcagaacatcgacaactttccactgccccccatcattgcgcatcagatagtcaatgcgattggcggtgccgtcactcacgatctggctctgtacaacctgatcgctgcctgatgccaccgggttaggcgagacccggaaagactggccatcaaagctcgagaattcggaaacgtaacgcgccacggtaaagcgcgtaaaaacatccagcagctgggattgctgttccggcgtcaggctgttccatttcagaccaacggagtttttcagcagcagcggcaggtccagaacctgctgcaccaccggagccagtgtctggtaacgctgaggaaaagggaccgcactaccctgtttcatgataccgagcagcgcctgattgagccgctcgatctgggcggacggacctgccgcctgggccgcaacgggaaccaggcttgccgtgaaggaaagcccggcgacgggtgcccacaacaccagcccctgtaacagagacgcgcggatgatcgttttcatcgtgacggcaccttctgagtcattggctgctccagcagtttcaggacggtatctcgaatggcctggtggtcaagtccagcctgtctgatctggtttggctgggtatcatggtcgatatagcgatcaggcaggatcatggaacgaagtttcagcgcatggccatcgcgcgcatccagcaggccggcctgcgccagatgctgcatcacgtggctggcatagccgccgatcgagccttcctcaacaaccacaagaacgtcgttctcccgcgccagacgctccaccagcgccgtgtccagcggcttcacgaagcggccatccgcaaccgtcaccgtcagcccatgcgcggcaagatcatccgcagccaacagagcatcctgcaaccgggtgccaatgctcaggatcgcgatcccgctccggccctcccgcacgatgcggccccggccgatcggcagaacatccccgcgcagacggcctttctcatcacgcggcagcgcaacgcctacgccttcaccacgcggatagcgcaccgcactcggcccagaatcataggccgcaaccgtcgccacagcatgcacaagctccgcctcatcggacggagacatgatcatcatcccgggcagacaacccagatacgccatgtcgaagctgccggcatgcgttgcgccatcggcccccaccagccccgcacggtcaatcgcaaagcgcaccggaaggtgctggatcgcaacgtcatgcaccagctggtcataaccgcgctgcaggaaggtcgaatacagcgcgcagaacggaaccatcccctccaccgccagaccagccgcaaacgtcaccgcatgctgctccgcgatcccgacatcaaagcaacgatccgggaagcgcttctcgaacgcgtccagacccgtgccggacggcatcgccgcattgatcgcaaccacccggggattatcctccgccgccgcaatcagcgcctccgcaaacactttcgtgtaggtcggcggtgcaggcttcgcccccggaacaggcgcaggcttgatctgctcgcccgtcaccacgttgaaacggctcaccgcgtgatatttgtccgcagatgcctccgccggcgcatagccatgacccttccgcgtgatcgcatgcaccagaatcggacccgtctcctccgcatcccgcacattgcgcagaaccggcagaagatgatccagattatgaccgtcaatcggacccacgtaatagaagccaagctcctcgaacaacgtcccgcccgtcaggatgccgcgggcatattcctccgctcgacgggccgtccgctcgatcccgcgcggaaaatggcgcgccatcttccccgccagatcccgcaggttcaggaagctccgcgaggacagcagacgagacagatacgccgacatcgccccaacaggaggcgcgattgacatgtcattgtcgttcaggatcaccaccaggcgcgacttcaggctgccggcattgttcatcgcctcatacaccatcccggcgctcatcgcaccgtcgccgatcaccgcgatcacatgctccggtcccgcaccgacctcgcccgccgcacgacgcagatcgcgcgccaccgccatcccgagaccagccgagatcgaggtcgagctgtggcccgcaccaaacgggtcgtattcactctccgaacgcttcgtgaagccggacagaccgcctcccatccgcaaggtccggatgcgatcgcgacggcccgtcaggatcttgtgaggataagcctgatgaccgacatcccagatcagacggtcggacggcgtgtcgaacaccgcatggatcgcaaccgtcagctcgatcaccccaagcgccgcgccaagatgcccgcccgttaccgaaacagcgtccaccgtctccgctcgaagctcatccgcaaccgcgcgcagttgctccgatgacatgttccgtaagtcagacgggtaacgtactcggtccagtgtcggagtctcatggcaacggacaggggttgtttcagtcatgcgaacttttcatcctgcggcgtgtggccgcttcaattcttgaacaccacccggacctcccgtcgattcttccccccggaagacccaacggcccgaattccctcacgggctggaccctgtccgagctgagcggtggcagcggcaggcatgaccatagaccactcgcgcagttcgcattcccctctatccaaatccggcaactctttgattgcatgtttcatgtggaacggtctgcggcaaccccaaacccgcagccagcccggccacaatgtccgaatccatcaagaagcgtgctttataagcaacactgtgccgataacctgtcctgcttttaatggaagactctcaatccaggaatggaatgatttactgcttgtgaattgaatgatttggctttcaaacccggcactgacaggcggtcatgccccgacaaaaaactttcctgatcctgaacagaacagcccgctcctgctttacacaccgtgctgccgcgcatttccagtctggacccatgcggtcgggatggtgtagcgaaaccggtctcatgcccggcctgaactgcccgggcatacagcatgatgaggctatcatttatcgttccgtcatatcgtgttccagagcatccatggccaaccggtcagatttacccggaccgtatgattggtttatccctgatgcccggtccgcgaccggtcatccgaccgcagttttgaccaaaggctgaggaagtccgtatggctgtgccgctgcaccaggcgatccgcgtaggcgcctatgtgatgaagcaacatctgctggggcggaaacgctatccgctggtcctgatgctggaaccactgttccgttgcaatctggcctgcgcgggttgcggcaagatcgattacccggcggaaatcctcaaccagcgcctgtccgtggcagagtgcctcgaagccgtcgatgaatgcggcgcgccggtggtggtgatcgccggtggtgagccactgctccataaggaactggatcaggtggtcgagggcatcattgcccgcaagaaattcgtgatcgtctgcaccaatgccttgctgctcgaaaagaagatgcatcttttcaagccgagcaaatggttctcctggtccgtccatctggatggagaccgggaagatcacgataaatcggtctgtcaggatggcgtctacgaacgcgcggtggaagctatccgccgcgtgaaacaggccggattccgcaccatcatcaactccactctgttcgacactgccgatccggagcgcatggcgcgtttcttcgacgatgtcatggaaatcggcgtggacgggatcagcgtctcccccggctatgcttatgagcgtgcgccggatcagcagcacttcctgaaccgtcgtcgcacgaaagatctgttccgcgggatttttgcccgtgcggacaagtcaaagaagaagtgggagttcaatcagtcctccctgttcctggattttctggccggaaaccagactttcaagtgcaccccatggggtaacccgacgcgcacctatttcggctggcagcgcccctgctatctgctcggtgaaggctatgccaaatccttcaaggagctgatggaggaaaccgactgggatgcctacggcaccggcaattacgaaaaatgcgccgactgcatggtgcattccggatatgaagcgaccgccgtggccgaggccgtcagcaagccgtggaaagccgccaaggtcgctttgaccggtatcaggacgaccggcgacatggctcctgacattccgctgaccaaccagcgtccagcccagtatgttttcagccggcatgttgaaacggcactggaaaaaatccgcgccgagcaggccggggcctccaaaccccccaagacagtggttcgccatgtggccgccgaggctggagactgaactgatttctcccccgatcgtgcaaacggtcgggggttttctttttcaaccctgttttggccactgaaaacgacgcagggtctgccgggccgccgcagcatcccgtgccagtgccatcagggaacctatctgggacggctgacgcagaattgatcccgccaccctgaacacgccgatcgcaccggcctgatccagtgccagcaacgccgcaggcggcagatccctgtccgccggatcacacactgcccggacaatcgaaaacgggatgccataccgggccgccacccgcgccaccgccccgctttccagatcaaccgcccccgccccggtctgacggaaaagcgctgccttatccgtccggctggccacgacctgccgggttgcgaccatacgacgcacagtcataccacccgcccaggatggatcggtctgataaagggccccttcctcaatcaactcggcgggaatcaacagggcacccggcagaatggccggatcgaggccacctgccagaccgaaactgaccagccgatccacaccgctttcaaccagatgaatggcagcccgttccgctccctctggctcccctccaccgaccgcggcaataccgaacccgcgcaggagtcttgcttcagcctgtaagcccacgaccacgccggttttcataaccgcatcccgcctgcatcctctgttcaggactgtttgaagcaaaacacgccccctccggcaaatacggcgcatcatagcctgcgggcttctgtcccctctcgtcattccgtgcagtctgtgccaccacagggtcatgagcacagatcgcagcatacgcattggaattgccggcatggccggtcggatgggcagcctgctggttgaagaagcggctgcacagggtacggtctccgggggaacgctccgacccggatcaaacagcccggccccagtcggcattcctgcctttgctgatataaacacgctggctgaagcttccgacgcggtgattgattttacctccgcctccaccgtgcaggcgcatgccagagcgttgagcaaggcggggacggcatggattctcggcacgtccggcctttcccctgccgatgaaaaggctgtcgaggaaatcgccgcccttgttccagtggtttatgcgcccaatttcgcgccgggggtcaatctggtgctggcactggccgaaaaaatggccgctgcgctgcccggtaaccgctatgatgccgaaatcgtggaaatgcaccatcgccgcaagatcgattcaccctccggcacggccattggtctgggccgcgcggtggccgccggtcgcggtgtgatgctggaggaagtgatcgaaagcggccggcacgggcatgtcggaccgcggcagcctggcgccatcggctttgcggccctgcggggcggccaggtcgtcggcgaacacaccctgctgtttgccgctgatgacgagcatatcgccctgacccaccgcgccttcgaccgtcgtgctttcgcgcgcggtgcggtgcaggcagccttatgggtgcagggtaagccgcccggattgtattcaatgatggatgtactgggcatgcgctgaaagcgactgcgccgatgctgaaaggaattctgaccgtcggcggctggaccatggccagccgtattctgggcctgctgcgggaaatgctgatcgcggcactggtcggcacagggccagtcgcggaagctttcatcatcgcgaacaaggtcccgaatctgttccggcggctgttcggggaaggggccttcaacgccgccttcgtcccttctttctccggactgctgcaaacggaaggtcacgacgccgcccagcgctttgccagcgaggccatggccgtcatgacgttctggctggtctccctgaccattctcggcgaaatctgtatgccgtggatgatgacggtgctggccaacggctttgtcgatgatccttccaaattcgccctgaccgttacactcagccgtatcacctttccctatctgcccctgatctgcctgtgcgcgctggtcggcggcgtgctgaacgggctgaaccgcttcactgccgccagcgcaagctatgtgctgttcaacgtggtctccatcgtgttcatgctctgggccacgccgttcatgccgggggtaggacatgcgctggcatggggtgtgacggtctcaggcgtgctgcaactctcgctgatgctgtgggcggcgaagcgggccggcatggcgctgcatctgccgcgcccgcgcctgaccccgcgcatgcgtatcctgctgcgccgcatgggaccggggctgatcggggccggggtcacccagatcaatttcctgatcgatgtggtcatcaccactttgctgcccgccggatcggtggcgctgctgggctatgccgaccgtgttaatcagctaccgcttggtgtcgtgggtctggccaccagcacagcctccctgcctgtattatcccggctggtccatgcgggggatgagcaaggcgcgaaccacgccatgaaccgggcgctggaatatgcgatgacgctgatcctgcctgccgccgtagcgctgatagtcatcgcccaaccaatcatggccgtgctgtatgagcgcggagcctttacagccgaagccacctatctgtcgtcacaatctctggcagcgtatgcaatcgggctgccagccttcgtggccgtacgcatcatcaccaacggttttttcgcgcggggcgataccgcaacgcctgttaaaatcagcattttcatcatcgccctgaatctgggactcaatctgctgctgatgaatcggctgcatcatatgggaccgcctctggcctccagcatcgcggcctatgtgaatgtgctggtgctgagtgcaatgctgggcaggcgtggtcatttctcagcagacgccgcattacgccgcgccttgtcccgcatgggtctggcggcactggcgatgggggccgtgctggccgtgttcagaccgcttttgttcgatacgctgcctgatattcacggcgcacgctgggtggcactggctttgttaatggccattggcgggggcgcctatgtgctcagcggccaaatgctgggggcgttccggatcagggatacgctggcgaaaatccgccgtcgccgctgaagggtcaggtccgccatttcacatggcaggtctggtccagcggatggcagaaccggccatagcgatagggaacgatctcggccggagccagcaattccaccggacgcgagggcggagaagaaaaatctgccgccacggcaggggggcgttcagaccgggagacagatgggaaaggggcaaacccacctgcctgacgatccgacacaaccgtggcggcagacctgaccggaccgtagctgccaccgaccaacgcagctgttccgaccgtcagcaggaccggaaaaagagccaggctccgggtctgcacaacccgagaggacgtgaaaaacatccgcatgaccgtgtcatccttttccatactggctgacagaggtgttctagcagatgaagaacaaaaacagaactgttattttcaaaaatcagaacaaaaaaagtacaaattcacctccatggggtgaggaaacgctacacggcactgttgaggtagccgtaaacagcccttgaaacccgcctgacaagaccggatcgatcccgctcgcccttttccccggcagtatcgaccatgcctttcacaatcgccatcacatcctgtgccgccatgtcgtattgaggctggggaggcagatcatgacggctgagtacctcccgcaggattgtcagaaaccggcttgtgacgcgctgcgtatcctcatccaagggaagccgtgcttcctcgatatcgagtaaccgggccagaaccggtcggcgtagctgatgagccaccgcagcctcgatcatgccggacaaagccgcccgcccggtcggagcagcaagagactgttcacattccgcgagcagaatcgaggtctccctcacgatcaacgccgcaatcaatgcctccttgccggggaaatactggtagagcgagccgatactgacaccggcccgctccgcgactgcattggtcgtgaaatcccccagccctttgcgctccagaatgtgagctgcggcctcaatgatgatgcgtaccgtctcctccgaacgcgcctgacggggcatttttctgggagaggggcgccgggaggaaggtgactgcggcatcagtacatatgcgagtagtgaatataaggatttactcacattatgacagcctcacacgaagatgcaaaggacgtacaccgtgaccataccttctttcgaacctgccctgaccgttttcatgctggtcaagacctcgcccgaatggcttggctttccggtggagcgacgcttcgcgctgctggaggagcaattcacccccatccttcgaaaacatgcggcgcatgtcaccttacgctttttcgatgtggagttctacgcaacccgcgtcaccgacctatggatgtgggatgccagggatcaccactcctatcagcttctggtcgaagacctccgcgaaaccgctttctgggatcgctatttcgagatcgtggaaatcctgcccggtgtcgaaaacgcctacgcccggaattacggcaggccggccatcaatgcctgacgtgatcgggaaagagtcagacctcgctcatggtcaggcggcggcagtatcgtatgtcggcatcaggatactatcggcagagcaggcggcccgtgatctggatgagcgcagcgagtatcgcctgtcacctgaagatatggacgatatgttggccgcccttgatagtgatcaggcgcaggatacgcaggatggggcttctgctgctggctatgaggctgatccgtctgcgttgccgactgacgctctcgtgccgtcacgctgacatggatacaatttcgaccatgcgcattctggcagccattagccttctctctttcatcccggcagccgcttcggctgagccgctggcagggatttcaacggaggtggtcatgctgccatcgacgaaggagaccgacgctgtcggcgatctggcgtggcaggctctggtaaagcgtctgggaccggagacgtatacagggaccagctatgtcacttttggctatcatcatttttttgtctgtggtgccggacacaaaggcacaaatacgaaatttacctttgtctatgtggcggccgaacaaaagtccgaaacggcgttgtttatctccacgattgatcacgccgattacctgcttgccgatcaacgtttttgccatccgcgctgagtgcgccatttccccttccgatgcgtctctgattgagcagctacaaattccacgcgcagaccagcggcatagggtattgcgtatctatcgaggtatcccatggaaacatcgcgatataaaaagaaaggggcaggttttgcctgccccttttcagtttttccgatcacactatggatcgactcacggcgaaggatgcggagcggcttgccagatatcacgcgcatattcgcggatggtccggtcggaagagaaccagcccatcgccgccgtgttgagcagcgctttacgccgccattccagcggcgtgcgatacagggccgctccccgcttgtgcgtttcctcatagctttcgaaatcagcggtcacgagaaacacgtcatcgttcagcagatgatcaatcagccccgcataacgtgacggatcatccggggagaatacgccagagcggatcgcctcgatcgcctgcgccaggctggggcacgcagcgactttggcacgggcatcgtatccggatgccttgatatccgccacctcatcagcccgcagcccgaagatcagaatattgtcgtccccgacgtgatcgcgaatttcgatattcgcaccgtccagcgtgccgatggtcagcgcaccgttcagcgccattttcatgttgccggtgccggatgcctccaaccccgccgtcgaaatctgctccgagagatcggccgccggaatgatgacctccgccaggctgacattataattgggcaggaacaccacccgcagccgatcacgcaccaccggatcattgttgacgacacgggcgatatcattggccagcttgatgatcagcttggcacggtgatagctggccgccgccttgcccgcgaatatcttgacgcgcggtgtccagttacggcccggctcggcacgcatcttgtcatacagcgccaccgtctcgatcagattgagcaattgccgcttgtattcgtggatacgcttgatctgcacatcgaacagcgcatcgggatcaagccggatgcccatccggtcctgcaccagggccgccagccgctgcttgttttcacgctttacagcgctgtagcggtccatgaagggggtatcatcgacaaatcgggccagttccgacagttcttccgcatccgcgacccagcgattcccgatcgagtcgttgatcagcgcggtcaggccgggattgcactccaccaaccagcggcggaaggtgatgccgttggtgatggcggtgatccgatcgggaaacaacttgtgaaaatcacggaacaccgtggtcttcatcagatcgccatgcagcgccgaaacgccattcactttcttcgatccgacgaaagcgagatgacccatgcgcacctgacgcccgttgctctcatcgatcagagagatggagcgccgcaactcgggagaactgaccggacgaggcgttgcggtatccagatgcagcgcgttgatctcatagataatctgcatatggcgcggcagaagacgttcgaacaatgtcaccggccagctttccagcgcctccggcaacagggtgtgattggtatagcccagcgtgccgcgggcgatggaaaaagcgcgttccagcgtcaagccgtattcatccaccagcaggcgcaccagttccgccactgccaccgcgggatgggtatcgttcagctggatggaagccgtatccggcagcctctccaccgatccctgctgcgccatgtgacgcctgaccagatcctgcagggaggcagaggtaaagaaaaactcctgcttcagccgtaattcccggccagcctcgctgctgtcatcgggatagagcacgcggctgatattggtggcattcagctgggcggcaaaagcatcggcatggtgaccgcgattgaaggcatccagccgcatcggctccaccgagcgggcgcgccacagacgcagcgtattgatgtgtgtgccctgccagcccaccaccggtgtatcatatgccacagcccgcacccgctccgccggcatccagaccagacgggaggagccatccggctgatcctgcggcagcacgcggcctccgaagccgatatcataggcaatttcggggcgctcgaattcccacggattgccgaagaccagccagtcttccggcatctcgacctgatagccatcgcggatcacctgcctgaacaggccgtgatcatagcggatgccatagccgagccccgccagcccgaccgtggccatactttccatgaagcaggccgccagacggcccagaccgccattgcccagcgccgcatccggctccagatccttgatctgatcaaaggagacgccatgcagggcgagggcttccttcgccgccgtcatcaggttcagattggtgagactgtcggtcagcaaccgcccgatcaggaattcgaggctcagataatagacccgcttggcattggcctcatcagcggagcgggcggtcgcatgccagcgatccacgatccggtcgcgcacagcgagggcggtcgcggcataccagtcgtgcaaccgggcatggcggggatcgcgccccaccgcgtaccgcatcttgtcctcgatggcacggtgcagttcggcaacctgtgcggtgtaaggcgtgttggcggcgtccatactcgctccctggtttgaacagaccgttcagaatccggcggtagcgagccggctcctgcggcaccaccacgatacagagacaaacgcatctgtcacgcacttgtgctgtaccaatggtcatcaggccaatggtcatcaggaaggcaagcaatccccgtgccgtagctccggccacagcggggaggcatgtcagaagaaagaaaaaagagagtcagacccgcagaaaaccaaccagtttttccgcctcggcgacgatgggctcagcgatggcttcggcccgacggccaccgtcatgcagcagccggtccagctctgcctcatctgccagcaaccgcctcgtttccgcggcaatgggggaaagctcctgcaccagcaactcggtcagggcctccttataggggccgaagccctttccgccatgctcgcgcaacacggttgcggtgtcactgttggtcagcgccgcataaatacctaccagattgcgggcttccggacgcccttccagcccgtcaatatcctcgggcagaggctcgggatcggttttcgcccgacggattttcatggcgatggtatcggcatcgtccgaaagattaatgcggctctgatcggatggatcggatttggacattttccgtaaaccatcccgcaggctcatcacccgcgctgccggcccctgaatcagcggctccacatgcgggaaaaatgccacgccgaaatcatgattgaatttctcggcaatgtcgttggtcagttccagatgctggcgctgatcatcgcccaccgggaccagcgtggcatggtaagccagaatatccgccgccatcagattgggatatacatacaacccggcagacgcattctcacggtccttgcctgccttgtccttgaactgcgtcatgcggttcaaccagcccagccgggccacgcagttgaaaatccaggccagccgagcatgggcactgacggaactctgcacgaacagaatgttgcgggccgggtccacgccgcaggcaatcaccgatgctgccatttcccgcgtggactgacgcagcttttccgggtcctgcgccaccgtgatcgcatgcatgtcgaccacgcagtaaaggcattcatgcgtatcctgcagcgtcacccagttgcgcagagcgcccagataattgccaagggtcgggatgccggaaggctggatgccggagaatatgcgcttcataccgcgttctttctctcatgaggcgttatcgcgtcaacgggcgatatgagggttcaactgcgttggggtcgggtgaaaagcagccgggccagaccaacggggcaaaatccggtgcgccacagacggccccatgtcatggcgccgatacatccgacatccttcagcggcctgaaatggcttggccgatgcaaggcagggccatggatacggggaatatcgaccgagacggtccgaatcccctgccgccctgcctcaatcagcaactcgctttcataggcaaaaccgcccgacctgatccgatccagcaagggcggcaaaactggggcagggtaaacccgcatcccgctctgtgtatcctcaatcggccagccggatgcccatgaaacgacagcatccgccacacggttggcagcacggcgaatccaaggtccgggtgcatgatcacgacggcgggagccgatgacgatcatgtccggatagcgttcggaaacctggatcagacgcggcagatcctccggcctgtgctggccatctgcatcgagcgtcacgatcaggggaacctccatggcgcaggccgccgccagaccggccgcaaggctcgcccccttgcccgcattggtggggaagcgcagcacctctgccccggctgcttccgcatgctgtgccgttgcatcacgggagccatcatcgaccaccagaatccgtgcatcccgcacagacgcacggcagcgcatcacaatatcgccaaccgatttttcttcctgataggcgggaatgacgatgacgatgcgcgatacgctttcatccccgggcatcttcctgccaggaccagttgaaaacgaaacagaggttggatgggtcacagaacgtgtttttgattacaaaggcgcaaggaatagcagcattccggttacaaaagatcctgaataatctatactagtccggtcaaggacagatggtaaactcttcatgctggacagcgcatcgatctccatgaaaatgggcgaatcaaccagtgacacacggctttgtgatgtgctgatcgtcggcgccggtccagccggatgcaccgcagcctacctgctggcagaaaaagggcgtgatgtcgttctgctggagaaagaacgccatccgcgctttcatatcggggagagcttgctgccacgcaaccttcaattaatagagcggcttggcctgaccgaagatatcgccacattcggcgtgttcaaacccggtgcggaattcatctcggatgatcatggcgggaaggatacaaaattctgtttcgcggatgctctggacaagacttttacccattcctggcaagtgaaacgcgccgatttcgatgccgccctgttccgtagcgcacgtgacaagggggcggatgtcatcgatggcatgcgtgtcaccaccatccgttttcccgaaggcgtgccggaaggatcggcccgcgccatcgtggaagccgtggacgaagccggaaacgcgcatcattttgctccccgctatgtgatcgacgcttcgggacgagatacgtttctgggcagcaaggttggtggcaaaaaacggaatcctcataacaacacggccgctctctacgcccatttccgtcatgtaacgccacgcccctgcgaccgtaccggttacattaccatttgtctggtggaaggcggatggttctggatgatccctcttcctgacgacatcaccagcgtcggctttgtcggcacgcaggaggctttcaaacaacgcaaaggctcactggaagatttcctcgacacccgcatcgccgccagcccgagtgtcagcagccgcatgatgcaggctgaacggatctccaaagtcaccgccaccggcaattactcctattcctgcgagcggctgtcggggccgggctggatgatgattggcgatgccttcgcatttctggacccggttttttcctccggtgtcctgctggccatgaccagtggcgaaatgggggcggaggtcgccgatctctggctggacaatcctgctgccgcccggaaaaagctgaaaaaagtcgaagccaaaatccgtcacgcgatcggcacgctgtcctggctggtttatcgcatcaataaaccggtgctgcgtgacatgttcatgtcccccaacaaccgttttcgcatgcgggatggtctggtgtcgctgctggccgggaatgttcatgggacattgccacgcaatccggtccgcgcattcaagggggcgtattatttcctgaccactctggcaaaaatcggtatcaggctgacaccggacggcgatctgaagcgaggcccccgtatcgactaattgaccaatcagatacggagaagcctgcttcagagtctcgatcaaactccaaccatcacatccgatgccttgataacggctgtcgctgtatcgccgattttcaggcccagctcctcggatgcttcgttggtgatcgaggccgtcaggactacgccgtcagcgatttcaatcttcacatgcgtggtcgtggcccccggcctgacctcgacaatgcggccctgaatctgattacgggcagataatctcattgtagccgtctcctgtaacgattgaagcatccctatggaggcttcctcattgggagccgtcaagcatggttcggagatatgttggccctgacatgatcggccgcatgttttcggaaagcacgtactttgggtgcaatcaccgcctgacaatacgccgcctcgggatggcgtgcgaaataatccacgtgctccggttcggctggatagaaaatctgtaaaggctcgatcgtcgtcgacaatggggcctgccagatttgcgcagcctcgacctctgccagcaccccacgcgctgcattctcctgctctgtcgaggctggcatgatgacggagcgatactgtgttcctacatccgcaccctgccggtttggtgtggtcggatcgtgaatcgtcagaaaaatcctcagcagatcgacataggagagaatagccggatcaaatgtaacctcgaccacttcggcatggaacgtcgtaccggtgcatacctccttgtaagtgggattggccgtatgtccgcccgcatagccgggacggatcgaggcaaccccgttcaattccctcagcaccgcttccacacaccagaagcagccgccccctatgaccgccgtttccatccacactctcctgccgatttgccttgctgcaatgtcggcacggcaacgcccggataaaagaggccgaatgatattcaggcagccagcgtgcgggatgtggcacggaatgtatgggcgggatgggtttcacccagccggtcgccctgaccgaacagcttgttgcgcagactgccttcggcataggcggtcttatagacaccgcgccgctggagttcagggatcaccagatcgacaaaatcctcgaacgtttcgggtgtgacggcgtaggcgaggttgaagccgtcaatgccggtctcctcgatccatgcctgcaattcgtccgctacacgctctggcgagccgatgacgatcgggcctgtcccaccaatggccgcgaattcggcaatttccctgatcgtccagactttaccgggatcggcgaccgtgaaagcatccaccgccgagtgaatcgcgtcattccggatctgcttcaactcatcatccagcccgtattgggaaaagtcgatcccggtccagcccgacatcaatgtcaaggctccccggtgactgacataacgccgatattcgtcaaatttcgcctgtgcttcctcatcagtgcgaccaacgatcacagtcatgagggtaaaaatcagaatatccgatggatcgcggccctgctcgccagcctgcttgcgaatatcggcaacactgggtgcaatcacctgtttcgaggggcccgcaatgaaaacgcattccgcatgtcgtgccgcaaaggcccggcctttgcgagaggcgcccgcctgataaagcacgggtgtacgctgcttcgatggttcacacagatgcatggcatccacacggaaataggcgccgtcatgatgcactttcctcaccttgtccggctgggtgaataccccgctgacaggatcgcgcagaacggcatcatcatcccaacttccttcccacagcttgtaggtcagttgcatgtattcctcggcaatatcgtatcgcgtatcgtgctccggctgcttcgccagcccggagcctttcgccgcactgttcagatagccggtgacgatgttccagccgatccttccctccgtcaggtgatcgagcgttgacatgcgccgcgcaaacggaaaaggcggttcataggaaagggtgcaggtcagaccaaaccccagatgccgggtgaccgcggccatagcaggaataagcatcgccggatcattgacgggaatctgtgccgcatcgatcagcgcagcatgcgcgttcccgccataaacatcatacacacccagcacatcggccagaaacaggccatcgaacaatccccgctccagcgtttgggccagatcggtccagtacccaagcgtgttatacatgcccgaccgatcacgcggatgacgccagaggccggaggattgatggccgacacaattcatgtcgaacgcgttcagacggatctgcttcgccattgtccggccctgcttaaataacgattccttaacgttatatcaataataaatgtaaaattgtcaagattaataaataaaacgattttaaatcgtattaatttctcttcagagcagggacgagccggctgcccggggtccataacaaaactgccgtcccatggtctggaacggcagcctgaatggaagaagatagatatcagcggagggccagaaacggctccttgactgtcgaggacagtacaggcggtaacgccacaccagcgtcgcccggcgtagtccagcgtatctgaccgggcgtatgacaggccggacaggcagccgcccaatgcgtcgtggcatgaccgcagtgcaggcagcgccaccccggatcggggctggcctccgaggcgcgacgcagcgcggcctgcatggcggcaccggggccatgctccttttcctcgatatcagccaacagcagccagacccgcttctggtcgatcaggcgactggcctgttcggcatggctgcgggcttcgccggtcagcccggcagccagattttcccgtgccagtaacagatgcgactcgggatgaccgggattgccagccaccagacgcttgaccgtgcgcacccgtgtcagtggatccgtcacaccggacagggccaccaccgccagatcgggttgcggatgggcggcccatgccttgaccagcacggcatcggaacgtctctgccgaccggctgcccgcagcgtagtcgcataggcaatggccgctgaggtcaggctgggatccagacgaaacgcctgccgggccgtgcgcagcttttcggcctgatccagctccgcctgcgctgctgccgtagcaaaggccgcccgttgttgatcgttttccgccaaagacagcgcatccatccagcgaccaccacggatcgccagattgacacgctcggtccgcagccaggctgcaccggggtgggccagttccgccttgcgcgccagttccgcggcacttgtccagtcctcgcgcgtgatagcctccctcagcaggccgcgatagccgaggaaagaggcatcttcagtccgggtcagcgcatggaaggcctgcgtggcctcactctcccggccggagagacgcgccgcctcggccatcaacagcagagtttgagcggtatcgccgagacaggcacgagccttgcctgcctcgcgccatgctccgcccgcatcccccgccgccagcgagaccagcgcacgggaaacggcataatccccggcctgccgcgtccgcgcctgccgccagcggcggattgtgcgggggaggcccagaatggcgccgacagcccgcagcaacagatgcacggccagaaccagaatgacgaccgcaacgatggccgctggcaccgacatgtcgatggtcagatcatccccgaccgtcatgccgacatggccgggcagtccggcgacataccacgcggcggcaacgaccaccgctgcggggagaacaattttgatgatacggcgcatcaggcgtgtgccgccatatcggacagcgcagcctgcgcatccagcagagcctgtgcctgcgctttccagccactgacagcctgcaccgccggccccgtcagcgcatccagtgtcctgacggccccggcaagatcacccgcatccaatgcttttctggcccgggcaatgacaccagccgcaggatcacccaccagaacctgatccccccgccggacggtgaccagcgtttcggctttttgttttacagtttcccagaaggaagcatgactcacatccgggcgggatgcttccagagcacgctgtgccacagtctcgaaagacaaggtcagcgccgccaaggtcggaggggcctcctgcgcaaagcgggtcaaggcaggcggcgcatttggaatatcacccagcttctcgccccggccaagagcagaggaggcagcctgaagacgggccagcctgcccgcccgatcggccagcgccgttacttttccggcctccccggcgatttcgttcaggcgttcacgcgcctgttgcagcgcctgcaccgccccttgctgctctgcatccagtttcgtgaggcgagattccagtacgtgaagcgcggcctgcatccgatcgcgttcagaatcggaaagatccctgaatcgcttttgctctgccgtgatgtcatccacgcgcttcgtcaacgcatcaaccgcagtcacggtcgcttcatcgcgggcggcagggcggtgttcaagcgtgtcgagacgcgctgtatgagcacgtacaaagcccgcaagtgattgcatctgccggtgaagcgtggtgccaagatcctcgatctgttcctccatcttcttgatggcaggccgttcggtgtcatggcggctggtgacgttttcctccagcgcctccaatcgtgccagcagcacgggatcggtcggctgcgattgtacgcccagatacaacgatactcccccaagaacgagcgcacccaccgccaggaccagcgcagcacggggaagagtttcctgccggttcgtgctgtccggtttctgcgtggatgaaggctgaggggaagaagagggaattgccccgctcatctcgtccgcatggccatcaatctgcggcccggtcttgtctgactcattcatcgcaggagggccagaagatcgtcctgagtaggctgcgctgcgacacgtatatccctccaggttaaagcagtgatggcctccacgaccgcgggggagatgacacaggccaccagccccgacgccgcatcggccaatccggccctgtccagaagacgcacgaaactccgtgccgtttccggtgaaaagaacaggaccgccttcaatccggccacccccgcagagggggcagccccttccatcagaatgcgcagagcctgctccgcctgttcgggcagagcctgcaccgggcgggcgcagtatacgaaacgatgcagaacggtgaacccgctctggctcaatccttgatacaaaaacgcgccctgttcctctcccgaggcaagcagcagcggctttccagccgggtcaagccgggcacgaacaagcatcagcagacggtctgcatcttttccggcactggtcacatcctgatgacctgccgcctgcgccgcccttgctgtggcatcccctactgcgaacagaggcaaagaacgcagcggatcaagcgcgggaatcgcattggcgctggtcaccagcaccgcctgcaaatcaggcagtgcctcctccaccagcgcatcggcgcggatttcaacctccagcgcaggggccagcaccggcgtaaaaccgagtgcgtccagccgtcgcgccgtcgccgaagcacccggctcgggccgggtaaccaggatggcgggccgttcaatgcgggacgagatcggaaggctcataccccgctttgccccctgttaatcgaggaaaatatcgggcgggctgtcggcacgcaggctgcgcccgagttcggcgcccagcgcctccgcttccgaaaccgcaccctgcaacgtccggcgcagcagaaagctgccatcctcagcggcgaccagaccggtcagatgcagcacaccccccgacaatatccgcgcatgtccgccgatcggcgtacggcaggacccatccagcagattgagcaacgcgcgttccgcggtggagaccgccttggcttcccgatcctcgatcccggccagcaggtcgcgcagagcgtaatcgtcttcccgcaccgtgacgccgacaatgccctgacaggcggcaggcaccatgatttcggtatccagcaccacgcttgccgcctgctccatatccagccgccgcagcccggccagagcgagaaggctggcatcgcattccccccgcgccagcttggcaaggcgggtctggacattgccacggatcgttgcaaaacgaagatcagggcgggcatgggccagctgggcctgtctccgtaccgatgaggtgccgaccagcgcgccctgttgcagcacgctgaacggatctcccggcgggggcggggtgaagccggggggaaggataatcgcatcccgcgcgtcttcgcgcttgagggtgcaggccagtacgatgccggggggaagctgggtttccagatccttcaggctgtgaaccgcgaagtcgatccgccggtcagccagcgcttcgtgaatttccttggcaaacagacctttgccgccaatctccgccagacgccggtcctgcacacgatcgccggtggtgttgatctgatgttcctcgaacacctccatatcccgcaggatcgggcagaagctgcgcagccgggcgagaaaggcacgggtttgcaccagggcaagaggagaagcgcgtgtgccgacccgtaaaggcaggccatgcatccccacatgggaggatggcggcgtagaagagggcgttgtggggccagagggatgaccagagggggggtgggcgggttgcatgcatgtgtcctaaaacccgtacagaggaaaggaaagagtacagatgacccccaatctgccggaaacgcatgaagcagtggattttccggcttccgaaaacctttttccgggtccggtcctgggtatcgagacctcctgcgatgaaaccgccgctgccgtcctggacggatctggccgtattctggcggaaatcgtgttgagccagtacgacgatcatgcccgcttcggcggggtggtgccggaaatcgccgcccgtgcccatctggcctatctgcccggcatggtgacagaggtaatggacaaagccggactccgttttcaggatctggccgcgattgccgcaacctccggtccggggctgatcggtggattgctggtgggggcggggttgggcaaaggtctggctctggcggcaaaacgaccctttatcgccatcaatcatctggaagctcatgctctggccgcgctgctgccggcattgggtggggtggcggaaataacctccggtgagcatttccctttcctgctgatgctgctgtccggcggtcattgccagtgcattctggtcgagggggtcggacgttaccggcggctcggcggcacgatcgacgatgcggtcggggaggccttcgacaaggtcggcaagctgctggggctgggctggcccggcggtccggcgctggagcggctggccttgcagggcaatccacacgcccttgcttttccccgccccatgaagggcagggtggggtgcgatttcagtttttcgggactgaagacggcggtggcccagtatgttgcccggtttccggacgggccgctgcctttatccgatgctgccgacatagccgccagttttcaggccgccgttgccgatgtcatggccgaccgcgccaccgccgcccttgctatggcggatgagatcgcgcccgcgaaaatgctcgtcgtctccggcggggtcgcggccaatgcagcgatccgggcggcgctttccaccgccgccgagcatcgtggcattgccatgctcgccccaccaccccggctgtgcaccgataatgccgttatggtggcctgggccgggctgcatcgtctgaaatatggcgcggtctccggtctggatcatgcccccctgccacgctggccgctggatgcgccggatatggcgctgccggaatcgaccacgccatgaattatcgccatgctttccacgctggaaacttcgccgattgccataagcatgccctgatggtcgcattgctgactgctctgcgacaaaaagaggctccgttcttcgtgctcgatacccatgcgggcaccggcgagaccctgctgacggacggaccagccgcccggaccggcgaatggagggagggaatcggtctgctgctggatgatccggctccggtgctggcgtcttatctggcactggtcacatcattgggcatggagcggagcctctatcccggttctcccctgattgcccgcgccatgctgcgtcctcaggaccgtatggcggtgtgtgaactccatcccgaagattgcgccagcctcgccgagcggttcagaggagacccctattgcgccatccatcgccgtgacgggtggaaagcgctggaaaccatgttgcctccgaaaaccgcttcctccggcggtgtcctgcccagacgcggcctgaccctgatcgatccgcctttcgagcaaccggatgaacaccgccgcctggccgatgccatgctgagggcgcaacaacgctttcctaccggcatggtcgccgggtggtatccgatcaagggcggtgctccggcccggttgctgcggcatcagttgcaggatgccgggctgaaacgggtgctgatcgccgaattattccttcacccgcccacggatacgacacgtcttaacggaagtggcatggccatcctcaacccaccctggcaatttggcgatgacgcccgcgcgatcatgcaggctctgaaaaccggattgaaggcgtgtgagatccgcgtggatgaattcggaactgattgtgcgccttctgccccgggggccatggaacataaaacacaatgacggatgccggtttgaacgatgttctggttgtcggtgccggtgcgtggggcaccgccctggccattcaggcagcaagggcggggcggcgcgtgcggctgtgggcacgcagcgaggagacagccatccgtttgcagaaaacccgccacaatccccggctgcccggtatcgtgatacacgacacggtaacagtcactcaccagctggatcaagccgccttcgccctgctggctgtgccgatgcagcatatgcgggcggtcgcacaaaacctgccgcccatgcgactgatcacctgctgcaagggggtggagagtaagaccggactgtttccgctggaaattctggcaaccctgtttcccgctctgccccatgccgtgctcagtggcccgaatttcgcgcatgaagtcgctgccgggctgccggcggcttccgtcatcgccagcacggatgccggattgagaagcgatcttatccatgctctcggcagtgccggattccgactatacggcaatgccgatcctgtcggtgcgcaggtgggcggcgcagccaaaaacgtcatcgccatcgccgcaggggccacgatcggtgcaggcttgggggaaaatgcccgtgccgcgctggtgacccgcggcattgccgaattgtcgcgtctggctgtcatgctgggggggcaggccgcaacagtggccggtttatcggggctgggcgatctgctgctgacctgtaccggaaaagccagccgcaatttccgcctcggcttcgcgcttggacaagggatggcgctggatcaggcgctggccaccagtgaaggggtggtggaaggcgtcatgactgcccccgccttgctgcagcgggccgggccggatgccgatttgccagtcatttccgctgttgccgcgatggtctccggccaagccgattttcaggaagccatgagcgcattgctgtcccgtccggtcagagacgaataaagcgctgtgctttacctgacaggcggcaccagcaccttggccgggtaacggcaccattctgcccccacacatcgccagcattccggacggcgcgccttgcagacatagcgtccatgcaagatcagccagtgatgcgccatgcccagcctgtccgccgggatacgcgccaccagtgcatcctcgaccatgcgcgtggtcttgccgggcgcaatgccagtacggttacccagccgaaacacatgcgtatccaccgccatggtcggctgatcgaacgccacgctcagcacaacattcgcggtcttgcggccaacacccggcagagattccagagcctcccgatcggcaggaacctccccgccgaaacgatccagcaattgctgcgacaaggccgcgacattccgcgcttttgcctgccatagcccgatggaacggatatgacgggcaatcccttcctcccccagcgccaccatcgaagcaggatcgggggcctgttcaaacaggctccgtgtggccttgttcaccgccacatccgtggtctgggccgacaacacgaccgcaaccagcaacgtgaaattggaggtgtagatcagctcacttttcggatctggattggctttggcaagcgcatccagaaaaccgattacctgcgccctggtcatacgcgggctggcagaaacaggatcggcagcagaaagagaagaagaggtggacatggaaaggaaacaccacgcgtgacccgatcatggcaagaggcaggcaaatgtagtggcgtttcaggacgaaagcaggaatgatacgcgccttatgtggcgattgacggaaaaaaactccgacgggtttccggtcacggaagccatcattatcccgcatcgcagcctgtcccgccgcgggctggcgctggtgtgtggggggctgtgcctgttatccgggctgggtgtcctcttttccctgatgattcatgcctggcccgtggccggatttgccgggctggaagccccgctggccatcgctgctttgctatggaatgccagagctgtccgccaaaccgagatcgtcaccctgagcggaactggtcccggcattgcccatatcgatgcaaggggacgcagccgccatatgaaaataaggccgggatggctgcgtttgcggctggaggaatgtccggggcgcgtgccgcaactgatcctgtcatcccgtgatggtgaattcgaactggcacgttcactgggggaggacgaaaaacgcgccctggcggaaactctccaggacgcgttgtacagggttcagaacccggttttcgataatccccagcttgttactgcagattaaccggtaaacatactgcggaaagcccagaacagaccgcccgccagaaggatcgaggcaggcagggtcagcacccaagccatgagcagactgcgcactgttttcgcctgcaggccggatccgtttgctgccatcgtacccgccacaccggatgtcagcacatgggtggtgctgaccggcaggtgatacatatcggctgcctgaatcaggcccattgccacgctttcagcaaccgcaccctgcgcataagtcagatgctccttgccgatgcgctccccgaccgtcaccacgatgcgacgccagccgaccatggtgccaagcccgagcgcaagagccacacagaccttgacccagaggggaatgaactgggtagcgttgttcgcctgagccgtgaaactctcgaaaaccgatttctgctgcggcgtcagagtggcggttttttccacgaacggcagggcatggctgatcaggtagaaatcattacggatattgcctgcctgatcatgcggcacatcgcgcagtgcaacccggctttccagctttgcattcacatctttgatcaaggcggccagcgcggatgccgtatcagacagggctttctttttctgtatcgcagccgtcaccctgttgcgggccgcatccagtgacacggcaggagcatgtctggcagcagacaggtcatcaagtatctggaccgtctgcagggacgaatggtgcagcgcgatcagtttctgaccatcaacggtatggttcagcgcataagccgtgggaaccgtgccgatcaggatcagcatgatcaggcccatacctttctgaccatcattggagccatggctgaagctgacgccggtgcaggtcagaaccagcagagcacggatcggccagggtggcggctgttttccttccggtgccttgtacaaggtcgggattttcaccagcccgcgcagcagcagcatccccagaccagccagcaaaaatccggcaacaggactgaacagcagggaacgcaggacattcagagcctgtgcccagtccacgccgctggtgccattcggaccggccatcagctgattcatcagaccgaccccgataatggagccaatcagagtatgagaggaagaattgggaataccgacataccaggtagccagattccacaaaatcgctgccaccagcagcgcaaataccatcgcaaatccggcatcgctgccaacctgaaggatgagttcaaccggcagcaaagagacgactgtgaaggcgacaccacccgaggaagccagaacacccaggaagttccatatgcccgaccagaccacagcgaaatgggcgggcagggaattggtatagatcactgtcgccacagcattggcggtatcgtgaaaaccgttgacgaattcaaagccaagcgcaatcgccagagcaatcccgagcagaacaaagggcagagcagtgggataactgacaccctcaagatcattcgacagatgaaaagcggcatatacgacaccaataaccagcagcaggctgacgataatcccggtcagctgcccggctttgcttgttgtcggcataaccatgtctgtaccattctgggttgggttccacccggacatcatgctttcgctttcacatcgatatgctgcaacggaaaagcatatccatcgaagatattgtaagattgtttagtgacacattgcgatggatcaaaaagcaccggagatttttgactctggaaaagacaggcttttttcaggtccgttattctgtcttttgaagacaaaaatgaccttccacccgatcagaaaggtcttacgatcaccatcgttacgatgatcagcatcagaagagtcggaacttcattggcaattctgtaaaatctgtgcgtccgtgtgttgcggtcttccagaaaatcacgccgccatttcgacatcgcgccatgaaaaccgctcatcagcagcacacaaagcagtttgacatgccaccagccgcggctccagtcgataacaccgggcgtcagcacaagaagaattccaaataaccatgtcgccatcatcgccggattgatgatctgcttcagcaaacgacgctccatgatcttgaaacgttcgctttcctcgctcccgcgctttaatccgcaatgatagacatacagtcggggcagataaaacaaaccagccatccaggcgatcatgctggcgatatgggccgttttgatccacagataaaaaggggtcagaaatgaaacggtcatgctgtcaccgtgctatccacctgcatccgttgccggaataacaccggcagttcggacaaggccctgaacactgtagcgccttccgctttcagggctgcaccatcgccatacggtgcgaaacccagaacctccataccggcagcatgcgcaccgcgtgagccagggatactgtcttccaccacaacacatgcctcagctggaatgcccgcatcggccgccgcagccagaaatacatccggggcaggtttcggtttgagggaacctcccggcccgccgctgaaagtccggccttctgtcagatagctaagaccggtccgagcaaatttgacggccatttctgcctgggaactgttggaggcaacccgccattccagacccagcgccgccatcccctccagaacctcttttgcccccggcacagggacggattccgtttccagtgctttcagcaacgcgcttgccaaggccgggcgccagccgggcgacaccggacggcccagcattttttcgatcaggggcaccatatcaatcaacgacatgcccagaaaaatacggtgtgcctcatcaggcgtcatcggcaacccttcttcggtcaggctggctgccacaacacgggaagcaatggtttcgctgtcgatcagcacgccatcacaatcgaagatcaccatgcgcagaggtactgttctcatgcagcatcttcctgttcaccatgggggcaatcacgatgaatacgcgggcagacacggccccctgcaaaactgcacaaaccaggtccatgctctctcacccgccttaccagcccggccagagagtcgataaattccggatcggaattctgcgtaggcacccggaaataacccttgatgttttttccgtgtgccaattccgcatactcgacatcgagttcaaccagcgtttccgaatgttcgctgacgaaggcaatcggcactaccagcaccgcaaccccatcctctaccgcccgatcaatcgcttcttccgtcgaggggcccagccagacctgcggcgtggcgcgggactgatagcagatctgatgatcaagaccgggtatattcatagcccgcagaacggctgccgtgctccgctccacctgaaactgataaggatcgccttttttgacgatgacctccggcagaccatgcgccgagaataacagccgtaaaggcacgtcatccggcagggtgttgcgggcttcatcatacgctttccgcaccaaagccgctgttgcggaagcaaaatcacgatcactgtgatagcagcacagggaaaaggtctgctttgccaaccctgctgcagcggcggcttcccgccagtctgtcagcgaactgcccgtcgtcgttgtggaatattgcggatagagcggcagcaggataatttcgtccgggtcccagtctttcacttcccgcactgtttcatgggcaaacgggtgccagtatcgcatggcaatgaaacagcgggcctcgaattccggtaaagcctgttccagcgtgcgtgcctgttcctgtgtcagctccagcagcggagatttgccgcctagcagcgcataattctcgctggccggtttgacacgcgctttcgcgataattctcgccagaatggggcggacgaaaaacgggaccctcagaatggcgggatctttgaataaattcagcagaaagggccggatggcggccgggctgtccgggccgccaaggttgaacagcaccaccgcaagcttgcgccgcttgcccgatccaacaggcggaagagagtcatcatgcggggagggcggggtacaggaaacattgctgatcattggcatggcttcgcaagtgttgtcccgtacccgaccggtaagtcaatcaggcaagttgagcggagtgaaaatcaggccgcattgcgccagcgcggacgatgacggcgcgcctgcggctgcttgcgcggttcttcagccggaagatcactttcgacaccaccggcaaccgacattttcacgcgggtgagcttctcgatagctttcaggaacggacgctcgctgccgtcacagaaggaaatcgcgatccctctctgtccagcccgcgccgtgcggccgatacgatggacatagctttccggctcgttcggcagttcgaaattgacgacatgcgacacaccggcaacgtcgatcccacgcgcggcgatatcggtggccaccagaacccgggcctctccgctacgaaaacgctccagagcgcgctgacgagcattttggcttttgttgccatgaatggcatcggccggaataccggattcttccagatgttcagcgacgcgattggcaccatgcttggtacgggtaaacacgatgaccttttccaacgcccgatccgccagcagacgggtcaacagcacgcgcttgccggtgctttcgataaaatgaacatgctgggcaatccggtcgggagtcggctcctccaccgcgatccgcacgcgcgcgggattacgcagcagcccttctgccagacgtccgatttcaccgggcatggtggctgagaacaacagggattgccgcttttccggcagggaggccagaaccttgcggatgtcgcgcataaagccgagatcaagcatccggtccgcttcatccagaacgaaatgcgacacctgatccagcagcagttcattggtgctcatcagatcacagatacggcccggcgtgccgatcacgatatcggcaccgcgctgcatgcgctgcacctgcggcttgcggccaacgccacccagaatcagaacacggcgaatcggcagctcaccacccagcatgcgcagattatcgtcaatctgcacggccagttcacgggtcggggccagaatcagagcgcgggttgaaaaggcccgcggacgctcccgtttctgcatcaggtgctgcaataaaggcagggaaaaagccgccgtcttgccggttccagtctgggcgatccccagcaggtcacgtccttccagcaaaggaggaatggcaccggcctgaatcggggtcggcttgtggaaactggccgcctgaagcgcctgaagaataggctcggccagtccaaaactatcaaatgtcacgtctgtcacagtcgtctccagccggcatatgcatgccggatcggtcacgatccacgcgcgatgctggaacgggacaggtcatctatggatcgttcaggaaacgccaacccttgcaggaccttgcctgcaggcaggtcggctcgacaggtctgacttatcgcgcgcagcgaacgatgcgggcttcatgcgccggagaagggcctgaaagcaagtctcttgagaaagtggctgttgcccggattcgtcagggcttggcatccggcagcaccagtctggcagccatcgtggccaattttaccaagggcgaatcgccgggcagggcagcaggtaaagcgctgagcggagatggaagcggggtagatgtcacatctggccgggtttccgcgggctgtgtcgaatcagtcgcgggtttttccgcggatggggtcgcaacagcaggtttaccatctgttttgccgtccggcaggggaaccgtgtaatcaggcacaattcgggcctgattgccgccgatcaccagcaccttacgcccgatcgccagaggtttttcatccttctgggtaacggagaccatatcaccgctggttttccggacgatgtattcccatgctttcgtatcacccaccacatgggttgcggtggttccgacaatcccaccgaccagcgcgccacccagcgccccgaaagccgatccgactccacccggcgtttgtgccccggcgataccgccagccgcagccccggtcgcagtgcccatcgatgaatcaatactgaccccgatcggcctgacaccaacaatgaccccctgttcgaccttgttggcctgctgcatcgcgcggtcggcataggtatcgggggaatagctgggtccacatcccgccagaaacgggacagcaaccgcacagagcgcagcggacagcaccgaaaggcagtgacgagctgaaacagactgacgaaacacggcaaaccc

SEQ ID NO: 2 - DNA, 1491 bp, Artificial Sequence
  Description of Artificial Sequences; note = synthetic construct
tggagagtttgatcctggctcagagcgaacgctggcggcatgcttaacacatgcaagtcgcacggtttggtttcggccggacagtggcggacgggtgagtaacgcgtaggtatctgtcctggggtgggggataactgtgggaaactacagctaataccgcatgacacctgagggtcaaaggcgcaagtcgccttgggaggagcctgcgttcgattaggtagttggtggggtaaaggcctaccaagcctacgatcgatagctggtctgagaggatgatcagccacactgggactgagacacggcccagactcctacgggaggcagcagtggggaatattggacaatgggcgcaagcctgatccagcaatgccgcgtgtgtgaagaaggtcttcggattgtaaagcactttcggcggggacgatgatgacggtacccgcagaagaagccccggctaacttcgtgccagcagccgcggtaatacgaagggggctagcgttgctcggaatgactgggcgtaaagggcgcgtaggcggttcgtacagtcagatgtgaaattcccgggctcaacctgggggctgcatttgatacgtgcgggctggagtgtgagagagggttgtggaattcccagtgtagaggtgaaattcgtagatattgggaagaacaccggtggcgaaggcggcaacctggctcatgactgacgctgaggcgcgaaagcgtggggagcaaacaggattagataccctggtagtccacgctgtaaacgatgtgtgctggatgttgggttacctagtaactcagtgtcgtagctaacgcggtaagcacaccgcctggggagtacggccgcaaggttgaaactcaaaggaattgacgggggcccgcacaagcggtggagcatgtggtttaattcgaagcaacgcgcagaaccttaccaggacttgacatgggagggctgtgtccagagatggacatttccgcaaggaccctctgcacaggtgctgcatggctgtcgtcagctcgtgtcgtgagatgttgggttaagtcccgcaacgagcgcaaccctcgcctttagttgccagcatgttcgggtgggcactctaaaggaactgccggtgacaagccggaggaaggtggggatgacgtcaagtcctcatggcccttatgtcctgggctacacacgtgctacaatggcggtgacagtgggaagctaggcagtgatgccatgctgatctcaaaaagccgtctcagttcggattgcactctgcaactcgagtgcatgaaggtggaatcgctagtaatcgcggatcagcatgccgcggtgaatacgttcccgggccttgtacacaccgcccgtcacaccatgggagttggtttgaccttaagccggtgcgcgaacccgcaagggacgcagccgaccacggtcgggtcagcgactggggtgaagtcgtaacaaggtagccgtaggggaacctgcggctggatcacctcccttaa

SEQ ID NO: 3 - protein, 598 aa, Artificial Sequence
  Description of Artificial Sequences; note = synthetic construct
VVTVLRRMGLWLAGIALLIGVALPAQAAEGGGKDTDWPHPLGGDHARRYSALTQINRQTVKRLRPVWSFSTGVLRGHEGGPLVVGDTMYVHTPFPNRLFALDLNDDGRIRWSYTPVQDPAVIGIMCCDTVNRGPAYADGRLFLHLADTSLVALDARTGKELWKIRDGDPAKGETGTSAPLVAGDLVLVGNSGGEFGVRGHMTAYAVKDGHRVWRAYAVGPDSDTLMDPLHTTQMGQPVGANSSLSSWSGDAWKLGGGPSWGWISYDPALDLIYYGTGNPGVWNPLQRPGDNRWAMSVFARDRKTGIAKWVYQFTPHDAWDYDGINEMILADIPVNGRQTKALVHFDRNGFAYVLDRVSGMLLQAKPFDPSLNWAKEIDLSTGKPVRNPRYEPKEEDKATKGICPSSLGAKNEQPAAFSPQAGLFLVPVNRICMDEEPFRVSYQAGQPYVGANLTLYPPPSSPLGTKDLGAFIGYDAGQGRIVWTDAEPFSVWSGALATAGGVAFYGTLEGWLKAVDVKDGSLLWQYKTPSGIIGNVMTYRHHGRQYVAVLSGVGGWAGIGLAEGLGTEDSEGTGAAVLNRALNNYTRLGGVLTVFGLP

SEQ ID NO: 4 - protein, 598 aa, Artificial Sequence
  Description of Artificial Sequences; note = synthetic construct
MKQQTLSRVCAMMLGIGALAVSFQAQANDELVKLSKDSANWSMPAGDYANQRHSALKQITVANASKLRPVWSFSTGVLRGHEGGPLIIGDVMYVHTPFPNKVFALDLNDNGRIIWVYEPKQDPDVIPVMCCDTVNRGVAYGDGKIILHQADNGLVALNAKTGKEVWKVMTGDAKKGETGTSAPLVIKDKVMVGISGGEFGIQGRLMSFNLKDGSKAWTAYSVGTDDQILFDDKTTAMGKPVGKDSSIKTWQGDQWKTGGGSTWGWISYDPDTNLVYYGSGNPSTWNPVQRPGDNKWSMTVFARDADTGVAKWVYQMTPHDEWDYDGINEMILANTKVNGKETKALVHFDRNGFAYVLDRVTGELLQANKFDPAVNWATGVNLKTGLPDRVKKYSTEAGGEDHNTKGICPAALGSKDEQPASFDPKTHMFYVPTNHVCMDYEPFKVSYTAGQPFVGATLSMFPPAGEDHLGNFIAYDVDKGKINWSIPETFSVWAGALSTDSGVVFYGTLDGFLKAVDAKNGKLLYKYKTPSGIIGNVTPYEHKGKEYIAVLSGVGGWAGIGMAAGLAGDTEGLGAVGAYKALSSYTQLGGVLTVFAVE

SEQ ID NO: 5 - protein, 625 aa, Artificial Sequence
  Description of Artificial Sequences; note = synthetic construct
MRKSKTGLLASASLCAVLGVAAGATSAMAEDKLIELSKSNENWLMPGRTYEAQNYSPLKQITTKNVKDLKVAWTFSDGVLNGHEGAPLVVNNTMYVTGPFPNRTFALGLDNPGRIIWENNPKQSANARSVACCDVVNRGMAYWPGDSKTPALIFKNLLDGRLTAMNAKTGDVVWQMENGDIKVGQTETQAPYVVKDLVITGSSGAELGVRGFITAYDVHTGAQKWRAYETGPDSDLLLAKDFNIHNPQYGQFGLGTETWQEETWKIGGGTNWGWYAYDPGTNLIYYGSGNPAPWNATMRPGDNKWTMTIFGRDADTGEAKFGYQKTPHDEWDYAGVNVMMLSEQKDKDGKLRKLLTHPDRNGIVYTLDRTNGDLVSANKIDDTVNWVKHVDLKTGIPVRDPEYATYMDHKGRDICPSAMGYHNQGFDSYSPEKQQFFLGVNHICMDWEPFMLPYRAGQFFVGATLNMYPGPKGNRQTYEGLGQIKSYNAITGQFKWQKMERFAVWGGTMATAGNLVFYGTLDGFIKARNQDTGELLWKFKLPSGVIGYPITYEHKGTQYVAIYYGVGGWPGVGMVFDLNDPSAGLGAVGAFKELAHYTQQGGGVFVFSLGGKGPYDDPKVGEYAN

SEQ ID NO: 6 - protein, 615 aa, Artificial Sequence
  Description of Artificial Sequences; note = synthetic construct
VGVFGGGRPNPGRIFMKSSKRLLAMSVAVSAFVGLTAVDGARANEDLAKLSKNPANWSMQAGDFANQRYSALKQITVANAGKLHPVWSFSTGVLRGHEGGPLVIGDVMYVHTPFPNKVFALDLNDNGRVIWSYEPKQDPEVIPVMCCDTVNRGVAYGDGKIILAQADTKVVALDAKTGKEVWKVTNGDPKKGETSTSAPFIVKDKVIVGISGGEFGVQGRLTAYSLKDGKLVWKAFSTGPDDQILFDDKTTALGKPVGKDSSIKTWQGDQWKTGGGATWGWYSYDPKLNLVYYGSGNPSTWNPVQRPGENKWSMTIFARDADTGVAKWVYQMTPHDEWDYDGINEMILADTKVNGKETKALVHFDRNGFAYVLDRVTGELLQANKFDPIVNWATGVDLKTGLPDRVKKYSTEAGGEDHNTKGICPAALGVKDQQPASFDPQNHMFYVPTNHICMDYEPFKVSYTAGQPFVGSTVNMYPPPGENHLGNFIAYDVNKGKIAWSDPELFSVWSGALSTAGGVVYYGTLEGYLKAVDAKTGKLLYKYKTPSGIIGNVNAYEHKGKQYIAVLSGLGGWAGIGMAAGLSGDAEGLGAVGAYRSLANYTQLGGVLTVFGIDN

SEQ ID NO: 7 - protein, 103 aa, Artificial Sequence
  Description of Artificial Sequences; note = synthetic construct
MFKRIIQGTLAAALIAGAAGASVAHAAYDGTHCKAPGVCWEPEPGYPAILKGSKYDPHHDPKELAKQQAALDAQEARNKLRVENFVKTGKFEFDVNKLQGQGN

SEQ ID NO: 8 - DNA, 1794 bp, Artificial Sequence
  Description of Artificial Sequences; note = synthetic construct
gtggtgacagtcttgaggcggatgggtctgtggcttgcgggcattgctctgttgataggggtggccctgccagcacaggcggcggaggggggcggcaaggatacggactggccgcatcctctgggtggcgatcatgcccggcgatacagcgcactgacacagatcaaccggcagaccgtgaagcgtctgcgcccggtctggagcttttcgaccggtgtgctgcggggtcatgagggcgggccgttggtggtgggggatacgatgtatgtccacaccccctttccaaaccggctgttcgcgctggatctgaacgatgacgggcgcatccgctggagctacacgccggtgcaggatccggccgtgatcgggatcatgtgctgcgacacggtcaatcgcggccctgcctatgcggatggccgcctgttcctgcatctggcggatacgagtctggtggcgctggatgcccggaccggcaaggagttgtggaagatcagggacggtgatccggccaaaggggaaaccggcacgtccgcccccctcgtggccggtgatctggtgctggtcggcaatagcgggggcgagttcggcgtgcgcggccatatgacggcctatgcggtcaaggatgggcatcgcgtctggcgcgcctacgcggtggggccggatagcgacacgctgatggatcctctgcacaccacgcagatgggccagccggtcggtgcaaattcttcgctgtcgtcatggagcggggatgcatggaaactgggaggcggcccgtcctggggctggatttcctacgatccggcgctggacctgatctattacggcaccggcaatccgggggtgtggaatccgctgcaacggccgggcgacaatcgctgggccatgagtgtctttgcgcgggatcgcaaaaccgggatcgcgaaatgggtctatcagttcaccccgcatgatgcctgggattatgacgggatcaacgagatgatcctcgccgatattcccgtgaacgggcggcagacaaaggcgctggtgcatttcgatcgtaacggctttgcctatgtgctggatcgggtcagcggcatgctgcttcaggcaaagccgttcgatccatcgctgaactgggcgaaagaaatcgacctctcaaccggaaagccggtgcgtaacccccgctatgagccgaaggaggaagataaagcgaccaaaggcatctgtcccagttctctgggcgcgaaaaacgaacagccggctgctttctcaccgcaggctgggctgtttctggtaccggtcaaccgcatctgtatggatgaggaaccgtttcgcgtctcctatcaggccgggcagccttatgtaggggcaaacctgaccctgtatcccccaccttcttccccgctggggacgaaagatctcggcgcgttcatcggctatgatgccggtcagggccggatcgtctggacggatgcggagcctttctccgtctggtccggggcgctggcgacggcgggaggcgtggcgttttacggaacgctggaaggctggctcaaggcggtggatgtgaaggatggttctttgctctggcaatataaaaccccgtccgggattatcggcaacgtcatgacctatcgccatcacggtcgtcagtatgtcgcggtgctgtccggtgtcggcggctgggccggcatcggtctggctgaggggctggggacggaggatagcgaaggcaccggggctgccgtgctgaaccgtgccctgaacaattatacaaggcttggcggtgttctgacggttttcggtctgccg

SEQ ID NO: 9 - DNA, 1794 bp, Artificial Sequence
  Description of Artificial Sequences; note = synthetic construct
atgaaacagcaaacgctgtcccgtgtttgtgccatgatgctgggcatcggcgctctggcggtttctttccaggctcaggcaaatgatgagctggtgaaactgtccaaggattctgcaaactggtcgatgcctgctggtgattatgcaaaccagcgccacagcgccctgaagcagattacggttgccaatgccagcaagctgcgtccggtatggagcttctccaccggcgttctgcgtggccatgaaggtggtccgctgatcatcggcgatgtcatgtatgtgcatacgccgttcccgaacaaggttttcgccctcgatctgaacgacaatggtcgtatcatctgggtgtacgagccgaagcaggatccggatgtcattccggtcatgtgctgtgatacagtgaatcgtggcgttgcttatggtgatggcaagatcattcttcaccaggcggataacggactggtcgcgctgaatgccaagaccggcaaagaagtgtggaaggttatgacgggcgacgccaagaaaggcgaaaccggtacctctgcaccgctggtcatcaaagataaggtgatggtcggcatctccggcggtgaattcggtattcagggccgcctgatgtccttcaatctgaaggatggttccaaggcctggacggcgtattccgtcggcacggatgatcagatcctgttcgatgacaagaccacggcaatgggcaagcctgtcggtaaggacagctccatcaagacctggcagggcgatcagtggaaaacgggtggcggttccacatggggctggatttcctatgatccggacaccaatcttgtctattacggctctggtaaccccagcacctggaacccggttcagcgccctggcgataacaagtggtccatgaccgttttcgcgcgtgatgcggataccggcgtcgcgaaatgggtctatcagatgaccccgcacgacgaatgggactatgacggtatcaacgaaatgattcttgccaacaccaaggtgaacggcaaggaaaccaaggcgctggtgcatttcgaccgtaacggcttcgcctatgtgcttgatcgtgtgacgggtgagctgctgcaggcgaacaagttcgatccggcggtgaactgggccacgggtgtgaatctgaagaccggtctgcctgatcgtgtgaagaaatactccaccgaagccggtggtgaagatcacaacacgaagggtatctgcccggccgcattgggctcgaaggacgaacagcctgcttcgttcgatccgaagactcatatgttctacgtgccgaccaatcatgtctgcatggattacgagccgttcaaggtgtcctacaccgcgggtcagcctttcgtgggtgcgacgctctccatgttcccgcctgcgggtgaggatcatctgggcaacttcatcgcttatgatgtggacaagggtaagatcaactggtcgatcccggaaaccttctccgtctgggctggtgctttgtcgacggatagcggtgtcgtgttctatggcacgctggatggcttcctgaaggcagtcgatgccaagaacggcaagctgctctacaaatacaagaccccgtccggcatcattggtaatgtcacaccttacgaacataagggtaaggaatacatcgccgttctgtccggcgtcggtggctgggccggtatcggtatggccgctggtcttgcgggtgacaccgaaggtctgggtgcggtcggtgcctataaggctctgtccagctacacgcagcttggcggtgtgctcacggtgtttgccgtcgag

SEQ ID NO: 10 - DNA, 1875 bp, Artificial Sequence
  Description of Artificial Sequences; note = synthetic construct
atgcgcaaatccaaaacaggactgctcgcgtctgcatcgctctgtgcggtgttgggcgttgccgctggcgctacgtccgccatggctgaggacaagctgatcgagctgtccaagagcaacgaaaactggctgatgccgggccgtacctatgaggcccagaactacagcccgctgaagcagattaccacgaagaacgtgaaggatctgaaagtcgcgtggactttctctgatggcgttctgaacggccacgaaggtgcgccgctggtcgtcaacaatacgatgtatgtcacgggtccgttccccaaccgcacctttgcgctgggtctggacaatcctggccgcatcatctgggaaaacaacccgaagcagagcgccaatgcccgttctgtggcctgttgtgacgttgtcaatcgtggcatggcctactggccaggtgacagcaagacccctgctctgatcttcaagaacctgctcgacggtcgcctgacggcgatgaacgccaaaaccggcgacgtcgtttggcagatggaaaatggcgacatcaaggtgggtcagacggagacccaggctccttatgtcgtgaaagatctcgtgatcacgggtagctccggcgctgagctgggtgttcgtggtttcatcaccgcctatgacgtgcatactggtgcacagaaatggcgcgcttatgaaactggcccggattctgatctgctgctggcgaaggatttcaacatccacaacccgcaatacggtcaattcggcctcggcacagagacctggcaggaagaaacctggaagatcggcggtggcacaaactggggctggtatgcatatgaccccggcaccaacctgatctattacggcagcggcaatccggctccgtggaacgctacgatgcgtccgggtgataacaagtggacgatgaccatcttcggtcgcgatgctgataccggtgaagccaagttcggctatcagaagaccccgcacgatgagtgggattatgccggcgtcaacgtgatgatgctgtccgaacagaaggataaagacggtaagctgcgcaagctgctgacccatcctgaccgtaacggcattgtctacaccctcgaccgtacaaacggtgatctggtttccgccaacaagatcgacgacaccgttaactgggtgaagcatgttgatctgaagaccggtattccggttcgcgatcctgaatacgcgacctatatggatcacaagggtcgtgacatctgcccgtccgcgatgggctatcacaatcagggcttcgacagctattctccggaaaagcaacagttcttcctgggtgtgaatcacatctgcatggactgggagccgttcatgcttccataccgtgccggtcagttcttcgtcggtgcgacgctgaacatgtatccgggtccgaagggcaatcgtcagacctatgaaggtctgggtcagatcaagtcctacaacgcgatcaccggtcagttcaaatggcagaagatggaacgcttcgctgtttggggtggcacgatggctaccgccggcaacctggtattctatggaacgcttgatggcttcattaaggctcgtaatcaggataccggtgagctgctgtggaagttcaagctgccgtccggcgtgatcggttacccgatcacctatgaacacaagggcacgcagtatgtcgccatctactacggtgttggtggctggcccggtgttggtatggtgttcgacctgaacgatccgtctgccggtctcggtgcggttggtgccttcaaggaactggcccattatactcagcagggtggcggcgtgttcgtgttctccctgggtggcaaaggcccgtatgacgatccgaaggttggcgagtacgccaac

SEQ ID NO: 11 - DNA, 1845 bp, Artificial Sequence
  Description of Artificial Sequences; note = synthetic construct
gtgggcgtttttggtgggggtcggccaaacccagggaggatttttatgaagtccagcaagcgactgcttgcgatgtccgttgccgtgtcagcctttgtcggcctgactgcggttgatggcgcgcgtgccaatgaagatctcgcgaaactgtccaagaacccggccaactggtccatgcaggccggtgatttcgccaatcagcgttacagcgcgctgaagcagatcacggttgccaatgccggcaagctgcatccggtgtggagcttctccaccggtgttctgcgtggccatgaaggcggcccgcttgtgattggcgatgtcatgtatgtgcatacgccgttcccgaacaaggtgttcgccctcgatctgaacgacaatggccgcgtgatctggtcgtacgaaccgaagcaggatccggaagtcattccggtgatgtgctgtgacaccgtgaatcgcggcgttgcttatggtgacggcaagatcattctggcccaggccgacaccaaggttgtcgccctcgacgccaagaccggcaaggaagtctggaaagtcaccaacggcgatccgaagaagggtgaaacctccaccagcgcccccttcatcgtgaaggacaaggtgattgttggtatctccggtggtgaattcggtgtgcagggccgtctgaccgcttacagcctgaaagacggcaagctggtctggaaggcgttttccaccgggccggatgaccagatcctgttcgatgacaagaccaccgctctcggcaagccggttggcaaggacagctccatcaagacctggcagggcgatcagtggaaaacgggtggcggtgcgacctggggctggtattcctacgatccgaagctgaacctggtctattacgggtccggcaatcccagcacctggaatccggtgcagcgtcctggtgaaaacaagtggtccatgaccattttcgcgcgtgatgcggataccggcgttgcaaagtgggtctatcagatgaccccgcatgacgaatgggactatgacggcatcaacgaaatgatcctcgccgacacgaaagtgaacggcaaggaaaccaaggcgctggtgcatttcgaccgtaacggcttcgcctatgtgcttgaccgcgtgacgggtgagctgctgcaggcgaacaagttcgatccgatcgtcaactgggccaccggcgttgatctgaagaccggcctgcctgatcgtgtgaagaaatactccaccgaagcgggtggtgaagaccacaacacgaagggcatctgccccgccgctctcggcgtcaaggaccagcagcctgcttcgttcgatccgcagaaccacatgttctacgtgccgacgaaccacatctgcatggattatgagccgttcaaggtatcctataccgccggtcagcctttcgtcggctccaccgtcaatatgtatccgccgccgggcgaaaaccatctgggcaacttcatcgcctatgatgttaacaagggcaagattgcctggtccgatccggaactgttctccgtatggtccggtgcgctctccacggctggtggcgttgtgtattacggcacgctggaaggctatctgaaggcagtcgatgccaagaccggcaagctgctctacaaatacaagaccccgtccggcatcatcggcaacgtcaatgcctatgagcacaagggcaagcagtatatcgccgttctgtccggccttggtggctgggccggtatcggtatggccgctggcctgtccggggacgctgaaggtctgggtgcagtgggtgcctatcgctcgctcgccaactacacgcagcttggtggcgtgctgacggtattcggcatcgacaac

SEQ ID NO: 12 - DNA, 309 bp, Artificial Sequence
  Description of Artificial Sequences; note = synthetic construct
atgttcaagagaatcatccagggaaccctggcagcggccctgatcgccggtgcggctggtgcttccgttgctcatgccgcttatgacggcacgcattgcaaggcgccgggcgtgtgctgggagccggaacccggttatccggcaatcctgaaagggtccaagtacgacccgcatcatgatccgaaagaactggcgaagcagcaggctgctctggacgctcaggaagcccgcaacaagttgcgtgtcgaaaacttcgtcaagaccggcaagttcgagttcgatgtgaacaagctgcagggtcagggtaac

SEQ ID NO: 13 - protein, 169 aa, Artificial Sequence
  Description of Artificial Sequences; note = synthetic construct
MAVITKTLVGESLVGDGNEVAHIDLIIGPRGSAAETAFANALTNNKDGFSTLLAVVAPNLMVKPNTILFNKVTIKGAKQAVQMFGPAQHGVALAVAEAVAEGIIPEAEADDLFISVGVFIHWLAEDDKKIQEYNYKATKEALVRAVRGEPKASEVVSQYKSVKHPFAAN

SEQ ID NO: 14 - DNA, 507 bp, Artificial Sequence
  Description of Artificial Sequences; note = synthetic construct
atggcggtcatcacgaagaccctggttggcgagtcactggttggcgacggtaacgaagtcgctcacatcgatctgatcattggcccgcgcggcagcgctgccgaaaccgcgttcgcaaacgccctcaccaacaacaaggacggcttctccaccctgctcgcggtggttgcaccgaacctgatggtgaagccgaacacaatcctgttcaacaaggtcaccatcaagggcgccaagcaggccgtccagatgttcggcccggcccagcacggcgtggctctggcagttgccgaagccgttgccgaaggcatcatcccggaagccgaagccgatgacctgttcatctccgttggcgtcttcatccactggctggccgaagacgacaagaagatccaggaatacaactacaaggccaccaaggaagccctcgtccgcgccgttcgcggtgagccgaaggcctctgaggtcgtctctcagtacaagagcgtgaagcatccgttcgccgccaac

SEQ ID NO: 15 - protein, 299 aa, Artificial Sequence
  Description of Artificial Sequences; note = synthetic construct
MADKTILHMLTPLKQMSPFDVNMALDAGFDAVIPYVDVTNDQVNGLVQDAIFSRPPRLGPKTGIFIAGRNAGQALDWIDESKKALVPPFGCSVYADPAGSFTTAAAMVAHVDTMLRKEFNQTLKGLKVAVFGATGVVGYASGVIAALEGAHVILAGHNGAKQVSESAREMQDRFGVTVEAVDASTEELKGDLLKRVDVAMTAAKAGVQVISSLLLKDAPHLLVVADVNAVPPLGVAGLDVNSGRVKLGEKTIGIGALAIGHTKYRAQFELFKKMLESDKIVSFDFRDAFHLAREIASAS

SEQ ID NO: 16 - DNA, 897 bp, Artificial Sequence
  Description of Artificial Sequences; note = synthetic construct
atggctgacaagaccatcctgcacatgctcacgccactgaagcagatgagtccgttcgacgtgaacatggcgctggatgcggggtttgacgccgtcatcccgtatgtggacgtcaccaacgaccaggtgaacggtctggttcaggacgcaattttttcccgcccgccgcggctcggcccgaaaacagggatttttatcgccgggcgtaatgccggtcaggcgctggactggatcgacgaatccaaaaaggcattggtccccccattcggctgttcggtttatgccgatccggcaggctccttcaccaccgccgccgcaatggtcgcccatgtggacaccatgctgcgcaaggagttcaaccaaactttgaaggggctgaaggttgccgtgttcggtgcgacgggggtggttggctacgcatccggggtcatcgccgcactggaaggcgcgcatgtgatcctcgccgggcataacggcgccaagcaggtcagcgaatcggccagggaaatgcaggatcgcttcggtgtcacggtcgaagccgtggatgccagcaccgaggaactgaaaggcgacctgctgaagcgcgtcgatgtggcgatgaccgccgcaaaggccggggtgcaggtcatcagctccctgctgctgaaagacgcaccgcatctgctggtcgtggcggacgtcaatgccgtgccgccgctgggtgtagccgggctggatgtgaattccggccgggtcaagctgggcgaaaagaccatcggcatcggcgcgctggccatcggccataccaagtaccgggcacagttcgaactgttcaaaaaaatgctggagagcgacaagatcgtctccttcgacttccgcgacgcgtttcatctggcgcgtgagatcgcttccgccagc

SEQ ID NO: 17 - protein, 323 aa, Artificial Sequence
  Description of Artificial Sequences; note = synthetic construct
MSNASPVSVNARAWALLQDMINNAEELKIGVSTGSLGETLIDAGSAVPGSIAAGLQLARICMGGLGTVTLLPDQTLENWPFSVSVASSNPVTSCLASQYAGWSLHHKDENGSFFALGSGPARALARGEKLFEELTYRDESTHAVLVLEAAKPPPAAIVERVARECRVAPENLGIIYAPTQSLAGSVQVVGRVLEVALHKTHELHFPLENVVDGIASAPLPPPHPDFVTAMGRTNDAIIFAGRVHLFVKGSAEEARKLAEQLPASTSRDYGKPFKDIFAAVKGDFYKIDPSLFSPAEVLVTAIETGETFRAGKRDQALLDASFN

SEQ ID NO: 18 - DNA, 969 bp, Artificial Sequence
  Description of Artificial Sequences; note = synthetic construct
atgagcaacgcttcccccgtcagcgtcaatgcccgcgcctgggccttgctgcaggacatgatcaacaatgccgaggaactaaaaatcggcgtatccaccggttctttgggcgagacactgattgatgccggctccgccgtgcccggcagcatcgccgccggtctgcaactggcccgcatctgcatgggcggtctcggcaccgtcacgctgctgcccgaccagactctggagaactggccgttcagcgtctccgtcgcgtcctccaaccccgttacctcctgccttgccagccagtatgcagggtggagcctgcaccataaggacgagaacggctccttcttcgcgctcggctccggcccggcccgcgccctggcacggggcgaaaagctgttcgaggaactgacctatcgcgatgaaagcacccatgccgtgctggtgctggaagccgccaagccgccgccggccgccattgtcgagcgcgtggcgcgggaatgccgcgtcgccccggaaaatctcggcatcatctatgccccaacgcagagcctcgccggttccgtgcaggtggtggggcgcgtgctggaagtcgccctgcacaagacgcatgagctgcatttcccgctggaaaacgtcgtggacggcattgcctccgccccgctgccgccgccgcacccggatttcgtgaccgccatgggccgcaccaacgatgcgattatcttcgcgggccgggtgcatctgttcgtcaaaggctccgccgaggaagcccgcaagctggccgaacagctgcctgcctcgacctcccgcgattacggcaagccgttcaaggacatcttcgcagcggtgaaaggcgatttctacaagatcgacccatccctgttcagcccggcggaagtgctggtgacggccatcgagaccggcgagaccttccgcgccggtaagcgcgatcaggccctgctggacgcatccttcaac

SEQ ID NO: 19 - protein, 358 aa, Artificial Sequence
  Description of Artificial Sequences; note = synthetic construct
MRPMSKSPGKGSKAPSKAPNAGRTVRPKPVAPIVVEQAAKKKISAASAKPTAIKTPRAARVTKVVVDDTFAEAFDMRATGVIVTGTNRKWARQAAETMTGFATSVIACGIEAGIDRELRPDETPDGRPGVRVLMFGMGWNEMQKQLQNRVGQCVLTCPGAACYDVGIPGPEKMKIGSLLRYFGDGWQIAKKLDGRRFWRIPVMDGEFVCEGTTGYTKNAVGGGNLILLGRSPAATLLAAETAVEAMKVVPDVIMPFPGGIVRSGSKVGSKYKMLPASTNHRFCPTLHGQVETDLDDDTRSVLEIVIDGLTAEAVADAMRAGMEAIMKLGPDKGASRISAGNYGGKLGRHHFKLRELLR

SEQ ID NO: 20 - DNA, 1074 bp, Artificial Sequence
  Description of Artificial Sequences; note = synthetic construct
atgcgcccaatgagcaaaagcccgggcaaaggaagcaaggcgcccagtaaagcgcccaatgctggccgtactgtacggccaaagcctgtcgcaccgattgtcgtggaacaggctgcaaagaagaaaatttcggcagcatcggcaaaaccgacggcaatcaagacgccgcgtgccgcacgcgttacgaaagtggtggtggacgataccttcgccgaagcgtttgatatgcgcgcgaccggcgtgatcgtgactggcaccaaccgcaaatgggcgcgtcaggcggcggagacgatgaccggcttcgcgacatcggtgattgcctgcggtatcgaggcagggatcgaccgcgaactccgtccggatgaaactccggatggacgccccggcgtgcgggtgctgatgtttggcatgggctggaacgaaatgcagaaacaactgcaaaatcgtgtcggccaatgcgttctgacctgtccgggtgccgcctgctatgatgtcggtattcccgggccggagaagatgaagatcggcagcctgctgcgctatttcggggatggctggcaaatcgcgaagaagctggatggccggcgtttctggcgtattcccgtcatggacggcgaattcgtatgcgaaggcaccacaggctacacgaaaaacgcagtgggtggcggcaatctcatcctgttgggccgctcccccgccgcgacgctgctggcggcggaaaccgcggtcgaggccatgaaagtggtgccggatgtgatcatgccttttccgggtggaattgtccgttccggctccaaggtcggatcgaaatacaagatgctgccggcctccaccaatcatcgtttctgcccgaccttgcacggccaggtggaaaccgatctggatgatgatacgcgcagcgtactggaaatcgtgatcgacggtctgacggcagaggcggtggccgatgccatgcgggccggtatggaagcaatcatgaagctggggcctgataaaggcgcatcccgtatttccgccggtaattacggtggcaagctgggcaggcatcatttcaagctgcgggagttgctgcgg

SEQ ID NO: 21 - protein, 268 aa, Artificial Sequence
  Description of Artificial Sequences; note = synthetic construct
VTIRLTLKADPEQRLDLSALTPEKLDGLNKAAIEKLEINTTREVVTVGDAFKLRGTGSEQIVIEGGSDRLDYVGAGMASGSVLLDGDAGAYAGRGMKGGVLQILGSAGPYAASGLKNGLIEISGDVAERLGAPAAGEQYGMAGGVVVVRGDAGPRAGDRLRRGVIVIEGDAGEAVGSRMAAGTIVVCGEAHGLPGYLMRRGTLVLGATAEVLPTFIPVHAPDLVFTRLLVRTLDPVSRKAARLASRAASRYAGDGAVIGRGELFLLEA

SEQ ID NO: 22 - protein, 533 aa, Artificial Sequence
  Description of Artificial Sequences; note = synthetic construct
MLTVLKGGRIVDPARDRDEVADLWLQDGRIVEAPANGRADEVVDVSGCVVMAGGIDIHSHIAGTNVNTAKLLLPELIGQEGGFDGTPIPHEVGRLYVQMGFTTVVEPAISPHVAVQAHAELSRIPFIDTATLTVLGNDDYFLRLVRDGESDAALADYVARNITAARGLGLKVINPGGAAAFKENLRSFSLDDEVPSYGVSSRQIFKAAQRARDVLGIPHPVHLHCNNLGMAGNVETAIATMDAAEGLPVHFAHLQFYSYGTEGPRKFSSAAARLAEEMNSRPNVTADVGQVMFGQTVTISSDVLRQFDGRVAAFPRKWSILDGDGNGGGVVPYRYKRTSFVNALQWAAGLELFLLVNDPWRLFFTTDHPNGAPFTAYPDLMALLMSRDLRAQWMETLPKDALDATTLPSLNREYDWREIAIMTRAAPARLLGLSDRGNLAIGSKADVSVYRPQEDRAAMFRDAAYVFRNGELVVKDGRTQRTVFGTCFTLQPEFDRSVDRRLKGYYEQVYGVPHTLFDVPGHLKSFETVECAQ

SEQ ID NO: 23 - protein, 369 aa, Artificial Sequence
  Description of Artificial Sequences; note = synthetic construct
VSAMAIRDTGDAAGALAWIDGREASLDDAVDAAVELLREGRSPAIGGLATDLKGLEAAVALAEAVGGTLDHAASEAAFRDLDLLRETGLVTVTPLQVRAQAQTVVLVGDGVEAIWPNFAADLALDEAPTIATHRGERQIIRIGASSGSDLKVNEEELPVILGALRAAVAGRTVRLPAARLKAVQALAETLKASSYGAILWSSETLDALSVEMLGGLVNDLNATTRYAALPVAGPGNVQGAIQTVAGITGLPPRLGFGRGRAEHDPWRFDLLRLIDEDETDCLLWIDALDYELPPDTPVPVIALTSGDEAPEQAAVAFAVGQPGVDHDAILFAGAVGGQIDHPASSAASRSARPDVATILGRLRAAYEAG

SEQ ID NO: 24 - DNA, 804 bp, Artificial Sequence
  Description of Artificial Sequences; note = synthetic construct
gtgactattcgtctcactctgaaggcggacccggagcagcgcctcgatctgtccgccttgacgccggaaaagctggatggcctcaacaaggccgccatcgaaaagctggaaatcaacaccactcgtgaagtggtgacagtcggtgacgcgtttaaactgcgtggaaccggtagcgagcagattgtgatcgagggcggttccgaccggctggattacgtcggtgcaggcatggccagcggctccgtgctgctggatggcgatgccggggcctatgccggtcgtggcatgaagggcggtgtattgcagattctcggcagtgccggaccttatgcggcctccgggctgaaaaacggtctgatcgagatttccggtgatgtggcggaacgcctcggcgctcctgcggcgggcgagcagtatggcatggcaggtggcgtggttgtggtccggggggatgccgggccacgggccggggatcggctgcggcgcggcgtgatcgtgattgagggcgatgccggtgaagccgtaggcagccgcatggccgccggcacgattgttgtctgtggtgaggcgcatggtctgccgggctatctgatgcgtcgtggaacgctggtgctgggggcaacggcggaggttctgccgaccttcatcccggtgcatgcgccggatctggtgttcacccgtctgttggtgcgcacgctggaccctgtcagccggaaagcggctcgtctggccagtcgcgcggcatcccgctatgccggcgatggtgccgtgatcggccgaggtgagctgttcctgctcgaagcg

SEQ ID NO: 25 - DNA, 1599 bp, Artificial Sequence
  Description of Artificial Sequences; note = synthetic construct
atgctgacagttctgaaaggcggacggatcgtcgatccggcgcgcgatcgtgatgaagtggccgatctatggcttcaggatggccggattgtcgaggctcccgccaatggtcgggccgatgaggtggtggatgtcagcggctgcgtggtgatggccggggggatcgatatccactcccacatcgccggcaccaatgtgaacacggccaagctgttgctgcccgaactgatcggacaggaaggcggcttcgatggcacgccgatcccgcatgaggtcgggcgtctgtatgtgcagatgggcttcaccaccgtggtggagccggctatttccccgcatgtggcggtgcaggcccatgccgagttgtcacgtatcccctttattgacaccgcaacgctgacggtgctggggaatgatgactatttcctgcggctggtgcgtgatggggagagtgacgcggcactggccgattatgttgcccgcaacatcacggctgcccgcgggctgggcctgaaggtcatcaatccgggcggtgcggcggcattcaaggaaaacctgcgcagcttctcgctggacgatgaagtgccgagctacggcgtttcttcccgccagattttcaaggcggctcagcgggcgcgggacgtgctcggtattccccatccggttcatctgcactgcaacaatctcggcatggccgggaatgtggaaaccgcgatcgcaacgatggatgcggcggaagggctgccggtccatttcgcgcatctccagttctattcctacggtaccgaaggtccgcgcaaattctcctctgctgccgctcggttggcggaggaaatgaacagccgcccgaatgtgaccgccgatgtcgggcaggtcatgttcggtcagacggtgaccatttcttccgatgtgctgcgccagttcgatggccgcgtggccgctttcccgcgcaaatggtcgatcctggatggggacggcaatggcggcggcgtcgtgccttatcgttacaagcgcaccagcttcgtcaacgcactgcaatgggcggcggggcttgagctgttcctgctggtcaatgatccgtggcgtttgttcttcacgaccgatcatcctaatggggcgccgttcacggcttatccggacctcatggccctgctgatgagccgcgatctgcgtgcgcaatggatggagacgctgccgaaagacgcgctggacgccaccacgctgccttctctgaaccgtgagtatgactggcgcgagatcgcgatcatgacccgcgccgctccggcgcgtctgctgggcctgtctgatcgcggtaacctcgctatcggatcgaaggcggatgtgtcggtgtaccgtccgcaggaggacagggctgccatgttccgtgacgcagcctatgttttccgtaacggcgaactggtcgtcaaggatggcaggacgcagcgtacggtgttcggcacgtgcttcacattgcagcccgaattcgacagaagtgtcgaccggcgtctgaaagggtattacgaacaggtctatggcgtgccgcatacgctgttcgatgtacccggtcatctcaagagctttgaaacagtggaatgcgcccaa

SEQ ID NO: 26 - DNA, 1107 bp, Artificial Sequence
  Description of Artificial Sequences; note = synthetic construct
gtgagcgcgatggcgatacgtgacacgggggacgctgcgggcgccctggcctggattgacggccgcgaggccagtttggatgacgcggttgacgctgccgtcgaattgctgcgcgaaggacgcagcccggcgattggcggattggcgaccgacctgaaaggactggaagctgcggtggcgctggcggaggcggtcggcggcacgctggaccatgccgcgtcggaagcggctttccgcgatcttgatctgctgcgggagacgggactggtgacagtcacgcctttgcaggtccgcgcccaggcgcagaccgtggtgctggtcggtgacggggtggaggccatatggccgaatttcgccgccgatctggctctggacgaggcgccgaccatcgccactcatcgtggggagcgccagatcatccgtatcggagcatcctccggcagcgacctgaaagtgaatgaggaagagcttcccgtcattctcggcgcgctgcgtgccgccgtggccggacggaccgtgcgtctgccggcagcgcggctgaaagccgtgcaggcgctggcggaaaccctgaaggcttcatcctatggtgcgatcctgtggtcttccgagacactggatgcgctgtcggtggaaatgctgggtggtctcgtcaatgatctgaacgctacaacgcgctatgctgccctgccggtggcaggccccggcaatgttcagggtgccattcagaccgtagccgggatcaccggtctgccgccgcgtctgggtttcggtcgcgggcgagccgaacatgatccatggcgcttcgacctgctgcgactgatcgacgaggatgagacggattgcctcctctggatcgacgcgctcgattacgaattgccgcctgatacccccgttccggtgatcgccctgaccagtggtgatgaagcgccggagcaggcggcggttgcctttgccgtcggacagcccggtgtggatcatgatgcgatcctgttcgcaggggctgtgggcgggcagatcgaccatccggcctcttccgctgcatcgcggagtgcgcgtccggatgtcgccactattctgggccgcctgcgtgcggcatatgaggcaggc

SEQ ID NO: 27 - protein, 290 aa, Artificial Sequence
  Description of Artificial Sequences; note = synthetic construct
MTAKLLYQFDTDWTPSVFDSVVAYDGGADHVIGHANVTPENVGALVDGAIFTRGPKEKRFTALWIGGGSMEAGEAVLSAVKKKFFGNFRVSVMLDSNGSNTTAAAGVALLAKAAPLKGKKAIVLAGTGPVGMRAAGLMALEGADVTITGRQKDRTEKAAAAISKRFGVEVKAVEAADAAAREAVIQGQQVVYAAGAIGFELLSEEAWKKTSSVELLADVNAQPPLGIGGVGVMDKGKEYEGGTGTVKGFGALGIGGLKLKLHRACIAQLFEKDDQVLDAEGIYALAKEMA

SEQ ID NO: 28 - DNA, 870 bp, Artificial Sequence
  Description of Artificial Sequences; note = synthetic construct
atgacagcgaaattgctgtatcagtttgatacggactggaccccgagcgttttcgacagcgttgttgcgtatgatggcggtgcggatcatgtgatcggccatgccaatgtgacgccggagaatgtcggtgctctggtcgatggtgcgatctttacgcgcggcccgaaggaaaagcgtttcaccgcattgtggatcggcggtggcagcatggaggccggtgaggctgtgctgagcgcggtgaagaagaaattcttcggtaatttccgcgtctccgtgatgctggacagcaatggctccaacaccaccgctgcggcgggtgtggcgttgctggccaaggcggctccgctgaagggcaagaaggcgatcgtgctggccggaacagggccggtgggcatgcgcgctgccggtttgatggcgctcgaaggggccgatgtcaccatcaccggtcgccagaaggaccgcactgaaaaagccgctgctgcgatcagcaagcgtttcggcgttgaggtgaaggcggtcgaggccgctgatgccgctgcgcgtgaagccgttattcaggggcagcaggtagtctatgccgccggtgcgatcgggttcgaattgctgtccgaagaggcctggaaaaagacctcctctgtcgagctgctggccgatgtgaatgcacagcctccgctgggtattggcggggttggtgtcatggacaagggcaaggaatacgaaggcggcaccggcaccgtgaagggctttggtgcgctgggtatcggcggtctgaagctgaagctgcatcgcgcctgcatcgcccagctcttcgagaaggacgatcaggttctggacgcggagggcatctacgccctggcgaaggaaatggcg

SEQ ID NO: 29 - protein, 214 aa, Artificial Sequence
  Description of Artificial Sequences; note = synthetic construct
VMTAGVSFKDESVEAFLEQLASKASTPGGGSAAAVMGAIGAALSSMVCNLTIGKKKYAEVEEELKGVLAQADALRLKLIAAIEEDVQAFDAVMGAYGMPKTTEEEQAARKQAIQKALHLATDAPLDCARLCRDAIDLAEIVSRKGNAAVISDGGVAVLAAHAGLRSSALNVYVNAKAIEDRAFAESRLQELQEILGSAGEKTEATYELVRSQLV

SEQ ID NO: 30 - DNA, 642 bp, Artificial Sequence
  Description of Artificial Sequences; note = synthetic construct
gtgatgaccgcaggcgtctcgttcaaggacgaaagcgtcgaggctttcctcgaacagctggcgagcaaggcttccacccccggtggtggaagcgccgctgcggtgatgggggccatcggtgcggccctgtccagcatggtctgcaacctgaccatcggtaaaaagaaatatgccgaggttgaggaagagctgaagggcgttctggcgcaggccgatgcgctgcgtctgaagctgattgcggcgattgaagaagacgtgcaggctttcgatgcggtcatgggcgcctatggcatgcccaagaccacggaagaggaacaggctgcccgcaagcaagcgatccagaaggccctgcatctggctacggatgcgccgctggactgcgcgcgcctctgccgtgatgccattgatctggcggagatcgtcagccgtaaggggaatgccgctgtcatcagcgatggcggtgtggctgttttggccgctcatgccggtctgcgtagttccgccctgaatgtctatgtcaatgccaaggccatcgaagaccgggcatttgcggaaagccgtctgcaggagcttcaggagattctgggcagtgcgggcgaaaagacggaagcgacttacgagctggtgagatcgcagctcgtc

SEQ ID NO: 31 - protein, 572 aa, Artificial Sequence
  Description of Artificial Sequences; note = synthetic construct
MSTEANKPRGNQHQEAKSDAEIAQAAFMRPIVDVAAEKLGIAAEHLAPYGHYKAKIDLNYLSSLDSRPDGKLVLVTAISPTPAGEGKTTTTVGLTDALNHIGKKAVACLREPSLGPCFGVKGGAAGGGYAQVVPMEDINLHFTGDFHAIGAANNLLAALIDNHVYWGNELGIDPRRIGWRRAVDMNDRALRSIVSSLGGVSNGYPREDGFDITVASEVMAIFCLATDLDDLQRRLGNIIVGHTKDRKPIRASELSAAGSMAVLLKDAIAPNLVQTLEHNPAFIHGGPFANIAHGCNSVIATRAALKLSDYVVTEAGFGADLGAEKFFDIKCRKAGLSPSAVVIVATVRALKMHGGVAKDALKTENVEAVQKGFANLERHIQNVRKFGVPVVVGVNKFSADTDAEFQMLHDLCAKMGVPCVSSDHWANGGAGAADLAHEVVKLVEGGSADFKPLYPEDMPLWDKLRTIATEIYGASDITADAAVRKRFDELQKEGFGHLPICVAKTQYSFSTDANLRGAPSGHVIPVRDLRLSAGAEFVVAICGDIMTMPGLPKVPAANAIRLASNGTIAGLF

SEQ ID NO: 32 - DNA, 1716 bp, Artificial Sequence
  Description of Artificial Sequences; note = synthetic construct
atgtctacggaagcgaacaagccgcgcggcaatcagcatcaggaagcaaaaagcgacgccgagatcgcgcaggctgcatttatgcgcccgattgtcgatgttgcggcagaaaagctgggcattgccgctgagcatttggctccgtatggccactacaaggccaaaattgatttgaattatctatcgtcgctggacagccgtccggatggtaagctggttctggtgaccgcaatcagccccaccccggcgggtgaaggcaaaaccacgacgacagtgggcctgaccgatgcgctgaaccatatcggcaagaaggcggttgcctgtctgcgtgagccttcgctgggtccgtgtttcggtgtgaagggtggcgctgccggcggcggatacgcccaggtggtgccgatggaagatatcaacctgcatttcacaggtgatttccacgcgatcggcgcagccaacaacctgctggcagctctgatcgataaccatgtctactggggtaacgaactgggcatcgacccgcgtcgcattggctggcgccgtgcggtggacatgaatgaccgtgccctgcgctccatcgtgtcctcgctggggggcgtctccaacggctatccgcgtgaggatggcttcgacatcaccgtggcctccgaagtgatggcgattttctgcctcgccacggatctggatgatttgcagcgccgtctgggcaacatcatcgtcggtcacaccaaggaccgtaagccgatccgcgccagtgagctgagcgccgccgggtccatggccgtgctcttgaaagatgcgattgcgccgaatctggtgcagacgctggaacataatccggccttcatccatggcggcccgttcgccaatatcgcccatggctgcaacagcgtgatcgcgacccgcgccgcgttgaagctgtccgattatgtggtgacggaagcaggcttcggtgctgatctgggggccgagaagttcttcgacatcaagtgccgcaaggctggcctctccccgtctgccgtggtgatcgtggcaacggtgcgcgccctgaagatgcatggcggcgtagccaaggatgcgctgaagaccgaaaatgtcgaagccgtgcagaagggtttcgccaatctggaacgccatatccagaacgtccgcaagttcggcgtgccggttgtggtcggcgtgaacaagttcagtgccgatacggatgccgaattccagatgctgcatgatctgtgcgcgaaaatgggcgtcccttgcgtcagctccgaccattgggccaatggcggcgcgggtgccgccgatctggcgcatgaggtggtcaagctggtggaaggtggctccgccgatttcaagccgctgtatccggaggatatgcccctctgggacaagctgcgtacgattgctaccgagatctacggcgcgtccgatatcacagccgatgcggccgtgcgcaagcggttcgacgaactgcaaaaagaaggattcggtcatctgccgatctgtgtcgccaagactcagtacagcttcagcaccgatgcgaatttgcgtggtgcgccatccgggcacgtcattcccgtgcgtgatctgcgactgtctgcgggcgccgaattcgtcgtcgcgatctgcggcgatatcatgaccatgccgggtctgccgaaagtgcctgccgccaacgcgatccgtctggcatcgaatggtactatcgccggattgttc

SEQ ID NO: 33 - protein, 159 aa, Artificial Sequence
  Description of Artificial Sequences; note = synthetic construct
VSQIMAKDAFSAERAARIIDTHRDQEGAMLPILHDLQAEFGYVPEEVVPMLADALNVSRAEVHGVISFYHDFKNHPPGRHVLKLCRAEACQAMGADTLADHVREKLRVDWHGTTVNGSVTLEPVFCLGLCACAPAAMLDNELHGRLDQDHVDTLLESVA

SEQ ID NO: 34 - protein, 518 aa, Artificial Sequence
  Description of Artificial Sequences; note = synthetic construct
MTIKVYVPRDAAALAVGADAVARKLEQLAQERSLDIAIIRNGSRGMLWLETLVEVETPHGRVAYGPVTARDLPGLLDAGMLEGKPHALNHGLTEEMPWFKKQTRLTFERCGIVDPRSLSDYQAHGGYKGLARALTMTPEAVVEDVTKSGLRGRGGAGFPTGIKWKTVLGAKAAQKYIVCNADEGDSGTFADRMIMEGDPFVLIEGMTIAGYAVGATKGYVYTRSEYPHAIDAMNRAIIAAREAGMLGDNILGSGISFDMEVRQGAGAYVCGEETALLDSLEGKRGVVRAKPPLPALSGLFGQPTVINNVISLTSVPWIMTHGGEAYAAFGLGRSRGTMPIQIAGNVKQGGLFEIAFGITLGELVDEIGGGTLTGRPVRAVQIGGPLGAYFPRALFDTPFDYEAFAAKDGLIGHGGIVIFDDTVDMAHMARFAMEFCAEESCGKCTPCRIGSTRGVETLDKLLRGEQHEKNYAVLEDLCNTMKFGSLCALGGFTPYPVVSAMTHFPEDFAPRTVPVAAE

SEQ ID NO: 35 - protein, 947 aa, Artificial Sequence
  Description of Artificial Sequences; note = synthetic construct
MPLVEEIDYGTPKVVSEKSVTLTIDGRQVTVPEGTSLMRAAMDTGITVPKLCASDNLKAFGSCRLCLVEIEGRPGTPASCTTPAMEGMVVHTQTDRLARLRKGVMELYISDHPLDCLTCSANGDCELQDMAGAVGLREVRYGYEGENHLHDSKDVSNPYFQYDPSKCIVCNRCVRACEEVQGTFALTIEGRGFESRVSPGAAHDNFFSSECVSCGACVQACPTATLMEKSVIEIGQPEHSEVTTCAYCGVGCSFKAEMRGEQIVRMVPYKDGKANHGHSCVKGRFAYGYALHKDRQLEPMIREKITDPWRVVSWDEAIQYTAKEFRRIQDKYGRSSIGGITSSRCTNEETYLVQKLVRAVFGNNNVDTCARVCHSPTGYGLKTTYGTSAGTQDFDSVEESDVIVVIGANPVDAHPVFGSQMKRRLRDGAKLIVIDPRKTDLVKSPHIKADFHLPLRPGTNVAIVSALAHVVVTEGLLDEAFVRERTDWESFQDWVQFVTRPENSPEAVAEICGVSAEDIRGAARLYATGGNAAIYYGLGVTEHSQGTTTVMAIANLAMATGNLGRRGVGVNPLRGQNNVQGSCDMGSFPHEFTDYRHVSNDAARAQFEALWGVSLDAEPGLRIPNMIDAAVDGTYKGIYIQGEDIVQSDPDTTHMIAGLKNMECVVVQDLFLNETADYAHVFLPGCSFLEKDGTFTNAERRINRVRKVMSPKNGYGDWEITQMLAKAMGYPMHYNHPSEIMDEIAATTPNFALVSYAKLDEAGSVQWPCNDEHPDGMPIMHIGQFSRGKGYFVVTEYIATDEKTGPLFPLLLTTGRILSQYNVGAQTRRTHNSMWHEEDRLDIHPKDAEDRGVRDGDWVKLESRSGATSLRARITEKVPPGVVYTTFHHPASQANVVTTDNSDWATNCPEYKVTAVQVQRSNGPTEWQREYGDHSTQARRIIPAAAE

SEQ ID NO: 36 - protein, 136 aa, Artificial Sequence
  Description of Artificial Sequences; note = synthetic construct
VPDLCLIASNHRKGNCPVTATNDRLVTMANQIAGFFSHRPEETAISGIAEHIVLYWEPRMRRAFDAIIESHNPALSPLAQKAGEYLMSHDVKPSDHDPLAGMQPRAVTGSDPKEDPNTPPGGFNTDEQHGDNRASS

SEQ ID NO: 37 - protein, 787 aa, Artificial Sequence
  Description of Artificial Sequences; note = synthetic construct
SDNMAAKPKIKPYHGPAGGIGALEAVEKHLCRQKIFLSGNKALLSMNKPEGFDCPGCGWPDPKHTSSFEYCENGAKAVAWEATKKRVTLDFFARHTVTELLGWSDYELEDAGRLTHPMIYDRATDQYTPISWEDAFRTIGDALNRLPDPNQAEFYTSGRASNEAAFLFQLFVRAYGTNNFPDCSNMCHESTSVALPDSIGVAKGTVQLDDFEKAEAIFIFGQNPGTNSPRMLNDLRAAAKRGAKIVSFNPIRERSLERFASPQHLGDLIKPVSISSHYYQVRIGGDMAAVKGIMKVVLEADDAARAAGQPRVLDVAFIETHTHGFEAVEADIRATDWKEIERASGLSRAQIEEAASIYIQAKSCIAVWGMGITQHRTGVANIQQIINLLLMRGNMGRPGAGACPVRGHSNVQGDRTVGIYEKPKPAFLDGLQRAFGFNPPREHGHDVGEAIDAMFEGHARAFIGLGGNFSLAVPDTERVAEAMRRLDLNVQIATKLNRGHLVVCNTSLLLPCLGRTEIDFQSSGPQMVTVEDSMSNVHASGGLNMPASEHLRSEVAIICGIAQATLKGRYDIPWQSYSEDYDRIRDAIEAVMPELFTGFNQKIRQPGGFRLYSPVDYREWNTPNGKANFLVHEGIDENEMPQDREDVLELATIRSHDQYNTTVYGLDDRYRGVFGQRMVVFINAADRERLGFEEGAIVAMRTVSEDGLERRVGGFRLVDYDIPAGCCAAYYPETNPLIPATRRALRSNTPTSKSVPVVFEAWKGEWDDRPNPELASIQTQVMAVAAE

SEQ ID NO: 38 - DNA, 477 bp, Artificial Sequence
  Description of Artificial Sequences; note = synthetic construct
gtgagccaaatcatggccaaggacgctttcagcgcggaacgcgctgcaagaattatcgatacccatcgtgaccaggaaggcgccatgttgcctatccttcatgatctacaggccgaattcgggtatgtgccggaagaagtcgtgcccatgcttgcggatgcgctgaatgtgtcccgcgccgaagtgcatggtgtcatcagcttttatcatgatttcaagaaccacccgcccggtcggcacgttctgaagttatgccgcgcggaagcgtgtcaggcgatgggtgccgataccctggccgatcatgttcgtgagaagctccgcgtggactggcatggcaccacggtcaatggctccgtgacgcttgagccggtattctgcctcggcctgtgcgcctgcgcacccgcggcgatgctggataatgagctgcatggccgtctggatcaggaccatgtcgatacgctgctggagagcgtggca

SEQ ID NO: 39 - DNA, 1554 bp, Artificial Sequence
  Description of Artificial Sequences; note = synthetic construct
atgaccatcaaagtatacgtcccccgcgatgcggccgcccttgcggtcggcgctgacgccgttgcccgcaagctggagcaactggcgcaggaacggtcgctggacatcgccattatccgcaacggctcccgcgggatgctgtggcttgaaacgctggtcgaggtggaaacaccgcacggccgcgtcgcctacggtcccgtgaccgcacgtgatctgcccggcctgctggatgccggcatgctggaaggcaagccgcacgcactgaatcatggcctgaccgaggaaatgccctggttcaagaagcagacccgtctgactttcgagcgctgcggcatcgtcgacccccgctcgctgagtgattatcaggcgcatggcggctacaagggccttgcccgcgcgctaactatgacgccggaagccgtggtcgaggacgtgaccaaatccggcctgcgcggtcgtggtggcgcaggcttccccaccggcatcaaatggaaaacggttctgggtgcgaaagccgcccagaaatacatcgtctgcaatgccgatgaaggcgatagcggcacctttgccgaccgcatgatcatggaaggcgatcccttcgtgctgatcgaaggcatgaccatcgccggttatgccgtgggcgcgaccaagggctatgtctatacgcgctccgaatatccgcatgccattgacgcgatgaaccgcgccattatcgccgcacgcgaagcgggtatgctgggtgataatattctcggttccggcatttccttcgacatggaagtgcggcagggagccggggcctatgtctgcggtgaggaaaccgcactgcttgacagcctggaaggcaagcgcggcgtcgtgcgtgccaagccgcctttgcccgctttgtccggtctgttcgggcagccaaccgtcatcaacaacgtgatctccctgacctccgtgccatggatcatgacccatggtggtgaggcttatgccgcgttcggtcttggccgttcccgtgggaccatgccgatccagatcgctggcaacgtcaagcaaggcggcctgtttgagatcgccttcggtatcacgctgggcgagctggtcgatgagatcggtggtggcacactgacggggcgtccggtgcgcgctgtgcagatcggtggtccgttgggagcctatttcccgcgcgccctgttcgataccccgttcgattatgaggcattcgcggcgaaggacgggctgatcggccatggcggcatcgttattttcgacgataccgtcgatatggctcacatggcccgcttcgccatggaattctgcgccgaggaaagctgcggcaaatgcacgccatgccgcatcggctccacgcgcggcgttgaaacgctggacaaactgctgcgcggtgaacagcacgaaaaaaactatgccgtgctggaagatctctgcaacacgatgaaattcggctccctgtgcgcgctgggcggcttcaccccctatccggtggtcagcgcgatgacccatttccccgaggatttcgctccccgcaccgtcccggtggcagcggaa

SEQ ID NO: 40 - DNA, 2841 bp, Artificial Sequence
  Description of Artificial Sequences; note = synthetic construct
atgccgctcgtggaagaaatcgactatggcacgccaaaagtcgtcagtgagaaatccgtcaccctgaccattgacggacgccaggtgacggtgccggaaggcacctccctgatgcgcgccgccatggataccggcattacggtgcccaagctctgcgcctccgacaatttgaaggcgttcggttcctgccgtctctgtctggtggaaatcgagggacgtccgggtaccccggcttcctgcaccacaccggccatggaaggcatggtggtgcatacccagaccgaccgtctggcacgcctgcgcaagggcgtgatggagttgtacatctccgaccatccgctggactgcctgacctgctccgccaatggcgattgcgagcttcaggatatggccggggccgtcggcttgcgggaagtccgctatgggtatgagggtgaaaatcacctgcatgacagcaaggatgttagcaacccgtatttccagtacgatccgtccaagtgcatcgtctgtaatcgctgcgtccgtgcctgtgaggaagtccagggcaccttcgccctgaccattgagggccgtggcttcgaaagccgcgtctcccccggtgccgcacatgacaatttcttttcctcggaatgcgtttcctgcggcgcctgtgtgcaggcctgcccgaccgcaaccctgatggaaaaatccgtcatcgaaatcggccagccggaacattccgaagtcaccacctgcgcctattgcggtgtggggtgcagcttcaaggcggaaatgcgcggcgaacagatcgtgcgcatggttccctacaaggacggcaaggccaatcatggccatagctgcgtcaagggccgcttcgcctacggttatgcattgcacaaggatcgtcagcttgagccgatgatccgtgaaaaaatcaccgacccgtggcgtgtggtgagctgggatgaagccatccagtataccgcgaaagaattccgccggattcaggacaaatacggccgctcctctatcggcggtattacctcctcccgctgcaccaatgaagaaacctatctggtgcagaagctggtgcgcgccgtgttcggcaataacaatgtcgatacctgcgcccgcgtctgccactctcccaccggctatgggttgaagacgacctacggcacctccgctggcacgcaggatttcgacagtgtcgaggaaagcgatgtcattgtggtgatcggtgccaatccggtcgatgcccatcccgtgttcggcagccagatgaaacgtcgcctgcgggatggcgcgaagctgatcgtgatcgatccgcgcaagacagatctggtcaaatccccgcatatcaaggccgatttccatctgcccctgcgccccggcaccaatgtcgccatcgtttccgcactggcccatgtggttgtgacggaggggctgctggacgaagctttcgtgcgtgaacgcaccgattgggagtccttccaggactgggtgcagttcgtgacccgcccggaaaacagcccggaagccgttgccgaaatctgcggtgtcagtgccgaagatattcgtggcgctgcccgtctctatgcgaccggcgggaatgccgcgatctattacggtctgggtgtgaccgagcacagccagggtacgacgacggtgatggccatcgccaatctcgccatggcgaccggtaatctgggccgccgtggcgtgggcgtgaacccgctgcgtggtcagaacaacgtgcagggttcgtgcgacatggggtctttcccccatgaattcaccgattaccgccatgtttccaacgatgccgcccgcgcccagttcgaagcgctgtggggcgtgtcgctggatgccgagccgggtctgcgcattccgaacatgatcgatgccgccgtcgatgggacctataaaggcatctacattcagggtgaggacattgttcagtccgatcccgataccacccatatgattgccggtctgaaaaacatggaatgcgttgtcgttcaggacctgttcctgaatgaaaccgccgactatgcccatgtgtttctgccgggctgctccttccttgagaaggatggaaccttcaccaatgccgagcgccgcatcaatcgcgtgcgcaaggtgatgtcgccgaaaaatggttatggtgactgggaaattacccagatgctggccaaggccatgggttatcccatgcactacaaccacccgtccgagatcatggacgagattgccgctactactccgaacttcgcccttgtttcttacgcgaaactcgatgaggccggctctgtgcagtggccttgcaatgacgagcatccggatggcatgccgatcatgcatatcggccagttcagccgcggcaagggctatttcgtcgtcaccgaatatatcgcgaccgatgaaaagaccggcccgctctttccgcttctgctcaccaccggtcgtattctcagccagtataatgtgggcgcgcagacacgccgcacccataactccatgtggcatgaggaagaccggctggatatccatccgaaagacgccgaggatcgcggcgttcgtgatggggactgggtgaaactggaaagccgctccggcgcgacatcgctgcgggcacgcatcaccgaaaaggttccgccgggcgtggtctacaccaccttccatcacccggcgagccaggccaatgttgtgaccaccgataactccgattgggctaccaactgcccggaatacaaggtcacagccgtgcaggtacagcgcagcaatggccccaccgagtggcagcgtgaatacggcgatcactccacgcaggcccgccggattatcccggcagctgcggaa

SEQ ID NO: 41 - DNA, 411 bp, Artificial Sequence
  Description of Artificial Sequences; note = synthetic construct
gtgcctgacctctgcctgatcgcctccaaccatcgcaagggaaattgtcccgtgaccgcaaccaatgatcgcctcgtgacaatggccaatcagattgccgggtttttctcccaccggccggaagaaacagccatctccggcattgccgagcacattgtgctgtactgggaaccgcgtatgcggcgcgccttcgacgccatcatagaatcacataatccggccctaagccctctggcgcaaaaagctggagagtatttaatgtcccatgatgtgaaaccgtccgaccacgaccctctcgcggggatgcagccacgtgcggtgacgggatccgatccaaaagaagatccaaacacacctccggggggattcaatacagatgagcagcacggagataaccgcgcctcaagctga

SEQ ID NO: 42 - DNA, 2355 bp, Artificial Sequence
  Description of Artificial Sequences; note = synthetic construct
atggcggccaagccaaagatcaaaccgtatcacggaccagccggaggcattggtgcgcttgaggctgtggaaaagcatctgtgccgccagaagattttcctgagcggcaacaaggcgttgctgtcgatgaacaagccggaagggttcgactgcccagggtgtggttggcctgatccgaagcacaccagctcttttgagtattgtgaaaacggggcaaaagcggttgcctgggaagccaccaagaagcgtgtgacgctggatttctttgcacggcatactgtgacggaactgctcggctggagcgattacgaactggaagatgctggtcgtctgacccacccgatgatctatgaccgggccaccgatcaatacacgccgatctcctgggaggatgcattccggaccatcggagatgctctgaaccgtttgcccgaccccaatcaggctgagttttatacttcgggccgtgcctccaacgaagctgcgtttctgtttcagcttttcgtgcgggcttacggaaccaacaatttccccgactgctccaatatgtgccacgaaagcaccagcgtggcgctgcccgacagtatcggcgttgcaaaaggcactgtgcagctcgacgattttgaaaaagccgaagccattttcattttcggccagaatcccggcaccaacagcccgcgcatgctgaatgatctgcgcgctgccgcaaagcggggggcgaagatcgtttccttcaacccgatccgggagcggtcgctggagcgttttgcgtctccgcaacatctgggtgatctgatcaagccggtgtcgatcagttcgcattattatcaggtgcgcatcggtggtgacatggccgccgtcaagggcatcatgaaagtggtgctggaggccgatgatgctgcccgtgccgccggtcaaccccgtgtgctggatgtcgcgttcatcgagacccacacccatggctttgaagcggtcgaggccgatatccgtgcgacggattggaaagaaatcgagcgtgccagcggcctgagccgggcgcagatcgaggaagccgcgtccatttatattcaggccaaaagctgtattgctgtctgggggatgggtattacccagcaccgcacgggcgtcgccaatattcagcagatcatcaatctgctgctgatgcgcgggaatatggggcggcccggagccggtgcctgcccggtgcgcggccattccaacgtgcagggtgatcgcacagtcgggatctatgaaaaaccgaaacccgcttttctggacgggttgcagcgcgcattcggctttaaccccccgcgtgagcatggccacgatgtcggagaagccatcgacgcgatgttcgaaggtcatgcacgggccttcatcggccttggtggcaatttcagcctcgcggttcccgatacggagcgtgtggcggaggcgatgcgtcgccttgacctgaacgtgcagatcgccacgaaactcaatcgcggtcatctggtggtttgcaatacatcgctattgctgccttgccttggccgtactgaaatcgatttccagagttcaggtccgcagatggtgacggtggaggattcgatgtccaacgtccacgcttcgggtggcctgaacatgccggcctcggagcatctgcgctcggaagtcgctattatctgcggtattgctcaggcaacgctgaaggggcgttacgatattccgtggcagtcgtatagtgaggattatgaccgtatccgtgacgcgattgaagcggtgatgccggaactgttcaccggctttaaccagaaaatccgccaaccaggtggcttccgtctgtattctccggtcgattaccgtgagtggaatacgccgaatggcaaggcgaatttcctggtgcatgaaggcatcgatgaaaatgagatgcctcaggatcgggaggatgtgctggaactggccacaatccgcagtcacgatcagtataacaccacggtctatggtctggatgatcgttatcgcggtgtgttcggtcagcgcatggtggtgttcattaatgcggccgatcgtgagcggctcggtttcgaggaaggggccatcgttgcgatgcgcactgtcagcgaagacgggctggaacggcgtgtcggcggtttccgtctggtagattacgatattcctgccggatgctgtgcggcttactatccggagaccaacccgctgattcccgcaacacgtcgtgctctgcgcagtaacacgcccacatcgaaatccgtcccggtggtgttcgaggcatggaagggggaatgggatgaccgtcccaatcctgagctggcttccatccagacacaagtgatggctgttgcggcagaataa

SEQ ID NO: 43 - protein, 444 aa, Artificial Sequence
  Description of Artificial Sequences; note = synthetic construct
MSDFTEIAHQDSCSTFSSGPLSGLGRAITTGLATFAIATCVAGNGVAHAADSAHDALVEKGKYLTTAADCESCHTAKGGVPFAGGREFKLPMGVLYAPNITPDKETGIGEYTDDEFVSAMWDGVGRGGRHLYPAFPYTSYTKLSRDDVLAIKAYLFSLKPVHAVSPPNNMRFPFSQRWLMVGWNMLNNPGRRFEPDSSRSPEWNRGAYLVEALGHCGECHTPRGWTYGLKNSRALSGETMQGWKAYNITSDPKQGIGDWSESELEAYLATGHSDGRGSASGPMAEAVSYSLSRLTHDDIHAMVVYLKAVPPIADGVGVAPAPEQAKMPDPAASANSEGGRLFAGACKSCHTLSGAGRQTNYAAIAGAATVSDPEGTNLVRILLDGSVLDIEKNGIPTVHAFMPSFGLSHTDAELAVLSNYVLGHFSGVRGTVTADQVRDARTAQ

SEQ ID NO: 44 - protein, 717 aa, Artificial Sequence
  Description of Artificial Sequences; note = synthetic construct
MNHTPLSRRGVLAGGAALVIGTWLPRSRHAKAEGATEQAEHSFAPNAFIRVAQDGGITLIMRDVEMGQGIWTGASMLLAEELEVGLDQISPQFAPPDDKLYASPLLQMQATGGSTSIRGDYKEFRMAAATARSVLVQAAAREWGVPPGECTVKRGVISHQASGRSAPYKDFVAVAVTLPVPKDVPLKDPKDWTLIGHSQRRLDTPPKVNGTAVYGIDVKLPGLKVATVETCPVLGGKLVSMDENAARAVPGVRDVLKLDHAVAVVGDHFWAAKQGVEALHIVWDEGPNAQVSQAEIVEGHKAASRTDGLTARKVGDPEGALSRATSRIEAVYQLPFLAHAPMEPINCTVHVSKESAEVWCGTQVPARAQEEVVQVTGLPKDKVQVHNHMIGGGFGRRLEAEYVRQAAAFGRQVSYPLKLIWTRETDIRHDRLRPYYYDTLSGGLDADGKVIAWTHKTTGASVLARWAPVAMPKTGIDPDLIECAETPYDIPNMRNSWVRHEPPGVVVAWWRGVGPAHNVFVVESFVDELAAAAKQDPLNFRRALLHKNPRALGVLNAAAEKAGWGTSLPPRHGRGIMVQNAFGSYLSVVCDAEVKPDGTVRLHRLVAAMDCGRAINPDSVRAQIEGGLVFGLTAALYGEITLEKGRVQQSNFNDYRMLRMNEVPPIDIVLIDSTEDPGGLGETGTAAAFPAIANAVFAATGKRIRRLPLGLGQLADA

SEQ ID NO: 45 - protein, 196 aa, Artificial Sequence
  Description of Artificial Sequences; note = synthetic construct
LICILIKQSPYHNGRSIRIFCDSVPVRLMAGYLSCVTFYACGEEFLMITLNINGADHQFDLPEDMPLLWALRDVAGLTGTKFGCGIALCGACTVHMDGEAVRSCTLPLGEAAGHKIMTIEAVGDTPAGAKVQKAWLDIEVVQCGYCQSGQIMAATALLNAHPHPTDDDIDAAMSGNICRCGTYPRIRRAIKQAAQA

SEQ ID NO: 46 - DNA, 1332 bp, Artificial Sequence
  Description of Artificial Sequences; note = synthetic construct
atgtctgattttacagaaattgctcatcaggattcctgttccacattttcctccggtccactgtcggggcttgggcgtgccatcacgacaggattggcgacttttgcaatagcgacctgtgtggcgggcaatggtgtcgcccatgccgcggatagtgcgcatgacgcactggttgaaaaaggaaaatatctgactacggccgcggattgtgagtcatgccatacggcaaaaggaggtgttcctttcgccggcggtcgggagttcaagctgccgatgggcgttttatatgcgccgaatatcacgccggataaggagacaggaatcggcgagtatacggatgatgagttcgtctcagccatgtgggatggagtagggcgtggcggccgacatttatatccggcttttccttatacgtcgtatacgaaactgtcacgggatgatgtgctggcaatcaaggcgtatctgttcagtctcaagcctgttcatgctgtctcccctccaaacaacatgcgttttcctttcagccagcgctggttgatggtggggtggaacatgctgaacaatccgggaagacggtttgaacctgattcttccagatctccggaatggaatcggggtgcctatctggtggaggcgctcggccattgcggggaatgccacacgccgcgtggatggacctatggcctgaaaaacagccgtgccctttcaggtgaaacgatgcagggctggaaagcctacaatattaccagcgatcctaagcagggaattggtgactggtccgagagtgagcttgaagcctatctggccacaggtcatagcgatggtcggggcagcgcctctggaccgatggcagaagcggtcagttacagcctcagccggctgacccatgatgatattcacgccatggtggtttatctgaaagccgtgccgccgattgccgatggtgtcggtgttgcgcctgctccagagcaggcgaaaatgccggatcccgctgcttccgcaaacagcgagggtggccgcctctttgccggtgcatgcaaaagttgccacacactcagcggagcagggcggcagacgaactatgccgctattgccggagcagctaccgtctccgatccggagggtactaatctcgttcgcattctgcttgatggttctgtgctggatatagagaaaaacggcatcccgaccgtgcatgcgttcatgccttcctttggcctgtcacataccgatgcggaattggccgttctctcgaactatgtgcttggccacttcagtggcgtgcgtggaactgtcacggcagatcaggtgagggatgcacgcaccgcccaa

SEQ ID NO: 47 - DNA, 2453 bp, Artificial Sequence
  Description of Artificial Sequences; note = synthetic construct
atgaatcatactcctctttcccgtcgcggtgttctggccggaggggccgctctggttatcggtacatggctgccgcgcagccgccatgcaaaggcagaaggggctacggagcaggccgagcactcatttgcacccaatgcctttattcgtgtggcacaggatggcggtatcacgttgatcatgcgtgatgtagaaatggggcagggcatctggacgggagcgtccatgctgttggctgaggaactggaggtcggtctcgaccagatcagcccccagttcgcaccgccggatgacaaactgtatgcgtcgccgctccttcagatgcaggcgaccggtggttcgacgtcgatccgcggcgactacaaggaatttcgtatggccgccgctacagcacgcagcgtgctggtgcaggctgccgcccgtgaatggggcgtgccgcccggggaatgcactgtgaagcgtggcgtgatcagccaccaggcctctggtcgcagtgcaccatacaaggattttgtggctgttgccgtcaccttgccggtgccgaaagatgtgccgctcaaggatccgaaagattggacattgatcggtcattcgcaacggcgtctggatacgcccccaaaggtcaatggcacggccgtatatgggatcgacgttaagctgcccggtttgaaggttgcgacagtcgaaacatgccccgtcctcggcgggaaactggtttcgatggatgagaatgcggcgcgggctgttcccggcgtgcgggatgttctcaagctggatcacgctgtggctgtggtgggtgaccatttctgggctgcaaagcagggggtagaagcactccatatcgtctgggacgagggacccaatgcgcaggtctcacaggccgagatcgtggagggccataaggctgcttccagaacggatggcctgacagcgcgcaaggtaggcgatccggaaggcgcattgtccagggcaaccagcaggattgaggcggtgtaccaattgccgtttctggctcatgcccccatggagccgatcaactgcacagtccatgtaagtaaggaaagtgccgaagtctggtgtggcactcaggttccggcgcgtgcgcaggaggaagtcgtgcaggtgaccggcctgcccaaagataaggttcaggtccataatcatatgattgggggcgggttcgggcgtcggctggaggctgaatatgtccgtcaggccgctgctttcggccgtcaggtttcatatccgttaaagctgatctggacgcgggagaccgatattcgtcacgatcggcttcggccttactattacgataccttatccggtgggttggatgcggatggcaaggttatagcatggacgcacaaaaccacgggcgccagtgtgttggcacggtgggcaccagtggccatgccgaaaacaggtattgatcccgatctgatagaatgtgctgaaacaccctacgatattccaaacatgcgtaattcatgggtgcgtcacgagccacccggtgtcgttgtcgcgtggtggcggggtgtcggaccggcacataatgtttttgtggtggaaagctttgtggatgagcttgccgctgccgccaaacaggatccgctgaatttccgccgtgctctgttgcataaaaatcctcgtgcacttggtgtgctgaacgcagccgctgaaaaggcaggctggggaacgtcccttccgccgcgccacgggcggggcatcatggtacaaaacgccttcggtagttatctctcagtcgtgtgcgatgccgaagtaaagccggatggaacggtccgtctgcacaggctggttgcagcgatggattgtggacgcgcaatcaatccggattccgttcgggcgcaaattgaaggtgggctggtcttcggcctgacggctgcactttatggcgagatcacgcttgaaaaaggccgtgttcagcaatcaaatttcaatgattaccgcatgctgcggatgaatgaggttcctccgatcgacatcgtgctgatcgatagcaccgaagatcccggcggtttgggagaaaccggtactgcggcagcattccctgccattgcaaggatgtggccgggctgacaggcacgaaattcggctgcggtattgctctgtgtggagcgtgcaccgttcacatggacggggaagcggttcgctcctgtacccttccgttgggagaagccgccggtcacaagatcatgacgattgaggcggtcggcgatacaccggcaggggcgaaagttcagaaagcctggcttgatatcgaggtcgtgcagtgtggatactgccagtccgggcagatcatggcggcaaccgcactgttgaatgctcatccccaccccacagatgacgatatcgatgcggccatgagcggcaatatttgccgttgcggcacttatccccgcatcaggcgtgccatcaaacaggcagcgcaggca

SEQ ID NO: 48 - protein, 343 aa, Artificial Sequence
  Description of Artificial Sequences; note = synthetic construct
MKLYRLPGPHGIVPQGFDSLYTTEAPEPKPRRGQVLVRLRAASLNYRDLLVARGQYPLSPVPPDLIPLSDGAGEVVETGEDVTRFQPGDRVAPCFFQSWHDGPITERDGASALGGAIHGVLTEYAVFEQDGLVRIPDHLSWEEAACLPCAAVTAWHALFGGTPVQPGQTVLTQGTGGVSIFAIQFAKAAGARVITTSSSDKKLSRAQALGADEGINYRSRPDWHKAATALTGGLGVDHVVEVGGSGTLPQSIRATRLGGQIHLIGVLTGQNEINPLPLMARSQTLRGIYVGSRAMFEAMNVAISQHRIRPVIDRVFPFAEAVAAYRHLESATHFGKVVIRLDE

SEQ ID NO: 49 - DNA, 1029 bp, Artificial Sequence
  Description of Artificial Sequences; note = synthetic construct
atgaagctataccgcctgcccggcccgcacggaattgtccctcagggatttgacagtctttacacgaccgaggccccggaaccgaaaccccggcgaggacaggtgctggtacggttgagggcggcctctctgaactatcgtgatcttctggtcgcacgcggacagtatccgctcagtccggtaccgcctgatctgatccccctctccgacggggcaggcgaggtcgttgaaaccggggaggatgtcacccgctttcagcccggcgaccgggtagctccctgctttttccagagctggcatgatggcccgatcaccgaacgggacggggccagcgcactcgggggcgccattcacggcgtgctgacggaatatgcggtgttcgaacaggatggtctggtgcgcatcccggatcatctctcctgggaagaagcagcctgtctgccctgtgccgcagtaacggcatggcacgccctgttcggcggcacacccgttcaaccgggccagacagtgttgacacagggcaccggaggagtctccatctttgcgatccagttcgccaaggccgctggggcgcgcgtgattaccacctcgtcctctgacaaaaagctgtcacgcgcccaggctctgggggccgatgaaggcattaattaccgtagccggcccgactggcataaggccgcaactgccctgaccggaggtcttggcgtcgatcacgttgtggaagtcggcggctccggcacgcttccgcaatccatccgtgccacgcggctgggcggccagatccatctgattggcgtgctcaccggtcagaacgagatcaatcctctgcctctgatggcccggtcccagactctccgcggcatctatgtcggctcccgcgcgatgttcgaggcgatgaacgtcgccatcagccagcaccggatcaggccagtgattgaccgcgtctttccttttgccgaagcagtggcagcctatcgccatctggaaagcgccacccatttcggcaaggtcgtcatccgcctggatgag

What is claimed is:

1. A biofuel cell, comprising a cathode, an anode, a conductive medium, an ion exchange membrane interposed between the cathode and the anode, and a bacterial catalyst around the anode, wherein the bacterial catalyst comprises an isolated Gram-negative bacterium, wherein the bacterium is an aerobic, facultative methylotroph that produces colonies that are yellow pigmented, wherein the bacterium can use methanol as a sole carbon source and can oxidize glucose and ethanol into acid, and wherein the bacterium comprises a 16SRNA nucleic acid identified as SEQ ID NO:2.

2. The biofuel cell of claim 1, wherein the bacterium is designated Granulibacter bethesdensis and deposited under ATCC Accession No. BAA-1260.

3. The biofuel cell of claim 1, wherein the bacterium can degrade methanol into carbon dioxide and hydrogen ions.

4. The biofuel cell of claim 1, wherein the bacterium can degrade ethanol into acetic acid.

5. The biofuel cell of claim 1, wherein the bacterium comprises a genome identified as SEQ ID NO:1 and is deposited under GenBank Accession No. CP000394.

6. The biofuel cell of claim 1, wherein the bacterium produces methanol dehydrogenase, wherein the methanol dehydrogenase oxidizes methanol into formaldehyde.

7. The biofuel cell of claim 6, wherein the methanol dehydrogenase comprises a first subunit peptide and a second subunit peptide.

8. The biofuel cell of claim 7, wherein the first subunit peptide is a first peptide, a second peptide, a third peptide, or a fourth peptide.

9. The biofuel cell of claim 8, wherein the first peptide of the first subunit has an amino acid sequence identified as SEQ ID NO:3.

10. The biofuel cell of claim 8, wherein the second peptide of the first subunit has an amino acid sequence identified as SEQ ID NO:4.

11. The biofuel cell of claim 8, wherein the third peptide of the first subunit has an amino acid sequence identified as SEQ ID NO:5.

12. The biofuel cell of claim 8, wherein the fourth peptide of the first subunit has an amino acid sequence identified as SEQ ID NO:6.

13. The biofuel cell of claim 8, wherein the second subunit peptide has an amino acid sequence identified as SEQ ID NO:7.

14. The biofuel cell of claim 9, wherein the amino acid sequence identified as SEQ ID NO:3 is encoded by a nucleic acid identified as SEQ ID NO:8.

15. The biofuel cell of claim 10, wherein the amino acid sequence identified as SEQ ID NO:4 is encoded by a nucleic acid identified as SEQ ID NO:9.

16. The biofuel cell of claim 11, wherein the amino acid sequence identified as SEQ ID NO:5 is encoded by a nucleic acid identified as SEQ ID NO:10.

17. The biofuel cell of claim 12, wherein the amino acid sequence identified as SEQ ID NO:6 is encoded by a nucleic acid identified as SEQ ID NO:11.

18. The biofuel cell of claim 13, wherein the amino acid sequence identified as SEQ ID NO:7 is encoded by a nucleic acid identified as SEQ ID NO:12.

19. The biofuel cell of claim 1, wherein the bacterium produces formaldehyde-activating enzyme that has an amino acid sequence identified as SEQ ID NO:13, wherein the formaldehyde-activating enzyme converts formaldehyde into methylene tetrahydromethanopterin.

20. The biofuel cell of claim 19, wherein the amino acid sequence identified as SEQ ID NO:13 is encoded by a nucleic acid identified as SEQ ID NO:14.

21. The biofuel cell of claim 1, wherein the bacterium produces methylenetetrahydromethanopterin dehydrogenase (NAD+/NADP) that has an amino acid sequence identified as SEQ ID NO:15, wherein the methylenetetrahydromethanopterin dehydrogenase (NAD+/NADP) converts methylene tetrahydromethanopterin into methenyl tetrahydromethanopterin.

22. The biofuel cell of claim 21, wherein the amino acid sequence identified as SEQ ID NO:15 is encoded by a nucleic acid identified as SEQ ID NO:16.

23. The biofuel cell of claim 1, wherein the bacterium produces N5N10-methenyltetrahydromethanopterin cyclohydrolase that has an amino acid sequence identified as SEQ ID NO:17, wherein the N5N10-methenyltetrahydromethanopterin cyclohydrolase converts methenyl tetrahydromethanopterin into 5-formyl tetrahydromethanopterin.

24. The biofuel cell of claim 23, wherein the amino acid sequence identified as SEQ ID NO:17 is encoded by a nucleic acid identified as SEQ ID NO:18.

25. The biofuel cell of claim 1, wherein the bacterium produces formylmethanofuran-tetrahydromethanopterin formyltransferase that has an amino acid sequence identified as SEQ ID NO:19, wherein the formylmethanofuran-tetrahydromethanopterin formyltransferase converts 5-formyl tetrahydromethanopterin into formyl methanofuran.

26. The biofuel cell of claim 25, wherein the formylmethanofuran-tetrahydromethanopterin formyltransferase is encoded by a nucleic acid identified as SEQ ID NO:20.

27. The biofuel cell of claim 1, wherein the bacterium produces tungsten-containing formylmethanofuran dehydrogenase that converts formyl methanofuran into formate.

28. The biofuel cell of claim 27, wherein the tungsten-containing formylmethanofuran dehydrogenase comprises a subunit (c) peptide, a subunit (a) peptide, and a subunit (b) peptide.

29. The biofuel cell of claim 28, wherein the subunit (c) peptide has an amino acid sequence identified as SEQ ID NO:21.

30. The biofuel cell of claim 28, wherein the subunit (a) peptide has an amino acid sequence identified as SEQ ID NO:22.

31. The biofuel cell of claim 28, wherein the subunit (b) peptide has an amino acid sequence identified as SEQ ID NO:23.

32. The biofuel cell of claim 29, wherein the amino acid sequence identified as SEQ ID NO:21 is encoded by a nucleic acid identified as SEQ ID NO:24.

33. The biofuel cell of claim 30, wherein the amino acid sequence identified as SEQ ID NO:22 is encoded by a nucleic acid identified as SEQ ID NO:25.

34. The biofuel cell of claim 31, wherein the amino acid sequence identified as SEQ ID NO:23 is encoded by a nucleic acid identified as SEQ ID NO:26.

35. The biofuel cell of claim 1, wherein the bacterium produces methylenetetrahydrofolate dehydrogenase (NADP+) that has an amino acid sequence identified as SEQ ID NO:27, wherein the methylenetetrahydrofolate dehydrogenase (NADP+) converts N5N10-methylene tetrahydrofolate into N5N10-methenyl tetrahydrofolate.

36. The biofuel cell of claim 35, wherein the amino acid sequence identified as SEQ ID NO:27 is encoded by a nucleic acid identified as SEQ ID NO:28.

37. The biofuel cell of claim 1, wherein the bacterium produces methylenetetrahydrofolate cyclohydrolase that has an amino acid sequence identified as SEQ ID NO:29, wherein the methylenetetrahydrofolate cyclohydrolase converts N5N10-methenyl tetrahydrofolate into N10-formyl tetrahydrofolate.

38. The biofuel cell of claim 37, wherein the amino acid sequence identified as SEQ ID NO:29 is encoded by a nucleic acid identified as SEQ ID NO:30.

39. The biofuel cell of claim 1, wherein the bacterium produces formate-tetrahydrofolate ligase that has an amino acid sequence identified as SEQ ID NO:31, wherein the formate-tetrahydrofolate ligase converts N10-formyl tetrahydrofolate into formate.

40. The biofuel cell of claim 39, wherein the amino acid sequence identified as SEQ ID NO:31 is encoded by a nucleic acid identified as SEQ ID NO:32.

41. The biofuel cell of claim 1, wherein the bacterium produces formate dehydrogenase, wherein the formate dehydrogenase converts formate into carbon dioxide.

42. The biofuel cell of claim 41, wherein the formate dehydrogenase comprises a first subunit peptide, a second subunit peptide, a third subunit peptide, a fourth subunit peptide, and a fifth subunit peptide.

43. The biofuel cell of claim 42, wherein the first subunit peptide has an amino acid sequence identified as SEQ ID NO:33.

44. The biofuel cell of claim 42, wherein the second subunit peptide has an amino acid sequence identified as SEQ ID NO:34.

45. The biofuel cell of claim 42, wherein the third subunit peptide has an amino acid sequence identified as SEQ ID NO:35.

46. The biofuel cell claim 42, wherein the fourth subunit peptide has an amino acid sequence identified as SEQ ID NO:36.

47. The biofuel cell of claim 42, wherein the fifth subunit peptide has an amino acid sequence identified as SEQ ID NO:37.

48. The biofuel cell of claim 43, wherein the amino acid sequence identified as SEQ ID NO:33 is encoded by a nucleic acid identified as SEQ ID NO:38.

49. The biofuel cell of claim 44, wherein the amino acid sequence identified as SEQ ID NO:34 is encoded by a nucleic acid identified as SEQ ID NO:39.

50. The biofuel cell of claim 45, wherein the amino acid sequence identified as SEQ ID NO:35 is encoded by a nucleic acid identified as SEQ ID NO:40.

51. The biofuel cell of claim 46, wherein the amino acid sequence identified as SEQ ID NO:36 is encoded by a nucleic acid identified as SEQ ID NO:41.

52. The biofuel cell of claim 47, wherein the amino acid sequence identified as SEQ ID NO:37 is encoded by a nucleic acid identified as SEQ ID NO:42.

53. The biofuel cell of claim 1, wherein the bacterium produces an aldehyde dehydrogenase, wherein the aldehyde dehydrogenase oxidizes acetaldeyde into acetic acid.

54. The biofuel cell of claim 53, wherein the aldehyde dehydrogenase comprises a first subunit peptide, a second subunit peptide, and a third subunit peptide.

55. The biofuel cell of claim 54, wherein the first subunit peptide has an amino acid sequence identified as SEQ ID NO:43.

56. The biofuel cell of claim 54, wherein the second subunit peptide has an amino acid sequence identified as SEQ ID NO:44.

57. The biofuel cell claim 54, wherein the third subunit peptide has an amino acid sequence identified as SEQ ID NO:45.

58. The biofuel cell of claim 55, wherein the amino acid sequence identified as SEQ ID NO:43 is encoded by a nucleic acid identified as SEQ ID NO:46.

59. The biofuel cell of claim 56, wherein the amino acid sequence identified as SEQ ID NO:44 is encoded by a nucleic acid identified as SEQ ID NO:47.

60. The biofuel cell of claim 1, wherein the bacterium produces an alcohol dehydrogenase, wherein the alcohol dehydrogenase oxidizes methanol into formaldehyde or ethanol into acetaldehyde.

61. The biofuel cell of claim 60, wherein the alcohol dehydrogenase has an amino acid sequence identified as SEQ ID NO:48.

62. The biofuel cell of claim 61, wherein the amino acid sequence identified as SEQ ID NO:48 is encoded by a nucleic acid identified as SEQ ID NO:49.

63. A method of degrading an organic material, comprising contacting the organic material with the biofuel cell of claim 1, whereby contacting the organic material with the biofuel cell degrades the organic material.

64. The method of claim 63, wherein the bacterium comprises a genome identified as SEQ ID NO:1 and is deposited under GenBank Accession No. CP000394.

65. The method of claim 63, wherein the organic material comprises methanol.

66. The method of claim 63, wherein the organic material comprises formaldehyde.

67. The method of claim 63, wherein the organic material comprises ethanol.

68. The method of claim 63, wherein the contact occurs at a pH of from about 5.0 to about 7.5.

69. The method of claim 68, wherein the pH is from about 5.5 to about 6.5.

70. A method for growing an isolated Gram-negative bacterium, designated Granulibacter bethesdensis and deposited under ATCC Accession No. BAA-1260, wherein the bacterium is an aerobic, facultative methylotroph that produces colonies that are yellow pigmented, wherein the bacterium can use methanol as a sole carbon source and can oxidize glucose and ethanol into acid, and wherein the bacterium comprises a 16SRNA nucleic acid identified as SEQ ID NO:2, comprising culturing the bacterium at a temperature and in a medium effective to promote growth of the bacterium.

71. The method of claim 70, wherein the temperature is from about 26° C. to about 37° C.

72. The method of claim 71, wherein the temperature is from about 35° C. to about 37° C.

73. The method of claim 70, wherein culturing is at a pH from about 5.0 to about 7.5.

74. The method of claim 73, wherein the pH is from about 5.5 to about 6.5.

75. A method of converting chemical energy in an organic material into electrical energy comprising contacting the organic material with the biofuel cell of claim 1, whereby contacting the organic material with the biofuel cell converts the chemical energy in the organic material into electrical energy.

76. The method of claim 75, wherein the bacterium is designated Granulibacter bethesdensis and deposited under ATCC Accession No. BAA-1260.

* * * * *